United States Patent 9,328,346 (POLYCOMB-ASSOCIATED NON-CODING RNAS) - sequence listing, part 55

SEQ ID NO: 10562 - RNA, 2501 nt, Mus musculus
gagcuuugggaggagcuguuuuggggauaugagcuccuuaauaacucagccuggcaaguuggagguaugaggggaccacaagggucacaggggaauagugucucuccuugcuuuucagagggcaagcaugcccccagaggacccauuggccucucuguugguggggcauccaauagggcgagcaaggaccaaacuauuugcccagaggaggaagaggugaggaguugaccugucaguuugucccguauuguuugggaccaagagcgagccccaaaccaguuugucuuccccauccuuaaaaacaaaccccuaaaaguaagccuccucuacucucagccagcagcaguuuccacuugggguuuuauuuuagcaagggugcuuuuaggagugggaggugguaagaaacucuccaccaaggguagaguucuccgccccugcgcaguccucccccucccucccccggggucccuuugggugucuucuccuccauucuagagggaggcccugucuuuagcaagugaugccuagacucucggagaggugaacugcccggccuaagugaucggaagccccgcggagaucagcgugcaaccgcaggaggagaaacggccguccugucgaggaugcccuagaagggcgggggacccccggagggaaggcucccggggaggggccggcgcaccggggagggggcuccgucaccgcauccugggcuucccccgccccucccggcgccugcugccgacccgacgcggcuacugcgugagaucugcuaggaacaauccuccgccaagcuguugcaucgcaaauaaaauccuaaugagcccccucccccuuccccuuggccggcagggacggucugcgcguggcgcaggcggcucugccgagugcucuucggccccgugcccgcgcgggcuccgggccgcgcuggccaucggcccggccuccuacaguucuaucgcaggucccucucccuuuuuccagcccgagccuggggaagaaugaaggacuagagagacuuggucccugagucucagucccugcgccacaaggaggagugggggguagccucagugucccccuccuggacacccagcuuuuugcuuugccagccccuuccuuccucuucccuccacccacucuagcccugcggccccaggcgcucugucccuuuacauuguccgcuuuauggccucuccccuccccucccccgggccuggccugcagccugggggggauuuccucacuuuuuuuuuuuuuuauaacuuacuuugauccggccucucuuuguccucgcuuccuucgcaaauuuuauuguccccguagccagcucuuugauuagacaggacagccucccugcccgccgaaguuuccaaacuguacucgggcgugcccuguuugagcagcucccccggcgcgcccagcagcggcuccgccuucacggccgccuggcccugccccggggcggccucggcgcgcggcgccggcucuagccaggugcggagguaccugcuuucggccgccggcgcgcccuggggcugcagguaggggugguagacagacggcaggcuccccgaggcgugcgggcucagcggcgcccaggaggcgccgaacaccggcgcuuugggcuggaagcugcacgaggggaaguccaggugcucggcguggcccggcugccgcggguucgcguacuggcccgaaggaaacuuggcuggaggcgcguccucgcucucgugacuuaugaucgagucgacauaauagcugcuaagcgucccagaaauggacauucucagacauuauccgcgcgcucgcagggggaagggaagcgcucgcgccgcggcgcccaagcagggaaaagguggcacacggacccggugcagagggcuuucggacgcgaccccccccagacccccacccucccacccccacccccugcucaacuucucagccaacaaaguacaguggagcagcccggcucggagcuccuugcaaaaugauuggucaaaguuuugcggacugccugauaaagcgucagcuccgacauaaaucaaucgggcgagggggcugcgcucgcgcugucauccguccucaccgcauuccauauccaggauggauuguuuuaugcugaugcaaugugcuaucacgucagggcuccggcggccacguaaccucagccugagcugccgggccgcccgggccccucccgcuuuuacaggaagggggguucucaacauggggcgaugggggcggaggagaggcggaggcaagcagcgggcugccucaggagggacgcaggcugaggagcccucuccccaggcagauuggggggggggggaggaccagcauacagggagggagagcgccccagccucagagcugcgggagaggcccgacaggguaauuaaagaggagguagucuugucgcccccccccaacaccuccaccuccaccccgcgggcccucauuuccuguccucuguccccuugacagagauguuuauu

SEQ ID NO: 10563 - RNA, 2501 nt, Mus musculus
cagaaaguuucuucuuccucucucaggcccucucagacucccuuuccacagaaaaucucgcguguuugcuuaaugagggaaaguuaugugcgugaccuaggugaggacagaucucggggugguuuggggucucauaagagccaguggggucaggugugucugcaagggagaaaaucucggggaaagucaccguuugugccgaaagggaaaaaaaaauccacagcaacccauaaucggucucauuucagcuaagucacccccaccgugcuucagucgggcggcgggggcgaucgaagcugcaguuuuauagcuguagaggaaagaacucguaaaaugcuaacagcuuuuaugcgcugcagcauaaacaacaacagacuccggcuuuauugcguuuuauaguuuguuaaagaguuuacagccguuuuuuugggggcugguuacccagccaauucccuccacacgauaguuaaaccuuuaucaauaauaaggaaauugaucauuaaagcuuuaaauaugacuaccucguuuguuugaaaauauguuuaggagaggaagcuguaugauuugauaacuuguauuaaaauaccaauuacauuuauaggaccuuuuaaaacucggugcaauuaaaccguguucuuuuacauuuuuccgaagcgacccugacauuuagaaagacuccaauugccucguuaaaaucgcgaaauuaacagcgugccuacgccaggcucagcguuguggauguguguguaugguguuuuuccgugacucccccacaucagucuuuggggguggucugcgaagguauuugauuuguugugaggcaagagauaucucauuaauguagguaguuaaacagauuuaauccguauucguucucucucucuccccccucccucucccccccucucccccucuuucucccuggguguuuuuuucucuuccccuccuuuuuuucugcccucuccucacucccuggcgcucucucgcucuagcucucucucgcacucgcucucucucgcucucacccucgcucugcguucuguccgggaggaguacccagaagccaauaggaugcggggucucuaauggaugcaaaugauggugaaaagacggggcaaaauaugaaacaacucauuuggagggaaguaaaucaccgaaaacuguuuaugaacuggcaucccuucuucgaaauguaaagcgaggaccucuuuaaguggcgguauauuuuuguuuggggggugggggguggggggagggcgagcgagccgcggcugccaugcaggcuuagacuuuugcaggcuucgcucuucuauuccuggaaaucacaaaaaguguggcggcuuugagaucuucuucgucuuuucuuucuuuuccuuccuuccuucuuuuuuuuccccuccucccuuuuccucuccuuuccuggcgagggugacuaggagccggcgaauccgcguuuuuuuuucucucucucucccucccuuuucccccuccccacccccuccccaacagcccccaacuacagccugcgccgccgccgccgccgccucaaaauucaauaaaaugagcucuuauuucgucaacucacuguucuccaaauacaaaaccggggagucccugcgccccaauuauuaugacugcggcuucgcccaggaccugggcggccgacccaccgugguguacggucccagcagcggcggcagcuuccagcacccuucgcaaauccaggaguucuaccacgggccaucgucgcuguccacagcucccuaccagcagaacccgugcgccguggcgugccacggcgaccccggcaacuucuacggcuacgacccucugcagcgccagagccuguucggugcgcaggauccagaccuggugcaguacgcagacugcaagcucgcggcagccagcggccugggcgaggaggccgaggggucugagcagagcccgucgcccacacagcucuuucccuggaugcgcccucaaggugagcucccguccgaccuggaccugacagggugggaaggggccaggggggcccccaugccggugggggggggagggcuggugggcaguccgggaguaucuucugcuccuagaggacuugugggcuccguuccaaacaccuaccuccucucccuucugucccacuuucuuuucuucuuuuuccccuuuucuuuuugcuuccuuugaaggaggggggggugucucuaagcgaauuuccugaauccauaaaccccucacccuccuuaacuuuucuucuucuccuccuuuccccuuuuacuguuuuaugggggcuguggagaaagacuggugggugugggggcgcucaacguuugcacuucucaauugcuuuauaguuuaauuacccugaagaaacuuuucuucuggggcagaggcucugggggcuuuucaagguggguucgagguccccacucuggcuuuuuagucuuacuccccccuccacauccacccucuuaaacuuuauggcacuuuuaauguau

SEQ ID NO: 10564 - RNA, 2501 nt, Mus musculus
auacauuaaaagugccauaaaguuuaagaggguggauguggaggggggaguaagacuaaaaagccagaguggggaccucgaacccaccuugaaaagcccccagagccucugccccagaagaaaaguuucuucaggguaauuaaacuauaaagcaauugagaagugcaaacguugagcgcccccacacccaccagucuuucuccacagcccccauaaaacaguaaaaggggaaaggaggagaagaagaaaaguuaaggagggugagggguuuauggauucaggaaauucgcuuagagacaccccccccuccuucaaaggaagcaaaaagaaaaggggaaaaagaagaaaagaaagugggacagaagggagaggagguagguguuuggaacggagcccacaaguccucuaggagcagaagauacucccggacugcccaccagcccucccccccccaccggcaugggggccccccuggccccuucccacccugucagguccaggucggacgggagcucaccuugagggcgcauccagggaaagagcugugugggcgacgggcucugcucagaccccucggccuccucgcccaggccgcuggcugccgcgagcuugcagucugcguacugcaccaggucuggauccugcgcaccgaacaggcucuggcgcugcagagggucguagccguagaaguugccggggucgccguggcacgccacggcgcacggguucugcugguagggagcuguggacagcgacgauggcccgugguagaacuccuggauuugcgaagggugcuggaagcugccgccgcugcugggaccguacaccacggugggucggccgcccagguccugggcgaagccgcagucauaauaauuggggcgcagggacuccccgguuuuguauuuggagaacagugaguugacgaaauaagagcucauuuuauugaauuuugaggcggcggcggcggcggcgcaggcuguaguugggggcuguuggggaggggguggggagggggaaaagggagggagagagagagaaaaaaaaacgcggauucgccggcuccuagucacccucgccaggaaaggagaggaaaagggaggaggggaaaaaaaagaaggaaggaaggaaaagaaagaaaagacgaagaagaucucaaagccgccacacuuuuugugauuuccaggaauagaagagcgaagccugcaaaagucuaagccugcauggcagccgcggcucgcucgcccuccccccaccccccaccccccaaacaaaaauauaccgccacuuaaagagguccucgcuuuacauuucgaagaagggaugccaguucauaaacaguuuucggugauuuacuucccuccaaaugaguuguuucauauuuugccccgucuuuucaccaucauuugcauccauuagagaccccgcauccuauuggcuucuggguacuccucccggacagaacgcagagcgagggugagagcgagagagagcgagugcgagagagagcuagagcgagagagcgccagggagugaggagagggcagaaaaaaaggaggggaagagaaaaaaacacccagggagaaagagggggagagggggggagagggaggggggagagagagagaacgaauacggauuaaaucuguuuaacuaccuacauuaaugagauaucucuugccucacaacaaaucaaauaccuucgcagaccacccccaaagacugaugugggggagucacggaaaaacaccauacacacacauccacaacgcugagccuggcguaggcacgcuguuaauuucgcgauuuuaacgaggcaauuggagucuuucuaaaugucagggucgcuucggaaaaauguaaaagaacacgguuuaauugcaccgaguuuuaaaagguccuauaaauguaauugguauuuuaauacaaguuaucaaaucauacagcuuccucuccuaaacauauuuucaaacaaacgagguagucauauuuaaagcuuuaaugaucaauuuccuuauuauugauaaagguuuaacuaucguguggagggaauuggcuggguaaccagcccccaaaaaaacggcuguaaacucuuuaacaaacuauaaaacgcaauaaagccggagucuguuguuguuuaugcugcagcgcauaaaagcuguuagcauuuuacgaguucuuuccucuacagcuauaaaacugcagcuucgaucgcccccgccgcccgacugaagcacggugggggugacuuagcugaaaugagaccgauuauggguugcuguggauuuuuuuuucccuuucggcacaaacggugacuuuccccgagauuuucucccuugcagacacaccugaccccacuggcucuuaugagaccccaaaccaccccgagaucuguccucaccuaggucacgcacauaacuuucccucauuaagcaaacacgcgagauuuucuguggaaagggagucugagagggccugagagaggaagaagaaacuuucug

SEQ ID NO: 10565 - RNA, 2501 nt, Mus musculus
acaucuaguuacuacaacuggggcacuaagacaaccgggaggccaggcucgccuccucuugggagaagagcagcagcucggaugaauuaacccaaauuaauaaauauucggccagcacccacccaccaaguugcgaacauucaaucccugcgucucucucgcucuguaaccggcugggggaaaugggugggggaugacaacacgguucccucagagguuauuuauuuucucuuccacucaauuccuucuuccccaaaucucgccugcaagcugccuccagcccgcgggggucgacagcggcccuuaagcccccagccccaauccgcagagcucggccuucccauucauuauugaucauauuuuauaaauccaacgccacacaauuuuuuccacauuacugggagccuccgggaggccgucauaccauuggccgaggggauaucacgugggccggggucacguggucagaagaggaaaaaggggguccuuuugguguaaaucuggacucuaauucuguaauauaucaaggaaucucguaaaaccgacacuaaaacguccccgacuacaaaucauccggccaaauuaugaguucauuguauuaugcgaaugcuuuauuuucuaaauauccagccgcaaguucgguuuucgcuccaggagccuuccccgaacaaacuucuugcgccuuugcuuccaacccccagcgcccgggcuauggagcagguccgggcgcuccuuucuccgccucggugcagggucuguacuccggcgggggggccauggcgggccagagcgcggcuggcgucuaugcggccggcuacgggcucgaaccgaguuccuucaacaugcacugcgcgcccuuugagcagaaccucuccgggguguguccgggcgaccccgccaaggcggcuggcgccaaggagcagagggacucggacuuggcggccgagaguaacuuccggaucuaccccuggaugcgaagcucagguaaagccgcgcucugagcggucccgagccgcaguguccgggccacgguccccagaagggcucccuuccggccagggcacccuucucuguguccagguuauucccggcugcagaucggccauugccacgccguuuaagucugggcugggaccacgcgcgccacccccacucccaguuuugcucagugcucucaggcccuagcggaucucuuuuugccgacgccacagagcucaaagcccccagcccgcccccaacccuuccucccggccuuuuagcuuuaaauauuuaucagcagcgccggcacgggcuggagacgaggccguuugucuugccuagaaaggcugggguuugcagagaauagccauuagggucuuucucuucucucuccccccuucccugccugagagcucaguucuggguguguccccccagcccuagcuugggcaagauauggaggagggggccauggcgcuaagcgauucuccccucccccuuccuuucuagccaaccccgcucccccauuauucccaucaggacaauuagaggugggcucuagaggccuggugggaugggggagaggaaacagaagagaugaggacccagacagggacacagagucaaagaguggugaaggaguuagucugagacccagagcgaugagucuacugacccccaccuccugauggacuuagaaggcccgucagcuccccaggagagcauagguuguuuguuauuuuuuuuuuccaggugucuuuccaagggcucugugggccccugaggaacagccaaguuuggugguaucacuccagaaagaugacucuccucuuggggagggcuaggacucuucagaaccaaaucaagauuuagggagugcacgaugcuuuaagaaccauagguuuucuucccucaggucuccuucacagcuuccucgcacaccuuuuacauuuccccgaggcaggugggcuugggagccaacuccaaggcucagaagacccaaccgggccagagacuccuauacucaugggcuugggggccacgaggaaaccauuucuugacuauuguucuucacgguuccuguuaccuacccuguaauugaacugaccuuccaguugguuuaucaaagucccuccccccccccaccucguaaauauuucagcuuggcuuauagcugacuugaaauuaagguccuuagccucucuccccucuccugucuccuucccaagagggcggauaccagcaucuccccagucuccuugggguucugagccuaugcugggaguucucagauacccuuuugccccaccauaggaaucuucaccuugcucucucucguagacucuggucauucuuuucuuccuugcaguccuggaggcccaaauauugcuucagacaaguagguuucaugugcaggaaggcaggcaguagucagaccuugcuugauacuuacugggaaggaaucaucagagccaaguucugucagucuacuaaugccaagguccaaggaaauaauguccuug

SEQ ID NO: 10566 - RNA, 2501 nt, Mus musculus
caaggacauuauuuccuuggaccuuggcauuaguagacugacagaacuuggcucugaugauuccuucccaguaaguaucaagcaaggucugacuacugccugccuuccugcacaugaaaccuacuugucugaagcaauauuugggccuccaggacugcaaggaagaaaagaaugaccagagucuacgagagagagcaaggugaagauuccuaugguggggcaaaaggguaucugagaacucccagcauaggcucagaaccccaaggagacuggggagaugcugguauccgcccucuugggaaggagacaggagaggggagagaggcuaaggaccuuaauuucaagucagcuauaagccaagcugaaauauuuacgagguggggggggggagggacuuugauaaaccaacuggaaggucaguucaauuacaggguagguaacaggaaccgugaagaacaauagucaagaaaugguuuccucguggcccccaagcccaugaguauaggagucucuggcccgguugggucuucugagccuuggaguuggcucccaagcccaccugccucggggaaauguaaaaggugugcgaggaagcugugaaggagaccugagggaagaaaaccuaugguucuuaaagcaucgugcacucccuaaaucuugauuugguucugaagaguccuagcccuccccaagaggagagucaucuuucuggagugauaccaccaaacuuggcuguuccucaggggcccacagagcccuuggaaagacaccuggaaaaaaaaaauaacaaacaaccuaugcucuccuggggagcugacgggccuucuaaguccaucaggaggugggggucaguagacucaucgcucugggucucagacuaacuccuucaccacucuuugacucugugucccugucuggguccucaucucuucuguuuccucucccccaucccaccaggccucuagagcccaccucuaauuguccugaugggaauaaugggggagcgggguuggcuagaaaggaagggggaggggagaaucgcuuagcgccauggcccccuccuccauaucuugcccaagcuagggcuggggggacacacccagaacugagcucucaggcagggaaggggggagagagaagagaaagacccuaauggcuauucucugcaaaccccagccuuucuaggcaagacaaacggccucgucuccagcccgugccggcgcugcugauaaauauuuaaagcuaaaaggccgggaggaaggguugggggcgggcugggggcuuugagcucuguggcgucggcaaaaagagauccgcuagggccugagagcacugagcaaaacugggaguggggguggcgcgcguggucccagcccagacuuaaacggcguggcaauggccgaucugcagccgggaauaaccuggacacagagaagggugcccuggccggaagggagcccuucuggggaccguggcccggacacugcggcucgggaccgcucagagcgcggcuuuaccugagcuucgcauccagggguagauccggaaguuacucucggccgccaaguccgagucccucugcuccuuggcgccagccgccuuggcggggucgcccggacacaccccggagagguucugcucaaagggcgcgcagugcauguugaaggaacucgguucgagcccguagccggccgcauagacgccagccgcgcucuggcccgccauggcccccccgccggaguacagacccugcaccgaggcggagaaaggagcgcccggaccugcuccauagcccgggcgcuggggguuggaagcaaaggcgcaagaaguuuguucggggaaggcuccuggagcgaaaaccgaacuugcggcuggauauuuagaaaauaaagcauucgcauaauacaaugaacucauaauuuggccggaugauuuguagucggggacguuuuagugucgguuuuacgagauuccuugauauauuacagaauuagaguccagauuuacaccaaaaggacccccuuuuuccucuucugaccacgugaccccggcccacgugauauccccucggccaaugguaugacggccucccggaggcucccaguaauguggaaaaaauuguguggcguuggauuuauaaaauaugaucaauaaugaaugggaaggccgagcucugcggauuggggcugggggcuuaagggccgcugucgacccccgcgggcuggaggcagcuugcaggcgagauuuggggaagaaggaauugaguggaagagaaaauaaauaaccucugagggaaccguguugucaucccccacccauuucccccagccgguuacagagcgagagagacgcagggauugaauguucgcaacuuggugggugggugcuggccgaauauuuauuaauuuggguuaauucauccgagcugcugcucuucucccaagaggaggcgagccuggccucccgguugucuuagugccccaguuguaguaacuagaugu

SEQ ID NO: 10567 - RNA, 2501 nt, Mus musculus
uucugaaaacacaauuaacuuuucccuauuccugcguggggugggguggggggggagguuguauuuauuucaucacuggggaaugggaugaucuucaucuaacugcuuccuccucccucaaaagcacagacgucucuuucgcagaucauacguagguggaucagggcgcguuguggagagagagagagagagagagagagagagagagagagagagagagagagagagagagaggaaggagggggaaaagguugauagguuugugcgcgggucccucgugcaggcugcgcuccuccugggugcuauuugacaauuccugccucugccauuggucaguguuggaucagaugguuguauuuccuucuggcccucacuggcaccucgccauccccccucagcuaaaacccaaucucggcuauacuacuaauaggcgcggcgcucggacuauaaaacacaacaaaucauaaacccggcggagcagcagcggccucgcgcgccuccccucccgaugaguuccuauuucgugaacuccaccuuccccgucacucuggccagcgggcaggaguccuuccugggccagcugccgcucuacucgucuggcuaugcggacccgcugcggcacuaccccgcgccuuaugggccgggacccggccaggacaagggcuuugcggcguccuccuauuacccaccagccggcggcggcuacggccgggcggcgcccugugauuaugggccggcgccugccuucuaccgggagaaggacgcggccugcgcucucuccggcgccgacgagccgcccccguuccaccccgagccgcgcaaguccgacugcgcacaggacaagagcguguucggagagaccgaggagcagaagugcuccacgcccgucuacccguggaugcagcgcaugaauucgugcaacagugagugagacuucccgcugucccgugucugugugugugugugugugggggggggucggcaagcagaaagacugaaagugucagcaucccccaaccccaauucucccauugggaacuaggugggcaucucagcagauagagcaagauugcccccccccccgaccuccagaucaguccucuugcccgcagaaguugcaaaguuugcaaagucccagcugcacaguaaggcagggggaauaagugggcucucccuacuuaagucaggcuaggauuguugauccggaagagguuaggggacucagucucugguccuguauuccuuuauguucucccuagcucuuguccggaucugagggguggggggugccccgcacccaaagaccacuccauuaaaaacaagagugcgucaugaaaggggagggguggcaugacgccggcaagggcgaguuuacuuggguccuggauuguguuucccuggggcugggggaggagaacuggggaagggggaccagggagcugugagacacuaccauagggucguauagucugaggaaggaagaagagaggacaggcggagggagugagaagaacaaacuggcuccugggucucagguuggauuauuugugggcuucaagucccaauugauguccauuagcaggacacgaaagugaggggcuguuaaugcggacuaugaaucgauccacgucauuagggauuaagggccagaaucuaucaucgaguaggguagggagggcuggauggauggaaaggaagggaaagaaaagauacagcucguaggaggcacaccuggccagccccucccccaagcucaggugagaguccaagugccccuccucuccccccacugaaagucuaggcagaaagaaagcacaggccucggaguccaggagggaaucuggagggggcgcuggaggaguaggaaacggggaccagggaaugggagggggaaagacuacucccgacaggcuagcuuuacguuugagggccgagugggggaggggcuaugggcuuggugugaugaccccaggccucaguuucuccucucugcguaacagguuccucuuuugggcccagcggucggcgaggccgccagaccuacacacgcuaccagacccuggagcuggagaaggaauuucacuauaaucgcuaccugacccgccggcggcgcauagagaucgcgcacgcccugugccugaccgagcggcagaucaagauuugguuucagaaccggcgcaugaaguggaaaaaggagagcaaacugcucagugcgucucagcucagugcggaggaggaggaggaaaagccagccgagugaaggugcugcaaagggaggggggacgcgaagggagaggucugugggggaaccuagggcacccgaaagccccagaaggcucugcggucgggggagucuggggacuugcuguccagagcacgacgggcagggcccagugcuugccuggaugcccccuucugcagagcucuuccugggcgcuuggcggaugcccacccagcacccccagcgccuccucccucccccgaagaacccaccuuggccu

SEQ ID NO: 10568 - RNA, 2501 nt, Mus musculus
aggccaagguggguucuucgggggagggaggaggcgcugggggugcugggugggcauccgccaagcgcccaggaagagcucugcagaagggggcauccaggcaagcacugggcccugcccgucgugcucuggacagcaaguccccagacucccccgaccgcagagccuucuggggcuuucgggugcccuagguucccccacagaccucucccuucgcguccccccucccuuugcagcaccuucacucggcuggcuuuuccuccuccuccuccgcacugagcugagacgcacugagcaguuugcucuccuuuuuccacuucaugcgccgguucugaaaccaaaucuugaucugccgcucggucaggcacagggcgugcgcgaucucuaugcgccgccggcgggucagguagcgauuauagugaaauuccuucuccagcuccagggucugguagcguguguaggucuggcggccucgccgaccgcugggcccaaaagaggaaccuguuacgcagagaggagaaacugaggccuggggucaucacaccaagcccauagccccucccccacucggcccucaaacguaaagcuagccugucgggaguagucuuucccccucccauucccugguccccguuuccuacuccuccagcgcccccuccagauucccuccuggacuccgaggccugugcuuucuuucugccuagacuuucaguggggggagaggaggggcacuuggacucucaccugagcuugggggaggggcuggccaggugugccuccuacgagcuguaucuuuucuuucccuuccuuuccauccauccagcccucccuacccuacucgaugauagauucuggcccuuaaucccuaaugacguggaucgauucauaguccgcauuaacagccccucacuuucguguccugcuaauggacaucaauugggacuugaagcccacaaauaauccaaccugagacccaggagccaguuuguucuucucacucccuccgccuguccucucuucuuccuuccucagacuauacgacccuaugguagugucucacagcucccuggucccccuuccccaguucuccucccccagccccagggaaacacaauccaggacccaaguaaacucgcccuugccggcgucaugccaccccuccccuuucaugacgcacucuuguuuuuaauggaguggucuuugggugcggggcaccccccaccccucagauccggacaagagcuagggagaacauaaaggaauacaggaccagagacugaguccccuaaccucuuccggaucaacaauccuagccugacuuaaguagggagagcccacuuauucccccugccuuacugugcagcugggacuuugcaaacuuugcaacuucugcgggcaagaggacugaucuggaggucgggggggggggcaaucuugcucuaucugcugagaugcccaccuaguucccaaugggagaauugggguugggggaugcugacacuuucagucuuucugcuugccgacccccccccacacacacacacacacagacacgggacagcgggaagucucacucacuguugcacgaauucaugcgcugcauccacggguagacgggcguggagcacuucugcuccucggucucuccgaacacgcucuuguccugugcgcagucggacuugcgcggcucgggguggaacgggggcggcucgucggcgccggagagagcgcaggccgcguccuucucccgguagaaggcaggcgccggcccauaaucacagggcgccgcccggccguagccgccgccggcugguggguaauaggaggacgccgcaaagcccuuguccuggccgggucccggcccauaaggcgcgggguagugccgcagcggguccgcauagccagacgaguagagcggcagcuggcccaggaaggacuccugcccgcuggccagagugacggggaagguggaguucacgaaauaggaacucaucgggaggggaggcgcgcgaggccgcugcugcuccgccggguuuaugauuuguuguguuuuauaguccgagcgccgcgccuauuaguaguauagccgagauuggguuuuagcugaggggggauggcgaggugccagugagggccagaaggaaauacaaccaucugauccaacacugaccaauggcagaggcaggaauugucaaauagcacccaggaggagcgcagccugcacgagggacccgcgcacaaaccuaucaaccuuuucccccuccuuccucucucucucucucucucucucucucucucucucucucucucucucucucucucucuccacaacgcgcccugauccaccuacguaugaucugcgaaagagacgucugugcuuuugagggaggaggaagcaguuagaugaagaucaucccauuccccagugaugaaauaaauacaaccuccccccccaccccaccccacgcaggaauagggaaaaguuaauuguguuuucagaa

SEQ ID NO: 10569 - RNA, 2501 nt, Mus musculus
auauuacccagaguuaaaauaauaauggugaugauaaugucagagaggccacaaauagaggggauagccgcacccuaacgaaguaggcaaaagacucaaauccaucuuccuaaagguucaagccugugagugagcugcgggccggguuucuuucuuggcuuggcgguugcacagagccagcaaagagguugccgaagccgccauggcggccugcggcccgcgcucccgucaaucgccgggagguggcgcgcucugcucagaggccaacgucaaccuucucccuguuuuucccccuucucacuuucucccccccucucggaggcucgcauugaaucggcccuaacgauucuccgaucgucauuauuuguaaccauagagcaugaauuaccucuugaggucaucagugagaauuuacgacuggucaacaaaagcacgugauucccuaacgcccccccaucccccuucuaaccccccccauauuuggccgcauacauagcaaaacgaaguacagugcaucgcuauaauucauuaauacaucauaaaucgugaagcacaggguuauaacgaccacgauccacaaaucaagcccuccaaaaucacccaaaugagcucguacuuuguaaacuccuucucggggcguuauccaaauggcccggacuaucaguugcuaaauuauggcaguggcagcucucugagcggcucuuacagggaucccgcugccaugcacaccggcucuuacggcuacaauuacaaugggauggaucucagcgucaaccgcuccucggccuccuccagccacuuuggggcggugggcgagagcucgcgcgccuuccccgcguccgcccaggaaccccgcuucaggcaggcgacguccagcugcucccuguccucgcccgagucccugcccugcacuaacggcgacagccacggcgccaagcccucugcuucguccccuuccgaccaggcgaccccagccagcuccagcgccaauuucaccgaaauagacgaggccagcgcguccucugagcccgaggaagcggcgagccagcuaagcagccccagcuuggcucgagcacagccagagcccauggccaccucuacggccgcgcccgaggggcagacuccacagauauuccccuggaugaggaagcuucacaucagccacgguaauucuccaucucuuuuuuguccucuccgcauuccugcccuguguugggggugggggcgagcaaagcuuggcuuugccucaaauauagaucccuuuuuucuuuucuuuuuuucuuuuucuuucuuucuuuuuuuuugccaucaagagggaaaagugucagaaaggguccccacagcuccauagauagagccaaacaguguuguuuucugggcguaggcauuuaaaaaaaaaaaaaaaaggccaguuuguugccacguucagcuuagguuuuguuuaccuagccagucaccggcuuuaggaugaaagaugggauuuguguauugugaggaaggguccugauuauuacagaaauuuugagacugcugcuagcaaagggggaaugggcuauaaacggagcuuucuagggcaaaagugcaguggcucucuucccucccgggcgagcugccgccugaacccagccuagggugaggcacugggaaggagccagagacaaagccgggagcauucacuaccaucagaagugggggcugcuggagaaggggggguaugaagaaauagaggcuggaugcaggcaucuggggugaggaggaugggagcugcggugagcugggugcuggggacgccuggguccugcuccccgcccccucccacucagugcccccuccuuuaaccggaauaacguugccucggggcucuccucuaacugcucuagauaugacugggccagacggaaaaagggcccggaccgccuauacucgcuaccagacccuggagcuggaaaaggaauuccacuucaaucgcuaccugacccggcggcgacguaucgagaucgcccacgcgcuuugccuguccgagcgucagaucaaaaucugguuccagaaccgucgcaugaaguggaagaaagacaacaaacugaaaaguaugagucuggcuacagccggcagcgccuuccaaccuugagcccauccggaggagcccugggcggcccgagagcccgcaccaaccccagcucgacccuuccaaucuucccugcacugccgcugcccgcuggggaccaguucccacgagccugucacaccccaguccuguguuacaauuuuucguuuggucuuaggucuucccauggcucccucucuccuggacugguuaucuuguuauuauuguuaauaauaauuauuauuauuauuucccccuccgugcuccccacuucucuuggcucgcccccccccaaguugccaguguuucugaauguccucgugucugugguugcgcuccuuuccccaggaaaaagaaaagaaaaagaaauucgcauguuuaaugugacuuccccucc

SEQ ID NO: 10570 - RNA, 2501 nt, Mus musculus
ggaggggaagucacauuaaacaugcgaauuucuuuuucuuuucuuuuuccuggggaaaggagcgcaaccacagacacgaggacauucagaaacacuggcaacuugggggggggcgagccaagagaaguggggagcacggagggggaaauaauaauaauaauuauuauuaacaauaauaacaagauaaccaguccaggagagagggagccaugggaagaccuaagaccaaacgaaaaauuguaacacaggacuggggugugacaggcucgugggaacugguccccagcgggcagcggcagugcagggaagauuggaagggucgagcugggguuggugcgggcucucgggccgcccagggcuccuccggaugggcucaagguuggaaggcgcugccggcuguagccagacucauacuuuucaguuuguugucuuucuuccacuucaugcgacgguucuggaaccagauuuugaucugacgcucggacaggcaaagcgcgugggcgaucucgauacgucgccgccgggucagguagcgauugaaguggaauuccuuuuccagcuccagggucugguagcgaguauaggcgguccgggcccuuuuuccgucuggcccagucauaucuagagcaguuagaggagagccccgaggcaacguuauuccgguuaaaggagggggcacugagugggagggggcggggagcaggacccaggcguccccagcacccagcucaccgcagcucccauccuccucaccccagaugccugcauccagccucuauuucuucauacccccccuucuccagcagcccccacuucugaugguagugaaugcucccggcuuugucucuggcuccuucccagugccucacccuaggcuggguucaggcggcagcucgcccgggagggaagagagccacugcacuuuugcccuagaaagcuccguuuauagcccauucccccuuugcuagcagcagucucaaaauuucuguaauaaucaggacccuuccucacaauacacaaaucccaucuuucauccuaaagccggugacuggcuagguaaacaaaaccuaagcugaacguggcaacaaacuggccuuuuuuuuuuuuuuuuaaaugccuacgcccagaaaacaacacuguuuggcucuaucuauggagcuguggggacccuuucugacacuuuucccucuugauggcaaaaaaaaagaaagaaagaaaaagaaaaaaagaaaagaaaaaagggaucuauauuugaggcaaagccaagcuuugcucgcccccacccccaacacagggcaggaaugcggagaggacaaaaaagagauggagaauuaccguggcugaugugaagcuuccucauccaggggaauaucuguggagucugccccucgggcgcggccguagagguggccaugggcucuggcugugcucgagccaagcuggggcugcuuagcuggcucgccgcuuccucgggcucagaggacgcgcuggccucgucuauuucggugaaauuggcgcuggagcuggcuggggucgccuggucggaaggggacgaagcagagggcuuggcgccguggcugucgccguuagugcagggcagggacucgggcgaggacagggagcagcuggacgucgccugccugaagcgggguuccugggcggacgcggggaaggcgcgcgagcucucgcccaccgccccaaaguggcuggaggaggccgaggagcgguugacgcugagauccaucccauuguaauuguagccguaagagccggugugcauggcagcgggaucccuguaagagccgcucagagagcugccacugccauaauuuagcaacugauaguccgggccauuuggauaacgccccgagaaggaguuuacaaaguacgagcucauuugggugauuuuggagggcuugauuuguggaucguggucguuauaacccugugcuucacgauuuaugauguauuaaugaauuauagcgaugcacuguacuucguuuugcuauguaugcggccaaauaugggggggguuagaagggggaugggggggcguuagggaaucacgugcuuuuguugaccagucguaaauucucacugaugaccucaagagguaauucaugcucuaugguuacaaauaaugacgaucggagaaucguuagggccgauucaaugcgagccuccgagagggggggagaaagugagaagggggaaaaacagggagaagguugacguuggccucugagcagagcgcgccaccucccggcgauugacgggagcgcgggccgcaggccgccauggcggcuucggcaaccucuuugcuggcucugugcaaccgccaagccaagaaagaaacccggcccgcagcucacucacaggcuugaaccuuuaggaagauggauuugagucuuuugccuacuucguuagggugcggcuauccccucuauuuguggccucucugacauuaucaucaccauuauuauuuuaacucuggguaauau

SEQ ID NO: 10571 - RNA, 2501 nt, Mus musculus
acauggaauggggguucugggauaaguaaggagucuggcucuccagucucuagcccuacagccuugggguggggguaggcuucuuugaggggagaagagagugaggggcagcuggguugaauuuggccaaaucuaauaauccaagaaccuauugaaggccuugggggguugggaggggaguaaaagucuugaauauucuuccaacuucuccccccccucccucuggucccuucuuuccaaaaagucuuugaagaaagauguuuuugacgcuuccaugucgcucucagauggaugggcucagagugauugaagugucuuugucaugcuaaugauuggggggugauggaugggcgcugggacugccaaacucuggcccgcuuagcccauuggccugggagagaucacaugugcccccccacccccacucccuagccccuuccuaggggaucgcuggcggggccaagcuggcccgggccaugggcucaagcuucagcucugugacauacugccgaaagguuguagggcaagagggugucucccccaaacggcccgacccuccuucggccucuacauggacuauaauaggaugaguuccuuuuuagaguacccacuuuguaaccggggacccagcgccuacagcgccccaaccucuuuuccccccugcucagcuccggccguugacagcuacgcaggggagagccgcuaugguggagggcugccuagcucagcgcuccaacaaaacucgggguauccuguccagcagccgccgucaucccuggggguguccuuucccagccccgcucccucgggguacgccccagccgccugcaaccccagcuaugggccuucucaguauuauucugugggucagucggaaggagauggaagcuauuuucauccgucgagcuacggagcccagcuagggggguugcccgacagcuauggagcggguggagucggcucagggccauauccuccgccgcagcccccauacggaacugagcagaccgcaaccuuugcaucagccuacgaccuccucucugaggacaaggaaucgccuugcucgucagaacccagcacucucacuccccggaccuucgacuggaugaaggucaagagaaacccaccuaagacagguagggcucagaggagccacuuccucuccuuggcucgggcauacacagaggggccugagccagggcuucauucauuccuucagcugcuuuuacuggcagguaaguacuuuccggguucaagucagcagauauuuucccacgggcuaaguucggggcuaccuccucccgaaggaggucuccgcagucuugucugugcgcccaguuuggaaccaguauuucacguuucuugucugaaggugaguaugggcggaaggcugguucuagauuuuguaauuacuaauggagggggugugugaugccacauaggaucugcauuggguagaugaugaaugaggaccaagccugaacuaggaggaguggacgggagggagaaagaggugagagaacugacguggcuuuucucccugccccgccccuagcgaagguguccgagcugggacugggcgcucccggcggucuccgcacaaacuucaccacgcgccagcugacggagcuggagaaggaauuucauuucaacaaauaccugagccgugcccggaggguggagaucgccgccacccuggagcucaaugaaacgcaggugaagaucugguuccagaaccggcgcaugaagcagaagaaacgcgagcgagaggggggcaggaugccugcaggccccccagguugcccaaaggaagccgcuggagaugccucugaccaguccgcgugcaccuccccagaagccucgcccaguuccaucaccucuugaauugaacuuccuaaguaacugggcuuccaacgcuugaccaguucucucgaagacuuucccaaacuucacagccuuggugacccuccucaaggccgaggcaccaguuuagagcugcccaggaaacugggcaggaguugggaaauguauuuuucucucucucagaucuagggguggagggaugauugauggcuggggauccuacaggucuugggaccuggggaacacucaacucaucagaggucgaaggaaggccuuuuggcuuugaucuggagucagcccauccuuucgggcuucuccuuucccuuccaacucaguucagugccuuugagcuuagagaguucuucuuucgaauucuuagcccaacucuucuuucuaggucugggaugucuaggcugggaguccuugggguuuuucugggggaggaugcguuugagugugagcccaaucgccaccaacccuuaaucuuaauccagccaacucaccgcagaccuuacaauagcagaccuuacaauagcaccgacugccuugugacauaccaaaaaaaaaaaaaaacaaaaaaaacaaaaaaaaacaaaacaaaacaaaaaaaaacaaaaaaaaccccacaaaaacaaaaa

SEQ ID NO: 10572 - RNA, 2501 nt, Mus musculus
uuuuuguuuuugugggguuuuuuuuguuuuuuuuuguuuuguuuuguuuuuuuuuguuuuuuuuguuuuuuuuuuuuuuugguaugucacaaggcagucggugcuauuguaaggucugcuauuguaaggucugcggugaguuggcuggauuaagauuaaggguugguggcgauugggcucacacucaaacgcauccucccccagaaaaaccccaaggacucccagccuagacaucccagaccuagaaagaagaguugggcuaagaauucgaaagaagaacucucuaagcucaaaggcacugaacugaguuggaagggaaaggagaagcccgaaaggaugggcugacuccagaucaaagccaaaaggccuuccuucgaccucugaugaguugaguguuccccaggucccaagaccuguaggauccccagccaucaaucaucccuccaccccuagaucugagagagagaaaaauacauuucccaacuccugcccaguuuccugggcagcucuaaacuggugccucggccuugaggagggucaccaaggcugugaaguuugggaaagucuucgagagaacuggucaagcguuggaagcccaguuacuuaggaaguucaauucaagaggugauggaacugggcgaggcuucuggggaggugcacgcggacuggucagaggcaucuccagcggcuuccuuugggcaaccuggggggccugcaggcauccugccccccucucgcucgcguuucuucugcuucaugcgccgguucuggaaccagaucuucaccugcguuucauugagcuccaggguggcggcgaucuccacccuccgggcacggcucagguauuuguugaaaugaaauuccuucuccagcuccgucagcuggcgcguggugaaguuugugcggagaccgccgggagcgcccagucccagcucggacaccuucgcuaggggcggggcagggagaaaagccacgucaguucucucaccucuuucucccucccguccacuccuccuaguucaggcuugguccucauucaucaucuacccaaugcagauccuauguggcaucacacacccccuccauuaguaauuacaaaaucuagaaccagccuuccgcccauacucaccuucagacaagaaacgugaaauacugguuccaaacugggcgcacagacaagacugcggagaccuccuucgggaggagguagccccgaacuuagcccgugggaaaauaucugcugacuugaacccggaaaguacuuaccugccaguaaaagcagcugaaggaaugaaugaagcccuggcucaggccccucuguguaugcccgagccaaggagaggaaguggcuccucugagcccuaccugucuuagguggguuucucuugaccuucauccagucgaagguccggggagugagagugcuggguucugacgagcaaggcgauuccuuguccucagagaggaggucguaggcugaugcaaagguugcggucugcucaguuccguaugggggcugcggcggaggauauggcccugagccgacuccacccgcuccauagcugucgggcaaccccccuagcugggcuccguagcucgacggaugaaaauagcuuccaucuccuuccgacugacccacagaauaauacugagaaggcccauagcugggguugcaggcggcuggggcguaccccgagggagcggggcugggaaaggacacccccagggaugacggcggcugcuggacaggauaccccgaguuuuguuggagcgcugagcuaggcagcccuccaccauagcggcucuccccugcguagcugucaacggccggagcugagcaggggggaaaagagguuggggcgcuguaggcgcuggguccccgguuacaaaguggguacucuaaaaaggaacucauccuauuauaguccauguagaggccgaaggagggucgggccguuugggggagacacccucuugcccuacaaccuuucggcaguaugucacagagcugaagcuugagcccauggcccgggccagcuuggccccgccagcgauccccuaggaaggggcuagggagugggggugggggggcacaugugaucucucccaggccaaugggcuaagcgggccagaguuuggcagucccagcgcccauccaucaccccccaaucauuagcaugacaaagacacuucaaucacucugagcccauccaucugagagcgacauggaagcgucaaaaacaucuuucuucaaagacuuuuuggaaagaagggaccagagggaggggggggagaaguuggaagaauauucaagacuuuuacuccccucccaaccccccaaggccuucaauagguucuuggauuauuagauuuggccaaauucaacccagcugccccucacucucuucuccccucaaagaagccuacccccaccccaaggcuguagggcuagagacuggagagccagacuccuuacuuaucccagaacccccauuccaugu

SEQ ID NO: 10573 - RNA, 2501 nt, Mus musculus
gccgugaaagcggccggcgccguccgcgcccugcuccgugaggaaguuacgagaguuuagcugcaggcagccggccaccagauucguggugggcugugacagccccuugcacagagucugcacguaggacaccagauccggccgcuucccggagcgcaagaucuccgagagagcccagauguaguucuuggccaggcgcagggucucgaucuuggacagcuucugcgucuuggaguagcagggcaccaccuugcgcagguuguccagagccgcguucaggucgugcaugcgguugcgcucccgcgcguuggccuucugucgccgcagcuuggagcgcuccagacgcgccuuggucaucuugcguuucuucggcccgcgcuucuugggccgcucgccuuccgccucguccaguccuuccuccuccuccucuuccuccuccuccucgccgcccagcucuccuuccuccuugaccucagccaacguggguucagggaucucuucuccuccacgaagagacacuggcuuggcggcccgggcggguccuggagcccccgacccgggagcaggaggaggcugcggcggcgcgucgcccuugucgcuccucggcucgucgucgucgccgucgccccagcuggcgaacuugggcacguccgagaggaggccgggcucgcugaacaggcgggucagcauggugccugagggcgccccgggggcggggagacagacagcacagagugaggggcgcgccggggucaccacgaccccccaacccgccuccaccccccaagucuccgugagcgccccagcucaggggcccccgaugcccacuacguccugcugccccgcccagagccggcccagcccugcccggcugccagugggggaccgcggcccaggcccuugcccgagauccgggcuccugcuccgccccuggcccggaaggaagcugcucucggccggugucggggucccagagagcuugaccaggugggggguuaagggaccagguccaucuucccggggaggcggugcucucgcccgaaagccagcucucucccggugacggagagaagcugggcggccgccguggggacgcugccccgguuccuccucuccacgguccggccccucggccuggcuccccaagcccuccggugccucucacccccaagcucccuaauccaauuugcaaguuggccgcgcgccgcccccggccgggcccccacccccgcagccccaauucuagacaccggagcaccgucuccucucuagcugcugcuuacgggucucccggagcgggcuccgggugcggggacugaagaagccgggcguggggaggagacccaaaagcgaacccuguucgucucccuugcggucagggacccucuuccccucuucaaacucccucccucccacacgucucuacagaucucguuguauuuugagauccuuggggaaaaauccaaauuuauuuguuugcuuaucuuuuuugguggugggaaaaggucacagguuccuucgggacagucauggggggggucccaucuucgcuucuucgagugccucaugacccuucccccucagcccauccuaggcauaccaucuccuuccgcagccccuuaagcugcggccccaaugggagagagaacacggggcgcccccgcugcccaucccguaaggggguagggucccaggaauaggagaacugggggggacuuccauguccgaagcagcgcccccccaccacuaauagcaggucagaucuagcucccucucggacaacuuaccucagagaggagucaaggggagaggggaggggaggggggagggggcaagagagagaggggggagaagaggaaucuucucgcuuauuucauuguucccccaucuucagggagcgggggcagcgguuccucaaggcggcgggcgccggcgucuucagagcgccaugcgagccgcggagcgaguguggcaucucuaccaggcgggguaccagccucuaugccaggccauaugggcuuggcacgucacgggcagcagcuaucacaugagagacggugauuggcaugcgucugcauugggggagagccggcucccccgggacccgccgccaucugucacucucuacuccaaaaaaaaaaaaaaaaauuaaauaaauaaaggaaauaaauaaauaucucugccgcccuccccuccccgcccaacgcaggaaaagcagagauugagagggaggugggaggauuugccccccucagauauagaaccccccacaugggaacaaugggguggcaagucugggaauuggcgguuugugguugccaggccaauucagggcucucuccagggucuugaucuguccauuucccugucuccaggucccuaaggugggucaggaccagacccugggguguggagaagggaccucggugcuuacugccgcuccccaagagaauccccuccaccacaaagggacagcugaggcuccuuccagggugggugug

SEQ ID NO: 10574 - RNA, 2501 nt, Mus musculus
cacacccacccuggaaggagccucagcugucccuuugugguggaggggauucucuuggggagcggcaguaagcaccgaggucccuucuccacaccccagggucugguccugacccaccuuagggaccuggagacagggaaauggacagaucaagacccuggagagagcccugaauuggccuggcaaccacaaaccgccaauucccagacuugccaccccauuguucccaugugggggguucuauaucugaggggggcaaauccucccaccucccucucaaucucugcuuuuccugcguugggcggggaggggagggcggcagagauauuuauuuauuuccuuuauuuauuuaauuuuuuuuuuuuuuuuuggaguagagagugacagauggcggcgggucccgggggagccggcucucccccaaugcagacgcaugccaaucaccgucucucaugugauagcugcugcccgugacgugccaagcccauauggccuggcauagaggcugguaccccgccugguagagaugccacacucgcuccgcggcucgcauggcgcucugaagacgccggcgcccgccgccuugaggaaccgcugcccccgcucccugaagaugggggaacaaugaaauaagcgagaagauuccucuucuccccccucucucucuugcccccuccccccuccccuccccucuccccuugacuccucucugagguaaguuguccgagagggagcuagaucugaccugcuauuaguggugggggggcgcugcuucggacauggaagucccccccaguucuccuauuccugggacccuacccccuuacgggaugggcagcgggggcgccccguguucucucucccauuggggccgcagcuuaaggggcugcggaaggagaugguaugccuaggaugggcugagggggaagggucaugaggcacucgaagaagcgaagaugggaccccccccaugacugucccgaaggaaccugugaccuuuucccaccaccaaaaaagauaagcaaacaaauaaauuuggauuuuuccccaaggaucucaaaauacaacgagaucuguagagacgugugggagggagggaguuugaagaggggaagagggucccugaccgcaagggagacgaacaggguucgcuuuugggucuccuccccacgcccggcuucuucaguccccgcacccggagcccgcuccgggagacccguaagcagcagcuagagaggagacggugcuccggugucuagaauuggggcugcgggggugggggcccggccgggggcggcgcgcggccaacuugcaaauuggauuagggagcuugggggugagaggcaccggagggcuuggggagccaggccgaggggccggaccguggagaggaggaaccggggcagcguccccacggcggccgcccagcuucucuccgucaccgggagagagcuggcuuucgggcgagagcaccgccuccccgggaagauggaccuggucccuuaaccccccaccuggucaagcucucugggaccccgacaccggccgagagcagcuuccuuccgggccaggggcggagcaggagcccggaucucgggcaagggccugggccgcggucccccacuggcagccgggcagggcugggccggcucugggcggggcagcaggacguagugggcaucgggggccccugagcuggggcgcucacggagacuugggggguggaggcggguuggggggucguggugaccccggcgcgccccucacucugugcugucugucuccccgcccccggggcgcccucaggcaccaugcugacccgccuguucagcgagcccggccuccucucggacgugcccaaguucgccagcuggggcgacggcgacgacgacgagccgaggagcgacaagggcgacgcgccgccgcagccuccuccugcucccgggucgggggcuccaggacccgcccgggccgccaagccagugucucuucguggaggagaagagaucccugaacccacguuggcugaggucaaggaggaaggagagcugggcggcgaggaggaggaggaagaggaggaggaggaaggacuggacgaggcggaaggcgagcggcccaagaagcgcgggccgaagaaacgcaagaugaccaaggcgcgucuggagcgcuccaagcugcggcgacagaaggccaacgcgcgggagcgcaaccgcaugcacgaccugaacgcggcucuggacaaccugcgcaagguggugcccugcuacuccaagacgcagaagcuguccaagaucgagacccugcgccuggccaagaacuacaucugggcucucucggagaucuugcgcuccgggaagcggccggaucugguguccuacgugcagacucugugcaaggggcugucacagcccaccacgaaucugguggccggcugccugcagcuaaacucucguaacuuccucacggagcagggcgcggacggcgccggccgcuuucacggc

SEQ ID NO: 10575 - RNA, 2501 nt, Mus musculus
cagcuacagcacuccaggccucuagcauucacuugcacauacucccuaccacgaugaugacugacagguguccucccacgcacaccucucucacacucgcuuucuaggacacccccauucacagcgugacaugcuggcacucucuucucgaccucacgggccucccuuaaaaguccacgucccgagggggggugggcgaagagguuaaagccagagucccggcugcagcugccccugcccccuccccuuagcgucaccgcuggacuucauuaauaauacaacgccgaguucuggggauacugcagggggcccccgggccgcuccccuagcccuggcucccacuccgcacccuccucccagcccgggagaacacgcuucucgaugcucauuggccgcuuuccccuaagcccucccuccaaacgccugggcgccagucccuggcagagaggacgggcugggaccccaggguugggaccuguggggugcagccaguagcggcagaggcgcggagaggaagaaggcagagugggggauagacagaagcugguagagcaaggccgagggcagcccgccgagauagcucaggccggcagccagagccccgcgccccaaaccgguggcgcgcagcuaaggcgcggggauccugagcucugaccuggggacgcugagcccggcgcugcaggcgagccccgcuguucaguccucccgaccgucgcgcguucuccucguggagcgcgggauuuuccugggugcggggacagugcuccuccuccuccuccgcgcagcacgcgccacccgcagcuccggacagccgagcagggcucagccagacaccccaagaacgcucagccgcccgccauggaccccaaggaccgcaagaagauucaguucucugugcccgcgcccccgagccagcucgacccccgacagguggagaugguaagggggccgcgccccauccacguaucacccccaacacauauucccccaccccagcacaguccgucccgucccauguuggauccagccuggacugcaauggggcgccccacaggacuggaaguucgccggagacuccuagcaacuuuucuccggaccuuuaagccuaucuugggcgggagaauuccugcagugagcguccggagacuaucaaucaguucucgggacugcccuuuuggcucuuauauagccccgcuaggcuagucauuuauuccccgcagagaccccaucacccuggugguaucccauggacagauacaaacagcucuggcgucugaggcugucacuucaaccacucauggucuagagggccacagucucacccuauaggccuaguuguuggugguggugggguguccccagaacguuauucugacuacucucugcucucaagaccuggaacugcaaccccagggagugagcugacaucucuuccuugaggguugggagaccuacaaaggugugagggagagugucggaggcagaggucuguucuccucgaccuagcaaggacacuuguugcugagaugccaauggcucugaagagggagagcaguaaaaagugggcaaagcaugucuuggucuuggggugcuugguuggggugggcugaagccugggccuaagcagccuuuggcagcagccgcuccagccucaauuaccugguccucucucuauuucccuggagcgucaaggggaccuaauuaacugacaguuggucugauugccaagcuaggguggccaaggagagcaauuuuacauuuuuuuuucccaugagaacugggugauaaauucuacagcuugagaaagacucuaaccuccagagaccccagcagaccccucagugucuggaguuaaggcccccacucgagcuucaggugaggguaggggugccugcgguacugggcucagacuuccuuugcagcugaguccagcugcuuugaaguccuugagcugaccuuugguggguagggccauagguagcucccuuggagugcuuaagcuggcuguaggaguugacaccagcuuuggugucuagagaaaguucuacaguagcuguggaguguggcucucuggacuaggaguccagggaugguuuuucuaguccuuuggaucaagugugcugugugaccuugggcacuuugcugaaccucucuaauucccggacuuuuaauccccguaaaauaaagcgauugcaugagccgagugagcucuagcugccuuugauucucaggcucccugaggacuccaaagcccagcucccagcuggcugagugcgauggugaggugccccuauagggcauuuauccuguccuuccuuccuccaucucucuagauccggcgccggagaccaaccccugccaugcuuuuccgggucucagagcacuccucaccagguaggguccauucccugcucccuaccccaauucuggggccuuucuaagugcucccacgagagagggucaggcuggagaauggaggccuggaaugccaacacagcugg

SEQ ID NO: 10576 - RNA, 2501 nt, Mus musculus
ccagcuguguuggcauuccaggccuccauucuccagccugacccucucucgugggagcacuuagaaaggccccagaauugggguagggagcagggaauggacccuaccuggugaggagugcucugagacccggaaaagcauggcagggguuggucuccggcgccggaucuagagagauggaggaaggaaggacaggauaaaugcccuauaggggcaccucaccaucgcacucagccagcugggagcugggcuuuggaguccucagggagccugagaaucaaaggcagcuagagcucacucggcucaugcaaucgcuuuauuuuacggggauuaaaaguccgggaauuagagagguucagcaaagugcccaaggucacacagcacacuugauccaaaggacuagaaaaaccaucccuggacuccuaguccagagagccacacuccacagcuacuguagaacuuucucuagacaccaaagcuggugucaacuccuacagccagcuuaagcacuccaagggagcuaccuauggcccuacccaccaaaggucagcucaaggacuucaaagcagcuggacucagcugcaaaggaagucugagcccaguaccgcaggcaccccuacccucaccugaagcucgagugggggccuuaacuccagacacugaggggucugcuggggucucuggagguuagagucuuucucaagcuguagaauuuaucacccaguucucaugggaaaaaaaaauguaaaauugcucuccuuggccacccuagcuuggcaaucagaccaacugucaguuaauuagguccccuugacgcuccagggaaauagagagaggaccagguaauugaggcuggagcggcugcugccaaaggcugcuuaggcccaggcuucagcccaccccaaccaagcaccccaagaccaagacaugcuuugcccacuuuuuacugcucucccucuucagagccauuggcaucucagcaacaaguguccuugcuaggucgaggagaacagaccucugccuccgacacucucccucacaccuuuguaggucucccaacccucaaggaagagaugucagcucacucccugggguugcaguuccaggucuugagagcagagaguagucagaauaacguucuggggacaccccaccaccaccaacaacuaggccuauagggugagacuguggcccucuagaccaugagugguugaagugacagccucagacgccagagcuguuuguaucuguccaugggauaccaccagggugauggggucucugcggggaauaaaugacuagccuagcggggcuauauaagagccaaaagggcagucccgagaacugauugauagucuccggacgcucacugcaggaauucucccgcccaagauaggcuuaaagguccggagaaaaguugcuaggagucuccggcgaacuuccaguccuguggggcgccccauugcaguccaggcuggauccaacaugggacgggacggacugugcuggggugggggaauauguguugggggugauacguggauggggcgcggcccccuuaccaucuccaccugucgggggucgagcuggcucgggggcgcgggcacagagaacugaaucuucuugcgguccuugggguccauggcgggcggcugagcguucuuggggugucuggcugagcccugcucggcuguccggagcugcggguggcgcgugcugcgcggaggaggaggaggagcacuguccccgcacccaggaaaaucccgcgcuccacgaggagaacgcgcgacggucgggaggacugaacagcggggcucgccugcagcgccgggcucagcguccccaggucagagcucaggauccccgcgccuuagcugcgcgccaccgguuuggggcgcggggcucuggcugccggccugagcuaucucggcgggcugcccucggccuugcucuaccagcuucugucuaucccccacucugccuucuuccucuccgcgccucugccgcuacuggcugcaccccacaggucccaacccuggggucccagcccguccucucugccagggacuggcgcccaggcguuuggagggagggcuuaggggaaagcggccaaugagcaucgagaagcguguucucccgggcugggaggagggugcggagugggagccagggcuaggggagcggcccgggggcccccugcaguauccccagaacucggcguuguauuauuaaugaaguccagcggugacgcuaaggggagggggcaggggcagcugcagccgggacucuggcuuuaaccucuucgcccacccccccucgggacguggacuuuuaagggaggcccgugaggucgagaagagagugccagcaugucacgcugugaauggggguguccuagaaagcgagugugagagaggugugcgugggaggacaccugucagucaucaucgugguagggaguaugugcaagugaaugcuagaggccuggagugcuguagcug

SEQ ID NO: 10577 - RNA, 2501 nt, Mus musculus
cuuuagcgcggucucuagagguugacuggacauacccggggggugggugggggugaccggaggacucuggccagggaugggaacugaacaagagaaucuugaauccgcuaugaggucagguuuucuguggcagcaggaggaucuccuaggugucugggaaggacuccuucgaggucgagggaggggggcaaagcaacauccccuucguuuccccucgcccugcuuccucuucaggguccagcucagaggcucuccgcgcgcaggccaccgcuuccaaacugcgucgcuuucuucggcggggcaaaggacuuucagauguuguagcgguggcggcgacucaggccagcgcccccuccccccuaacggccucuucucccgcuccauugcuccaguucccccucgcccuccccugcucucccaccucggggacggcgcuggggguguggccagggggccgguauaaagucccgggagccggucccgggcagccgcucagcccccugccccccgccgccugcugggccggccgaggaugcagcgcagcgccucgguggccaggcucgcucugcuccagcgugcuugcuaacuuccccggcuccgucucugccugccggggucgccccgugucccugcgcccuccgggucugguucucuaagcucucugggcgcugccuccgggucccuugcagcccgcucgcgagcccgcgcuccccuccugcgccccacccucguccucgccaugcugcccuucggccucguggccgcccugcugcuggccgcagggccucggccgagccugggcgacgaagccauccacugccccccuugcuccgaggagaagcuggcgcgcugccgcccccccguggguugcgaggaguuggugcgggagccaggcugcgguuguugcgccacuugcgcccugggcuuggggaugcccugcgggguguacaccccacgcuguggcucaggcaugcgcugcuacccuccccgggggguggagaagccccugcguacauugaugcacgggcaaggcgugugcacggagcugucggaaaucgaagccauccaggaaagccugcagaccucugguaagguacaccuaccuucccucggccacauuucccaaacacccuccucccugcaacuuaguucccauucuggcuggccuggaaggcccgucaaugcccccugugaguugaggagaagggagguacguggcagagcuuagaaacagccaagaaugcuggcauuuaaucccagcaccaguugccacuggucgagggaaaccuaccccaccucuucaucucaaaccuccuaaguacuucuuugggaagaggggccuuggccucagugguaagccuggcuccugagguaaguuaaaugaccugauucaguuacauuugucaucuagaguuagaugacugcgaugauaaggugugcgugcguguguguguguguguguguguguguguguguguacaugcacaugugcauacgugugugcaugugucuguggggggugauaaggaugguguguguguacaugcgcaugugcauacgugugugcaagugucugugggggugauaaggauggugugcuugugcacguuugugugauaaggaugguauguguauucgagcgggaggcaguguguguguguguguguguguguguguguguguguguguugggacgguuccuuucuguuccugauccagagccugauccacacacccagucucaggugagaggugugaggagccaggggcugggccuuucacucaucacccuggggugaagugggacauacaauucagaagaaccucugggguaaagaacaugcgacuuggacuucccccaaaggcucagaaagcaaaggaagagaaggcagggcucuuucugccagguuggcacauccagguuucuugcuccuuccuucuggcaggugccaucugaggggguuggagggaaaugcugguugcuggucccgaguugcagaccccuuggguauaugggacugagaagagaggagggcuagacagacagaucuugcauuuauuccuucuccuuuguccacuugucgguggaccuuucuccguuucuucuuggaaccuuucucuuguccgucugcuauuuccugccguaucucucaacuuccaguuucaccaaacagccccgacuucucuuuuucucggucuccuugagccugacuaguuuccuucucuugcucugacuucguuugguuuucugcaguccuuccacuuccaucucagacgcucucgcucuuuugauguccugacagugacuccuucugcguguucugccuuucacugucucccugacucugguuauugucccuccucugacagccaggcucucugaaccaccacagagcuucucucuugccugauauucgaauccuccauuguugcaguccggaugcugggacuugagccccaagcuuccugcucugggucccaggccacuccacuuccucaau

SEQ ID NO: 10578 - RNA, 2501 nt, Mus musculus
auugaggaaguggaguggccugggacccagagcaggaagcuuggggcucaagucccagcauccggacugcaacaauggaggauucgaauaucaggcaagagagaagcucuguggugguucagagagccuggcugucagaggagggacaauaaccagagucagggagacagugaaaggcagaacacgcagaaggagucacugucaggacaucaaaagagcgagagcgucugagauggaaguggaaggacugcagaaaaccaaacgaagucagagcaagagaaggaaacuagucaggcucaaggagaccgagaaaaagagaagucggggcuguuuggugaaacuggaaguugagagauacggcaggaaauagcagacggacaagagaaagguuccaagaagaaacggagaaagguccaccgacaaguggacaaaggagaaggaauaaaugcaagaucugucugucuagcccuccucucuucucagucccauauacccaaggggucugcaacucgggaccagcaaccagcauuucccuccaacccccucagauggcaccugccagaaggaaggagcaagaaaccuggaugugccaaccuggcagaaagagcccugccuucucuuccuuugcuuucugagccuuugggggaaguccaagucgcauguucuuuaccccagagguucuucugaauuguaugucccacuucaccccagggugaugagugaaaggcccagccccuggcuccucacaccucucaccugagacuggguguguggaucaggcucuggaucaggaacagaaaggaaccgucccaacacacacacacacacacacacacacacacacacacacacugccucccgcucgaauacacauaccauccuuaucacacaaacgugcacaagcacaccauccuuaucacccccacagacacuugcacacacguaugcacaugcgcauguacacacacaccauccuuaucaccccccacagacacaugcacacacguaugcacaugugcauguacacacacacacacacacacacacacacacacacgcacgcacaccuuaucaucgcagucaucuaacucuagaugacaaauguaacugaaucaggucauuuaacuuaccucaggagccaggcuuaccacugaggccaaggccccucuucccaaagaaguacuuaggagguuugagaugaagaggugggguagguuucccucgaccaguggcaacuggugcugggauuaaaugccagcauucuuggcuguuucuaagcucugccacguaccucccuucuccucaacucacagggggcauugacgggccuuccaggccagccagaaugggaacuaaguugcagggaggaggguguuugggaaauguggccgagggaagguagguguaccuuaccagaggucugcaggcuuuccuggauggcuucgauuuccgacagcuccgugcacacgccuugcccgugcaucaauguacgcaggggcuucuccaccccccggggaggguagcagcgcaugccugagccacagcgugggguguacaccccgcagggcauccccaagcccagggcgcaaguggcgcaacaaccgcagccuggcucccgcaccaacuccucgcaacccacgggggggcggcagcgcgccagcuucuccucggagcaaggggggcaguggauggcuucgucgcccaggcucggccgaggcccugcggccagcagcagggcggccacgaggccgaagggcagcauggcgaggacgaggguggggcgcaggaggggagcgcgggcucgcgagcgggcugcaagggacccggaggcagcgcccagagagcuuagagaaccagacccggagggcgcagggacacggggcgaccccggcaggcagagacggagccggggaaguuagcaagcacgcuggagcagagcgagccuggccaccgaggcgcugcgcugcauccucggccggcccagcaggcggcggggggcagggggcugagcggcugcccgggaccggcucccgggacuuuauaccggcccccuggccacacccccagcgccguccccgaggugggagagcaggggagggcgagggggaacuggagcaauggagcgggagaagaggccguuaggggggagggggcgcuggccugagucgccgccaccgcuacaacaucugaaaguccuuugccccgccgaagaaagcgacgcaguuuggaagcgguggccugcgcgcggagagccucugagcuggacccugaagaggaagcagggcgaggggaaacgaaggggauguugcuuugccccccucccucgaccucgaaggaguccuucccagacaccuaggagauccuccugcugccacagaaaaccugaccucauagcggauucaagauucucuuguucaguucccaucccuggccagaguccuccggucacccccacccaccccccggguauguccagucaaccucuagagaccgcgcuaaag

SEQ ID NO: 10579 - RNA, 2501 nt, Mus musculus
gaguaccccagcaguauguagaggcaggagcugggagcaggccugcucugccucuggccuaccaccaaggauuccaagaauauggucugcuccauucuuccccagacacugucccaucugcaucgcucaugguuacucuuagggaaacuaagcgaagguccucaucucacaucacaugguuacucuggggcaucuuaaucaagaaagucucugagcuuggugaucacagccccuuuacaaagaucuuugaagguagagcacguuuccauucccuucaggagcauaaacuaacccuacaaccaucacuccuauuaggaguagaagcaucaacuaggcccaagcaggaggacgcagagcucagcacauucccucccagggaaagagcacuaaguccacacucagcucagccuuacucucaagggggucagggauggggagcgcagggacaaaucugcacugcacugacucucagaugcuuuagggguuaagauaucacaguuauauccaggcuggaggaacccagaaaggugcaaagaaugcaacggguggagcccguggagugcggcagccuccacccaccagcaccuucacagcucgggacauggcccccgcaaucaugcggggguggggugauucacugcgcccagaccgccaccuccacccgccccacuuacacuccuaacgcccacccuaccugccccacccgcucccagcaggcgccaagggcgcccgcgcacugcaagacccuugggaacugaaagugccuggaggccaggggcagaucgcggccuagggacaugcguggguagccgagguuggugcgggggcgcggggauaggguguggggggcugacgaucgugucccuugcauggcgcccccgccacugcgugccugagcccugaaucacccgcuauaucgggcccgcagcgccggaggccccaggucccgggccccaccuuuagugucugcuuacagaggggcauacagagaccaccagagaccucgggcauucccucccuuuucccucucuccgccccaccaaaaaaaaaacuuccuccaaguggaaaggcguuugacagagacaagcugggagcauucagcguucccaagucuagcccgcuaacuuuuccgauaggaguuagagaccguggggaggagccuggagaggaaggcgcagggugcgccccucugugagccccaagaguuugccacucccuaaaccccacuccaacuggguucacaggaaggggggaggagcuccugaccgcucucaccaggccgggcuggcggagagacgagccucggccggguguccccacccggaucccaggccgggaccccagcucugggcgcgguccgccccgcgggcucaccugguagaucaugacuuugaaguugcggcgccucagcagcuccgccucguugaccuccaguuucuuuaucuggccggccuggcgcuccaggcugccgcgcacggucuucacguugacgcugaccuugcgcaccuucuccagcaacuugcucacgguguugcucgugguggcgugcgccuugcccagcuugcucagcucucccuggaugcucugcacagcgcccuccaucuccgccugucgcuccuccagcugggcuugggucagcuggaucuggucaacggcgccgaugauuuuauccagaaggcucagcaccagcacaccguucaccugguccgacuugaucagcucgucggagccgguccccgacggcuccuccguggcccgcgccuccccuugggugggcuccgggcccucugaggaagcaucgggaaauccggaauacggccgcucaacgauauggagcgugacauccuccauggcuucccggagccgugcggggccgaccggguggaacuggagcgggagaccgggagagaaggaggagcgagagacuggacagcgagcaggagcccagagcggaggaaacucgagccacguccgugcgcaccgggacucuagccagaacuguggggcggggaaucugcgaguugcccggcuccuagaccaaacccggagucccgucggccauuggcuggccccaccccagaaagggaggaaccggggcaggaggggagaccaaccccggaggggcagcagaggggaacccaagagcugggcgccccacccuguucaggaugguuggaauaguuggagcgggagucuagggccccccuuggcaguggaggcugcggcagcgggacuggggcagaggaaugugagcugcggaaaggaauuaggucuucggagugugcucuacucuuucucuuuccucacccacaaacccacuccagccuuuuaagaucaagcugagguccaaauggcgcgugaauuggguguaaacgaguaguuugugucuaugccucauguccuuggaggauccuugcccuauacaaucuuuuucaaagauuugggggucugcccccaucgucuaucuauacacugaguuaccacugucccccaaaucuugu

SEQ ID NO: 10580 - RNA, 2501 nt, Mus musculus
acaagauuugggggacagugguaacucaguguauagauagacgaugggggcagacccccaaaucuuugaaaaagauuguauagggcaaggauccuccaaggacaugaggcauagacacaaacuacucguuuacacccaauucacgcgccauuuggaccucagcuugaucuuaaaaggcuggaguggguuugugggugaggaaagagaaagaguagagcacacuccgaagaccuaauuccuuuccgcagcucacauuccucugccccagucccgcugccgcagccuccacugccaaggggggcccuagacucccgcuccaacuauuccaaccauccugaacaggguggggcgcccagcucuuggguuccccucugcugccccuccgggguuggucuccccuccugccccgguuccucccuuucugggguggggccagccaauggccgacgggacuccggguuuggucuaggagccgggcaacucgcagauuccccgccccacaguucuggcuagagucccggugcgcacggacguggcucgaguuuccuccgcucugggcuccugcucgcuguccagucucucgcuccuccuucucucccggucucccgcuccaguuccacccggucggccccgcacggcuccgggaagccauggaggaugucacgcuccauaucguugagcggccguauuccggauuucccgaugcuuccucagagggcccggagcccacccaaggggaggcgcgggccacggaggagccgucggggaccggcuccgacgagcugaucaagucggaccaggugaacggugugcuggugcugagccuucuggauaaaaucaucggcgccguugaccagauccagcugacccaagcccagcuggaggagcgacaggcggagauggagggcgcugugcagagcauccagggagagcugagcaagcugggcaaggcgcacgccaccacgagcaacaccgugagcaaguugcuggagaaggugcgcaaggucagcgucaacgugaagaccgugcgcggcagccuggagcgccaggccggccagauaaagaaacuggaggucaacgaggcggagcugcugaggcgccgcaacuucaaagucaugaucuaccaggugagcccgcggggcggaccgcgcccagagcuggggucccggccugggauccggguggggacacccggccgaggcucgucucuccgccagcccggccuggugagagcggucaggagcuccuccccccuuccugugaacccaguuggagugggguuuagggaguggcaaacucuuggggcucacagaggggcgcacccugcgccuuccucuccaggcuccuccccacggucucuaacuccuaucggaaaaguuagcgggcuagacuugggaacgcugaaugcucccagcuugucucugucaaacgccuuuccacuuggaggaaguuuuuuuuuugguggggcggagagagggaaaagggagggaaugcccgaggucucugguggucucuguaugccccucuguaagcagacacuaaagguggggcccgggaccuggggccuccggcgcugcgggcccgauauagcgggugauucagggcucaggcacgcaguggcgggggcgccaugcaagggacacgaucgucagccccccacacccuauccccgcgcccccgcaccaaccucggcuacccacgcaugucccuaggccgcgaucugccccuggccuccaggcacuuucaguucccaagggucuugcagugcgcgggcgcccuuggcgccugcugggagcggguggggcagguagggugggcguuaggaguguaaguggggcggguggagguggcggucugggcgcagugaaucaccccacccccgcaugauugcgggggccaugucccgagcugugaaggugcugguggguggaggcugccgcacuccacgggcuccacccguugcauucuuugcaccuuucuggguuccuccagccuggauauaacugugauaucuuaaccccuaaagcaucugagagucagugcagugcagauuugucccugcgcuccccaucccugacccccuugagaguaaggcugagcugaguguggacuuagugcucuuucccugggagggaaugugcugagcucugcguccuccugcuugggccuaguugaugcuucuacuccuaauaggagugaugguuguaggguuaguuuaugcuccugaagggaauggaaacgugcucuaccuucaaagaucuuuguaaaggggcugugaucaccaagcucagagacuuucuugauuaagaugccccagaguaaccaugugaugugagaugaggaccuucgcuuaguuucccuaagaguaaccaugagcgaugcagaugggacagugucuggggaagaauggagcagaccauauucuuggaauccuuggugguaggccagaggcagagcaggccugcucccagcuccugccucuacauacugcugggguacuc

SEQ ID NO: 10581 - RNA, 2501 nt, Mus musculus
aggagucugaaggcagccuaagguagguauauaaguaucuccaaaaaacuaaaaacgagaccuuugccuuuaaucccaguguuggugggucagagguagauggaucggaguaucuacuugguuaucucaaaaccaaacgaaguuucuuggauagaaguguuuucccccauugcuucucagccuuuuggcuaagaucaaguguaaaagcguuuucccuguggucagaucugccuagcaccgaucaguuugaaccuaccgaucuagcugcuacuaccuauagagcuuguuacuuguagagcaacccaucccuugaucaacuaagguaguuacaaacagcacccuuuggugcuuugacccacaccaggcuggggcaagccuuccaaggacccaacucggccuugagauugccagcagacacaacaagggguggggccgcugugggcaggagcagagccaagcagauacucaguccuagcuugccaauaggacccuucaugcucgcuugcuugcucugaacuuuaguacuauuccacauggaccccacgguagugcucauuaccgguugcuccucuggaaucggcaugcacuuggcuguucgccuagcuucugaccguucccagagcuucaaagguauaggacgggaaaggccuggaggccaggggagagccccccagagguaagcacgaugaugaaucuucguccucucccaaauuuuaguuuaugccacauugcgggaccugaaggcacagggaccauuguuggaggccgccaggacucaaggaugcccuccuggcuccuuggagauacuggaauuggaugucagagacuccaaaucuguggcugcugcccaggcaugcgugacugagggucguguggauguacugggugagcccugaaacaugcgauaggagucuuuacccuccaguguccaaauuaugucccgaguucaaggaacaugggaggacggugugggaggggaaagagcggugcacaaauggggucuguucucucuccccucagucuguaaugcuggccgcggcuuguuugggccgcuagaagcacaugaauugaacgcugugggugcuguguuggaugugaaugugcuugggaccauucggaugcugcaggccuuucugccagacaugaagaggcgccacucugggcgugugcuggugaccgcgagugugggaggcuugaugggugagcgaaagggacagaguaagagguuccgaguacagggaggagccguagggccucugcaaccuugucuccccuucuaggacugccauuccacgaaguguacugugccagcaaguuugcgcucgaagguuugugcgagagucuggcgauccugcugccgcucuuuggaguccagugaguuaccaaccuuccaggacccucuaaagcuugggaaccccagcaccagaucuugcagaugcucugccucuggccuuccuucuccaugcuagacacuaugcagggcacuuggcacagguuaucucacuucacaagccgcccuagcucuuaaggcauaccgggaugaguaaacagagcggguagguaacuggaccccaaauggacaugagaacccuucccuagcacacucagcucugcaaucuccauaguucugccagcaucugcuuccagcguucagccccuuucugugccuucccuuugcaaaaccagggccaaguuuguggucccugcuaguaaccgguugcuguugcaucacccuuuccccuuccccgcagugugagccucaucgaguguggggcagugcacacagccuucuaugaaaagcuggugggcggccccggcggggcucuggaacgagcagaugcccagacccgccaccucuuugcgcacuaccugcgugguuaugagcaagcccugagcgaggcgcaggacccagaggaggugacggaggugagugcaaacggagucucgggcaccguuucugggugggggcgugguaauacacccccaggggugccccacagacacgcgcugcucuuccugcuucagcucuucuugacugcaaugcgagccccgcagcccgcgcugcgcuacuucuccacgaaccgcuuccuaccccuggcccgaaugcgcacagaggaucccaguggcagcagcuaugucgcggccaugcaccaagaagccuucucuaaucugcagacccaggagaaugccaaggcuggggcccaagucccgggggucucggacacggccuccagcgcccucauuugccucccugaaugugcaaucccuaggguggcaucugaauugggguggucugcaucggauaaaccgggucaggacaauucauguuaccagcaaaagaucuaagccagcaucucuuuuuucuuauuuuagaaugaguuuuguuuuaagacaggguuucacuauguagcccuguguugccaguaacucauaaagacccaccugccucugccuccugcgugcugggaccuuagaugugugcaaccacacacuucucagaa

SEQ ID NO: 10582 - RNA, 2501 nt, Mus musculus
uucugagaagugugugguugcacacaucuaaggucccagcacgcaggaggcagaggcaggugggucuuuaugaguuacuggcaacacagggcuacauagugaaacccugucuuaaaacaaaacucauucuaaaauaagaaaaaagagaugcuggcuuagaucuuuugcugguaacaugaauuguccugacccgguuuauccgaugcagaccaccccaauucagaugccacccuagggauugcacauucagggaggcaaaugagggcgcuggaggccguguccgagacccccgggacuugggccccagccuuggcauucuccugggucugcagauuagagaaggcuucuuggugcauggccgcgacauagcugcugccacugggauccucugugcgcauucgggccagggguaggaagcgguucguggagaaguagcgcagcgcgggcugcggggcucgcauugcagucaagaagagcugaagcaggaagagcagcgcgugucuguggggcaccccuggggguguauuaccacgcccccacccagaaacggugcccgagacuccguuugcacucaccuccgucaccuccucuggguccugcgccucgcucagggcuugcucauaaccacgcagguagugcgcaaagagguggcgggucugggcaucugcucguuccagagccccgccggggccgcccaccagcuuuucauagaaggcugugugcacugccccacacucgaugaggcucacacugcggggaaggggaaagggugaugcaacagcaaccgguuacuagcagggaccacaaacuuggcccugguuuugcaaagggaaggcacagaaaggggcugaacgcuggaagcagaugcuggcagaacuauggagauugcagagcugagugugcuagggaaggguucucauguccauuugggguccaguuaccuacccgcucuguuuacucaucccgguaugccuuaagagcuagggcggcuugugaagugagauaaccugugccaagugcccugcauagugucuagcauggagaaggaaggccagaggcagagcaucugcaagaucuggugcugggguucccaagcuuuagaggguccuggaagguugguaacucacuggacuccaaagagcggcagcaggaucgccagacucucgcacaaaccuucgagcgcaaacuugcuggcacaguacacuucguggaauggcaguccuagaaggggagacaagguugcagaggcccuacggcuccucccuguacucggaaccucuuacucugucccuuucgcucacccaucaagccucccacacucgcggucaccagcacacgcccagaguggcgccucuucaugucuggcagaaaggccugcagcauccgaauggucccaagcacauucacauccaacacagcacccacagcguucaauucaugugcuucuagcggcccaaacaagccgcggccagcauuacagacugaggggagagagaacagaccccauuugugcaccgcucuuuccccucccacaccguccucccauguuccuugaacucgggacauaauuuggacacuggaggguaaagacuccuaucgcauguuucagggcucacccaguacauccacacgacccucagucacgcaugccugggcagcagccacagauuuggagucucugacauccaauuccaguaucuccaaggagccaggagggcauccuugaguccuggcggccuccaacaauggucccugugccuucaggucccgcaauguggcauaaacuaaaauuugggagaggacgaagauucaucaucgugcuuaccucuggggggcucuccccuggccuccaggccuuucccguccuauaccuuugaagcucugggaacggucagaagcuaggcgaacagccaagugcaugccgauuccagaggagcaaccgguaaugagcacuaccgugggguccauguggaauaguacuaaaguucagagcaagcaagcgagcaugaaggguccuauuggcaagcuaggacugaguaucugcuuggcucugcuccugcccacagcggccccaccccuuguugugucugcuggcaaucucaaggccgaguuggguccuuggaaggcuugccccagccuggugugggucaaagcaccaaagggugcuguuuguaacuaccuuaguugaucaagggauggguugcucuacaaguaacaagcucuauagguaguagcagcuagaucgguagguucaaacugaucggugcuaggcagaucugaccacagggaaaacgcuuuuacacuugaucuuagccaaaaggcugagaagcaaugggggaaaacacuucuauccaagaaacuucguuugguuuugagauaaccaaguagauacuccgauccaucuaccucugacccaccaacacugggauuaaaggcaaaggucucguuuuuaguuuuuuggagauacuuauauaccuaccuuaggcugccuucagacuccu

SEQ ID NO: 10583 - RNA, 2501 nt, Mus musculus
ugucccggaggaaauggacacacuacccccuugccggggcucaggaggacaagaggcugcuaagcgcauacucuucagaccaagggugguuuggaauuuugcccuucucauacacaaaccccugcuuaggaacuucaauuguaaccuggggucugagguuggucaaaaucaacccggagccaagcuagcuagacaggaacugugccauggucccauugcgcccaggcugcuaaagccaggaggaggguugggggaggaggaccagggacaccugucccugagcuccuaggaggggguggagguggggcacgagggaggccauggccuaucugacagggauccuauccaugcgggaaacuuggggacucccaggucccacucuuucccugggagccuacccguuucuuuucuggagguucugaguggggcuauccaccccucuaccagagggcagguacugaucccaccccaccccaccccccacaacuccccuaaucucagucccuugcuucccuccuccuccccucuauauuuaucugcccucugccucgccaggugcuggcgccugcacuggcugcggugccgcccgccccacccaggaauggagccaccggacuugcuggggaccccugagcgggguuggggggaaaugggagcuggacccaggccacagcacacagaagccugguugccucugguggguaaggacgugagagaggucuccucgaaagauggaggucuuacacaccaacugugccugagugucucucucccaaaggagauuugauuaaaaaaaauuuucagccaccaagucacccucacccauucccucugguuucccaggaaccucaccagagaaggcagagaguucugucuuaaguggcggaauaaugagaaguccucaaagggccaucgucccgagccuuuucuuuguggggucccugaugcagaccccaauucuaggaugucuuuuugcccucgcccaggauacugcggugggagcucccgcaucuggccccagugcucuugaacugagagcagagcgaacccaggcguuccagccgcccagccggccucgccacauuccuuggcucuggcggaggcggaaggagacgggaugggacgcgggcccggcagggaagggagaggcagggccagguugggccacgcgugacgccuccucugccucagggcccccagcagguggacagcgccuugugugcagcgcgaagcccacaggcgcaucccuaguagggcuacuugccccuggagcucccggggcucuggcccucagacaagaaucucccccacauuugcaguuggccaagaggacugcguuuggcccaaguauggagcaggcucaggcgugacggccgguuguagugagaaagauugaacucgguucuaaaucccuguagacuuacccucccgccgcccgcuggacucgggguccuuagcucaaaggucucgucguccucgucuucguccccguccccgcuaagcucgccguccccguagucccggugcagaagagugaagccucgacggcagcagagaagccaccacaaucccccggggagaggcauccgggcgagcagccugggaaugggggcgcaggcaguguugccugagcagcagggaaucugagaaacuggagguacuccgacccgaacuggguagagaagaggugugacgagaggaaagaagggggccggaaggaggcaguguccagcgcugaggugcaaaaggacuaucaccagagcccgcugggggcucgcugucugggcccgggcagaggaggggggagauagcguccagggccgggggaagggagccgggagcaauguccggagcugggaaguaguguucguuguaguguccagcucuguaggagcagugucuggugcagcaaucguggugggcgguuguccaagcuccaaggagggugguguccgguagggcguccgguggccggggcccgggcggcgcgcgcugcgcucccugcagccccgggacuggcgcguugggggcgcgggcagaguucccagaccccgccucccucucugcccccccuccuucccuccgccuucccuguucuuuuucuccucccuucuucacaggguagggucuacguugcgucacagccuccucugcccaaucauuguuccuggcgccggucagggagaccaaucccaagcuugaaaccgcggcggguugcaucaugugucucuggcugagugacaguagggaggggcgggggggggggggacuggggagggagcuucugaggucggacacggggugucuguggcgucacguaggaccgccuucgugcucuuguuuuaacucuuggcucaccaagcagcaaauuaaaaaacccuuuucgaaggucuggaaaaggaagggcauaaagcuggaaggaagcuaggcuauugaccugugauuaccugucacaucuuggaaucccuacaaagagccuuacuaccuucaaggcauuccac

SEQ ID NO: 10584 - RNA, 2501 nt, Mus musculus
guggaaugccuugaagguaguaaggcucuuuguagggauuccaagaugugacagguaaucacaggucaauagccuagcuuccuuccagcuuuaugcccuuccuuuuccagaccuucgaaaaggguuuuuuaauuugcugcuuggugagccaagaguuaaaacaagagcacgaaggcgguccuacgugacgccacagacaccccguguccgaccucagaagcucccuccccagucccccccccccccgccccucccuacugucacucagccagagacacaugaugcaacccgccgcgguuucaagcuugggauuggucucccugaccggcgccaggaacaaugauugggcagaggaggcugugacgcaacguagacccuacccugugaagaagggaggagaaaaagaacagggaaggcggagggaaggagggggggcagagagggaggcggggucugggaacucugcccgcgcccccaacgcgccagucccggggcugcagggagcgcagcgcgcgccgcccgggccccggccaccggacgcccuaccggacaccacccuccuuggagcuuggacaaccgcccaccacgauugcugcaccagacacugcuccuacagagcuggacacuacaacgaacacuacuucccagcuccggacauugcucccggcucccuucccccggcccuggacgcuaucuccccccuccucugcccgggcccagacagcgagcccccagcgggcucuggugauaguccuuuugcaccucagcgcuggacacugccuccuuccggcccccuucuuuccucucgucacaccucuucucuacccaguucgggucggaguaccuccaguuucucagauucccugcugcucaggcaacacugccugcgcccccauucccaggcugcucgcccggaugccucuccccgggggauugugguggcuucucugcugccgucgaggcuucacucuucugcaccgggacuacggggacggcgagcuuagcggggacggggacgaagacgaggacgacgagaccuuugagcuaaggaccccgaguccagcgggcggcgggaggguaagucuacagggauuuagaaccgaguucaaucuuucucacuacaaccggccgucacgccugagccugcuccauacuugggccaaacgcaguccucuuggccaacugcaaaugugggggagauucuugucugagggccagagccccgggagcuccaggggcaaguagcccuacuagggaugcgccugugggcuucgcgcugcacacaaggcgcuguccaccugcugggggcccugaggcagaggaggcgucacgcguggcccaaccuggcccugccucucccuucccugccgggcccgcgucccaucccgucuccuuccgccuccgccagagccaaggaauguggcgaggccggcugggcggcuggaacgccuggguucgcucugcucucaguucaagagcacuggggccagaugcgggagcucccaccgcaguauccugggcgagggcaaaaagacauccuagaauuggggucugcaucagggaccccacaaagaaaaggcucgggacgauggcccuuugaggacuucucauuauuccgccacuuaagacagaacucucugccuucucuggugagguuccugggaaaccagagggaaugggugagggugacuugguggcugaaaauuuuuuuuaaucaaaucuccuuugggagagagacacucaggcacaguugguguguaagaccuccaucuuucgaggagaccucucucacguccuuacccaccagaggcaaccaggcuucugugugcuguggccuggguccagcucccauuuccccccaaccccgcucagggguccccagcaaguccgguggcuccauuccuggguggggcgggcggcaccgcagccagugcaggcgccagcaccuggcgaggcagagggcagauaaauauagaggggaggaggagggaagcaagggacugagauuaggggaguuguggggggugggguggggugggaucaguaccugcccucugguagagggguggauagccccacucagaaccuccagaaaagaaacggguaggcucccagggaaagagugggaccugggaguccccaaguuucccgcauggauaggaucccugucagauaggccauggccucccucgugccccaccuccacccccuccuaggagcucagggacaggugucccugguccuccucccccaacccuccuccuggcuuuagcagccugggcgcaaugggaccauggcacaguuccugucuagcuagcuuggcuccggguugauuuugaccaaccucagaccccagguuacaauugaaguuccuaagcagggguuuguguaugagaagggcaaaauuccaaaccacccuuggucugaagaguaugcgcuuagcagccucuuguccuccugagccccggcaaggggguaguguguccauuuccuccgggaca

SEQ ID NO: 10585 - RNA, 2501 nt, Mus musculus
ggaugacaccauuucuguggaucuguauucuuggcuucaacaugguaccuccucccccauccccuagccuuccuccugggcaggugcugcucaacaaaggauggggaacauaugccccuccuccagcaccacccccuccaagaccuaggaaaacaagacacagaaugauggacacauuucauagugagcagggaaguagcaagagagagcacuggguggccugagagggcaggaaauucuaauuaaugggcuuccugcaauaagagauauccagggacucggguuagccuacaguuuaaacacccacaacacuuuagaccucgguguuuaauggggacagcgaggaauuggugggugcccccaugccuuuccaccagaaaggcacaguuagucauagcuauccagccugcauucagcauuacagggaauucccacuguugcugaaagaauggagaccucuacacuccugcugcuucuccugcucaaggugcgagggaagugacuucugcacccauuccauaucgccucuccaaggucucuuccuucagggucucauccuagaugccaucuuccaguucuccacggcugcucagggcaacuccccagggaguggugucuagccuucccccagaugcucuccuggaccuuaaacuccucuccauccacacccuuuugccuccucccguucagaauccacugcacccacucuccuaggcucccuuccccccagagugccuucccagguccuuugggagccccuggcugagaugagguuucuauguuaaacuuccccaccaugcccucuccuuguccucagagucauuuucuuagccaccugucuuuccuggggcucaagucaccuuacacacugacgcuucaggauggaaaaaacacacggguauuuugugcgaaauuugcuuuuuauuuagggacagggaaaugaacacacacagcccuccagucuggguguccgagacaccgagauaugaagugcccucuucuuaaaccaaacaugcaagugaagucgguguaguuaacacaucucgcaggaggccuugggggagucuucaccacugguccaaaccuucuggccugcaggaggaaaaggaaaugaauugaauaggaaggcaggguuguaagugaugggggcaggccacacuccagggcaugaguggggagggguguuuucuaccgagaccugaaggggagguucucgcugucgcugucgucugugaagagcaguuuggagaacagagcugcggggacaucucuuuuuccauaccugggggcgggaccacaaagggggcguggucaggccuccagguggaucuggggagaggaagcaaccccgguggcugggguccacccgccugcccucuccagcgcucaccgcugccgggugaccagguugagguaguggcgcagggaggcguaguagcggcucagcuccuccggggaggcgucuucgccgggagccucugguuuggcaggguaggcguccaccagggcucccagacaggcgagcaggauuagcagcauugcgaccgugacgggccaaggccugcgcaccgccaccaucuaggaggaaagcuuuggugggugggucauucugaaccuggauccuccaaggcgggaggcgucgggcccacgucucaauaaucuguuugucccaaccacaggauucaccuagucuucuaccgccuugcaccaucucuagccucaguuuccccaucugucagacagcuguaaguccugcuugccuccccacucccgcuaauacgcaaagagguagaugagggaagaaagcugcgaugacacccgagugccccaccggcuucuccaucucaccucagcuaaacccugcccacccagcucgcaaccacucagucccaguuuccagagacccgaccucaguuuccccacaaaauaucaugauaccagacuauuccugaucccagucacucacagcagcuacagcuuccgaagcaagaugagcaggaggagauggaaggugggagaagcucgaaggcucgacagcuacugaacuccguggccucugcucagagcuucccugcggggcuuauaucccacuuggaaagggaggggggaguccaggggaggggagccagcaggggagggcuugucuccucccucccuccaccccugccaaucgcugacuuuacacccagccaguacgugcugucucuccaccucagcagaagcugagggggcagucccaucuucggacugggguccuucuggaaagggugccuugccugaauccgguguucacccuaaggcaaucuagaguuuggaucuagacuaauaaggcaaaaccaggagugagaucccaucuuccuuagccuguucauaggaugggauggagaugggaaaugccguuccuccagccugugcaaccugggauagcuccuuucuggaagcagcccugugugcuucuguuuggagaaggucccagggcugacuggaccugugggggaaga

SEQ ID NO: 10586 - RNA, 2501 nt, Mus musculus
ucuucccccacagguccagucagcccugggaccuucuccaaacagaagcacacagggcugcuuccagaaaggagcuaucccagguugcacaggcuggaggaacggcauuucccaucuccaucccauccuaugaacaggcuaaggaagaugggaucucacuccugguuuugccuuauuagucuagauccaaacucuagauugccuuagggugaacaccggauucaggcaaggcacccuuuccagaaggaccccaguccgaagaugggacugcccccucagcuucugcugagguggagagacagcacguacuggcuggguguaaagucagcgauuggcagggguggagggagggaggagacaagcccuccccugcuggcuccccuccccuggacuccccccucccuuuccaagugggauauaagccccgcagggaagcucugagcagaggccacggaguucaguagcugucgagccuucgagcuucucccaccuuccaucuccuccugcucaucuugcuucggaagcuguagcugcugugagugacugggaucaggaauagucugguaucaugauauuuuguggggaaacugaggucgggucucuggaaacugggacugagugguugcgagcugggugggcaggguuuagcugaggugagauggagaagccgguggggcacucgggugucaucgcagcuuucuucccucaucuaccucuuugcguauuagcgggaguggggaggcaagcaggacuuacagcugucugacagauggggaaacugaggcuagagauggugcaaggcgguagaagacuaggugaauccugugguugggacaaacagauuauugagacgugggcccgacgccucccgccuuggaggauccagguucagaaugacccacccaccaaagcuuuccuccuagaugguggcggugcgcaggccuuggcccgucacggucgcaaugcugcuaauccugcucgccugucugggagcccugguggacgccuacccugccaaaccagaggcucccggcgaagacgccuccccggaggagcugagccgcuacuacgccucccugcgccacuaccucaaccuggucacccggcagcggugagcgcuggagagggcaggcggguggaccccagccaccgggguugcuuccucuccccagauccaccuggaggccugaccacgcccccuuuguggucccgcccccagguauggaaaaagagauguccccgcagcucuguucuccaaacugcucuucacagacgacagcgacagcgagaaccuccccuucaggucucgguagaaaacaccccuccccacucaugcccuggaguguggccugcccccaucacuuacaacccugccuuccuauucaauucauuuccuuuuccuccugcaggccagaagguuuggaccaguggugaagacucccccaaggccuccugcgagauguguuaacuacaccgacuucacuugcauguuugguuuaagaagagggcacuucauaucucggugucucggacacccagacuggagggcuguguguguucauuucccugucccuaaauaaaaagcaaauuucgcacaaaauacccguguguuuuuuccauccugaagcgucaguguguaaggugacuugagccccaggaaagacagguggcuaagaaaaugacucugaggacaaggagagggcaugguggggaaguuuaacauagaaaccucaucucagccaggggcucccaaaggaccugggaaggcacucuggggggaagggagccuaggagagugggugcaguggauucugaacgggaggaggcaaaaggguguggauggagaggaguuuaagguccaggagagcaucugggggaaggcuagacaccacucccuggggaguugcccugagcagccguggagaacuggaagauggcaucuaggaugagacccugaaggaagagaccuuggagaggcgauauggaaugggugcagaagucacuucccucgcaccuugagcaggagaagcagcaggaguguagaggucuccauucuuucagcaacagugggaauucccuguaaugcugaaugcaggcuggauagcuaugacuaacugugccuuucugguggaaaggcaugggggcacccaccaauuccucgcuguccccauuaaacaccgaggucuaaaguguuguggguguuuaaacuguaggcuaacccgagucccuggauaucucuuauugcaggaagcccauuaauuagaauuuccugcccucucaggccacccagugcucucucuugcuacuucccugcucacuaugaaauguguccaucauucugugucuuguuuuccuaggucuuggaggggguggugcuggaggaggggcauauguuccccauccuuuguugagcagcaccugcccaggaggaaggcuaggggaugggggaggagguaccauguugaagccaagaauacagauccacagaaauggugucaucc

SEQ ID NO: 10587 - RNA, 2501 nt, Mus musculus
gccccgagucugauccagcccagaucagcggcaaguuaagaaccccuagugcugugcgcuccagagcgaccgucaccugugggugggggggacgaguggguuugguugucgucauggcgacggcguggguggccacagcccugcggucugcugcagcggccagaagguugcgcagcccgggagguccugggggcucacggagacugaguggcagcgcgcggcggcgcggggcaaagagcgccagcccgggacgccggcucagcaccgccagggcucacgcagaggacgccgagggcgcuaagggucguguccagucuccugcggucgaggagccgucguggacaccgcuuccaacgccccucgaauccccugcgccucccgccggcagaucacuggugcagcgggacauccaggccuuccugaaccaguguggugccagcccgggggaagcacgccacuggcucacgcaauuccagaccugcuaccauucgguggacaagcccuucgccgucauggagguaagccgaucccggugucgucgugucacugucaugagauggugacuguucaauaguacgucguaggucucagcaugccuaacugugaaucuggagagcagaggcguugaguuagugcuggggauggagaaagccauaaggcuacgaaaaccgcccuuggcgcuaaggagaaggcugggaagcccgggccuccagaagugaugucugacaaaggccucucaccguggaagcaguuagggguucagucggcugagcugucgcacuaccccuccccccaaggugucccagaguccaaggccgcugggaggagcugagggaggaacauuagugcuagauaaggggguggcuaagacccaacgggcaaagggcggagcagucggccaaaaguggggcccaauggcuccuaaguagaauguggucacugaggguccuaaagcccgauuaggaacaggcggcuuagagucagugucgcgucccugaacguccacuucuguacaggucgaugaggaggugauccggugcccgcaggcgguaucccgccuggcuuucgcccuggccuucuugcaacgcauggacaugaagccacuggugguucuggggcugccuacccccacggcaccuucuggcugucuuuccuucugggaagcuaaggcgcagcuugcucagagcugcaaggugcugguggaugaacuaaggcacaacgcggcuacugcugugcccuuuuuuggcggcggaucaguacugagcgcugcggagccagcuccccaugccagguuagugucaacccaaccugccccggcauccucagagagggcggaccacucugcuggcccugcccuggucccgcucaagcaccacaucuggcccacagcuacgguggcaucgucgcgguggagacagaccuguugcaguggugucuggaauccaacagcauccccauccugugccccauuggggaaacggcugcgcgccguuccgugcuccuugacucgcuggaggugacugcaucucuagccaaggcuuugcagcccaccaaaaucaucuuccucaauaauucaggcggccugcggaauaacagucagaaggugcgccccucuccugugccacgucauaacacuaagcaagacugaguccccggcccugugaccccuacguaaacccauaacaggcuacagucacucucaagccaauagaguaggaagaccuaacagaagaucggggggggggggggugguguuccucgguucccagaucugagcgcuucccagcagagaagauaaaaguuaaguggucacggagagguccacagggcuaggcucaguuugguaugggugugaaucugcuagagguucaucuucuuccugggacuuagauccugagcaacgugaaccugcccgcugaccuugaccuuguuaccaacgcugaguggcugagcaucaaagagcggcagcagauucggcucaucguggacgugcugagccgccugccgcacuacuccuccgcagucauuacagccgcuagcacgcugcucacggaacucuuuaguaacaagggugagauaugugagaaggugggcugggcugagucccaaaggugaccacugggcagugcccagcugagggacagcaggagugccccgcccacucauccccccgcccccaccucggcugaaagcugucgggagaccugagagaggcaagagaacucagacaguggaaacuggaauaaagaacuugagaacuagggagaugggcagaaagcgcaccuagcgguggaccugacucuggcccaaccuacgcgcucuuuccaaucucccaggcuguggcacccuguuuaaaaaugcugagcggaugcugcgagugcgcaaccuggacagccuggaccagggccgccuagugaaccuagucaacgccagcuucggcaagaagcuccgagaagacuaucuggagucacugcgcccucgguugcacucgaucuaugucu

SEQ ID NO: 10588 - RNA, 2501 nt, Mus musculus
agacauagaucgagugcaaccgagggcgcagugacuccagauagucuucucggagcuucuugccgaagcuggcguugacuagguucacuaggcggcccugguccaggcuguccagguugcgcacucgcagcauccgcucagcauuuuuaaacagggugccacagccugggagauuggaaagagcgcguagguugggccagagucagguccaccgcuaggugcgcuuucugcccaucucccuaguucucaaguucuuuauuccaguuuccacugucugaguucucuugccucucucaggucucccgacagcuuucagccgaggugggggcggggggaugagugggcggggcacuccugcugucccucagcugggcacugcccaguggucaccuuugggacucagcccagcccaccuucucacauaucucacccuuguuacuaaagaguuccgugagcagcgugcuagcggcuguaaugacugcggaggaguagugcggcaggcggcucagcacguccacgaugagccgaaucugcugccgcucuuugaugcucagccacucagcguugguaacaaggucaaggucagcgggcagguucacguugcucaggaucuaagucccaggaagaagaugaaccucuagcagauucacacccauaccaaacugagccuagcccuguggaccucuccgugaccacuuaacuuuuaucuucucugcugggaagcgcucagaucugggaaccgaggaacaccaccccccccccccccgaucuucuguuaggucuuccuacucuauuggcuugagagugacuguagccuguuauggguuuacguaggggucacagggccggggacucagucuugcuuaguguuaugacguggcacaggagaggggcgcaccuucugacuguuauuccgcaggccgccugaauuauugaggaagaugauuuuggugggcugcaaagccuuggcuagagaugcagucaccuccagcgagucaaggagcacggaacggcgcgcagccguuuccccaauggggcacaggauggggaugcuguuggauuccagacaccacugcaacaggucugucuccaccgcgacgaugccaccguagcugugggccagauguggugcuugagcgggaccagggcagggccagcagagugguccgcccucucugaggaugccggggcagguuggguugacacuaaccuggcauggggagcuggcuccgcagcgcucaguacugauccgccgccaaaaaagggcacagcaguagccgcguugugccuuaguucauccaccagcaccuugcagcucugagcaagcugcgccuuagcuucccagaaggaaagacagccagaaggugccguggggguaggcagccccagaaccaccaguggcuucauguccaugcguugcaagaaggccagggcgaaagccaggcgggauaccgccugcgggcaccggaucaccuccucaucgaccuguacagaaguggacguucagggacgcgacacugacucuaagccgccuguuccuaaucgggcuuuaggacccucagugaccacauucuacuuaggagccauugggccccacuuuuggccgacugcuccgcccuuugcccguugggucuuagccacccccuuaucuagcacuaauguuccucccucagcuccucccagcggccuuggacucugggacaccuuggggggagggguagugcgacagcucagccgacugaaccccuaacugcuuccacggugagaggccuuugucagacaucacuucuggaggcccgggcuucccagccuucuccuuagcgccaagggcgguuuucguagccuuauggcuuucuccauccccagcacuaacucaacgccucugcucuccagauucacaguuaggcaugcugagaccuacgacguacuauugaacagucaccaucucaugacagugacacgacgacaccgggaucggcuuaccuccaugacggcgaagggcuuguccaccgaaugguagcaggucuggaauugcgugagccaguggcgugcuucccccgggcuggcaccacacugguucaggaaggccuggaugucccgcugcaccagugaucugccggcgggaggcgcaggggauucgaggggcguuggaagcgguguccacgacggcuccucgaccgcaggagacuggacacgacccuuagcgcccucggcguccucugcgugagcccuggcggugcugagccggcgucccgggcuggcgcucuuugccccgcgccgccgcgcgcugccacucagucuccgugagcccccaggaccucccgggcugcgcaaccuucuggccgcugcagcagaccgcagggcuguggccacccacgccgucgccaugacgacaaccaaacccacucgucccccccacccacaggugacggucgcucuggagcgcacagcacuagggguucuuaacuugccgcugaucugggcuggaucagacucggggc

SEQ ID NO: 10589 - RNA, 2501 nt, Mus musculus
cuuucuuugcagaaggaagacagucccucaaugaaggugacauugcugcaugccuuauuggugauuaauaaggggacuuguggggcugucugcaugagccuuugcuagauguuggagccucccaguuuggucaggaaccaaggacaaagaggagagacaccagaagccugauagacacaaaugggagagagucacagcaauagagaaguggggggaggugaacccagagaagagagacagagaugaauggcagauuccaguaagaaauggucaaaagacagagcaagaagaggcagacacgauaguggggacugggaggagcaggcagaagaaaaaaagaggacagacuuccacacagauaggcuuucugcccuuucuccuauccccaaacuuugcagauacccaagcaggguagugcugcagugggagggguuccgagaagaucuggagucucaauuguaggggauuccuuccagcuuccacuugccuacccucaauuuugacccuggccucagcuaaaagaagguucagucugaccacgcccccgggguggggccccuguaacccagaggugagagcgcagggagcugagaacccagggugggugguuccaaggacaccgcugugcauccgugucucagacacgugcacaccagcucccuauuuucuaggauacuggaggagcuguaccuggagacuuuaaggaggggaguuuccaucacuccgccccgccucuagaggaaacuuuuucccgggaggcgcaggauagcucuguuacucugggaaaagguggagcauuccagggggguugcaaaggguguucguucagcucgauggucccuucucuagggccagggauguacugcaguuaaggcuauugggcaacgaacucccucugccuuugugcgcaaaacauuuccugcagcccuccuccuucuucuccugagcgcacagccacucgucuuagcgcccuccggcgcggagacugcuucuccuuauccuugcccuagagcauccuugcuguucccuuaaagccagucggcgucagcuugaaucuuagcucucaagagaaaucagccugaaucagucucccacgggccaaaccccuacggaccaguucgugcgcccuagagcccugugaucugacuaguuggauuuaucuuuacgcauuuccacuccgcgggugcccuguagccucucccuuaagagcucaagcccaaggguugaagacucaggggugcccgcuaauuacaaccauucuucacaugauaguuaagggggccgcuuuagggucuccaccuacgccugcccggugugccugucgacucugauccaauacgcauucuccugggggcucccugggagcccugcccccaggucagccccacgcccccucauggcccaccuggccguucuugcagaggucugcccacauacuggugccgucgccgccgcgcaugaggacgugguaggugaaaaaguaggugccaggaauguugcauguaaacuugccgcuggccgcaucguaguuguugccuagguuggugaccacgucgucaaacuugagcaccucguaacccucaugaggguucuugaggccggcguagaaggccacgcguggcaccgugguauagguggccgugcugauggcgccgcugccucccgaacccggcaggccaggaggaccaggcuugccugguucacccuucuccccaggcggccccacaggaccuggagggccccggucuccuggaggccccggagggcccggcuugcccgugcggcccggcuuccccugggggcccugcaccagcguggagggcggaggcgcaccgcucugcucgcucagagcgucgccgccgucggaccgcgcgccggcgccggggccccgcgcgggauaggggucgcacaccaugcggcaggugcccagcaucucauaguggccguccgggccgccggagcucaccagcaccgggaugagcaccaccagcacgagcagcaucaccacgcccgcggcggcagccagcagggucuuccggccggcgcggagccuugggagagccgggccacccggccgcgccgucggggcaaugaugccggcggguaaggggcgcgggcgcgacgcccgcgcucaagggcgguccggcggggcugcgggcauggggccggggcccgggcgccgcgcugcgcugcuugcgcugcggagcccagcagccggcuccggccucgugcuucccucccgcugcgcugcccgacugaacgcggccucccgccuagcgccuagcuccucccgccuucccuggcuggggccacugccuccuccguugggccccgcccacccgcuccgcggggcucggagagggcgagggguggggcugcgggcggggcaggcgccuaauugggccgcggaagccucaaggugggaggggcagggaggggcggggcuaugagaguggugggcaucacggagggagcuggagauugaggcucagaauggggaa

SEQ ID NO: 10590 - RNA, 2501 nt, Mus musculus
uuccccauucugagccucaaucuccagcucccuccgugaugcccaccacucucauagccccgccccucccugccccucccaccuugaggcuuccgcggcccaauuaggcgccugccccgcccgcagccccaccccucgcccucuccgagccccgcggagcgggugggcggggcccaacggaggaggcaguggccccagccagggaaggcgggaggagcuaggcgcuaggcgggaggccgcguucagucgggcagcgcagcgggagggaagcacgaggccggagccggcugcugggcuccgcagcgcaagcagcgcagcgcggcgcccgggccccggccccaugcccgcagccccgccggaccgcccuugagcgcgggcgucgcgcccgcgccccuuacccgccggcaucauugccccgacggcgcggccggguggcccggcucucccaaggcuccgcgccggccggaagacccugcuggcugccgccgcgggcguggugaugcugcucgugcugguggugcucaucccggugcuggugagcuccggcggcccggacggccacuaugagaugcugggcaccugccgcauggugugcgaccccuaucccgcgcggggccccggcgccggcgcgcgguccgacggcggcgacgcucugagcgagcagagcggugcgccuccgcccuccacgcuggugcagggcccccaggggaagccgggccgcacgggcaagccgggcccuccggggccuccaggagaccggggcccuccagguccuguggggccgccuggggagaagggugaaccaggcaagccugguccuccuggccugccggguucgggaggcagcggcgccaucagcacggccaccuauaccacggugccacgcguggccuucuacgccggccucaagaacccucaugaggguuacgaggugcucaaguuugacgacguggucaccaaccuaggcaacaacuacgaugcggccagcggcaaguuuacaugcaacauuccuggcaccuacuuuuucaccuaccacguccucaugcgcggcggcgacggcaccaguaugugggcagaccucugcaagaacggccaggugggccaugagggggcguggggcugaccugggggcagggcucccagggagcccccaggagaaugcguauuggaucagagucgacaggcacaccgggcaggcguagguggagacccuaaagcggcccccuuaacuaucaugugaagaaugguuguaauuagcgggcaccccugagucuucaacccuugggcuugagcucuuaagggagaggcuacagggcacccgcggaguggaaaugcguaaagauaaauccaacuagucagaucacagggcucuagggcgcacgaacugguccguagggguuuggcccgugggagacugauucaggcugauuucucuugagagcuaagauucaagcugacgccgacuggcuuuaagggaacagcaaggaugcucuagggcaaggauaaggagaagcagucuccgcgccggagggcgcuaagacgaguggcugugcgcucaggagaagaaggaggagggcugcaggaaauguuuugcgcacaaaggcagagggaguucguugcccaauagccuuaacugcaguacaucccuggcccuagagaagggaccaucgagcugaacgaacacccuuugcaaccccccuggaaugcuccaccuuuucccagaguaacagagcuauccugcgccucccgggaaaaaguuuccucuagaggcggggcggagugauggaaacuccccuccuuaaagucuccagguacagcuccuccaguauccuagaaaauagggagcuggugugcacgugucugagacacggaugcacagcgguguccuuggaaccacccacccuggguucucagcucccugcgcucucaccucuggguuacaggggccccaccccgggggcguggucagacugaaccuucuuuuagcugaggccagggucaaaauugaggguaggcaaguggaagcuggaaggaauccccuacaauugagacuccagaucuucucggaaccccucccacugcagcacuacccugcuuggguaucugcaaaguuuggggauaggagaaagggcagaaagccuaucuguguggaagucuguccucuuuuuuucuucugccugcuccucccaguccccacuaucgugucugccucuucuugcucugucuuuugaccauuucuuacuggaaucugccauucaucucugucucucuucucuggguucaccuccccccacuucucuauugcugugacucucucccauuugugucuaucaggcuucuggugucucuccucuuuguccuugguuccugaccaaacugggaggcuccaacaucuagcaaaggcucaugcagacagccccacaaguccccuuauuaaucaccaauaaggcaugcagcaaugucaccuucauugagggacugucuuccuucugcaaagaaag

SEQ ID NO: 10591 - RNA, 2501 nt, Mus musculus
cucuacucggauccgucuuuccuaccacaagcugcaggugugguauugacaagaggcugcauagaaagcauuugacagcugccugcccguugaggaaaagaaugaaaccaggaggaaagcaaacugagcccggugaagugaaauagcaguguugaugucucugcggaggugggacuagcagaguccaggaagugacccaaagcuuuuuuuuucuucuuuuuuuaaaccgagcacccaggcgcagacaccugggacccagaugcacacaggaccccggggggcgcggucuccucuagugaacgcgggcagguccucgugggcggggggcuggggaagauugcaaaguuuacccaucacacucagccucaggcaggguccaggcgugagccggagggagggagcgcgagcacuccgcccgccccgcugugucccacccaccccguccccucccuucuucccuccccuccgcaggaaaagcagcugcgggugccaggcucgccguggcgcgcgcgcggcgugaagggcggcggacaggaugcgagcgcaguggccgggacaacucugggccgcucugcuggcgcugggggcgcuggcgggcguuguuguuggaggugagcgagucgggugcgcgaaaugccguaggacccugggaacccggagcuaggacugagaagcagaggugcggggggcggauccuucuucccguggccucgagggcgcaucgcugguggcggagauccuggccuggcccgggaagcagaggaaagauggagauccgcugggccgucccggugcgcuggcagaaggaugcagcucaccugcuugggugggugugugcgcucuggguugccccuuucucuggagugcgcaggacaaucuucuggccgccccacuccuuaaggaggagcagggauucgggcuccgucccuucuggggccgaccucucacccaacacucccugacugugugcugggagucagcacagagguccuuggggcugacuuugucucuccugcgugugucccacaacaucagcugccugcaucgucagcuuucaggcccacuaacgcugcagggaaggggagucauccaguccgcagagccuaggggagcgggagggggugguugcuggaggucagcuggagcaaguaaaacccgcaguugugugugugugugugugugcacauguguguaauacagucucauauauuucaggauaccucacacucuguguaguccagggugaccuugcacuucagauuccccugugccucuacuaaggagugcuaggacuauagacaugcaccaccccucaggguuuauaugcugcagggagucgaacccagggucuccucauggcaggcaagcacuuuauuaauugagcuacaucuccagacccagauggacuauuuguuaaagguaaacuuuauuaaguugacuuugaaguuaaguaaucuaaaaaaagauuuugguggcugccuuccugacccuuguacggugguacagaugaacauagacaugggacagggaaagggaaagggguuucaguagagaacugauauuugucuuuuguggcagaagcuuccaagcgaaagaugaaaacuguggucuuuagccuacauugaacaagcuuugucaccacagaacaggaaccaggcucucuagcauucugcccuggagauauuagagucucugucagcugcugguagccguugauggggaauggggaaauccuccaggaaagcugauguuucuaacagauaggcuaacuuucgugaauuuaaaaccuuuuaaacauuucgacuuaauuuuuuaauuggcaugucaugacaggcccugcuucuguacagcgugaaaguguccucacagauaacagauacacugaacaaaagauagcuaguacucuuuguguuaggcaauuuccaguuccccucagcuauuuugagauuuuacuuaaaacacuuugugguuuguuuguaucuauaacuuucacauugacuucugagugucaucaucaccaccucaggauagaaagagauccuguuuaaaaaaauagaagugauauuucugaagagugacacucagguugucuuuuggucucugcccagggacaauuguauaugagcaugcauguacaugugcaugcguguacacaugguauacacaccaaacaaacaaacaaacaaacaaacaacggauccuuuaggauaucuguucacagauuuguugugauuggaauaaucuagggaggcgauggcuugugccaagcuagccucaggcucccucugagaggauguagaguccuguugaggggcagaagccucuagagcauccugugcaagaggugucugucauacucacaugccaucucaguguugguggcagaguugcaaacaucacuaggucccuggggaagcaggcaguguggugacuuuggggacacacagaacagggucggagugaggugccacagaagggccuucagaguaggagggguagga

SEQ ID NO: 10592 - RNA, 2501 nt, Mus musculus
uccuaccccuccuacucugaaggcccuucuguggcaccucacuccgacccuguucuguguguccccaaagucaccacacugccugcuuccccagggaccuagugauguuugcaacucugccaccaacacugagauggcaugugaguaugacagacaccucuugcacaggaugcucuagaggcuucugccccucaacaggacucuacauccucucagagggagccugaggcuagcuuggcacaagccaucgccucccuagauuauuccaaucacaacaaaucugugaacagauauccuaaaggauccguuguuuguuuguuuguuuguuuguuugguguguauaccauguguacacgcaugcacauguacaugcaugcucauauacaauugucccugggcagagaccaaaagacaaccugagugucacucuucagaaauaucacuucuauuuuuuuaaacaggaucucuuucuauccugagguggugaugaugacacucagaagucaaugugaaaguuauagauacaaacaaaccacaaaguguuuuaaguaaaaucucaaaauagcugaggggaacuggaaauugccuaacacaaagaguacuagcuaucuuuuguucaguguaucuguuaucugugaggacacuuucacgcuguacagaagcagggccugucaugacaugccaauuaaaaaauuaagucgaaauguuuaaaagguuuuaaauucacgaaaguuagccuaucuguuagaaacaucagcuuuccuggaggauuuccccauuccccaucaacggcuaccagcagcugacagagacucuaauaucuccagggcagaaugcuagagagccugguuccuguucuguggugacaaagcuuguucaauguaggcuaaagaccacaguuuucaucuuucgcuuggaagcuucugccacaaaagacaaauaucaguucucuacugaaaccccuuucccuuucccugucccaugucuauguucaucuguaccaccguacaagggucaggaaggcagccaccaaaaucuuuuuuuagauuacuuaacuucaaagucaacuuaauaaaguuuaccuuuaacaaauaguccaucugggucuggagauguagcucaauuaauaaagugcuugccugccaugaggagacccuggguucgacucccugcagcauauaaacccugagggguggugcaugucuauaguccuagcacuccuuaguagaggcacaggggaaucugaagugcaaggucacccuggacuacacagagugugagguauccugaaauauaugagacuguauuacacacaugugcacacacacacacacacacaacugcggguuuuacuugcuccagcugaccuccagcaaccacccccucccgcuccccuaggcucugcggacuggaugacuccccuucccugcagcguuagugggccugaaagcugacgaugcaggcagcugauguugugggacacacgcaggagagacaaagucagccccaaggaccucugugcugacucccagcacacagucagggaguguugggugagaggucggccccagaagggacggagcccgaaucccugcuccuccuuaaggaguggggcggccagaagauuguccugcgcacuccagagaaaggggcaacccagagcgcacacacccacccaagcaggugagcugcauccuucugccagcgcaccgggacggcccagcggaucuccaucuuuccucugcuucccgggccaggccaggaucuccgccaccagcgaugcgcccucgaggccacgggaagaaggauccgccccccgcaccucugcuucucaguccuagcuccggguucccaggguccuacggcauuucgcgcacccgacucgcucaccuccaacaacaacgcccgccagcgcccccagcgccagcagagcggcccagaguugucccggccacugcgcucgcauccuguccgccgcccuucacgccgcgcgcgcgccacggcgagccuggcacccgcagcugcuuuuccugcggaggggagggaagaagggaggggacggggugggugggacacagcggggcgggcggagugcucgcgcucccucccuccggcucacgccuggacccugccugaggcugagugugauggguaaacuuugcaaucuuccccagccccccgcccacgaggaccugcccgcguucacuagaggagaccgcgccccccgggguccugugugcaucugggucccaggugucugcgccugggugcucgguuuaaaaaaagaagaaaaaaaaagcuuugggucacuuccuggacucugcuagucccaccuccgcagagacaucaacacugcuauuucacuucaccgggcucaguuugcuuuccuccugguuucauucuuuuccucaacgggcaggcagcugucaaaugcuuucuaugcagccucuugucaauaccacaccugcagcuugugguaggaaagacggauccgaguagag

SEQ ID NO: 10593 - RNA, 2501 nt, Mus musculus
uggcagaagaggcuggauggaggggaugcugggggcccaagacuggccaccugagucagucgcgcaucccauccuucggcuggccaggccucgcagcagcccaggcuucgccacgcggugaaguucugcggaaaguuuugcaguugcuucgccucucgcgccagcaggagaagcugugacgcagcgucuggggcuccaggcccggucugaaaagagaggguagacaaggcgggaaggaauuaagaagcagaauaggggaagauaaagagcgcacacugggauccuuguggaccucgcugauccucuucuccagccuucgccuccucucccucccgacacgcacucccuugcggccggguccccagcccugcgcccccgcgccuccuccguccccucccacgcugcccgcuucccuuccccucugccccucaaacccuccuccaggguucugcgcuccucccuccgcccucccucugcggggccugccuccucccuccuccucuccgggaggcaucacuucguccggacccggaggaggaugcgauccccucgccggcggucaucugagcacagcgcuagggcugucucugcacgcagcccugccgugcgcccuccguacucucguccuccgagcgccgcagggaugguacccauccgaccugcccucgcgcccuggccucgucaccugcugcgcugcgucuugcuucucgggggacugcgucucggccacccggcggacuccgccgccgcccuccuggguaaggcgcugccaacuuggccaacuucgggagucgggccucuugacuuuucccuccuuuuuuucucccaucuuuucugaagaagugcgugcgugcgugugugugugugugugugugugcgcgcgcacgcgugugugugcgugugugugugugugugugugugugugugugugugugugugugugacuggauuuuuuaaauucgucuccacuuuucugggagcaagggaggagaugggaggaggagcgcgccuggaggugggggaggaccugaguggaaccagauguggcaggcggcgggggaggggagccaaggcaccgcggccugggagggagagggagggcugguguccgggccacccggacccccggcgcucgccccgcgcuggucuggguaccuugauauacaaccagagagccagaggcgcauuguuucuuacucuguacgugaggggucagucuguucagcgucuggcaauggggucuuuauguuuucuuacuuggucuuuaaggacagcuuguggcagaggacuuaugcaccguucgaucguaacccuguggaacaguuuugugccaggagaaccgaaugcgcgugcgugcguguguguguguguguguguguguguguguguguguguguguguucguuucucacuuuguguguucaauucugaucaaauuggcacuucuccagaguggacagucuuuggugcaaaagaguuucuaaagauacaaaccacaacccacagaagaccaaccacacaagccccccaaacugcacccuucucuuuucuguauguuuuuuuuuguuguuguguuguuguuguuguugucgucgucgucgucguuauuuuagaacuaucugaaaugugaggucagacaggucccucgacaagaaccugaacacucauaaacauugauaggguagaucuuggggggcagaggcacucagaauuuuaaaaaaugugcuggguguugccuccacauccccuuuuuauguuuaauugggggcugggucagcggaaagggaugggacagcagcugcagcuuugugcuaggacuagagggcccccugaagagucugaggccuuugcgguggccuggugugcugugggcauuugcugaggggaaagguagggucagggugacccacaguuacauaggagccuccucugcccuucccucccaccuggaucugaagccugcauacacaggaagcaagccggagccccuuguagcuugguagcaucagcgugccccucaccucccgggguucuugccagagccuuguuccucuguauaggacacgggacugcaggauucgagggaggagggaaaggacagccaauuccaagagccuuagcuuggguuuuaacgccaggcccugggaaagagcugggccagagcgcugacuuggucuuucccccagggagcuuuugacagggggguggagaugccugaugaggggcccagucagggaggaaaaggaggcuuacagugucccugggcuuccuggucucugcuucugucccucccugcucucucagacuguccuacacacaaaaugcccaugucugggcugcuguguggccuggaucacccuccugagcccugaagaagcccagccuggauucacggagcugggagugggggugggggagagggggugggggagaggggcuuuucgcuaaagcaacugaacaggaggguaaaaaccacacaacuucccugucaccgaacaaac

SEQ ID NO: 10594 - RNA, 2501 nt, Mus musculus
guuuguucggugacagggaaguugugugguuuuuacccuccuguucaguugcuuuagcgaaaagccccucucccccacccccucucccccacccccacucccagcuccgugaauccaggcugggcuucuucagggcucaggagggugauccaggccacacagcagcccagacaugggcauuuuguguguaggacagucugagagagcagggagggacagaagcagagaccaggaagcccagggacacuguaagccuccuuuuccucccugacugggccccucaucaggcaucuccaccccccugucaaaagcucccugggggaaagaccaagucagcgcucuggcccagcucuuucccagggccuggcguuaaaacccaagcuaaggcucuuggaauuggcuguccuuucccuccucccucgaauccugcagucccguguccuauacagaggaacaaggcucuggcaagaaccccgggaggugaggggcacgcugaugcuaccaagcuacaaggggcuccggcuugcuuccuguguaugcaggcuucagauccaggugggagggaagggcagaggaggcuccuauguaacugugggucacccugacccuaccuuuccccucagcaaaugcccacagcacaccaggccaccgcaaaggccucagacucuucagggggcccucuaguccuagcacaaagcugcagcugcugucccaucccuuuccgcugacccagcccccaauuaaacauaaaaaggggauguggaggcaacacccagcacauuuuuuaaaauucugagugccucugccccccaagaucuacccuaucaauguuuaugaguguucagguucuugucgagggaccugucugaccucacauuucagauaguucuaaaauaacgacgacgacgacgacaacaacaacaacaacacaacaacaaaaaaaaacauacagaaaagagaagggugcaguuuggggggcuugugugguuggucuucuguggguugugguuuguaucuuuagaaacucuuuugcaccaaagacuguccacucuggagaagugccaauuugaucagaauugaacacacaaagugagaaacgaacacacacacacacacacacacacacacacacacacacacacacgcacgcacgcgcauucgguucuccuggcacaaaacuguuccacaggguuacgaucgaacggugcauaaguccucugccacaagcuguccuuaaagaccaaguaagaaaacauaaagaccccauugccagacgcugaacagacugaccccucacguacagaguaagaaacaaugcgccucuggcucucugguuguauaucaagguacccagaccagcgcggggcgagcgccggggguccggguggcccggacaccagcccucccucucccucccaggccgcggugccuuggcuccccucccccgccgccugccacaucugguuccacucagguccucccccaccuccaggcgcgcuccuccucccaucuccucccuugcucccagaaaaguggagacgaauuuaaaaaauccagucacacacacacacacacacacacacacacacacacacacacacacgcacacacacgcgugcgcgcgcacacacacacacacacacacacgcacgcacgcacuucuucagaaaagaugggagaaaaaaaggagggaaaagucaagaggcccgacucccgaaguuggccaaguuggcagcgccuuacccaggagggcggcggcggaguccgccggguggccgagacgcagucccccgagaagcaagacgcagcgcagcaggugacgaggccagggcgcgagggcaggucggauggguaccaucccugcggcgcucggaggacgagaguacggagggcgcacggcagggcugcgugcagagacagcccuagcgcugugcucagaugaccgccggcgaggggaucgcauccuccuccggguccggacgaagugaugccucccggagaggaggagggaggaggcaggccccgcagagggagggcggagggaggagcgcagaacccuggaggaggguuugaggggcagaggggaagggaagcgggcagcgugggaggggacggaggaggcgcgggggcgcagggcuggggacccggccgcaagggagugcgugucgggagggagaggaggcgaaggcuggagaagaggaucagcgagguccacaaggaucccagugugcgcucuuuaucuuccccuauucugcuucuuaauuccuucccgccuugucuacccucucuuuucagaccgggccuggagccccagacgcugcgucacagcuucuccugcuggcgcgagaggcgaagcaacugcaaaacuuuccgcagaacuucaccgcguggcgaagccugggcugcugcgaggccuggccagccgaaggaugggaugcgcgacugacucagguggccagucuugggcccccagcauccccuccauccagccucuucugcca

SEQ ID NO: 10595 - RNA, 2501 nt, Mus musculus
uucccuugggaaacgggaagguccaagcuccguggguuucuugggaugggggugggagguggcauccaguggagccugugaggcagaacucacacagcucugcagcccuugcucucuaacucaggugcgguggcagguagugacguggguacauucuccagaugagaaguguagguguucacgaucugagcaacugcaugcccaaaaauuauguuuuuuuuucagaagaaaaggggggugucaucgugggcccaccacuuccuuugugaggcguucuuucccccuuaacuauugaucucacaacucugucaucuacaaaccgcucagagcuagcauaaaacuccaaagugcagaagcaguccugaucuggacucggaauuggaggacagagauggacaggagcccagggucuggcggggacaguggggggggggguaucacuaagucaaaccucacaaugccuccuuucauaugauucaaaacgcguccaggaagggcuaucuuucuaagagcuggcccuccuguggcaucccaccacacuuaaguagcugaagggaggagaggagggaagaauuuccucaauuucccaggggcggagugcacacgagaaauggugacggaaagaaagucgaaacacuacgcaaggauuuuugagaaauuaaagcaaugaucgccaguuccccugaucuguccccagugucagagaccaaccagccgaucugacuacaaccuggcagaaccagaccgccccuccguagacaccuguuaguucgaguuuccguugggcaugagggcgccaggagggcuaagaagccuaaugcauuuccggcgucggagguuucugccucgcgcuccuagaagcuguccccacaguccaagggacucaaucccuaucucuagaugcauuucaaccgaagcacaccucucaagucucuguauacuaggggggucacagagccccgcccugcccuaacagcgaccacgccccucccagcccacucuugguccgcuguugacucuccucuccccaguuugguuccuacggaggucucuugccgacuucgugcugaggggcagugacccagggcuugcugccucaguuacgggagacgcggcgcgguuccccucuuguacccaucgcgcagagaggagugagucuguggugucagggaucaagagaaggccggccggcuggagcuaccuggcucccccagaaccgcuuggggcccaaccuguaccccgcccuuacccucucaguugggggcuuggagugagcgccuagcugccccggggcuccccgcccccggccggccccgccccaggauggccaguucccauagcaaucgcacagacaccgguugccaagcaaccccucccccuccucccgcguccgcuuuccccccaacccuagacuccucccgcccccacgccagccuccaccucccccaggggcgccggcgaggccccuggggaucgcuccgcucucggguugcgcgcgcgugcgugaguuucuguguguuucauugugucugugcgcgagggggugugcgcgugcgagccgagaguuugugggaucgguguguuggggagguccccagccuagagggacccgaggcugcugcgcccguguccacucgggaacccacccucccagcuuuagguucuuugugucucgcguggagccagcgccgcgcccaccccucccccggcccacuccccggggcaaugugugcgugugcaugugugcguguuaugugugugcguuggggguagggguccuaccuucgaugcaacacacccgccacagucccgaaugggugaggucgccgcgagcgcggcggggcgggggcccgucguccauggucagguuggugccguugcagaugugcgcgcuggaguacagccaguagucggugccgauggcgauggccaugagcgagaaggcggcgaaggcuccggccguggucagcagcaucugcagcccgcggucgcaucgcaccauggugggcgccucauaguccgccgcccgccggcccggcccgccgcgcccgcccgcccuccucccucggcgcgcggcuccgggggcuccaggggcuggggggccgagggccggggggcggcgccgcgcugcgcgcuccgaccccgcgccccgggcgugccugcgcuccggcugcgcggggcucaaacuccgaggcgcggcggcgagugagggcugcgcgggcuacgcgggccgccgggcgggcuggcggcggcggcagcggcggcgguggcggccgggggcuccucccucucggcccgcccuccccuccgcucuuggcccgcgcccuccgcgccuccacccaccgcccgccgcccggcgcgcucucucggcgccgccccuccgccucuggccccgcgcucgcucucccacggccgggauuuucccuccccucucuccccucccugcgcucacgcgcgcucucuuuucucucccaggcuucauucacauuaucagagcgaag

SEQ ID NO: 10596 - RNA, 2501 nt, Mus musculus
cuucgcucugauaaugugaaugaagccugggagagaaaagagagcgcgcgugagcgcagggaggggagagaggggagggaaaaucccggccgugggagagcgagcgcggggccagaggcggaggggcggcgccgagagagcgcgccgggcggcgggcgguggguggaggcgcggagggcgcgggccaagagcggaggggagggcgggccgagagggaggagcccccggccgccaccgccgccgcugccgccgccgccagcccgcccggcggcccgcguagcccgcgcagcccucacucgccgccgcgccucggaguuugagccccgcgcagccggagcgcaggcacgcccggggcgcggggucggagcgcgcagcgcggcgccgccccccggcccucggccccccagccccuggagcccccggagccgcgcgccgagggaggagggcgggcgggcgcggcgggccgggccggcgggcggcggacuaugaggcgcccaccauggugcgaugcgaccgcgggcugcagaugcugcugaccacggccggagccuucgccgccuucucgcucauggccaucgccaucggcaccgacuacuggcuguacuccagcgcgcacaucugcaacggcaccaaccugaccauggacgacgggcccccgccccgccgcgcucgcggcgaccucacccauucgggacuguggcggguguguugcaucgaagguaggaccccuacccccaacgcacacacauaacacgcacacaugcacacgcacacauugccccggggagugggccgggggaggggugggcgcggcgcuggcuccacgcgagacacaaagaaccuaaagcugggaggguggguucccgaguggacacgggcgcagcagccucgggucccucuaggcuggggaccuccccaacacaccgaucccacaaacucucggcucgcacgcgcacacccccucgcgcacagacacaaugaaacacacagaaacucacgcacgcgcgcgcaacccgagagcggagcgauccccaggggccucgccggcgccccugggggagguggaggcuggcgugggggcgggaggagucuaggguuggggggaaagcggacgcgggaggagggggagggguugcuuggcaaccggugucugugcgauugcuaugggaacuggccauccuggggcggggccggccgggggcggggagccccggggcagcuaggcgcucacuccaagcccccaacugagaggguaagggcgggguacagguugggccccaagcgguucugggggagccagguagcuccagccggccggccuucucuugaucccugacaccacagacucacuccucucugcgcgauggguacaagaggggaaccgcgccgcgucucccguaacugaggcagcaagcccugggucacugccccucagcacgaagucggcaagagaccuccguaggaaccaaacuggggagaggagagucaacagcggaccaagagugggcugggaggggcguggucgcuguuagggcagggcggggcucugugaccccccuaguauacagagacuugagaggugugcuucgguugaaaugcaucuagagauagggauugagucccuuggacuguggggacagcuucuaggagcgcgaggcagaaaccuccgacgccggaaaugcauuaggcuucuuagcccuccuggcgcccucaugcccaacggaaacucgaacuaacaggugucuacggaggggcggucugguucugccagguuguagucagaucggcugguuggucucugacacuggggacagaucaggggaacuggcgaucauugcuuuaauuucucaaaaauccuugcguaguguuucgacuuucuuuccgucaccauuucucgugugcacuccgccccugggaaauugaggaaauucuucccuccucuccucccuucagcuacuuaaguguggugggaugccacaggagggccagcucuuagaaagauagcccuuccuggacgcguuuugaaucauaugaaaggaggcauugugagguuugacuuagugauacccccccccccacuguccccgccagacccugggcuccuguccaucucuguccuccaauuccgaguccagaucaggacugcuucugcacuuuggaguuuuaugcuagcucugagcgguuuguagaugacagaguugugagaucaauaguuaagggggaaagaacgccucacaaaggaaguggugggcccacgaugacaccccccuuuucuucugaaaaaaaaacauaauuuuugggcaugcaguugcucagaucgugaacaccuacacuucucaucuggagaauguacccacgucacuaccugccaccgcaccugaguuagagagcaagggcugcagagcugugugaguucugccucacaggcuccacuggaugccaccucccacccccaucccaagaaacccacggagcuuggaccuucccguuucccaagggaa

SEQ ID NO: 10597 - RNA, 2501 nt, Mus musculus
ccgcagcauaaccucacucugguugcucagcagcucccggaacagcucacugugcagccccagcaacaggcgauggguguggaaggcucggaccucgucggugcccacagccuggacccgcaggaugacaucacuggcauugcccuggcgcagcagguccugcagucgcuggagcagcaugugggagugguugauggcggugccugcugccuccccacccacaucggcucucugagcugcagcaggaagggacauggcagagccugagagggcacccggccuggugcuuccagcuaagacugcagagggaccuacugguggcacgguggcacugugugggagaaggguggggagccuacaugaguguccacaagcuagcucaugcugagugagcauguuggccccaggcagacuugggguacguucuuagcagaauauguucgggucaggcagaagucguggacuaguuaauguuucugugaaccuauugauguccauggcacuugguccccagggggagggugacaaaaccggucagagguggcacagccuuggguacugagaacuuacguggcugccauguggcauugaaugaaccuaacccaguucucauacucaggaaagcucaagggggcagaacagacacauaguaaauacacacaggaaaggguggggaguucaaggccagccuggacuccauagccaguacuagaucaaguguuaagcacacacacacacacacacacacacacacacacacacacacacacacacaaaucaauuuuaaaaauaaauaaaugcacaagugagcagccuggaaccagccagagacaaaggaauacagccagcccuaaagaccugggcgggaaugaccagguggagcucagggccagggacagcaggcauagcguuucuuucugucuuuguuuguuuguuuguucucuuuuuaguuuuuugagauggggucucuuauaguucaggcuagccuugaauucaugauuagcugagguugggcuugaacucuugauccuucucccuccuccauccuuugugcugggauuacaggauugcaucaccacuccacaaugaggagcacugccccggcccuacucggugagacaguaagggacccaaugaaguaacuugggugaacagugaaggaauaggauuccagggguaacaguguugaagcuagcaucucccuuccagggaggccuguuucuuguguucucagggcagcucuggggucagauagggacacaugcugaguuauagaaaagacaccccccuagacugagcagugcagugagccuugcaaacugggaaaagcaggcgguuaauagucugacaauugcagaagggcaccagcaggcagcucuuguguacacacacacacacacacacacacagagugggcacagggccuauguguggaucguugaaaggaaggcucacaagagugagcaucugugugugggagagggagacccagcaggggagagagggagcagcugcugguggugaauuucccagccccgccuccuagccccgccuccccagcugucacuccgaaagaccuaaaugcugauggcguucucuugcagccucugccuggacccagcugucggagacaaugaacaauagagggucuuuuugucauuaagacuccugccugcugcccagccucuuucccuggaaggcuaugugccccuuucucucugucuuuggagagguccagucucuccguguucucuggggcuggcuggcuggcuccaccuccuggccagcucuauguagcuccuagcagaaguuccugcccccaacccuuaccuuuuuccuuaccaggcaccugauccccguacuuuccacucaccugcacgagugaccagucccaccaaggccagaauagcccagaagcugccccaggacccaggcuugcaggaaccuuuucuaagcaucuuugugcucugucccuaaguccacuggagggacagucaaguccagagcacuccgaucccaucccuccuccuuauauaggauccagcaaggggacaguacccgcuucccuccuaaccucccucccccuaccagucucugccauggauugguugaagcuggucccugcuguugccuaggcaacuacuuaagccagaguguggcagccccaggggcuauuguguuggccugggcccccaaggggaacagauccggacacccuccucccccaccucuucagacaacccagcaaagcuagcuguuccucucccgggaaguuuuaagcucucugaagggcaagcaaagggcuucaggaccccuggcagucaccaacccuuagggccccagcccccaggcccagccuccauccuggcacagagcauacuuggcaguguccuggugagcuggcuacaaagggagagccuggaagaggcagggaagagcuggcucagggcucuauuccucccccacccccauuuuagggugggccagucauccagagggga

SEQ ID NO: 10598 - RNA, 2501 nt, Mus musculus
uccccucuggaugacuggcccacccuaaaaugggggugggggaggaauagagcccugagccagcucuucccugccucuuccaggcucucccuuuguagccagcucaccaggacacugccaaguaugcucugugccaggauggaggcugggccugggggcuggggcccuaaggguuggugacugccagggguccugaagcccuuugcuugcccuucagagagcuuaaaacuucccgggagaggaacagcuagcuuugcuggguugucugaagaggugggggaggaggguguccggaucuguuccccuugggggcccaggccaacacaauagccccuggggcugccacacucuggcuuaaguaguugccuaggcaacagcagggaccagcuucaaccaauccauggcagagacugguagggggagggagguuaggagggaagcggguacuguccccuugcuggauccuauauaaggaggagggaugggaucggagugcucuggacuugacugucccuccaguggacuuagggacagagcacaaagaugcuuagaaaagguuccugcaagccuggguccuggggcagcuucugggcuauucuggccuuggugggacuggucacucgugcaggugaguggaaaguacggggaucaggugccugguaaggaaaaagguaaggguugggggcaggaacuucugcuaggagcuacauagagcuggccaggagguggagccagccagccagccccagagaacacggagagacuggaccucuccaaagacagagagaaaggggcacauagccuuccagggaaagaggcugggcagcaggcaggagucuuaaugacaaaaagacccucuauuguucauugucuccgacagcuggguccaggcagaggcugcaagagaacgccaucagcauuuaggucuuucggagugacagcuggggaggcggggcuaggaggcggggcugggaaauucaccaccagcagcugcucccucucuccccugcugggucucccucucccacacacagaugcucacucuugugagccuuccuuucaacgauccacacauaggcccugugcccacucuguguguguguguguguguguguguacacaagagcugccugcuggugcccuucugcaauugucagacuauuaaccgccugcuuuucccaguuugcaaggcucacugcacugcucagucuaggggggugucuuuucuauaacucagcaugugucccuaucugaccccagagcugcccugagaacacaagaaacaggccucccuggaagggagaugcuagcuucaacacuguuaccccuggaauccuauuccuucacuguucacccaaguuacuucauugggucccuuacugucucaccgaguagggccggggcagugcuccucauuguggaguggugaugcaauccuguaaucccagcacaaaggauggaggagggagaaggaucaagaguucaagcccaaccucagcuaaucaugaauucaaggcuagccugaacuauaagagaccccaucucaaaaaacuaaaaagagaacaaacaaacaaacaaagacagaaagaaacgcuaugccugcugucccuggcccugagcuccaccuggucauucccgcccaggucuuuagggcuggcuguauuccuuugucucuggcugguuccaggcugcucacuugugcauuuauuuauuuuuaaaauugauuugugugugugugugugugugugugugugugugugugugugugugugugugcuuaacacuugaucuaguacuggcuauggaguccaggcuggccuugaacuccccacccuuuccuguguguauuuacuaugugucuguucugcccccuugagcuuuccugaguaugagaacuggguuagguucauucaaugccacauggcagccacguaaguucucaguacccaaggcugugccaccucugaccgguuuugucacccucccccuggggaccaagugccauggacaucaauagguucacagaaacauuaacuaguccacgacuucugccugacccgaacauauucugcuaagaacguaccccaagucugccuggggccaacaugcucacucagcaugagcuagcuuguggacacucauguaggcuccccacccuucucccacacagugccaccgugccaccaguaggucccucugcagucuuagcuggaagcaccaggccgggugcccucucaggcucugccaugucccuuccugcugcagcucagagagccgauguggguggggaggcagcaggcaccgccaucaaccacucccacaugcugcuccagcgacugcaggaccugcugcgccagggcaaugccagugaugucauccugcggguccaggcugugggcaccgacgagguccgagccuuccacacccaucgccuguugcuggggcugcacagugagcuguuccgggagcugcugagcaaccagagugagguuaugcugcgg

SEQ ID NO: 10599 - RNA, 2501 nt, Mus musculus
uacaagcagaaaagggccuccaggcauugacaagagccucagaccucugauccagaccagaccaguauaguucccagccuggcacggccuuggcugggcaaagacagcagagucuuucuaagcaccccccuccaaccugcagcuagcaguguggguaucccaagccagcucuuucgcacccuguggaccaggcucccaaggcccgcaugcugcuuuucucuaaauucuucacaacuugcuagguagacauguggucuugugcccuugcacucccaaaugugccugcacucccaaaggaugccccuggaggggaaacaguaaggauuuccucauuggagggggucacuuccucaaucccauauuuugcugaccaccacagagauaaacugcaaaaaggaucucaucucccccacccccuucagacugcguuugcaaacuucuccacaggcaugcacuauguccgaugcccaagagggcugagugagguagcuccacagauaggauacggcuaaaacgcuccaaagagcuaagcagggugggacaaggagccacgaaaaggguaccaagaggacacuucugacacccggagaaacagaggaacuguggcuucugucuguguggaagaggggacacaggauacucagaagagauguaaaaggcaaaccacggggacagccacgggcugggagccacagucucaccugcugagugccugaguagcgcaggagaggccuucagggacucaacuccaaguggagccuuccacuucugccagcuuuuccaggaccacauaacuauauaugcucccccuaccuagcucgauuguacccacccuuuggguuaaggaguccuaaggguaacauauaugccaggcaaucuaagcagccacacaauuccuugacccccauaggucaccaagucgucguaucccccacucacccccauucguguguguggacauucugaauaauauaauaauaaaaagucaacagcagcaaauagucaggcuccuggauccugccuggcccugucgguggggccuucuagggaacacgcagcggggaaguagacucuagcagccuuccucugucccucugagcucaugggaucugcguagggggcuuccauucugcccugcuaagcaaaaacucccaaauggcugcagagaagcccuccucacccagccagcaccucaccuguggaaguuucuucccgggguucccaguccuuuagccaucgcacccuccccccgcgugucccccacucccccacccccagcgcuggcaucccagggaggcggccugccaacacccaagcguucccuggcucccuuuccuggggccggagcugcugcggaauuucggaggaauuuugaggucgccaagcaucuuccagcucagaggggaaaagaaaagagaggaacgguggaggggguuacgggggagggagaaagugagcuuggggcguucaguugcaggauggcaaagggagagccccaaccggcuguagggcagagaggugggccgcgcgaacccggguacagccgcuuaccuacgucugcauugcaaaacgccuguugcgggugcaccggggagcagcugcaggcgucggccgggcgcagcagcguggcuagcagcaggaggccgagcgccagccggaggcugcgggccgcggcgcccauggcgggcgcgcugggggccuggguccggcugcuggggcgcggacuggggcgccgggcacgccccuccucaccuggcccgcucccccgcgcaaacuuucuguccucuuugucaaggggcgcagcggcgaggggacggcgcagggcagugcacccggcggagaagaaagaggcuggggggcggcgagcgagcgcagcccggcucggcuccuccgcugccuucuauggcuguguuugcugcgggcucgggccgagccgccguuuuauugcgcuccgaggauccucugcuccuccucucgguggcuggcggccagugcaggccgggcgcucccagcagcccuccucccgcgccgcgccgcccagcccuccccagaaccccggcuuuuguugugcccagccuggcacaggcugcgggcuucccgcaccaccuggcacgcugcgcuguagggccaugcgcgcugcguaccugacugcgcgcuggauuggcacucacacacgaaaacggccagcugugcgacucguuaaggcugaugggcccccgacucuggguggaacucaggccuugucccugaaaggccaccaggcugcccccucauccccauccccaugaccgccggcccaacuuuuuccucaggccuggccccaaggucuuccucacuucucuuuccaugggauaaauuccaagcacccucuggggccagugucacuccccauggcccccucccaugggggaggguggagugcuuggagaccuuagaauucccagcgccuuuggcuaguugcuaaagagaggcugggguguaguuaugguggacaaaagaga

SEQ ID NO: 10600 - RNA, 2501 nt, Mus musculus
ucucuuuuguccaccauaacuacaccccagccucucuuuagcaacuagccaaaggcgcugggaauucuaaggucuccaagcacuccacccucccccaugggagggggccauggggagugacacuggccccagagggugcuuggaauuuaucccauggaaagagaagugaggaagaccuuggggccaggccugaggaaaaaguugggccggcggucauggggauggggaugagggggcagccugguggccuuucagggacaaggccugaguuccacccagagucgggggcccaucagccuuaacgagucgcacagcuggccguuuucgugugugagugccaauccagcgcgcagucagguacgcagcgcgcauggcccuacagcgcagcgugccagguggugcgggaagcccgcagccugugccaggcugggcacaacaaaagccgggguucuggggagggcugggcggcgcggcgcgggaggagggcugcugggagcgcccggccugcacuggccgccagccaccgagaggaggagcagaggauccucggagcgcaauaaaacggcggcucggcccgagcccgcagcaaacacagccauagaaggcagcggaggagccgagccgggcugcgcucgcucgccgccccccagccucuuucuucuccgccgggugcacugcccugcgccguccccucgccgcugcgccccuugacaaagaggacagaaaguuugcgcgggggagcgggccaggugaggaggggcgugcccggcgccccaguccgcgccccagcagccggacccaggcccccagcgcgcccgccaugggcgccgcggcccgcagccuccggcuggcgcucggccuccugcugcuagccacgcugcugcgcccggccgacgccugcagcugcuccccggugcacccgcaacaggcguuuugcaaugcagacguagguaagcggcuguacccggguucgcgcggcccaccucucugcccuacagccgguuggggcucucccuuugccauccugcaacugaacgccccaagcucacuuucucccucccccguaacccccuccaccguuccucucuuuucuuuuccccucugagcuggaagaugcuuggcgaccucaaaauuccuccgaaauuccgcagcagcuccggccccaggaaagggagccagggaacgcuuggguguuggcaggccgccucccugggaugccagcgcugggggugggggagugggggacacgcggggggagggugcgauggcuaaaggacugggaaccccgggaagaaacuuccacaggugaggugcuggcugggugaggagggcuucucugcagccauuugggaguuuuugcuuagcagggcagaauggaagcccccuacgcagaucccaugagcucagagggacagaggaaggcugcuagagucuacuuccccgcugcguguucccuagaaggccccaccgacagggccaggcaggauccaggagccugacuauuugcugcuguugacuuuuuauuauuauauuauucagaauguccacacacacgaaugggggugagugggggauacgacgacuuggugaccuaugggggucaaggaauuguguggcugcuuagauugccuggcauauauguuacccuuaggacuccuuaacccaaaggguggguacaaucgagcuagguagggggagcauauauaguuaugugguccuggaaaagcuggcagaaguggaaggcuccacuuggaguugagucccugaaggccucuccugcgcuacucaggcacucagcaggugagacuguggcucccagcccguggcuguccccgugguuugccuuuuacaucucuucugaguauccuguguccccucuuccacacagacagaagccacaguuccucuguuucuccgggugucagaaguguccucuugguacccuuuucguggcuccuugucccacccugcuuagcucuuuggagcguuuuagccguauccuaucuguggagcuaccucacucagcccucuugggcaucggacauagugcaugccuguggagaaguuugcaaacgcagucugaagggggugggggagaugagauccuuuuugcaguuuaucucugugguggucagcaaaauaugggauugaggaagugacccccuccaaugaggaaauccuuacuguuuccccuccaggggcauccuuugggagugcaggcacauuugggagugcaagggcacaagaccacaugucuaccuagcaaguugugaagaauuuagagaaaagcagcaugcgggccuugggagccugguccacagggugcgaaagagcuggcuugggauacccacacugcuagcugcagguuggaggggggugcuuagaaagacucugcugucuuugcccagccaaggccgugccaggcugggaacuauacuggucuggucuggaucagaggucugaggcucuugucaaugccuggaggcccuuuucugcuugua

SEQ ID NO: 10601 - RNA, 2501 nt, Mus musculus
ccugaacuaugucgaacccuggcaccaccaggguccagggcaccuuggccuuuggccuccaggaaagcagcccugugcuuuauuacccuggcuggaaagguguccacagccaacuugcucgaggccucugcugagcuaggacuggucacaccauauugcaccaggucugaguccugccuucgagcaagcuggaucacacuguggccagcugggaacuuuccugucccagaagaggucucauccagcuuccugccuuucagguacucuccaaggccggcacugggcucucccaaaggucucugugaaggguccaggggcuccuuccuggguuucgguccucguuucuuggagcugucccccggugagcugggcuugucgucuacacggcugguaccccugucccucucucggucccggucccgaggugggucugcccugcagguacuggugcugcucccugguggggguagccccguguuccgcaggcccucucgggcccuggaaguagacgccaaauccuggggugagcggccuggguaagggauccggaugccucugguagagucacuucugaauucauagguuuuggccuuugccuuggccugggccugcagaaggaaguuguugugaggagaaaaaagccccgcccccgcccaccccacccccccacgaccucuagccuugacugcccaacuuucccuggaugccugggaaauucuaauugaguggggaggugggcucuuaguaauagucugggggaggggaaugaggguuugucuggaagaagccauuugcaaccaacagacuccuuguguaacagaggucuacuugggauggcuggagggggggugggaaugaaggccuucuggugcagcuaaguccugccucuagaacuccgugauggggccucugacagaaguccagauuacaaauacacacaaggcaagggcacccauugauuuacaagcccugcagauccucccugaacggcacacuccaccucuggagaucgcaacauaccuugagaaggaagguuuuaggcuuggguccucgcuuuuuggggccauagagcuccaucucccguucccuaaagaaagaaaagagagagaaggggguguguccuggcugcaccgaagucagcguguauggguucuagugaguggcuaggcuaagggucuguaccuuuccucaaaggcugcaaggaggcgagcauccagaauauuuucuucgggcucccacgugcuguaccuaaaggaaaccaggaagaauggagcaucagucccuggagcaggagagagaggacagaguggagggcguguaugugugugcaacuuuuccggcugccuuguguuguauuucaaugugaaggggaaaagaggaagaaagaacccuccucgauaucagugugggguagcgauugcauauaaccuacuuacuucugcgaccagcccuuccauuucacgagauauuccaugcgucccugcagaugcaaaagggaaaaugcuuguguaugugugugcguggggagaaaugcaugacgaggacacaagaaauacacacgaaaaugcaugcaccaaaugaaugcuccaaacacuaccgccaaaggaaccaguccacugcagcaccccugcagaaacgcugcacaaagugcaugcaccggcauucaucccccaccccaccccccauccaugcaaucugugcagggcugcaagucuaaggagagcgcuggggcugagccgccgccgccgccgccacggccgcggccgcugcugggaccugggggaagggaggcugggcugcagcaaggggagggagccugggcccuggugagggagaguucgcgucgccgcccgccuuccccuucaccuacuuugcgaaugcgccgcuucaggagggcuucggccgcgaacacccgcucccccaccgccgagagcuccauguugacucgccgcuuccccccucagccgcuuccaggagcagaaaagcagcagccagcccucgacagcccauaauacucucccgcugacgucaguucuccucccucccccgcgcacucucccucccuccacccccucccagcgcuuccucccgccccacguguugcuaacgacguugcuaaagccaagcguccugggcccguucugcgggcgcugauuggacuagcgcccggccacgccccucuccccgucuccccugcguugcuacgugacccgcguuccaauagccaggaggcggggucucuguccacuccagagacccagagggagggggagcgagccgucagcggaagugacgccaagcggggcgggcccggcugcugucagucugcacggcuggacaggggggccgcugcccuaggcucccgccccuggccccccugccugauugcccagcguuuccccgggugcguggcuugccccgccgagcuauuagggcucccugcguaggugccagccaggcgcugccccucugcagacccaggcccuccccaccugcccaug

SEQ ID NO: 10602 - RNA, 2501 nt, Mus musculus
caugggcagguggggagggccugggucugcagaggggcagcgccuggcuggcaccuacgcagggagcccuaauagcucggcggggcaagccacgcacccggggaaacgcugggcaaucaggcaggggggccaggggcgggagccuagggcagcggccccccuguccagccgugcagacugacagcagccgggcccgccccgcuuggcgucacuuccgcugacggcucgcucccccucccucugggucucuggaguggacagagaccccgccuccuggcuauuggaacgcgggucacguagcaacgcaggggagacggggagaggggcguggccgggcgcuaguccaaucagcgcccgcagaacgggcccaggacgcuuggcuuuagcaacgucguuagcaacacguggggcgggaggaagcgcugggaggggguggagggagggagagugcgcgggggagggaggagaacugacgucagcgggagaguauuaugggcugucgagggcuggcugcugcuuuucugcuccuggaagcggcugaggggggaagcggcgagucaacauggagcucucggcggugggggagcggguguucgcggccgaagcccuccugaagcggcgcauucgcaaaguaggugaaggggaaggcgggcggcgacgcgaacucucccucaccagggcccaggcucccuccccuugcugcagcccagccucccuucccccaggucccagcagcggccgcggccguggcggcggcggcggcggcucagccccagcgcucuccuuagacuugcagcccugcacagauugcauggaugggggguggggugggggaugaaugccggugcaugcacuuugugcagcguuucugcaggggugcugcaguggacugguuccuuuggcgguaguguuuggagcauucauuuggugcaugcauuuucguguguauuucuuguguccucgucaugcauuucuccccacgcacacacauacacaagcauuuucccuuuugcaucugcagggacgcauggaauaucucgugaaauggaagggcuggucgcagaaguaaguagguuauaugcaaucgcuaccccacacugauaucgaggaggguucuuucuuccucuuuuccccuucacauugaaauacaacacaaggcagccggaaaaguugcacacacauacacgcccuccacucuguccucucucuccugcuccagggacugaugcuccauucuuccugguuuccuuuagguacagcacgugggagcccgaagaaaauauucuggaugcucgccuccuugcagccuuugaggaaagguacagacccuuagccuagccacucacuagaacccauacacgcugacuucggugcagccaggacacacccccuucucucucuuuucuuucuuuagggaacgggagauggagcucuauggccccaaaaagcgaggacccaagccuaaaaccuuccuucucaagguauguugcgaucuccagagguggagugugccguucagggaggaucugcagggcuuguaaaucaaugggugcccuugccuuguguguauuuguaaucuggacuucugucagaggccccaucacggaguucuagaggcaggacuuagcugcaccagaaggccuucauucccacccccccuccagccaucccaaguagaccucuguuacacaaggagucuguugguugcaaauggcuucuuccagacaaacccucauuccccucccccagacuauuacuaagagcccaccuccccacucaauuagaauuucccaggcauccagggaaaguugggcagucaaggcuagaggucguggggggguggggugggcgggggcggggcuuuuuucuccucacaacaacuuccuucugcaggcccaggccaaggcaaaggccaaaaccuaugaauucagaagugacucuaccagaggcauccggaucccuuacccaggccgcucaccccaggauuuggcgucuacuuccagggcccgagagggccugcggaacacggggcuacccccaccagggagcagcaccaguaccugcagggcagacccaccucgggaccgggaccgagagagggacagggguaccagccguguagacgacaagcccagcucaccgggggacagcuccaagaaacgaggaccgaaacccaggaaggagccccuggacccuucacagagaccuuugggagagcccagugccggccuuggagaguaccugaaaggcaggaagcuggaugagaccucuucugggacaggaaaguucccagcuggccacagugugauccagcuugcucgaaggcaggacucagaccuggugcaauauggugugaccaguccuagcucagcagaggccucgagcaaguuggcuguggacaccuuuccagccaggguaauaaagcacagggcugcuuuccuggaggccaaaggccaaggugcccuggacccugguggugccaggguucgacauaguucagg

SEQ ID NO: 10603 - RNA, 2501 nt, Mus musculus
gguuuuuaggaguauagacuggaucagaguaguggagguaggcugagaggucagaagauggacaggccuuccuaaggucauggagaaguaguuggagccagaggccauguacagacacaagagguggaaucaguuaacugugcuucccgcagagcguuaaaaggaaggccaggaguaaaccagacuagggagagaaaacacagagcccaauaauguuuaggaguuuaagcucuaggaggccuggugacacccugagaaauggaggacagugacaugugcccaucugcaagcaaaaugguuggagcagugagaaaccgagaauggcgguugccgagagaacacgcguggguagugcagccucagcagacacacucagggguugcaugugggaggaggggcucccagacuugaggacuggagaaagcauuagcaaccugacagaaccggguuaacaaaggaaggacuacaucucccagcaugcucggguucgguggggugacggcuggcgguggcugcgccgcauccgacuggugggcgcgggaccugggugggcaccggagccugucaucccugagggguccguggggugcgggcggcgaugcaccgcugucccucgcccaagggccgcgccgggcucuuguuccccgccccgcggccccgccccuugccccaccccagacgggagaccuaacccgggccgcagcgcagcggccgcagcaacaucacucucaccgccgcuguuccgccccauccuuuucuguuuuucucucauucuccgguggcggcggcggggaaggcgaaggagaggcaacagcagccagccuuggcugcaaugaaugauccuccacccggaggggaggacuccaggugagccucugaccucgggaggaucgggacccuccgagccgcccaggacucgcaucccccgccauggaucccuaggggaagggaaaaaggaggaggaaaagacagcucugccgcccacccccaucucauuuuccucuuccuuuaucucauuguugccgaagcuguagccguagcgcucacucuugcuccagcaugggguggauuccaggcacuacccuucggcaggagcagcuugcgcgguaaccuagggauucugccuaauucuaccucuccagacugugcacagaaagccgcggagagcuguggaggccuggacugcagcagucucggggccaacucccugcauccccacccugguaggcugcaugcggauugaagagaggugccugagggcugggccagcccgacugaucccgaccuaggaguagggcagaaggaccgcccaggcugcagagcggcccaccuggaaggacagaggugcaagauggccaguaagaccaaggccagcgaggcccugaaggugguggcccggugccgcccccucaguaggaaggaggaggcugcuggucaugagcagauucugaccauggacgugaaacugggccaggugacucugcgaaacccccgcgcggcacccggggagcugcccaagaccuucacuuuugaugcuguguaugaugcuagcuccaagcaggccgaccuguaugacgaaacggugaggccccugauagacucagugcuucaggguuucaacggcaccguauuugccuauggccagacuggcacuggcaagaccuacaccaugcaggggaccuggguggagccagagcuccgcgggguuaucccgaaugccuuugagcacaucuucacccacaucucccgcucccagaaccagcaguaccugguucgugcuuccuacuuggagaucuaccaggaggagauccgagaccugcuauccaaggagccaggcaagaggcuagagcugaaggagaauccugaaacaggggucuacaucaaggaccucucuuccuuugucaccaagaaugucaaggagauugagcaugugaugaaccuggggaaccaagcccgagcagugggcagcacccacaugaaugaggucagcucucggucccaugccaucuuuguuaucacaguggagugcagugagcguggcucugauggccaggaucauauccgaguaggcaagcucaaccugguagaccuggccggcagugagagacagaacaaggcuggucccaacgcagcuggagggccagccacacagccaacagcugguggugggaguggaaguggcagcgcuagugguucugccagcagcggagagaggccuaaggaagcuucuaaaaucaaucucucgcuguccgcccugggcaaugugauugcugcucuggcuggcaacaggagcacccacauccccuaccgggacuccaagcuaacccggcugcuccaagacucacuggggggcaaugccaagaccaucaugguggccacacuggguccagcuucucacagcuacgacgagagccucucuacccugcgcuuugccaaccgagccaagaacaucaagaacaaaccgcgggugaacgaggaccccaaggacacacugcugaggg

SEQ ID NO: 10604 - RNA, 2501 nt, Mus musculus
cccucagcaguguguccuugggguccucguucacccgcgguuuguucuugauguucuuggcucgguuggcaaagcgcaggguagagaggcucucgucguagcugugagaagcuggacccaguguggccaccaugauggucuuggcauugccccccagugagucuuggagcagccggguuagcuuggagucccgguaggggaugugggugcuccuguugccagccagagcagcaaucacauugcccagggcggacagcgagagauugauuuuagaagcuuccuuaggccucucuccgcugcuggcagaaccacuagcgcugccacuuccacucccaccaccagcuguuggcuguguggcuggcccuccagcugcguugggaccagccuuguucugucucucacugccggccaggucuaccagguugagcuugccuacucggauaugauccuggccaucagagccacgcucacugcacuccacugugauaacaaagauggcaugggaccgagagcugaccucauucaugugggugcugcccacugcucgggcuugguuccccagguucaucacaugcucaaucuccuugacauucuuggugacaaaggaagagagguccuugauguagaccccuguuucaggauucuccuucagcucuagccucuugccuggcuccuuggauagcaggucucggaucuccuccugguagaucuccaaguaggaagcacgaaccagguacugcugguucugggagcgggagaugugggugaagaugugcucaaaggcauucgggauaaccccgcggagcucuggcuccacccagguccccugcaugguguaggucuugccagugccagucuggccauaggcaaauacggugccguugaaacccugaagcacugagucuaucaggggccucaccguuucgucauacaggucggccugcuuggagcuagcaucauacacagcaucaaaagugaaggucuugggcagcuccccgggugccgcgcggggguuucgcagagucaccuggcccaguuucacguccauggucagaaucugcucaugaccagcagccuccuccuuccuacugagggggcggcaccgggccaccaccuucagggccucgcuggccuuggucuuacuggccaucuugcaccucuguccuuccaggugggccgcucugcagccugggcgguccuucugcccuacuccuaggucgggaucagucgggcuggcccagcccucaggcaccucucuucaauccgcaugcagccuaccaggguggggaugcagggaguuggccccgagacugcugcaguccaggccuccacagcucuccgcggcuuucugugcacagucuggagagguagaauuaggcagaaucccuagguuaccgcgcaagcugcuccugccgaaggguagugccuggaauccaccccaugcuggagcaagagugagcgcuacggcuacagcuucggcaacaaugagauaaaggaagaggaaaaugagaugggggugggcggcagagcugucuuuuccuccuccuuuuucccuuccccuagggauccauggcgggggaugcgaguccugggcggcucggagggucccgauccucccgaggucagaggcucaccuggaguccuccccuccggguggaggaucauucauugcagccaaggcuggcugcuguugccucuccuucgccuuccccgccgccgccaccggagaaugagagaaaaacagaaaaggauggggcggaacagcggcggugagagugauguugcugcggccgcugcgcugcggcccggguuaggucucccgucugggguggggcaaggggcggggccgcggggcggggaacaagagcccggcgcggcccuugggcgagggacagcggugcaucgccgcccgcaccccacggaccccucagggaugacaggcuccggugcccacccaggucccgcgcccaccagucggaugcggcgcagccaccgccagccgucaccccaccgaacccgagcaugcugggagauguaguccuuccuuuguuaacccgguucugucagguugcuaaugcuuucuccaguccucaagucugggagccccuccucccacaugcaaccccugagugugucugcugaggcugcacuacccacgcguguucucucggcaaccgccauucucgguuucucacugcuccaaccauuuugcuugcagaugggcacaugucacuguccuccauuucucagggugucaccaggccuccuagagcuuaaacuccuaaacauuauugggcucuguguuuucucucccuagucugguuuacuccuggccuuccuuuuaacgcucugcgggaagcacaguuaacugauuccaccucuugugucuguacauggccucuggcuccaacuacuucuccaugaccuuaggaaggccuguccaucuucugaccucucagccuaccuccacuacucugauccagucuauacuccuaaaaacc

SEQ ID NO: 10605 - RNA, 2501 nt, Mus musculus
uugccccaucggagagaccaugcaaacuccccccaccuuuggggauuuguucucaaccauggagccaggcccugguguucuaagucuacagucuggguguacuguucugccuccacagcucuguucuaaacugaagcuggugggagcaagcuagacagaggcccugggccauauuccccgucccugcuuuuccucucaaagacccuucucugcagccuccgccucaccccgcuuccucggccuugcuaccuccccagggagggagggagaaaagguggcccgccucugggucuugcugguggagcagagcuacgccggaaggaauuagcugguuuuauaaccuuguacacuuagccagcccuaacaaagucggaugcuucuguuacuuuaggccccucucacuguuggcagcuugagagcguccuaugcagggacagguuaggaguuuuuccugauucugcugcacacugggauuggaguuuccuguaaggaucccaccagucaguguggcgugccaugacagacccuuggaaaauagaugcugguccuaagugcccccauaggaccgucagggccagagaguucuauguauggaaacaaagcugucugugcguacaugcugcgcacugaguguguuucugagauggcugaugcgugguagccacagccuguuuucccacgcugguaucaaaggccugcagacugccaaaggcugccuagccucacuuuucagcccuacuugccuuccuuucccuccugauuuccaagcuagaucuuuggcugggcagaauugaagccaaaauuacuugcauuuccgccugaaauuaguuaaauuuucccuaucugucugcuuuaaugacuucaauggagauuaauaaaagccagaugacacacacauacuacaaccaccccacaaccccacccacauccuaccuuuggagggcccuacacaggguaaaaugugauguuugagcuccaaccaucccuuuucuccccacacaagccgaggcccuggacucuggcugcuggggccuacugucacagaaggaaggcaggcacccaaacucucuucccauacacaagccaccauccacccgaaacggccugccugagagggguccuucugauaccgagaggccaugacuuuaauuggauaccagcugcucuacccugaauuccccugagcuucaauuuguguauaguccccagucccccgcugaacacaaggcacuaccaucacugcucucgucccucuuggcgggaacucaaaggccacaacuccugcccuucuuucuucucccagggcuccaggcccaaggcuacacuagacccuucccccaaagaagcggaucuugagcuccgcuuggcuugaggggaaccugccagccuguucugaagagcggcucccacucccuuagcccucggagaccaagccuugacuggcuuagggguucgugaacaaugacuucgaagacaacuuuuucucuccagcaccugaggauaacuauagggaucauaguucaggaucgaaucgggcagaggcuugccucccccggcucgucuccagucaagaguagacgggaugggcuggugcgcagaagacgcguaaaguaccuugaguugcuuggucugugaagccggugauuguguccacacgcccgugcccugaagcugccgcgaccggagcccuccccgccaggcuccuguaaagcgacaucaugaagugguguggcaccaccgagccguuccugaagccagaacccgcagcgcggcgcacagcucggggacccggaaccgcagcggccuggagagcugaagggccuggagcccgggcgaggguccgcccgccgccgccgcccccggggcuccaggcugguccagcccccgccgcucggagcaccgcggcagcuucuagcccgucgcggggacggcaagcgcucagcagccagagacacagcgcggcggcagcgcucagguccaugggcuccuugggccggccggccgcgcgacacgggcuccguggcuccgggaagucccccgacgccuuuugaacauaguguuuaauaaugggggaagugugcgcagcaagccgcugccccccuccucucccaccccacccccgcccagcgcucggagcagcgcccccugcugaacguucaacccgcagcgcugagccccccaacucaggccuaucgcgcagugcaggguagaagucgccuccccuugcuguagugccugguccuuguccuugccaagagaaggccauccgcccgaggcuccugccacaacgcggugccccgccuccccucccgaagguacuacgagcccccaccccccuccgccccaagaccucagcgcacuccuuggcuggaagauggggcgucucgcguacccgcccagcuuccucccgacuccuccauggagaaacaccgcccuccgcgugaucuugugagugcuagggaugccagacccgggccaagucaagacugggccccucccau

SEQ ID NO: 10606 - RNA, 2501 nt, Mus musculus
augggaggggcccagucuugacuuggcccgggucuggcaucccuagcacucacaagaucacgcggagggcgguguuucuccauggaggagucgggaggaagcugggcggguacgcgagacgccccaucuuccagccaaggagugcgcugaggucuuggggcggaggggggugggggcucguaguaccuucgggaggggaggcggggcaccgcguuguggcaggagccucgggcggauggccuucucuuggcaaggacaaggaccaggcacuacagcaaggggaggcgacuucuacccugcacugcgcgauaggccugaguuggggggcucagcgcugcggguugaacguucagcagggggcgcugcuccgagcgcugggcggggguggggugggagaggaggggggcagcggcuugcugcgcacacuucccccauuauuaaacacuauguucaaaaggcgucgggggacuucccggagccacggagcccgugucgcgcggccggccggcccaaggagcccauggaccugagcgcugccgccgcgcugugucucuggcugcugagcgcuugccguccccgcgacgggcuagaagcugccgcggugcuccgagcggcgggggcuggaccagccuggagccccgggggcggcggcggcgggcggacccucgcccgggcuccaggcccuucagcucuccaggccgcugcgguuccggguccccgagcugugcgccgcgcugcggguucuggcuucaggaacggcucgguggugccacaccacuucaugaugucgcuuuacaggagccuggcggggagggcuccggucgcggcagcuucagggcacgggcguguggacacaaucaccggcuucacagaccaagcaacucaagguacuuuacgcgucuucugcgcaccagcccaucccgucuacucuugacuggagacgagccgggggaggcaagccucugcccgauucgauccugaacuaugaucccuauaguuauccucaggugcuggagagaaaaaguugucuucgaagucauuguucacgaaccccuaagccagucaaggcuuggucuccgagggcuaagggagugggagccgcucuucagaacaggcuggcagguuccccucaagccaagcggagcucaagauccgcuucuuugggggaagggucuaguguagccuugggccuggagcccugggagaagaaagaagggcaggaguuguggccuuugaguucccgccaagagggacgagagcagugaugguagugccuuguguucagcgggggacuggggacuauacacaaauugaagcucaggggaauucaggguagagcagcugguauccaauuaaagucauggccucucgguaucagaaggaccccucucaggcaggccguuucggguggaugguggcuuguguaugggaagagaguuugggugccugccuuccuucugugacaguaggccccagcagccagaguccagggccucggcuuguguggggagaaaagggaugguuggagcucaaacaucacauuuuacccuguguagggcccuccaaagguaggaugugggugggguuguggggugguuguaguaugugugugucaucuggcuuuuauuaaucuccauugaagucauuaaagcagacagauagggaaaauuuaacuaauuucaggcggaaaugcaaguaauuuuggcuucaauucugcccagccaaagaucuagcuuggaaaucaggagggaaaggaaggcaaguagggcugaaaagugaggcuaggcagccuuuggcagucugcaggccuuugauaccagcgugggaaaacaggcuguggcuaccacgcaucagccaucucagaaacacacucagugcgcagcauguacgcacagacagcuuuguuuccauacauagaacucucuggcccugacgguccuaugggggcacuuaggaccagcaucuauuuuccaagggucugucauggcacgccacacugacuggugggauccuuacaggaaacuccaaucccagugugcagcagaaucaggaaaaacuccuaaccugucccugcauaggacgcucucaagcugccaacagugagaggggccuaaaguaacagaagcauccgacuuuguuagggcuggcuaaguguacaagguuauaaaaccagcuaauuccuuccggcguagcucugcuccaccagcaagacccagaggcgggccaccuuuucucccucccucccuggggagguagcaaggccgaggaagcggggugaggcggaggcugcagagaagggucuuugagaggaaaagcagggacggggaauauggcccagggccucugucuagcuugcucccaccagcuucaguuuagaacagagcuguggaggcagaacaguacacccagacuguagacuuagaacaccagggccuggcuccaugguugagaacaaauccccaaagguggggggaguuugcauggucucuccgauggggcaa

SEQ ID NO: 10607 - RNA, 2501 nt, Mus musculus
cggggauucccuaguccuugcagcgaggggaggggaaucgacucagagagagaaaugcccaggcaaggggaaucagcccggugcacccgagcucuacgagccuccuaaggggcacgcguguccgugccccaguucagauucgccgcccucccuucccggaucuccccaaaacgcccccgcugcagcccgccucauugucugaaacggucugaaaacuucgcaacuagucgaacguggacagacacacaaauaaacccucuuaacgaggccacgcauaaugaucccgggagucuuucgccccuggacuugagagcuuuccgaccucccgcaccguccccggccccuggcaaaagacccaggaugauuuuuuuuuaauuuuuuaaaaaaaaaauuuuaauuuuuuuuaagcaaaaaaacaaaacgcaaaagcaaagcugggcugguuaccuugcaaaccagcuccucuccgcugugcagaugcacagcgcggaaaacguggucucccuccagaggcuccaacaguaaguauuucccgaugcaagaaacgcaaugcgacaaguucggagucucgggcgggcucggagagccaagguucgggcugaaacucuggcugggcucagcggaccuuauagacgacagcucuucgaaauccuggguuuuguuccgcgaucucccauaucucgcuauugugauagggguagaccuguguauguucaugagugugaggaucgcacacgacaaaacaaacaaacaaaccaaaaaaccccucuggagagauggaugagccgcgccggugcaggcgccucggugcuaccgacuuaaaaggaucaagaagggaggggacccgucuggggcuccguggaggaagaguuaagaacuagcccccagaugggcgcugcagggcugguccccggcugcgagccccgcucccgggggugcucgcucugcggacaacucggguccuuuuguuacccagaagcugccagcgcggugcagaaccgcacgcuggacucagugggucucuguucgcagcguggaucuggacgagugagcgugccucuggggugaggagcugcagcgccgggcuucugagcgauccccagcugaggauccgcagaccgggcggagaagcccugcguggaguuugugcagucuucagggagcgcgcggcgccggcucgcccuccacgcguuagaaaccaaacaaaaagaaaaaggaaauaagcucgggucuaccggcucacgccgcgcggcagccagaauccgcgcugcaccccccucuuuuugguggaaaggguggggggcguguaaggggggugcuagagagggcaguuaccuaagucuuaacuguagauggcgucugaggcuuuuccaaaaaaucgcagagcugucucucucaagaaaaaaaaaaaaagacagaaaaaaaaaauugcaaaggcgcuuuuaacuuggggcggucagcaguggcaacaaaagauugcaaaagcugaguagggagugcgcggaguagggcaggcacagguaccgcgacaaagcccaaggcagagcccgcgcggucagcacuagcucuugcugucgcugcucacgucccagauccuccuccgaugaagcaagaagugcgggcggugaccugggggguaccagcagcaggagcuuuccggggguccugcaggagcugccagcagaugcuccccggacuccgucaacccgcggcguuccuuuuccgcugcacaacugggucuugagccuugaaacaauuugcaaaccacucuugucucccgaugccuugcgaccaaauugcacggcgggguuugcucugcaggaaaaauaaaaaucgacggcuugucuucuuuucuuauuauuuuuuuuuucuugccacccagaaguaggagaggaccguguauuuaaaaauuaaaggggauggccacggcgcccuaggccaaucccggcgcucaagcacgcccgcauccccgggcgaggcgguauuaauaguuacuuacguggccggggaucucggagcgagcccggcugugugugcgcguaugugugcgcgcgcgccucgcuugcucgcgcucggucuccccauucaaugucaccgacacauuuccacagagcccccgcccucuucgccggccccgcccuacccacgccccggccccugucauugagcccggagcccaucaaucagcggcgccgcugccagugcgcgcgcggcuccccugcgcccgccggcggccagggcugcugccgccacuccugcagugcccccacugggggcgccagccucgcccccggauggcucggccaggcgcgagguaaacagugcuuuauauccuuccgcaguccaagggcucugggcuccccuggccugcuguucgcgcugcagcgacagggaugcuggacuguguaucugccaccgucgccacgcaacaccggcaggcucaggucaacuuugagacuuagauccucuuccccgggauuuuccgcagaaagccucgcauc

SEQ ID NO: 10608 - RNA, 2501 nt, Mus musculus
gaugcgaggcuuucugcggaaaaucccggggaagaggaucuaagucucaaaguugaccugagccugccgguguugcguggcgacgguggcagauacacaguccagcaucccugucgcugcagcgcgaacagcaggccaggggagcccagagcccuuggacugcggaaggauauaaagcacuguuuaccucgcgccuggccgagccauccgggggcgaggcuggcgcccccagugggggcacugcaggaguggcggcagcagcccuggccgccggcgggcgcaggggagccgcgcgcgcacuggcagcggcgccgcugauugaugggcuccgggcucaaugacaggggccggggcguggguagggcggggccggcgaagagggcgggggcucuguggaaaugugucggugacauugaauggggagaccgagcgcgagcaagcgaggcgcgcgcgcacacauacgcgcacacacagccgggcucgcuccgagauccccggccacguaaguaacuauuaauaccgccucgcccggggaugcgggcgugcuugagcgccgggauuggccuagggcgccguggccauccccuuuaauuuuuaaauacacgguccucuccuacuucuggguggcaagaaaaaaaaaauaauaagaaaagaagacaagccgucgauuuuuauuuuuccugcagagcaaaccccgccgugcaauuuggucgcaaggcaucgggagacaagagugguuugcaaauuguuucaaggcucaagacccaguugugcagcggaaaaggaacgccgcggguugacggaguccggggagcaucugcuggcagcuccugcaggacccccggaaagcuccugcugcugguaccccccaggucaccgcccgcacuucuugcuucaucggaggaggaucugggacgugagcagcgacagcaagagcuagugcugaccgcgcgggcucugccuugggcuuugucgcgguaccugugccugcccuacuccgcgcacucccuacucagcuuuugcaaucuuuuguugccacugcugaccgccccaaguuaaaagcgccuuugcaauuuuuuuuuucugucuuuuuuuuuuuuucuugagagagacagcucugcgauuuuuuggaaaagccucagacgccaucuacaguuaagacuuagguaacugcccucucuagcaccccccuuacacgccccccacccuuuccaccaaaaagaggggggugcagcgcggauucuggcugccgcgcggcgugagccgguagacccgagcuuauuuccuuuuucuuuuuguuugguuucuaacgcguggagggcgagccggcgccgcgcgcucccugaagacugcacaaacuccacgcagggcuucuccgcccggucugcggauccucagcuggggaucgcucagaagcccggcgcugcagcuccucaccccagaggcacgcucacucguccagauccacgcugcgaacagagacccacugaguccagcgugcgguucugcaccgcgcuggcagcuucuggguaacaaaaggacccgaguuguccgcagagcgagcacccccgggagcggggcucgcagccggggaccagcccugcagcgcccaucugggggcuaguucuuaacucuuccuccacggagccccagacggguccccucccuucuugauccuuuuaagucgguagcaccgaggcgccugcaccggcgcggcucauccaucucuccagagggguuuuuugguuuguuuguuuguuuugucgugugcgauccucacacucaugaacauacacaggucuaccccuaucacaauagcgagauaugggagaucgcggaacaaaacccaggauuucgaagagcugucgucuauaagguccgcugagcccagccagaguuucagcccgaaccuuggcucuccgagcccgcccgagacuccgaacuugucgcauugcguuucuugcaucgggaaauacuuacuguuggagccucuggagggagaccacguuuuccgcgcugugcaucugcacagcggagaggagcugguuugcaagguaaccagcccagcuuugcuuuugcguuuuguuuuuuugcuuaaaaaaaauuaaaauuuuuuuuuuaaaaaauuaaaaaaaaaucauccugggucuuuugccaggggccggggacggugcgggaggucggaaagcucucaaguccaggggcgaaagacucccgggaucauuaugcguggccucguuaagaggguuuauuugugugucuguccacguucgacuaguugcgaaguuuucagaccguuucagacaaugaggcgggcugcagcgggggcguuuuggggagauccgggaagggagggcggcgaaucugaacuggggcacggacacgcgugccccuuaggaggcucguagagcucgggugcaccgggcugauuccccuugccugggcauuucucucucugagucgauuccccuccccucgcugcaaggacuagggaauccccg

SEQ ID NO: 10609 - RNA, 2501 nt, Mus musculus
uaaacuucgacugggcaauggaaagaagggacuggacagagagaguucuauacccagggcuucccaucaucccaguggccuuuccaugaugcuugccugguaccugggcccaagaaggcauuccaacuaccucugccggccuguagaaaacucuggcuccucugucuuuggccuccucuuccagccaggagcagcuaagacccguucugauuuuuagcagcaaaccagugccaacccagcaaagauauguuuuucuagaacagcgggggguguuauuacaaguguucagcaagagagaauaaggaagcuaaaagacucaaagcaucuuaaaaauagcuuguacuaugggaauugccuggccagccaaagauccggauguguccgacgcugcagggcguuuuuccaaccacuguuuggcaggugguccacccacuuaucgccuccucccagcguauucccugauggccaaagcagaggcccuugcuggucaauucccaccugggcuguaaggaugcugcaacucgacuccgugcagccccacugguaaaggaaugcaagcccugagucagaagaaaguucuagguguuucugccaacuguuguuugcauuugucuccuuuaacagagacaguagcgggcacccacccaggaggcagaguuagaauaugcaagaguggggauaaggaagggacacaaaacccuauaagggacuggggcggggguggggggccacucugggugagcuggggacagaggcgccaaguagggacggaggccugggugggaggauacuagggaugcagagggauggguggagggccuggcccccauacucaccgcgggugcgagccgggcggggccucguggggucagcuccuggggcccccaggccuccgacucggccagcaacugauccagcaggcguagggucuccucccggccaccggagggcgucgcgggucgggggucgcggccgcucuccuccugccccgcggccguccgggccuggucagccgugccgcccuccgaggcugucucucccgggccugucugacgccugucagggcugcgucgccgccucgggauccggccgcuccggcugcugccgcugcccauggcgcgcacccagccuggagcgcgcagccugggagccgggcgggacuggggcgggagcgcggcgggccagauggggcgagggaacagcaagggggauucuggaggagugagcggcggagggugcgauggagagauagggagggaggagagucacgggggaugggagcuaugagaaacggggguagcaggaggagucacggggggcgcggggauggaagagacagagaagcaaggaugaucugggaggcuggaggaaguagaggcugcuaggggagagggggcgcuccucagggggagaaugggaggauggggaaagacuuggaggagaugaagaacgggguggggcagggggagcgccgugagacagggagaaaauggggaaggugauccugggggggaaggagaguaagcgggaugaagagagggugggagugacucccugggagacucucagggugcggcgggggugugggaaguuugggguaggguggcacugcagggaggugcaacaggguuaguauuguauggaagggagccuuaaagggugcagaguggauagacugguggaagggaagucagggcgaaagaaucaucuuggagaaguuugggggaggcccauggagcacgggugggagucaugcugggagcaaggggagcaaggcaccggcugaaaagagcuggggggugaaagacagaagaaugcuugaagcagagccggaugccagggaaggggaagaucaggagucgggguuggagacuagcacugucggaaaggaggucguuggggcuucagguacaggucugagagagcagagacaaggugagaggaggagggagacagaaaaggagagccggagaugugugugugagugugagagagagagaauguccaagggaggggagagcuucaggguggccagccggagugagagguugagaggcguguaccagaggcccugggcagggcacacugaagggcgugucccuggacagggacucgaggguagaggagaagacucuggagugggcgugugacuuccugggagggaaggaugcgcagaauuuggggugguuagauuguggaagauugcgaccccccggcccggacagggugaauuuagaggucgaaagacgaccuuccucuucaccaucuuucugaccuccgauuggaguuccucuggccgcuucaccgcaggcucuggcuuccuuuucuccagguauagaucugguuacuaaagcugucaccacugagguuucuacaggacuggggcgacccuggcuuggcuagauuugugcuuuuacgggacaauuucuggaggcuuaccauaggcuaauucuuugccugcuucccuuccagcacuuuccagggcagggugauuuaaauac

SEQ ID NO: 10610 - RNA, 2501 nt, Mus musculus
guauuuaaaucacccugcccuggaaagugcuggaagggaagcaggcaaagaauuagccuaugguaagccuccagaaauugucccguaaaagcacaaaucuagccaagccagggucgccccaguccuguagaaaccucaguggugacagcuuuaguaaccagaucuauaccuggagaaaaggaagccagagccugcggugaagcggccagaggaacuccaaucggaggucagaaagauggugaagaggaaggucgucuuucgaccucuaaauucacccuguccgggccggggggucgcaaucuuccacaaucuaaccaccccaaauucugcgcauccuucccucccaggaagucacacgcccacuccagagucuucuccucuacccucgagucccuguccagggacacgcccuucagugugcccugcccagggccucugguacacgccucucaaccucucacuccggcuggccacccugaagcucuccccucccuuggacauucucucucucucacacucacacacacaucuccggcucuccuuuucugucucccuccuccucucaccuugucucugcucucucagaccuguaccugaagccccaacgaccuccuuuccgacagugcuagucuccaaccccgacuccugaucuuccccuucccuggcauccggcucugcuucaagcauucuucugucuuucaccccccagcucuuuucagccggugccuugcuccccuugcucccagcaugacucccacccgugcuccaugggccucccccaaacuucuccaagaugauucuuucgcccugacuucccuuccaccagucuauccacucugcacccuuuaaggcucccuuccauacaauacuaacccuguugcaccucccugcagugccacccuaccccaaacuucccacacccccgccgcacccugagagucucccagggagucacucccacccucucuucaucccgcuuacucuccuucccccccaggaucaccuuccccauuuucucccugucucacggcgcucccccugccccaccccguucuucaucuccuccaagucuuuccccauccucccauucucccccugaggagcgcccccucuccccuagcagccucuacuuccuccagccucccagaucauccuugcuucucugucucuuccauccccgcgccccccgugacuccuccugcuacccccguuucucauagcucccaucccccgugacucuccucccucccuaucucuccaucgcacccuccgccgcucacuccuccagaaucccccuugcuguucccucgccccaucuggcccgccgcgcucccgccccagucccgcccggcucccaggcugcgcgcuccaggcugggugcgcgccaugggcagcggcagcagccggagcggccggaucccgaggcggcgacgcagcccugacaggcgucagacaggcccgggagagacagccucggagggcggcacggcugaccaggcccggacggccgcggggcaggaggagagcggccgcgacccccgacccgcgacgcccuccgguggccgggaggagacccuacgccugcuggaucaguugcuggccgagucggaggccugggggccccaggagcugaccccacgaggccccgcccggcucgcacccgcggugaguaugggggccaggcccuccacccaucccucugcaucccuaguauccucccacccaggccuccgucccuacuuggcgccucuguccccagcucacccagaguggccccccacccccgccccagucccuuauaggguuuugugucccuuccuuauccccacucuugcauauucuaacucugccuccugggugggugcccgcuacugucucuguuaaaggagacaaaugcaaacaacaguuggcagaaacaccuagaacuuucuucugacucagggcuugcauuccuuuaccaguggggcugcacggagucgaguugcagcauccuuacagcccaggugggaauugaccagcaagggccucugcuuuggccaucagggaauacgcugggaggaggcgauaaguggguggaccaccugccaaacagugguuggaaaaacgcccugcagcgucggacacauccggaucuuuggcuggccaggcaauucccauaguacaagcuauuuuuaagaugcuuugagucuuuuagcuuccuuauucucucuugcugaacacuuguaauaacaccccccgcuguucuagaaaaacauaucuuugcuggguuggcacugguuugcugcuaaaaaucagaacgggucuuagcugcuccuggcuggaagaggaggccaaagacagaggagccagaguuuucuacaggccggcagagguaguuggaaugccuucuugggcccagguaccaggcaagcaucauggaaaggccacugggaugaugggaagcccuggguauagaacucucucuguccagucccuucuuuccauugcccagucgaaguuua

SEQ ID NO: 10611 - RNA, 2501 nt, Mus musculus
guugcugugccucaguuucucaaguaggaacgaggaaaacuagagauagauguuuugugugggaacaguggugggcacggaggcaaaagaggcagugccgcgaaagcucacuuccuagaacacaacaaaauuuguaaguauucaaaaaagguauuacuagcaacaaaacccuuggauacagggagaaaggaugauaaagggaugugggguaacuuuguugugguacugcaguuuuaaaagcagaaucagggauccaaucucugucccaagcgacaccucugcaccucuaggagccccccacaguggagucugugugcacugguccugcaguccaaggaggcccugcugcaccuccgagaagggucgcuagguucagacaccaaggcccuggugauugcccagcccccgcccucugcgaagcuaagagggggcggagccacgcgcaugugcacagcuggcgccccccuccccgccccccgcgcacagcugggacgugggccggggaccggagggcucaguugggagccggcgguggacgcgcccgccgaggccuccuccgcugcuguucacgcgugccagcuccuguccgcgccaucugccauggccgugcgccccacgcgccgcugccugcuggcgcuccugcugugcuuugccuggugggccauggcgguggucgccucgaagcaaggggcaggcuguccaagccgcugccuguguuuccguaccaccgugcgcugcaugcaucuguugcuggaggccgugcccgccguggcgccgcagaccuccauccugugagugcggcccggagggcgcuggggucugcgggacgugcgauucagggggaucgaggggcguggguaucuuggggggcagggguacugguuuggagaggugggcuaccccggcguccggcgcagggugugcugggccuuuuguccguccuggcuaggacgccaggggcggaccugagcgcuuagcgcgcggccuggggagccgccuuuguucaaacucggaaucucccgcuggaccgggaaguaguagggagucgccagggaaagccccgcgcgucucucgagcccuccccgccuggccuucccuccggugucuucucaacuuucucuccacucgggguuccucucccucucucuucucuaaagcgcaggccugggguugggucgucccuccuccgaccccuucuuucuccaucaguguaccugccccccuuucuccuccuucuggaaggaugcccaccccacaucacccugcgccaaggaaaccucuugcagauucugggucccgcggcgccacagcgccaaguguacucccaucggcuucugcgcuggagccuucaaguucgcuggguguccugaggacucuguugggcgcagcccuuguaaggagcuuuuucuuugcuuggaagaagcuuggcguuccaggugccauggagggcccaccaucgugcggguggccaaguucugagcagcucugggacucuccucuugcuguuucuacucaguuggucaguuucgcagacguccuccacuuccuggcuuuuucaccuggaguugugcuuugcgccuucaccgaaagcccccagaucugaaggaaucccagugcugcagaguuggcugcaggccucuguguguucugagauuugguucugugaaggaaggcaugcguuuaggggccaacuguaauucaggguccugcagcugcacuucugcauuccaaaaagaguuuucacuuuuuuguggcugggcuggaggacuuuggcaucucugaggaugccugcgaaaguuauaaaaaucugagggaacuauucaaggagugggcggucggucagggcucucacuucuaaaagugcauggguguccuacuuccucugggggagauugugcgggccgcacgcggccagucuggggugggaaugccuagccuaguccucuagagagcuaaauaaggcuuccauuccagaggguguggauggucagccaaggcugcaucugagaggacagacagugugcuuuaaaccaauaaacuuuuuaaacugggccagaguggaacgucuccaaauacagagaauuucuguagugacucaauggccaaaacuuggacccuagagucauuucucacaucugggcaaagucagauucucagacuguucccaauucuuaguugcuuucugcagcaguguuuuuacaugagugcuguagaacccagcaggaguccccccacucugccuuguaugcuaccaugccacauaaaaauuuaguguguguguggaggggugggggggcgggggcaagcuuagugguuaaagaggucugcagcaaagcuugacaaccugagucuuaaggcccacaugguggaaagagagaccugacuccugccugcaaauugcccucugacuuccagaugcaugccacaugccccucccucccuccuuccuccccucccucauauacaggaauaaacuuuuuaaaaaguaauuuaaaaaauua

SEQ ID NO: 10612 - RNA, 2501 nt, Mus musculus
uaauuuuuuaaauuacuuuuuaaaaaguuuauuccuguauaugagggaggggaggaaggagggagggaggggcauguggcaugcaucuggaagucagagggcaauuugcaggcaggagucaggucucucuuuccaccaugugggccuuaagacucagguugucaagcuuugcugcagaccucuuuaaccacuaagcuugcccccgcccccccaccccuccacacacacacuaaauuuuuauguggcaugguagcauacaaggcagaguggggggacuccugcuggguucuacagcacucauguaaaaacacugcugcagaaagcaacuaagaauugggaacagucugagaaucugacuuugcccagaugugagaaaugacucuaggguccaaguuuuggccauugagucacuacagaaauucucuguauuuggagacguuccacucuggcccaguuuaaaaaguuuauugguuuaaagcacacugucuguccucucagaugcagccuuggcugaccauccacacccucuggaauggaagccuuauuuagcucucuagaggacuaggcuaggcauucccaccccagacuggccgcgugcggcccgcacaaucucccccagaggaaguaggacacccaugcacuuuuagaagugagagcccugaccgaccgcccacuccuugaauaguucccucagauuuuuauaacuuucgcaggcauccucagagaugccaaaguccuccagcccagccacaaaaaagugaaaacucuuuuuggaaugcagaagugcagcugcaggacccugaauuacaguuggccccuaaacgcaugccuuccuucacagaaccaaaucucagaacacacagaggccugcagccaacucugcagcacugggauuccuucagaucugggggcuuucggugaaggcgcaaagcacaacuccaggugaaaaagccaggaaguggaggacgucugcgaaacugaccaacugaguagaaacagcaagaggagagucccagagcugcucagaacuuggccacccgcacgauggugggcccuccauggcaccuggaacgccaagcuucuuccaagcaaagaaaaagcuccuuacaagggcugcgcccaacagaguccucaggacacccagcgaacuugaaggcuccagcgcagaagccgaugggaguacacuuggcgcuguggcgccgcgggacccagaaucugcaagagguuuccuuggcgcagggugauguggggugggcauccuuccagaaggaggagaaaggggggcagguacacugauggagaaagaaggggucggaggagggacgacccaaccccaggccugcgcuuuagagaagagagagggagaggaaccccgaguggagagaaaguugagaagacaccggagggaaggccaggcggggagggcucgagagacgcgcggggcuuucccuggcgacucccuacuacuucccgguccagcgggagauuccgaguuugaacaaaggcggcuccccaggccgcgcgcuaagcgcucagguccgccccuggcguccuagccaggacggacaaaaggcccagcacacccugcgccggacgccgggguagcccaccucuccaaaccaguaccccugccccccaagauacccacgccccucgaucccccugaaucgcacgucccgcagaccccagcgcccuccgggccgcacucacaggauggaggucugcggcgccacggcgggcacggccuccagcaacagaugcaugcagcgcacggugguacggaaacacaggcagcggcuuggacagccugccccuugcuucgaggcgaccaccgccauggcccaccaggcaaagcacagcaggagcgccagcaggcagcggcgcguggggcgcacggccauggcagauggcgcggacaggagcuggcacgcgugaacagcagcggaggaggccucggcgggcgcguccaccgccggcucccaacugagcccuccgguccccggcccacgucccagcugugcgcggggggcggggaggggggcgccagcugugcacaugcgcguggcuccgcccccucuuagcuucgcagagggcgggggcugggcaaucaccagggccuuggugucugaaccuagcgacccuucucggaggugcagcagggccuccuuggacugcaggaccagugcacacagacuccacuguggggggcuccuagaggugcagaggugucgcuugggacagagauuggaucccugauucugcuuuuaaaacugcaguaccacaacaaaguuaccccacaucccuuuaucauccuuucucccuguauccaaggguuuuguugcuaguaauaccuuuuuugaauacuuacaaauuuuguuguguucuaggaagugagcuuucgcggcacugccucuuuugccuccgugcccaccacuguucccacacaaaacaucuaucucuaguuuuccucguuccuacuugagaaacugaggcacagcaac

SEQ ID NO: 10613 - RNA, 2501 nt, Mus musculus
gagucgugguguaaggaugcuuauaggagcucaaguuccuaagagccagacagguugacccuuuuucuaagggcuuaaccuagcucaccucccucuagcgcuaguugccagaguuccuagccuugggcacauuucgugacucacuucuuauaaacguaaauguauaaguccgcgguagguccuaccggcccccuuugccggccgaucuacacaccuaccuccgggaccagccccgacgcaucccuccccagcuugcuccacuugggaagcgcgcccagaaacggacccgccagcccacgcugggaacucaaguaccaaugcccuacagcuucagcagacgcugccuuaaaacaaaagaggcgccuggggaggugggaccuggaccucaacccccaccccuagccaacuugcuguccuccgcccccuccgcccccgcucuccaugugcgcaugagcagagacgccucccucgguuccucccuaggcgaaacuuucuaauucccuucuuugggccggugggcugccaggagcggguugagcgcucgcccagccgggugaggagaacaaaguaguuaagcgacuugacccccuuccugggcccagcccccgcuuccgugggagcggcaggaaauggaagggccccucuccucucucccaacauuugccuuuucuccccgcuaccucuccagaaaggaagacccgaagaaaagacaggcagcuugccugcugcguccuccuucccgugccgcguccccucgucugcgaggacuggacauggggcugcuccagguguucgccuuugguguccuagguaacucaguaaggguuggggggaggggugugcuccggcauuagggaagaaaacccccaaaccgguuugcccccgcuuugaaggcaguuuugggggaucgggggagagagagugguuggaaaugacgccgugagaucgccaccgcucucgcuucggugguggccagggaccgcgcacgcggagcuccgcggacccgcauccacuggguucugcgcacagagcucgcgcuccugcagguuuccgaggugaucgcuccagggcuuugcaccuuuuaccaguuaaacgcuguuuccccacugcggaaggcaggcucccugcuguggcugggcagacugcggaggguccuggaaaaaccaauuacgcacaaaagugucggggcccagagcaggcuucgacuugggaacagauuggagccauguggcuuuaauuaaccauccuuguuugucucgggguggcaccaugaacaguugggccgggugcuuugcuggaauggcgaagcguugaagccacuacagagacacaccagucgucucuagcucagggcuucuguggcaaacgcggugccucacccggcgcaaucgccggugacccuggcgcgugcacgcggacauauuuuugugccccccccccgcccccagacuaaccacacucacaccgaggaugcgcgcacugccaugugcacgcggguuuucauuagcgggugugcagcgcuuggcagggucaaccucacugcgcccugguccaggcacuucgaagugaccggaucacucuguccaccuuucauagagggguagaucagaguagacaaaaaagucaguuguauuuucugggugcugcgcucagcugacugcuagucaaaccuaaugacgauucugagucuuuuuuuuuucuuucauccuucugucuuuuccuugucccagcuuuccaggccuuuucugcgccuaucucuccaccguguuuuuucuauguagucuccuuucuuuuuaauccucucugucugccccuccugcuguuuucuuuugcccuggcuugucgguugcuuuuuuuuuuuuucuuucuuccuaaccuuguugcuuuucuuuucuguagcccuauggggcacccgagugugcgcucaggaaccggaguucagcuauggcugcgcagaaggcagcugcuacccugccacuggcgaccuucucaucggccgagcgcaaaagcucuccgugacuucgacauguggacugcacaaaccagagcccuacuguauuguuagccaccugcagguaagacacgagucuagagaaugcauugugggcugcauccuccuccuggccgaucaaaggggcuugcccaggagacuccacauccugcugucaauccagauaggaaguacaaccagcagaggagccccgggaugaagccaguagcucagucccaaucuccauuugcacagucgcacccgccaaacauuuccugccaccuaacaccaccaucaguaggagaagcccggggcugcagaugagcuuagccucuguccugugcccuguacgguccccuguauuuuauucuguuguuauuuauacuguuugaucaaacccuuuugaaauuguguauuguagaugguucaguucucuucuugcauuguugguguuggguuuccaucuuuggcuugaguauaaggacgccccaagcgcugaagucuuuucgag

SEQ ID NO: 10614 - RNA, 2501 nt, Mus musculus
cucgaaaagacuucagcgcuuggggcguccuuauacucaagccaaagauggaaacccaacaccaacaaugcaagaagagaacugaaccaucuacaauacacaauuucaaaaggguuugaucaaacaguauaaauaacaacagaauaaaauacaggggaccguacagggcacaggacagaggcuaagcucaucugcagccccgggcuucuccuacugauggugguguuagguggcaggaaauguuuggcgggugcgacugugcaaauggagauugggacugagcuacuggcuucaucccggggcuccucugcugguuguacuuccuaucuggauugacagcaggauguggagucuccugggcaagccccuuugaucggccaggaggaggaugcagcccacaaugcauucucuagacucgugucuuaccugcagguggcuaacaauacaguagggcucugguuugugcaguccacaugucgaagucacggagagcuuuugcgcucggccgaugagaaggucgccaguggcaggguagcagcugccuucugcgcagccauagcugaacuccgguuccugagcgcacacucgggugccccauagggcuacagaaaagaaaagcaacaagguuaggaagaaagaaaaaaaaaaaaagcaaccgacaagccagggcaaaagaaaacagcaggaggggcagacagagaggauuaaaaagaaaggagacuacauagaaaaaacacgguggagagauaggcgcagaaaaggccuggaaagcugggacaaggaaaagacagaaggaugaaagaaaaaaaaaagacucagaaucgucauuagguuugacuagcagucagcugagcgcagcacccagaaaauacaacugacuuuuuugucuacucugaucuaccccucuaugaaagguggacagagugauccggucacuucgaagugccuggaccagggcgcagugagguugacccugccaagcgcugcacacccgcuaaugaaaacccgcgugcacauggcagugcgcgcauccucggugugagugugguuagucugggggcggggggggggcacaaaaauauguccgcgugcacgcgccagggucaccggcgauugcgccgggugaggcaccgcguuugccacagaagcccugagcuagagacgacuggugugucucuguaguggcuucaacgcuucgccauuccagcaaagcacccggcccaacuguucauggugccaccccgagacaaacaaggaugguuaauuaaagccacauggcuccaaucuguucccaagucgaagccugcucugggccccgacacuuuugugcguaauugguuuuuccaggacccuccgcagucugcccagccacagcagggagccugccuuccgcaguggggaaacagcguuuaacugguaaaaggugcaaagcccuggagcgaucaccucggaaaccugcaggagcgcgagcucugugcgcagaacccaguggaugcggguccgcggagcuccgcgugcgcggucccuggccaccaccgaagcgagagcgguggcgaucucacggcgucauuuccaaccacucucucucccccgaucccccaaaacugccuucaaagcgggggcaaaccgguuuggggguuuucuucccuaaugccggagcacaccccuccccccaacccuuacugaguuaccuaggacaccaaaggcgaacaccuggagcagccccauguccaguccucgcagacgaggggacgcggcacgggaaggaggacgcagcaggcaagcugccugucuuuucuucgggucuuccuuucuggagagguagcggggagaaaaggcaaauguugggagagaggagaggggcccuuccauuuccugccgcucccacggaagcgggggcugggcccaggaagggggucaagucgcuuaacuacuuuguucuccucacccggcugggcgagcgcucaacccgcuccuggcagcccaccggcccaaagaagggaauuagaaaguuucgccuagggaggaaccgagggaggcgucucugcucaugcgcacauggagagcgggggcggagggggcggaggacagcaaguuggcuagggguggggguugagguccaggucccaccuccccaggcgccucuuuuguuuuaaggcagcgucugcugaagcuguagggcauugguacuugaguucccagcgugggcuggcggguccguuucugggcgcgcuucccaaguggagcaagcuggggagggaugcgucggggcuggucccggagguagguguguagaucggccggcaaagggggccgguaggaccuaccgcggacuuauacauuuacguuuauaagaagugagucacgaaaugugcccaaggcuaggaacucuggcaacuagcgcuagagggaggugagcuagguuaagcccuuagaaaaagggucaaccugucuggcucuuaggaacuugagcuccuauaagcauccuuacaccacgacuc

SEQ ID NO: 10615 - RNA, 2501 nt, Mus musculus
cccaaagggcccggagaacuccgagggaucccaggcgggaugggacaucacccagagcgucgaagccgcuugccacuacugcugucacagccacuuggggagggggagacugcaacagcgacccagacaguccccuguuugcggugcugugcucgggugcgggggcgcugggcgcgcucuggcgcggaaggaaaucgccccgcguccuccccgaagcggagggggagagcugggggggggagagggaggggagaggcgggcgcaggggcuggccgcucgggccaggucgguuuugaaugguucgcaggacgaauuguuagaccccgagcaaggggggagggggcgagggaggggggcuggaaagaggaaacuuuccuauaaaacuucgaaaagucccuccuccccacgucaggccaaugacaccgcugcccccaaacuuuccgcccgcacggagguauaagagccgccaaguccacagcccgcgcccaacucucagacaccucgcgggcucgccagcaccggcaccggcugcgccaggccggaacggggcgcgcuugcggccgucgggcgccuucuuuuuggaccucggggcccuccacaccguccccucccccgcccgccucccuccccgccuccagcgcccuccccgcggagguccccccacccccaucccgccucccugcguccuccgggccgcaccgcccgggccggcgccgagcgcggggaagcuggcgggcuagggcgccccgcuccucugcucuacccucccccgucccggcuccgcgaggccgcacgucgccgcccgcgagaugaugcaggacguguccagcucgccagucucuccggccgacgacagccugagcaacagcgaggaggagccggaccggcagcagccggcgagcggcaagcgcggggcucgcaagagacgcagcagucggcgcagcgcgggcggcagcgcggggcccggcggggccacgggcgggggcaucggaggcggcgacgagccaggcagcccggcccagggcaagcgcggcaagaaaucugcgggcggaggcggcggcggcggcgcgggcggaggugguggcggcggcggcggcagcagcagcgggggcgggagcccgcagucguacgaggagcugcagacccagcgggucauggcuaacgugcgggagcgccagcgcacgcagucgcugaacgaggcguucgccgcccugcgcaagaucauccccacgcugcccucggacaagcugagcaagauucagacccucaaacuggcggccagguacaucgacuuccuguaccagguccugcagagcgacgagcuggacuccaagauggcaagcugcagcuauguggcccacgagcggcucagcuacgccuucuccgucuggaggauggagggggccugguccauguccgcgucccacuagcagcggagcuccccacccccucugcaggccggagaccuagguaaggaccggcuccagggaucgaucgggccaggccgcggguccccuguucaccucgccaccgugcuggguaucccccccccaucccccuccacucuccucgcugcccuccaccuagccaggcaccgccaccucauuccacccgcaucccuggcaagcaguucaguccccacaggggaaacagguccuagggucggggagaaccagugugcccaggagagguguaugugugugugcgcgugcgggggugugcaugacagaagauugagaaagucaagcauaggggccuugugcccaaaacgccaucccccaaaccccuuucuuucuucuuuaaaauucccuucuuaaaacaacuguuuccaaauuccacccccuccuuuccgcccacccacuuccucuugcccuugggcugaaauccuuccagguuguucagcgaaaauucucgcugguagugauaacagggcuuagcggucauagaaaacagccacagagacauccucaauaaccgacuuuccccucuggguuuuugcagaugucauuguuuccagagaaggagaaaauggacagucuagagacucuggagcuggauaacuaaaaauaaaucuauaugacaaagauuuucauggaaauuagaagagcagagaccaaauucacaagaaucagggcguggggcacacuuuuaaaagagaaagcgagacaggcccguggacagagauucccagaggggcagcagcagaccccccacaccucugcauucugauagaagucugaacacucguuuguguccccccaccccacuuuuugacgaagaauguuuuauuuuuauuuuucaugcaugcauucucaagaggucuugccaaucagccacugacaggaaaggcaucccuguggacuggcuccauuuuaaaaugguaacaaucagaggaauuuuaacaccuuuagaaauaaaaacgcugggaucaaacuggccugcaaaaucauagucagugaauuccuuaaaaaccauacuuccucugaaggaaaagaaaaaca

SEQ ID NO: 10616 - RNA, 2501 nt, Mus musculus
uguuuuucuuuuccuucagaggaaguaugguuuuuaaggaauucacugacuaugauuuugcaggccaguuugaucccagcguuuuuauuucuaaagguguuaaaauuccucugauuguuaccauuuuaaaauggagccaguccacagggaugccuuuccugucaguggcugauuggcaagaccucuugagaaugcaugcaugaaaaauaaaaauaaaacauucuucgucaaaaagugggguggggggacacaaacgaguguucagacuucuaucagaaugcagagguguggggggucugcugcugccccucugggaaucucuguccacgggccugucucgcuuucucuuuuaaaagugugccccacgcccugauucuugugaauuuggucucugcucuucuaauuuccaugaaaaucuuugucauauagauuuauuuuuaguuauccagcuccagagucucuagacuguccauuuucuccuucucuggaaacaaugacaucugcaaaaacccagaggggaaagucgguuauugaggaugucucuguggcuguuuucuaugaccgcuaagcccuguuaucacuaccagcgagaauuuucgcugaacaaccuggaaggauuucagcccaagggcaagaggaagugggugggcggaaaggaggggguggaauuuggaaacaguuguuuuaagaagggaauuuuaaagaagaaagaaagggguuugggggauggcguuuugggcacaaggccccuaugcuugacuuucucaaucuucugucaugcacacccccgcacgcgcacacacacauacaccucuccugggcacacugguucuccccgacccuaggaccuguuuccccuguggggacugaacugcuugccagggaugcggguggaaugagguggcggugccuggcuagguggagggcagcgaggagaguggagggggaugggggggggauacccagcacgguggcgaggugaacaggggacccgcggccuggcccgaucgaucccuggagccgguccuuaccuaggucuccggccugcagaggggguggggagcuccgcugcuagugggacgcggacauggaccaggcccccuccauccuccagacggagaaggcguagcugagccgcucgugggccacauagcugcagcuugccaucuuggaguccagcucgucgcucugcaggaccugguacaggaagucgauguaccuggccgccaguuugagggucugaaucuugcucagcuuguccgagggcagcguggggaugaucuugcgcagggcggcgaacgccucguucagcgacugcgugcgcuggcgcucccgcacguuagccaugacccgcugggucugcagcuccucguacgacugcgggcucccgcccccgcugcugcugccgccgccgccgccaccaccuccgcccgcgccgccgccgccgccuccgcccgcagauuucuugccgcgcuugcccugggccgggcugccuggcucgucgccgccuccgaugcccccgcccguggccccgccgggccccgcgcugccgcccgcgcugcgccgacugcugcgucucuugcgagccccgcgcuugccgcucgccggcugcugccgguccggcuccuccucgcuguugcucaggcugucgucggccggagagacuggcgagcuggacacguccugcaucaucucgcgggcggcgacgugcggccucgcggagccgggacgggggaggguagagcagaggagcggggcgcccuagcccgccagcuuccccgcgcucggcgccggcccgggcggugcggcccggaggacgcagggaggcgggauggggguggggggaccuccgcggggagggcgcuggaggcggggagggaggcgggcgggggaggggacgguguggagggccccgagguccaaaaagaaggcgcccgacggccgcaagcgcgccccguuccggccuggcgcagccggugccggugcuggcgagcccgcgaggugucugagaguugggcgcgggcuguggacuuggcggcucuuauaccuccgugcgggcggaaaguuugggggcagcggugucauuggccugacguggggaggagggacuuuucgaaguuuuauaggaaaguuuccucuuuccagccccccucccucgcccccuccccccuugcucggggucuaacaauucguccugcgaaccauucaaaaccgaccuggcccgagcggccagccccugcgcccgccucuccccucccucucccccccccagcucucccccuccgcuucggggaggacgcggggcgauuuccuuccgcgccagagcgcgcccagcgcccccgcacccgagcacagcaccgcaaacaggggacugucugggucgcuguugcagucucccccuccccaaguggcugugacagcaguaguggcaagcggcuucgacgcucugggugaugucccaucccgccugggaucccucggaguucuccgggcccuuuggg

SEQ ID NO: 10617 - RNA, 2501 nt, Mus musculus
ccgcggccgguggggccgccuggcccugucuguacgcugcgagcggagccccgaggccgccgcccuccaugcccacuuucuuguagcuuuccuccaggggacucaagaugucagacacugagaacggagucgugugcuuuggacucaucgacaugauucggcgucggcuggaggaggaaggaagaggaggaaaaaaaaaagggagagggggaaggcgaagccucgcuacuuuuuuuuucucccuuugccaaauauucugguguuaccuuaacgccgaucuuguuggauguacacguaacggaguggaccgaguccgccuuaauuggcuugaguggaggcucgggggcugccucgcguuuguuuuagcccggcgccagguuuuaggcagccaccagaggcggggcauaagcgcuaaagcaacaagacaauagaagccuacaucuugcccgagauaauuagcuuacaugcugaugacaagguaaacaccuuuaagcuucacuugucaagauuuuuaggucucaaagagagaaagaaggagagagggagagagagagagagagagagagagagagagagagagagagagagagagaaccaaagcauuacuuucccccucccuuggacacccccacccccauuuuuguggggugccuguggcgcgcgaggaaaaggcgggggggggggaaggaggagggaaccgagagcgggagggccagaggugggguagagaauaaccuaaggggagggauggaaaggagaacggaaggugaauacugcuuugcaaccaacuuggggaguuacaaaguggaaccgcgguccaauuuggucgggguuccgaggucaggggcuggccuuugggggagaagggggcugaggagcagggagcgggauuucaccugagccugccggggcugcuccucccucccgcugcggccucccagccccgcgccuucccaccgccuccggaccacaucgggcuucgcugcgcugagccccagucaccaccaaaagagugugcgagucuggggaugaacccuggggcugcacuguuggucuaugugucugucagucugucugcuucuucugccgccgccgucagagggacaccucugcuccccgcccccuuuccccuuacccgagagaaucccagcgggcggagggggagcugaguaagggaacgacugccuccgggaggcugucaccgauccccgcgccaccccccaccaagcuccuggcucccuagcggaccagcccccccagcccaccccaccccgccgcucccuuucuccaccccuuuugccggcccaggcaaguacaccgcuggcccucugagcuacgaggcuaagggugcgggggauuaacaggagaguccaccacggaaguugccccaucucgaacaaaccuggugccccugacccuugcccauggccuggauacuucggcuucagaagcugaugcugucuuuccgaggacaucccagucccagcaccccagcucagauccccgcaguuuucccuuccgaugcuucagugaaagcccgggcggggagccgcgugagcgcccgcagauccguugcagaguggaacugagucugaacccggguggaacucguuguccgggaggaggcgaauaucucgacgcccgcagcccagcgggcgggaggcugggcugaggcucgccuccucccggagcucagccaugcaaaagugcacuugcuuccccgggaauaaccaaauaucuuugucuaaaguggcggcguaaauggccggucgcuuuguggccacgcuggauauuaguagaugaggaucauucugcuucaauugggcgccucucauccggcuaggaagaaacugcuuaggaggaaguggguuuccugucugagcguucccaggcuucaagugugagccccgcgccuugaggguccuugggcgccuggcaagggggagcugugggcugugcucccuagcgggcccgggggcgucagccucauugcuguuaccaggucaggaucagcagcuaaguggguuacccagccaagcccugcauggcacagauuuggagaccaccuccguuuuuuuuuuuuucuccuuggaauuuaagcguuuucguuauuguuuguuuuuguuuuggcuuugcuugucugcuguucgagcuuucuuggagcgcuagaggcugggagggcggagugcuuccuggcccggcaggugccuccuagacacuucggcggccagucaaggaggcuucuugauuuugguuuuuguuuucacauuuucuuuccccuccuuguagugagggagcucccgauaaugaacaagcaguuuugaacuacuuaauucagcaggguaggcuccuuuccauuaauagcaauuauaguauggaaaguuguuuuauuugcuuuuuaagaucucuccuugaagagugcucucuacucccucaacacaaagccgacgacuaaacuaacauuagcuuuccucaccaccuaccuccaucgugaagggaag

SEQ ID NO: 10618 - RNA, 2501 nt, Mus musculus
cuucccuucacgauggagguagguggugaggaaagcuaauguuaguuuagucgucggcuuuguguugagggaguagagagcacucuucaaggagagaucuuaaaaagcaaauaaaacaacuuuccauacuauaauugcuauuaauggaaaggagccuacccugcugaauuaaguaguucaaaacugcuuguucauuaucgggagcucccucacuacaaggaggggaaagaaaaugugaaaacaaaaaccaaaaucaagaagccuccuugacuggccgccgaagugucuaggaggcaccugccgggccaggaagcacuccgcccucccagccucuagcgcuccaagaaagcucgaacagcagacaagcaaagccaaaacaaaaacaaacaauaacgaaaacgcuuaaauuccaaggagaaaaaaaaaaaaacggagguggucuccaaaucugugccaugcagggcuuggcuggguaacccacuuagcugcugauccugaccugguaacagcaaugaggcugacgcccccgggcccgcuagggagcacagcccacagcucccccuugccaggcgcccaaggacccucaaggcgcggggcucacacuugaagccugggaacgcucagacaggaaacccacuuccuccuaagcaguuucuuccuagccggaugagaggcgcccaauugaagcagaaugauccucaucuacuaauauccagcguggccacaaagcgaccggccauuuacgccgccacuuuagacaaagauauuugguuauucccggggaagcaagugcacuuuugcauggcugagcuccgggaggaggcgagccucagcccagccucccgcccgcugggcugcgggcgucgagauauucgccuccucccggacaacgaguuccacccggguucagacucaguuccacucugcaacggaucugcgggcgcucacgcggcuccccgcccgggcuuucacugaagcaucggaagggaaaacugcggggaucugagcuggggugcugggacugggauguccucggaaagacagcaucagcuucugaagccgaaguauccaggccaugggcaagggucaggggcaccagguuuguucgagauggggcaacuuccgugguggacucuccuguuaaucccccgcacccuuagccucguagcucagagggccagcgguguacuugccugggccggcaaaagggguggagaaagggagcggcgggguggggugggcugggggggcugguccgcuagggagccaggagcuuggugggggguggcgcggggaucggugacagccucccggaggcagucguucccuuacucagcucccccuccgcccgcugggauucucucggguaaggggaaagggggcggggagcagaggugucccucugacggcggcggcagaagaagcagacagacugacagacacauagaccaacagugcagccccaggguucauccccagacucgcacacucuuuugguggugacuggggcucagcgcagcgaagcccgaugugguccggaggcggugggaaggcgcggggcugggaggccgcagcgggagggaggagcagccccggcaggcucaggugaaaucccgcucccugcuccucagcccccuucucccccaaaggccagccccugaccucggaaccccgaccaaauuggaccgcgguuccacuuuguaacuccccaaguugguugcaaagcaguauucaccuuccguucuccuuuccaucccuccccuuagguuauucucuaccccaccucuggcccucccgcucucgguucccuccuccuucccccccccccgccuuuuccucgcgcgccacaggcaccccacaaaaauggggguggggguguccaagggagggggaaaguaaugcuuugguucucucucucucucucucucucucucucucucucucucucucucucucucccucucuccuucuuucucucuuugagaccuaaaaaucuugacaagugaagcuuaaagguguuuaccuugucaucagcauguaagcuaauuaucucgggcaagauguaggcuucuauugucuuguugcuuuagcgcuuaugccccgccucugguggcugccuaaaaccuggcgccgggcuaaaacaaacgcgaggcagcccccgagccuccacucaagccaauuaaggcggacucgguccacuccguuacguguacauccaacaagaucggcguuaagguaacaccagaauauuuggcaaagggagaaaaaaaaaguagcgaggcuucgccuucccccucucccuuuuuuuuuuccuccucuuccuuccuccuccagccgacgccgaaucaugucgaugaguccaaagcacacgacuccguucucagugucugacaucuugaguccccuggaggaaagcuacaagaaagugggcauggagggcggcggccucggggcuccgcucgcagcguacagacagggccaggcggccccaccggccgcgg

SEQ ID NO: 10619 - RNA, 2501 nt, Mus musculus
auaaaaugaaaaaaaaaaaaaagcugcacaccagaacaacgcggugcauacaauuaacuuuagcgugacuuugcauguauagcucuucacgcuauacaaaaccucgcguuaauucuguuaccuguuuguaguccucuggcaauugaaaacuuugguaacacaauucacacacacacacacacacacacacacacacacacacacacacacacacacacccuguaaccgauaguugcugcugcucacaccaaagccuaggcuuuagagcuauaguucggaccaacuuaaaauucccaagugaaacucuacuugcuuucucuuaaugcuauucugcuuccuaauucucagcuuugagauguaagaaagcucuuucuaugggggucuucucuggugggccgaggugauugcaucaaaauuaaacuccugaaaguggucugagcgccuacuaaaaguuaucgguaagcgaaaucuccauccguagcagucgagauaauaacuagguggcuaaaaaacaagaguccugacguauaacugcuuauuugguaaucuaacagaaaauauugacguccuuaaauuuauguucaucagcaaauguaacuccaugugaaacuauaagagaugaauagauuucaaaaagaagacucaaaaaagagaugguucccaaagaaacacagaaacgaauaaauaaaucgccgcgaaggucuuuucggacucuguacuuuucuguacagaucuuaaaguacuuugggauuuauuucuaguccucucuccaagaucgcacgaggcuuucucgguaagcgcuuucgauaacgguaauuacacuuuugaagguaaucggcagcuguuucuagaaaauacuuucaauagguaguggcccugccuguaccugauucuccucgcaaugcuuuugugcacaauguaaaauaaacccagugaacaugccaccaaggggacaaugaagagaaacagguucuuggccccgaguucuggaaaaagauucuguucgcacuagcgccacccagcgguccuagagacgaacgaauagacacuuuucuacaaauggcuuuugaagaauuaaguuuuauaaaauuuagaaaucauucuuuacgaaaaacuccaacuucugcaacagaucauuuuuauccaaagacgucggcuaauuacauggugugaccgagaggccucccgguaagcgagcaccgacucucucaguuauucuuuacucaagccagagcccgccugcccgcccgcggcucccggggcugggcuccagccccggcucucuagcgggcaaagacaagugcuucccuuccggagcccguguuuucaaagcccagaguuucccaaaacucuccgcugguugcaagcgccaggacccagcgggcagcgggcugaucgagaggucgggugggggccacacuggaagccgcgccucgggcgagccgcccccaccccgcccgccccaguccgggcaggagcccaccucgccugagucuccccggacaccgacucuggggacgccccaccgccuccccgccucucaccuccugcguguccgcguaguagcuguuccagucguugcucucaugcccuuccaucuucacagucccuaacauccuggagccagcccggccgacacaaccauccaacccugugcggagcgacgggcgggugcgcugcucggggcgggggaggggcgcggagccgcugcggucaccggagcgcucgagggcccagcgccacccgggcgaggaggaagcccggcgcugcggggcgcggcgugcgcggcggcggcggcgcggcgcggcgggagggggcagcgccggggacaggaggcggccgcggagcgcggcgcccggcagcgccuccgcgggaagugagcgggcggccugugcgaagcgagugcaguugagcugauguggaucuuacgucgccggagugcccaccuccucguccucuccccauuuguccgccgcacaaagacgcucgcaccuacaaagcccgaggugcaccugugaggcggccgcccgccaguccagccgccgcgccucccgccccgccgcgccagcgccgcgcgccccccgcgccccucccgccauccccucccccaaaccuggcccucacuuuguuuacaaagcaguauaauugguuuaagccucgcggcuagggaaagaggaaaauagggcgggugugugugugacccccuuuggaaaaggaaaaaaagagaaagaaaagaaaaggaaaaaaaagaagaaaaggaaaaauaggcggugccuuggaggacaggccagggcucuggacccaaagagcugugcugcgggagaaggaccugggugguggcaucagagcuacagcgcaaggaucgugcucgcugaaugaccccgaguucccuccuagaggugcucaccacccccuggaccuuacuacgacuccgcucuugguccacuuggcuccuuugcuccccucauccugauucuugacccaaaguucaacccuggaag

SEQ ID NO: 10620 - RNA, 2501 nt, Mus musculus
cuuccaggguugaacuuugggucaagaaucaggaugaggggagcaaaggagccaaguggaccaagagcggagucguaguaagguccaggggguggugagcaccucuaggagggaacucggggucauucagcgagcacgauccuugcgcuguagcucugaugccaccacccagguccuucucccgcagcacagcucuuuggguccagagcccuggccuguccuccaaggcaccgccuauuuuuccuuuucuucuuuuuuuuccuuuucuuuucuuucucuuuuuuuccuuuuccaaagggggucacacacacacccgcccuauuuuccucuuucccuagccgcgaggcuuaaaccaauuauacugcuuuguaaacaaagugagggccagguuugggggaggggauggcgggaggggcgcggggggcgcgcggcgcuggcgcggcggggcgggaggcgcggcggcuggacuggcgggcggccgccucacaggugcaccucgggcuuuguaggugcgagcgucuuugugcggcggacaaauggggagaggacgaggaggugggcacuccggcgacguaagauccacaucagcucaacugcacucgcuucgcacaggccgcccgcucacuucccgcggaggcgcugccgggcgccgcgcuccgcggccgccuccuguccccggcgcugcccccucccgccgcgccgcgccgccgccgccgcgcacgccgcgccccgcagcgccgggcuuccuccucgcccggguggcgcugggcccucgagcgcuccggugaccgcagcggcuccgcgccccucccccgccccgagcagcgcacccgcccgucgcuccgcacaggguuggaugguugugucggccgggcuggcuccaggauguuagggacugugaagauggaagggcaugagagcaacgacuggaacagcuacuacgcggacacgcaggaggugagaggcggggaggcgguggggcguccccagagucgguguccggggagacucaggcgaggugggcuccugcccggacuggggcgggcggggugggggcggcucgcccgaggcgcggcuuccaguguggcccccacccgaccucucgaucagcccgcugcccgcuggguccuggcgcuugcaaccagcggagaguuuugggaaacucugggcuuugaaaacacgggcuccggaagggaagcacuugucuuugcccgcuagagagccggggcuggagcccagccccgggagccgcgggcgggcaggcgggcucuggcuugaguaaagaauaacugagagagucggugcucgcuuaccgggaggccucucggucacaccauguaauuagccgacgucuuuggauaaaaaugaucuguugcagaaguuggaguuuuucguaaagaaugauuucuaaauuuuauaaaacuuaauucuucaaaagccauuuguagaaaagugucuauucguucgucucuaggaccgcuggguggcgcuagugcgaacagaaucuuuuuccagaacucggggccaagaaccuguuucucuucauuguccccuugguggcauguucacuggguuuauuuuacauugugcacaaaagcauugcgaggagaaucagguacaggcagggccacuaccuauugaaaguauuuucuagaaacagcugccgauuaccuucaaaaguguaauuaccguuaucgaaagcgcuuaccgagaaagccucgugcgaucuuggagagaggacuagaaauaaaucccaaaguacuuuaagaucuguacagaaaaguacagaguccgaaaagaccuucgcggcgauuuauuuauucguuucuguguuucuuugggaaccaucucuuuuuugagucuucuuuuugaaaucuauucaucucuuauaguuucacauggaguuacauuugcugaugaacauaaauuuaaggacgucaauauuuucuguuagauuaccaaauaagcaguuauacgucaggacucuuguuuuuuagccaccuaguuauuaucucgacugcuacggauggagauuucgcuuaccgauaacuuuuaguaggcgcucagaccacuuucaggaguuuaauuuugaugcaaucaccucggcccaccagagaagacccccauagaaagagcuuucuuacaucucaaagcugagaauuaggaagcagaauagcauuaagagaaagcaaguagaguuucacuugggaauuuuaaguugguccgaacuauagcucuaaagccuaggcuuuggugugagcagcagcaacuaucgguuacagggugugugugugugugugugugugugugugugugugugugugugugugugugugaauuguguuaccaaaguuuucaauugccagaggacuacaaacagguaacagaauuaacgcgagguuuuguauagcgugaagagcuauacaugcaaagucacgcuaaaguuaauuguaugcaccgcguuguucuggugugcagcuuuuuuuuuuuuuucauuuuau

SEQ ID NO: 10621 - RNA, 2501 nt, Mus musculus
uucgcaguccccgcccuggaaccgccccucacccagccccaguccccgcuacaggaacagcaggggcagggaaggcgagaaccgaucccagccguucuguauucgaugcaaccgcccuagaaggaauucgggccccgggagccgagucaguggcggcacccgacaccgaacgguacagaaacccuuucggaggccagcgccccuuccgugcugccuccgcgcgccccgccccgcgccucccugccacacgcuucggauucugcgcugcucauugggcaucugccccgccaaucugaaagauguuagcgaaucacgcuuuagaaaaggcaaagagaacgggaaagggggcuuucacacuggcuccccuggcgcgagcuuaacgcccccaaagcggcuggaggcacugggcggggcuucauuugcauaacggccgccccuuggucucccugcccaaggcuggcgucaagcgccucacccaacuagauaucaguuggaccaccggcuggucacuccgaccaggcaagccugugggagcgccggacggguuggagcgggcgggcccggggaccgauuggcucugagaguuuccagcaggcagggaggaggggacuauaagaaccagaagccccguagaggucuccgggagacgcuagucgcgcucguggagaguugugagaagcgaccguuggcucaggucccggcuugcgcuugccucuccugacgcuuucguccuaacguugcuuugccuguuuuuucagucaggaugucugcccgcggcccggcuaucggcaucgaccugggcaccacuuacucgugcguggggguauuccaacauggcaagguggagaucaucgccaacgaccaggguaaccgcaccacccccagcuacguggccuucacugacaccgagcgucucaucggcgacgccgccaagaaccaaguggccaugaaccccacaaacaccaucuucgacgccaagcggcugaucggacggaaguucgaggacgccacagugcaguccgauaugaagcacuggccguuccgaguggugagcgaaggugggaagcccaaagugcagguggaauauaaaggggagaugaagaccuucuucccugaggagauuucuuccaugguccucacuaagaugaaggagaucgccgaagccuaccuggggggcaaggugcagagcgcagucaucacuguuccugccuauuucaacgacucgcagcgccaggccaccaaggaugcgggcaccaucaccggccucaacguguugcgcaucaucaaugagcccacagcagcggccaucgccuacggccuggauaagaagggcugugcgggcggcgagaagaacgugcucaucuuugaccugggcgggggcaccuucgauguguccauccugaccaucgaggauggcaucuuugaggugaaguccacggccggcgauacccaccuggguggcgaagacuucgacaaccguauggucagccaccuggcggaggaguucaagcgcaaacacaagaaggacauugggcccaacaagcgcgcugugcgccggcugcgcaccgccugcgagcgcgcuaagcgcacccugagcucguccacgcaggccagcauagagaucgacucgcucuacgagggcguggauuucuacacguccaucacccgcgcccgcuucgaggagcucaacgccgaucucuuccgagggacccuggagccgguggaaaaggcgcugcgcgaugccaagcuagacaagggccagauccaggagauagugcuggugggcggcucaacccgcaucccuaagauccagaagcuccugcaagauuucuucaacggcaaggagcugaacaagagcauuaaucccgacgaggcgguggccuacggcgccgcugugcaggcggcuauccucaucggcgacaagucggaaaaugugcaggaucugcuguuacucgacgugacuccauugucgcucggcaucgaaacagcuggcggugucaugaccccacucaucaagagaaacaccacgauccccaccaagcagacgcagaccuucacuaccuacucagacaaccagagcagcgugcuggugcaaguguacgagggcgaacgggccaugaccaaggacaauaaccucuugggcaaguucgaccugacugggauccccccagcaccccguggggucccccagaucgaggucaccuuugacaucgaugccaacggcauccuuaacgucacugcugccgacaagagcaccgguaaagaaaauaaaaucaccauaaccaacgacaagggucggcugagcaaagacgacauugaccggauggugcaggaggcggagcgguacaaaucggaagaugaagcaaaucgcgaucgcguggcagccaaaaaugcgguggaguccuauaccuacaacaucaagcagaccguggaagacgagaaacugaggggcaagauuagcgagcaggacaaaaacaagauccucgacaagugucaggagg

SEQ ID NO: 10622 - RNA, 2501 nt, Mus musculus
ccuccugacacuugucgaggaucuuguuuuuguccugcucgcuaaucuugccccucaguuucucgucuuccacggucugcuugauguuguagguauaggacuccaccgcauuuuuggcugccacgcgaucgcgauuugcuucaucuuccgauuuguaccgcuccgccuccugcaccauccggucaaugucgucuuugcucagccgacccuugucguugguuauggugauuuuauuuucuuuaccggugcucuugucggcagcagugacguuaaggaugccguuggcaucgaugucaaaggugaccucgaucugggggaccccacggggugcuggggggaucccagucaggucgaacuugcccaagagguuauuguccuuggucauggcccguucgcccucguacacuugcaccagcacgcugcucugguugucugaguagguagugaaggucugcgucugcuugguggggaucgugguguuucucuugaugaguggggucaugacaccgccagcuguuucgaugccgagcgacaauggagucacgucgaguaacagcagauccugcacauuuuccgacuugucgccgaugaggauagccgccugcacagcggcgccguaggccaccgccucgucgggauuaaugcucuuguucagcuccuugccguugaagaaaucuugcaggagcuucuggaucuuagggaugcggguugagccgcccaccagcacuaucuccuggaucuggcccuugucuagcuuggcaucgcgcagcgccuuuuccaccggcuccagggucccucggaagagaucggcguugagcuccucgaagcgggcgcgggugauggacguguagaaauccacgcccucguagagcgagucgaucucuaugcuggccugcguggacgagcucagggugcgcuuagcgcgcucgcaggcggugcgcagccggcgcacagcgcgcuuguugggcccaauguccuucuuguguuugcgcuugaacuccuccgccagguggcugaccauacgguugucgaagucuucgccacccagguggguaucgccggccguggacuucaccucaaagaugccauccucgauggucaggauggacacaucgaaggugcccccgcccaggucaaagaugagcacguucuucucgccgcccgcacagcccuucuuauccaggccguaggcgauggccgcugcugugggcucauugaugaugcgcaacacguugaggccggugauggugcccgcauccuugguggccuggcgcugcgagucguugaaauaggcaggaacagugaugacugcgcucugcaccuugccccccagguaggcuucggcgaucuccuucaucuuagugaggaccauggaagaaaucuccucagggaagaaggucuucaucuccccuuuauauuccaccugcacuuugggcuucccaccuucgcucaccacucggaacggccagugcuucauaucggacugcacuguggcguccucgaacuuccguccgaucagccgcuuggcgucgaagaugguguuugugggguucauggccacuugguucuuggcggcgucgccgaugagacgcucggugucagugaaggccacguagcuggggguggugcgguuacccuggucguuggcgaugaucuccaccuugccauguuggaauacccccacgcacgaguaaguggugcccaggucgaugccgauagccgggccgcgggcagacauccugacugaaaaaacaggcaaagcaacguuaggacgaaagcgucaggagaggcaagcgcaagccgggaccugagccaacggucgcuucucacaacucuccacgagcgcgacuagcgucucccggagaccucuacggggcuucugguucuuauaguccccuccucccugccugcuggaaacucucagagccaaucgguccccgggcccgcccgcuccaacccguccggcgcucccacaggcuugccuggucggagugaccagccggugguccaacugauaucuaguugggugaggcgcuugacgccagccuugggcagggagaccaaggggcggccguuaugcaaaugaagccccgcccagugccuccagccgcuuugggggcguuaagcucgcgccaggggagccagugugaaagcccccuuucccguucucuuugccuuuucuaaagcgugauucgcuaacaucuuucagauuggcggggcagaugcccaaugagcagcgcagaauccgaagcguguggcagggaggcgcggggcggggcgcgcggaggcagcacggaaggggcgcuggccuccgaaaggguuucuguaccguucggugucgggugccgccacugacucggcucccggggcccgaauuccuucuagggcgguugcaucgaauacagaacggcugggaucgguucucgccuucccugccccugcuguuccuguagcggggacuggggcugggugaggggcgguuccagggcggggacugcgaa

SEQ ID NO: 10623 - RNA, 2501 nt, Mus musculus
ccuggcggaagcucgagguggccagcgaagcucccgaaggcucuccccgcuguaggacgacgacgaggccccggacucggagcucagggcaccgucccuccggcgggagagcgaguccagcgaguggcucuuucuaccuguccgagaaccggcgggcggaggccggcuccuggcggggggacugggagaaguccuucgagcaacucgcgaggcgggcgaggccgggaggcugcugcugcugcugcagcugcugcugcugcccccgcucagggccgaggcugaggcugaggcugaggccgaggccggggcugccgccggacccuucggugugaacaggcgccgcuucuccucgcgcaugaugcgcucgcgcucggcgcggcacugcugcaguuuggccaggcgcuccgccucguaggccucguacaggccgguggccacgcgcauggagcggcccggggccucgcgcaccaggucggccagggcccgaggcagcagcuccacgggcuugaccgcgcaucgggcgcaggccuccagagagcgggggcuggucaggacguagcggcugcccucugccucggggcaggcgaaauugaagagaucgaggugcagcaacggagacugcucccgacguccaccuucugccccgcaggggacuucagccuuacggggcgccgccgcggaggcggaggccgaggaggcagccggcugcugggcucccugggcaucggggggcucggacgcuguggccucauccccuucagagccaccgggcuccgcucccucuuucuccucuucuggcaccggguccaccauagcugaaccucguucuuuguuggagucccugagaugacagaggggcggggggacauagaggaucugugagcuguuccucccuccucagccauauuuaccccucccaacuuaauccgauuucagauuaggcucaggggccugauggaacguaaauccuaaaacugaugccccaaaaacucaggcugggcaguugcgguggggggacgcugggccuuagacagcagccucagucucccucagaccuagaaugcagggccuuucaggagaccacauuggcgugaggcccacuagcugcauccccuuccugcaaagauugaagugcaaggaaggcugcagccagcgagggaggcgcuggaggauuccccggaggauuagcuauuuguuuguagcuuaggcgggcugcugggaugcagcuuugcaagaacacaaaaggggaaggggccugugcaugccaaagugcauugcugcgagggccccaguugccuaggaagaaguuuaugguugauuucucucuaccaaaaggacccggagcgcagggcccccgggagauggaagggcugaaaagagucuccaaaggcuucuccgaguggagugauggauucuuucuccagccucuccagcggggcuugcugggagcucucugccuuccucuuccuccagcccccacccgguguuugcucaagaugcacaaggcaccugaauccucccagaugcacccgaucuccaaggccgaauguguaguuaaagguaccaucaaccccaguaugguggacucagacaucagccgcugaugcucaccaguuuccgcaccgcaucucaggggagugggcucuuagagcgccguaaacccugccgcuccauucugggagcugcuaggucuccgagcggguucacuuaccccagguccgggcuccggcccccuugccgagggcuuuuguucgccucucgcugcucuccccggcgccucuucagucccugcgccggcggggucggguuacugccggcugcagcagccagcgucucuccaugggagacuacgaacugggagcacacaucccagacgcuaccuacccgggggagggggagugcgacaaagucucccuaaaauaacguagcucugcucccuugcucacaacugauucuuaaaaaaggaagcuggguucuucccucgccucugcauccaucuccaccucuaccgccaagguaccgcaggucucucgcugcuccuggcgccuccugguggccacuuaaggguauucauuucuuugcuuagaggacgacaaagcaauuaaaaauacaguaacuacacauguaugcauauaaaugaaugcaugcauacauacguaauacagagagauguggacauagcaguuaucaccagaaaucuagucuuugggcaccuuaggcggguacaaugaaggaaucaguauauuucucaaagggaucuuaagcagaccaacaagucagcaaguaauuggguagaaagagggcaccugguccaaauagugauuuuuauuuauuuaaggaaagcuaagaugggagaacgaaugagaacaaagaaugaugccacauuaugaaauugccauuaccuuguuugcucaccuaaauaacuaaaaacagucgacaaaaacacacggguucaggcggcagaacacaagugaccagcggaugcugcuuccgagucgcua

SEQ ID NO: 10624 - RNA, 2501 nt, Mus musculus
uagcgacucggaagcagcauccgcuggucacuuguguucugccgccugaacccguguguuuuugucgacuguuuuuaguuauuuaggugagcaaacaagguaauggcaauuucauaauguggcaucauucuuuguucucauucguucucccaucuuagcuuuccuuaaauaaauaaaaaucacuauuuggaccaggugcccucuuucuacccaauuacuugcugacuuguuggucugcuuaagaucccuuugagaaauauacugauuccuucauuguacccgccuaaggugcccaaagacuagauuucuggugauaacugcuauguccacaucucucuguauuacguauguaugcaugcauucauuuauaugcauacauguguaguuacuguauuuuuaauugcuuugucguccucuaagcaaagaaaugaauacccuuaaguggccaccaggaggcgccaggagcagcgagagaccugcgguaccuuggcgguagagguggagauggaugcagaggcgagggaagaacccagcuuccuuuuuuaagaaucaguugugagcaagggagcagagcuacguuauuuuagggagacuuugucgcacucccccucccccggguagguagcgucugggaugugugcucccaguucguagucucccauggagagacgcuggcugcugcagccggcaguaacccgaccccgccggcgcagggacugaagaggcgccggggagagcagcgagaggcgaacaaaagcccucggcaagggggccggagcccggaccugggguaagugaacccgcucggagaccuagcagcucccagaauggagcggcaggguuuacggcgcucuaagagcccacuccccugagaugcggugcggaaacuggugagcaucagcggcugaugucugaguccaccauacugggguugaugguaccuuuaacuacacauucggccuuggagaucgggugcaucugggaggauucaggugccuugugcaucuugagcaaacaccgggugggggcuggaggaagaggaaggcagagagcucccagcaagccccgcuggagaggcuggagaaagaauccaucacuccacucggagaagccuuuggagacucuuuucagcccuuccaucucccgggggcccugcgcuccggguccuuuugguagagagaaaucaaccauaaacuucuuccuaggcaacuggggcccucgcagcaaugcacuuuggcaugcacaggccccuuccccuuuuguguucuugcaaagcugcaucccagcagcccgccuaagcuacaaacaaauagcuaauccuccggggaauccuccagcgccucccucgcuggcugcagccuuccuugcacuucaaucuuugcaggaaggggaugcagcuagugggccucacgccaauguggucuccugaaaggcccugcauucuaggucugagggagacugaggcugcugucuaaggcccagcguccccccaccgcaacugcccagccugaguuuuuggggcaucaguuuuaggauuuacguuccaucaggccccugagccuaaucugaaaucggauuaaguugggagggguaaauauggcugaggagggaggaacagcucacagauccucuauguccccccgccccucugucaucucagggacuccaacaaagaacgagguucagcuaugguggacccggugccagaagaggagaaagagggagcggagcccgguggcucugaaggggaugaggccacagcguccgagccccccgaugcccagggagcccagcagccggcugccuccucggccuccgccuccgcggcggcgccccguaaggcugaaguccccugcggggcagaagguggacgucgggagcagucuccguugcugcaccucgaucucuucaauuucgccugccccgaggcagagggcagccgcuacguccugaccagcccccgcucucuggaggccugcgcccgaugcgcggucaagcccguggagcugcugccucgggcccuggccgaccuggugcgcgaggccccgggccgcuccaugcgcguggccaccggccuguacgaggccuacgaggcggagcgccuggccaaacugcagcagugccgcgccgagcgcgagcgcaucaugcgcgaggagaagcggcgccuguucacaccgaaggguccggcggcagccccggccucggccucagccucagccucagccucggcccugagcgggggcagcagcagcagcugcagcagcagcagcagccucccggccucgcccgccucgcgaguugcucgaaggacuucucccaguccccccgccaggagccggccuccgcccgccgguucucggacagguagaaagagccacucgcuggacucgcucucccgccggagggacggugcccugagcuccgaguccggggccucgucgucguccuacagcggggagagccuucgggagcuucgcuggccaccucgagcuuccgccagg

SEQ ID NO: 10625 - RNA, 2501 nt, Mus musculus
ggaggccagccauacacuggacucauuccuucuucggugcaccugggaguagcuacucuggcccugagugccuuucaugaagggcaccuuuaaccaaagcgccgcagcugaacuccaucaccgauuaucuacuuaagggcuuccuccugcagccgccugccuuuuccacacuggcugccuucgagugguccagccuggcugagggauggugcgaguuuagguuuucuuuugaagcuacuuuuuaauuuuauuuuagaaacagccucuuccuauauagcguaggcuggacuugaacucgauagccucgcaagcgcugagauagcaggcugcucucggcgagcguuuugaggaggccagaagugggguuuuuaccuacuaacaucuccuuuuggggggaaagaaaggaggaaagaaauaggguggaguuggaugugacuaggccagggaagaugagguaggacaguaggcccggguaggguggggaggggcuaaggucugugugcuggaaguguguugcauccgacgcuguguuggacacuggaggaauucaggcaagucagcuuuauucucucuaccuccguuuccuugucuacaaagugacuagguguaucucaaaaugucagauucucuggaucauuuaaacaaacgccucggaggacugcagugguucggcgccuaagguuuggcagcuuuuaauagcugugcuuucuuaacuccugcugagccgccuccuucuccaggugugagccaggaauauugauccggguaggugugacagagcugcggagggaaggugagacccgcagaguaauaaaauuaccucagagaaaaccugaaaucaaauguccacccccacaaaagcccacuugugaucacgggggcggggggggggcgggcgaggggggacgcugcacuucugagcaggcacucaggaguggaggcaggaagagucacgcgcacaguuuaaauuguucuuucugagacuuugguuaaauggguuagugcagagucgguaaguggcagcuauuuuccuaauuuuguuugcaaaguaucucaaaaugcucgucugcgugcagcuguguaacaccacuuaagaaagugacaucauggaaggaaacagaaggaauauuauccccuuucuuggaauauaugugacagcgaggaacucuuugucuuuagagcuugguuuuggggguucaguuuugguuuuuggcuuuuugaguccgggguuucucuguguagcccuggcuggcuuggaacucaaauucuccugccucgacugggauuaaaggcauacaugugccgccaccacugugcuguauuuuuuuuucccuuaguauguacacacuuugaagaucuuuagagcuuagaauguuacccaaggaugcuucugauuaucacuauuggaaaggcucuauguucuugcugucagguaaaauucuggcgguuccuucagcgcuuuaaaauucuuuuccuccucaccuugacccaaccacaauucacauucgagugcauuucuuuuaagcauacagcuuguuaaacuuaagcacuuauaugaaaacucauuuuuaaaauggggggcaaauuaaaacaauguguuaagcucugaggaccaggucugagaagccaaagaagaaaauauucucuuuucuaauuucaaaagcucuucucaaaggagugccucugcuuggcaguuacuggaguuaggcagauuggccuguguuggaggggaggcuggcuagcuagcucauuugugauaccuugaacaaauuagggugcugccaaaugccucaguuucuccaccugugaauuggggcuaucgguagugccagccuguuucauuuggagaccgggucugaaguauccagaccaacuucacauaucuuggacauugauccuccugccuccacuucucaugugcugaaauuauaggugagugugggguuuccuguucuggaauuacaggcauucaccgccacacguguuuaugugcugguagaaauggaauccagggcuucuugcaugcuaggcaagcucccgcccagcagccccuuacacucccuuuuaaaaucagagacucgcuuauuuauuacuuauuuuauguguaugaguguuuuacuugaauauaugucuguguaccacauucaugccuggugcccgguggagguuggcagaggguuggauucuccgaaacugggauuauggagguuaggugcugccauguggguacuaggauguguaccugggacaucuuaaccaccgagcccaggacucauuaaaaaaaauuuuauauuuauuuuguauguagugggcauacaugucuuagcacauauguaguggucagaugacaguucccagagucuguuuucucuuucugucauguggguccuggaaauugaacucggaccaucaggucugguagcaggcacuuugcucauugagccaucucuuugagugugaguguaugagcaugugugugugugggggggggugcgggggga

SEQ ID NO: 10626 - RNA, 2501 nt, Mus musculus
uccccccgcacccccccccacacacacacaugcucauacacucacacucaaagagauggcucaaugagcaaagugccugcuaccagaccugaugguccgaguucaauuuccaggacccacaugacagaaagagaaaacagacucugggaacugucaucugaccacuacauaugugcuaagacauguaugcccacuacauacaaaauaaauauaaaauuuuuuuuaaugaguccugggcucggugguuaagaugucccagguacacauccuaguacccacauggcagcaccuaaccuccauaaucccaguuucggagaauccaacccucugccaaccuccaccgggcaccaggcaugaaugugguacacagacauauauucaaguaaaacacucauacacauaaaauaaguaauaaauaagcgagucucugauuuuaaaagggaguguaaggggcugcugggcgggagcuugccuagcaugcaagaagcccuggauuccauuucuaccagcacauaaacacguguggcggugaaugccuguaauuccagaacaggaaaccccacacucaccuauaauuucagcacaugagaaguggaggcaggaggaucaauguccaagauaugugaaguuggucuggauacuucagacccggucuccaaaugaaacaggcuggcacuaccgauagccccaauucacagguggagaaacugaggcauuuggcagcacccuaauuuguucaagguaucacaaaugagcuagcuagccagccuccccuccaacacaggccaaucugccuaacuccaguaacugccaagcagaggcacuccuuugagaagagcuuuugaaauuagaaaagagaauauuuucuucuuuggcuucucagaccugguccucagagcuuaacacauuguuuuaauuugccccccauuuuaaaaaugaguuuucauauaagugcuuaaguuuaacaagcuguaugcuuaaaagaaaugcacucgaaugugaauugugguugggucaaggugaggaggaaaagaauuuuaaagcgcugaaggaaccgccagaauuuuaccugacagcaagaacauagagccuuuccaauagugauaaucagaagcauccuuggguaacauucuaagcucuaaagaucuucaaaguguguacauacuaagggaaaaaaaaauacagcacagugguggcggcacauguaugccuuuaaucccagucgaggcaggagaauuugaguuccaagccagccagggcuacacagagaaaccccggacucaaaaagccaaaaaccaaaacugaacccccaaaaccaagcucuaaagacaaagaguuccucgcugucacauauauuccaagaaaggggauaauauuccuucuguuuccuuccaugaugucacuuucuuaagugguguuacacagcugcacgcagacgagcauuuugagauacuuugcaaacaaaauuaggaaaauagcugccacuuaccgacucugcacuaacccauuuaaccaaagucucagaaagaacaauuuaaacugugcgcgugacucuuccugccuccacuccugagugccugcucagaagugcagcguccccccucgcccgccccccccccgcccccgugaucacaagugggcuuuuguggggguggacauuugauuucagguuuucucugagguaauuuuauuacucugcgggucucaccuucccuccgcagcucugucacaccuacccggaucaauauuccuggcucacaccuggagaaggaggcggcucagcaggaguuaagaaagcacagcuauuaaaagcugccaaaccuuaggcgccgaaccacugcaguccuccgaggcguuuguuuaaaugauccagagaaucugacauuuugagauacaccuagucacuuuguagacaaggaaacggagguagagagaauaaagcugacuugccugaauuccuccaguguccaacacagcgucggaugcaacacacuuccagcacacagaccuuagccccuccccacccuacccgggccuacuguccuaccucaucuucccuggccuagucacauccaacuccacccuauuucuuuccuccuuucuuuccccccaaaaggagauguuaguagguaaaaaccccacuucuggccuccucaaaacgcucgccgagagcagccugcuaucucagcgcuugcgaggcuaucgaguucaaguccagccuacgcuauauaggaagaggcuguuucuaaaauaaaauuaaaaaguagcuucaaaagaaaaccuaaacucgcaccaucccucagccaggcuggaccacucgaaggcagccaguguggaaaaggcaggcggcugcaggaggaagcccuuaaguagauaaucggugauggaguucagcugcggcgcuuugguuaaaggugcccuucaugaaaggcacucagggccagaguagcuacucccaggugcaccgaagaaggaaugaguccaguguauggcuggccucc

SEQ ID NO: 10627 - RNA, 2501 nt, Mus musculus
cacuuggcagcacucagcucuaugcccugcagacuuuaggcuaggccuccaaagguuaguagggaauucauuuagacgcagagagggccagcuacgugcaggcacugaucugcugggaacaugaaagcuaacaaaacccugcuuaagcagaacuuguauaaguuugaacacauacauagaaauagaaauacgugaggggggaauaaaugcuauaagaaagcauaaagcuggaugagggcacagaagggaugagacacggugaacuuugcuaagauacagaagaccguugcaggcaagagaagaguaugugugcagagcaggaggcagaagauccucuguagugggacuaggcguacaagcaacgggaaugcuaccuggaacuacaacggacagauaaaccaggcucaggccaagggcugccaaagccccuccuagacuaaucaauugcaccuugcccagucuggcauugccaggcuccugugccuucacuccagagacaccuggguacucaggagagguccccaacucauuaaauccugggcaaggcguuguuggggcggggaggggaccuccugugauaacagaguccagaacccgcagcgaguggugcaaaauaauaaguugaagaguuggagcgaggcguggcuuuucaaaaugugcaaacaacgcugacaucuagacuuccuggaacacagacccagucccucgcacaggucagggcagccuucucuuucacagagcuccuaaacccuugccuaaguccucugcgugucccagcagaccugagcccggacuauacacuugucuuggcgcgccugcuucgcugucagcccguuccuggagaugcgucugucuucgcgcccugauguccccacucccccccccccccccccgcccagauccuccaccuacuggcgcccggagccaguuuauccuucucugggccucaagaacccagagcgcccacccagccacugcagcucguuagcccagcacagaaugagugagaaacgcacacgagcuuaacgucgggguucugggagaacugguguccaagggaacagauaguagauuuauuuuccccaaaauaacuuuuugaaagcugguccgagccccgguuucggaaccucggagcgguuucucuaguaguuacugaggacaaagggacaggacccgcacuccacugaaggcguaacuguccgggauacccgcaucccuuugcuccaccccgcccccagcccuauccccucuucagugcucacccggugagccgcccucgccgugcagccgcgggucgcugagggguuuccaggcgcgcgacagaaggugcagcccuggcugcuaucugcugcuggccccggggauggcuucuccgagucuggacagguggcuggacucgacgcagcugcuggguucgggguggccuccuggccucggccucugcgagccucccaggguuccccugggccggcugguuccacucagagggcgacaagccggggaccggcgcgucaggcucucggaacagacuguacaccuuggcugcagccgcugcgggguggcugcccacggggugccacaaccgauucgcaucccugcuagcugguucguaucucccuauggaaucccguugggcaugacuuguccccaucaagacagccaggacaaguggcaggaagccccuccaacgcacccgucggaugcauccggagcagcgagcgguggucggcgcucucauggcgccagaguggcugcagagcugugggcaccggagaccucgcggggaggugcuuuccaucguucgcuccacagacccgccuggcgacuugccccuucccgucuaggggaccucugaaacagccguuuggggguccagggguuccuagguaagggcuguauggcgugagcugcccgggcugcgcaccgagcccgagccugccgcaccuucgcucccgcacugccgccgucugaaggggaaccgaaggguuuuauuuuuggaaaccgcccccugcuuuuucgccucuuuuauccacgccaugccccccuccuuggagggacagcucggcccccuuauuacgggagacaagaauuccagcaacacccucuuuggcaccgagaagcgagcgggcggcgaggggauuaacccgugaggagcugcgggcgacagggcagacccggggacuggaaagacagauggcgucugccuggaccagcgcaccugagcugccuuuuuccuguccugggcaaacucaaguuguccaccuguccuggauguauuuucuguuccugaccucacggacccagaugaacugcuucucgggccugaaggaagcuggggaagguacccagaccggaguaauggggaccgagcccgaggcaugcgcgccuggucucguugcuuccaccucugaccgcugggggcgcuaggcgagaaugcaggugucccuggggcagcucccaagagccgguugccuauggggaagggcaacuuggggcgcgcg

SEQ ID NO: 10628 - RNA, 2501 nt, Mus musculus
cgcgcgccccaaguugcccuuccccauaggcaaccggcucuugggagcugccccagggacaccugcauucucgccuagcgcccccagcggucagagguggaagcaacgagaccaggcgcgcaugccucgggcucgguccccauuacuccggucuggguaccuuccccagcuuccuucaggcccgagaagcaguucaucuggguccgugaggucaggaacagaaaauacauccaggacagguggacaacuugaguuugcccaggacaggaaaaaggcagcucaggugcgcugguccaggcagacgccaucugucuuuccaguccccgggucugcccugucgcccgcagcuccucacggguuaauccccucgccgcccgcucgcuucucggugccaaagaggguguugcuggaauucuugucucccguaauaagggggccgagcugucccuccaaggaggggggcauggcguggauaaaagaggcgaaaaagcagggggcgguuuccaaaaauaaaacccuucgguuccccuucagacggcggcagugcgggagcgaaggugcggcaggcucgggcucggugcgcagcccgggcagcucacgccauacagcccuuaccuaggaaccccuggacccccaaacggcuguuucagagguccccuagacgggaaggggcaagucgccaggcgggucuguggagcgaacgauggaaagcaccuccccgcgaggucuccggugcccacagcucugcagccacucuggcgccaugagagcgccgaccaccgcucgcugcuccggaugcauccgacgggugcguuggaggggcuuccugccacuuguccuggcugucuugauggggacaagucaugcccaacgggauuccauagggagauacgaaccagcuagcagggaugcgaaucgguuguggcaccccgugggcagccaccccgcagcggcugcagccaagguguacagucuguuccgagagccugacgcgccgguccccggcuugucgcccucugaguggaaccagccggcccaggggaacccugggaggcucgcagaggccgaggccaggaggccaccccgaacccagcagcugcgucgaguccagccaccuguccagacucggagaagccauccccggggccagcagcagauagcagccagggcugcaccuucugucgcgcgccuggaaaccccucagcgacccgcggcugcacggcgagggcggcucaccgggugagcacugaagaggggauagggcugggggcgggguggagcaaagggaugcggguaucccggacaguuacgccuucaguggagugcggguccugucccuuuguccucaguaacuacuagagaaaccgcuccgagguuccgaaaccggggcucggaccagcuuucaaaaaguuauuuuggggaaaauaaaucuacuaucuguucccuuggacaccaguucucccagaaccccgacguuaagcucgugugcguuucucacucauucugugcugggcuaacgagcugcaguggcugggugggcgcucuggguucuugaggcccagagaaggauaaacuggcuccgggcgccaguagguggaggaucugggcgggggggggggggggggaguggggacaucagggcgcgaagacagacgcaucuccaggaacgggcugacagcgaagcaggcgcgccaagacaaguguauaguccgggcucaggucugcugggacacgcagaggacuuaggcaaggguuuaggagcucugugaaagagaaggcugcccugaccugugcgagggacugggucuguguuccaggaagucuagaugucagcguuguuugcacauuuugaaaagccacgccucgcuccaacucuucaacuuauuauuuugcaccacucgcugcggguucuggacucuguuaucacaggagguccccuccccgccccaacaacgccuugcccaggauuuaaugaguuggggaccucuccugaguacccaggugucucuggagugaaggcacaggagccuggcaaugccagacugggcaaggugcaauugauuagucuaggaggggcuuuggcagcccuuggccugagccugguuuaucuguccguuguaguuccagguagcauucccguugcuuguacgccuagucccacuacagaggaucuucugccuccugcucugcacacauacucuucucuugccugcaacggucuucuguaucuuagcaaaguucaccgugucucaucccuucugugcccucauccagcuuuaugcuuucuuauagcauuuauuccccccucacguauuucuauuucuauguauguguucaaacuuauacaaguucugcuuaagcaggguuuuguuagcuuucauguucccagcagaucagugccugcacguagcuggcccucucugcgucuaaaugaauucccuacuaaccuuuggaggccuagccuaaagucugcagggcauagagcugagugcugccaagug

SEQ ID NO: 10629 - RNA, 2501 nt, Mus musculus
aauauaaauaaauuuaagaaggaggaggaggaagaagaggaggaggaggaagagaagaagaaaauuaguuuuugcccagagcacacacuuguagccugagccaucagggaacugaucuaggaagauuagccugggcaacaaugaaaggccuaucucaaaaaaugauaauaaugaucauacuaauaauuccuauauacuucuauuaaugugagacuugaaugaguuaauauagugaaaaccuaauggggucugccagguagaaaugccuuaauaaaucuaaguccucagaaauguccuucacggaagucaggcaggguuaacacaaugcccuaguauggauagagacaaaggacccuccacuggcccucuccuguccaccuucuguccacacacauucccacccauaccaugcacaccgcggaguagcacguccacaccauucugguagugguugaaggcagccucguagucuucacugacaucucgcuccagugccagguggaucuguguagcugcaucuaccagguagucacguuuggucacaucggcugucccuguagcuacccgguuacgaaucuguuccagguacaugcaggccugggaccgugcucgugaacagggcucuggcuccaggccugguccagguggacauucacaggcuaccaggcucauaguggcccugcuguugugaccuguaagaagcaaaggucuuaggggagacacguguugggagccacaccccuaccuguacuccagcuuccucuacuaaacauuggagagacagauguucacauccaaaagcuggagggacgagcgaugguaaggucccgucuuugagcuggguccuaccucaguguggcaaugauagauuaacacagcaguguguguguguggggggggggcuuucuuuucuuuuccacucaaauucagcuccacaaauaccaugcuguaugaacggagcacggaaaacuggggguaccugugacccacagcugccuuugagggguguccacagaguaaaccuagugucaagagcauaguaaacauaccaaagucacacacuggcuuaaagcuggucucaccucuccuccaccucaggucuccccuccucccugucuuccuugugaaguuccauucagcucagggguaccucuccccagacaaaaccuuuggcccagagagguccugagucagcaaguggggaacuccccccccccaauacccaggcuccaagccggaauggcgagcucaucaaagcccccugggagaugaggugauugacagauuagaugccaguucauguggaguucagcgagagugucagggugacccagcccuauggaggcuaucccagaaguccaggggccugugcgcccucccaaggaccugacaguaacuccuccccaagcaaugugugaccccaauggcccaagggauaagaguggcggcugccagaggggaaggggcaaagagaaagcagccagcagugcggucccugucccucacagcagccuagcagccaccguugcugucucggguacccuggaaaaugaccaggggguagcuuuucucccuggaucuuuuccaccucggcaaggaaagagacacaggauaaaggaagagguggggaggaaacgcacauauccaagcagccaggaggccaggagauggagaaaggcggccuuccugcucugccaggcccagcgggauagguagcuucgaggccugugcuggggcaccgacgccggcugcgcagggcugcgaguugcggguccagcuuucggagccgcgugccuaagacuauacacgucaagcaagcagcgcgugcacgaccccggcacacaaggugcaucacuauagggaacguccaaggaggucgggcugaggcagggaggggaagccuccucuccugagaggauggcucaagagcagaccaaauacuauaccuguccgcgugccagagcuccgggccuucccgccaacgcugucccuucaccuucugcaaggcuccgucugugccuaccacccuuccgcaggugccugggggcggggguggggcgucuagccgggugccugccagccauuggcuaaggaugagcucauccucaacccguuagaauaaaccuccaaucaucguucuccucggcuucugacagcccuuaaagcccuagaguuugcaaggccaggaacucaggagugggagucaguggggauggaugugggugacugaguguagcagggagagaaaaggucuauugucacccagggauguggcugccuuagaccucuaagccaaugaaacuuaaccacagcacguucaagagacuuucuucauucacuacuucaguuagucaauguuucucuguuggguguguacucugcccuagggcuuaggguagagcugccucuauggcuucacagaucaaucugcccagggcuuccugggcucuaaggucaggcgagugguucggaguugagcagcaccgaauccuaaccuggag

SEQ ID NO: 10630 - RNA, 2501 nt, Mus musculus
cuccagguuaggauucggugcugcucaacuccgaaccacucgccugaccuuagagcccaggaagcccugggcagauugaucugugaagccauagaggcagcucuacccuaagcccuagggcagaguacacacccaacagagaaacauugacuaacugaaguagugaaugaagaaagucucuugaacgugcugugguuaaguuucauuggcuuagaggucuaaggcagccacaucccugggugacaauagaccuuuucucucccugcuacacucagucacccacauccauccccacugacucccacuccugaguuccuggccuugcaaacucuagggcuuuaagggcugucagaagccgaggagaacgaugauuggagguuuauucuaacggguugaggaugagcucauccuuagccaauggcuggcaggcacccggcuagacgccccacccccgcccccaggcaccugcggaagggugguaggcacagacggagccuugcagaaggugaagggacagcguuggcgggaaggcccggagcucuggcacgcggacagguauaguauuuggucugcucuugagccauccucucaggagaggaggcuuccccucccugccucagcccgaccuccuuggacguucccuauagugaugcaccuugugugccggggucgugcacgcgcugcuugcuugacguguauagucuuaggcacgcggcuccgaaagcuggacccgcaacucgcagcccugcgcagccggcgucggugccccagcacaggccucgaagcuaccuaucccgcugggccuggcagagcaggaaggccgccuuucuccaucuccuggccuccuggcugcuuggauaugugcguuuccuccccaccucuuccuuuauccugugucucuuuccuugccgagguggaaaagauccagggagaaaagcuacccccuggucauuuuccaggguacccgagacagcaacgguggcugcuaggcugcugugagggacagggaccgcacugcuggcugcuuucucuuugccccuuccccucuggcagccgccacucuuaucccuugggccauuggggucacacauugcuuggggaggaguuacugucagguccuugggagggcgcacaggccccuggacuucugggauagccuccauagggcugggucacccugacacucucgcugaacuccacaugaacuggcaucuaaucugucaaucaccucaucucccagggggcuuugaugagcucgccauuccggcuuggagccuggguauuggggggggggaguuccccacuugcugacucaggaccucucugggccaaagguuuugucuggggagagguaccccugagcugaauggaacuucacaaggaagacagggaggaggggagaccugagguggaggagaggugagaccagcuuuaagccagugugugacuuugguauguuuacuaugcucuugacacuagguuuacucuguggacaccccucaaaggcagcugugggucacagguacccccaguuuuccgugcuccguucauacagcaugguauuuguggagcugaauuugaguggaaaagaaaagaaagccccccccccacacacacacacugcuguguuaaucuaucauugccacacugagguaggacccagcucaaagacgggaccuuaccaucgcucgucccuccagcuuuuggaugugaacaucugucucuccaauguuuaguagaggaagcuggaguacagguagggguguggcucccaacacgugucuccccuaagaccuuugcuucuuacaggucacaacagcagggccacuaugagccugguagccugugaauguccaccuggaccaggccuggagccagagcccuguucacgagcacggucccaggccugcauguaccuggaacagauucguaaccggguagcuacagggacagccgaugugaccaaacgugacuaccugguagaugcagcuacacagauccaccuggcacuggagcgagaugucagugaagacuacgaggcugccuucaaccacuaccagaaugguguggacgugcuacuccgcggugugcaugguaugggugggaauguguguggacagaagguggacaggagagggccaguggaggguccuuugucucuauccauacuagggcauuguguuaacccugccugacuuccgugaaggacauuucugaggacuuagauuuauuaaggcauuucuaccuggcagaccccauuagguuuucacuauauuaacucauucaagucucacauuaauagaaguauauaggaauuauuaguaugaucauuauuaucauuuuuugagauaggccuuucauuguugcccaggcuaaucuuccuagaucaguucccugauggcucaggcuacaagugugugcucugggcaaaaacuaauuuucuucuucucuuccuccuccuccucuucuuccuccuccuccuucuuaaauuuauuuauauu

SEQ ID NO: 10631 - RNA, 2501 nt, Mus musculus
uuuguaaucaauggaaacgccuggucagcgcugcacagcuccaccaggguuggaauggcagggaggacucuucguccugaccaagccccuugaaugcuccuuacuauauccaguucccagacuccagucuggccuccggcacucaacacagauucuguccaccaagacuccaucugcauccuuacagcuugcugggcaggggcccugagccagcuggacgaacccuagcgaucacguccugcuuuccgugugcuuggugacccuaacccaugacugcaccucucuaggcugcugggucacaaaagcuggacucuugggcuucagccuggaugucgagcuugcagacccaccccagcuugccacuggccugcucccacccuucagaccaaccgaucccuucuccuuggcugcugaggcucaugaggaaagaagagagggggcucagcuugcagagcuggccuggcuggcuuaccuuccacuucuguugaguuguucccagcagacagggcccccugcgguggacacaaagguggagcuauaaggagggggcauauucuuggggcucggcucuuugagcccaccccaagcuccucccccauccucugcuaaaaaccaccugacuuucuggccucaguuucuucacuuggaaaaggguaggaggcuucuuguguucccaagugcuuguaauccuguggggucucucuucugcccagcccccaggccaguccugcugggccuacuacagcccgccuuggcugggugccagagcccagggggagggugaucagcuggugggagcucaggggcuggagaagaggcggcgccaugagcuggugcugccugccaguaacguuacaccucgagcuaacacugcagcaagcagacggauggccuggcugcucggcaaggggacuggacaacccacccacuccugggcuggggcugagggcucccagggcagugggcagugcagcgggcagugcagcaggaagggaaugcauuggcuuugucaggauuuugcugcccaaucuggcucccugccagacucacccagcuccugggaaaagggcccugcucacuuccccaggcccugcacucaggaccuucugacacccaccaggaggaaagggcacggcaggaucccuugucauaucugaagcccacccaagagcccucugcucaauuggagcaauggugggggaagggccucaccuccccaccucaagcuucuuuagucagcuccuuccccacuaggccaggucagagguccugggggcgccugguuggucauggggccacaacccugaccacagggccagggagcugacugggauuaguggacggaugcuuuuugcaaagccacuagggcuccaggggcuagacaggaaaccucccucauucccuguggcuucccugcccccacuaagacagcccccaggaauuggggacugcccagccagaggucuccucccugagguccagcccagccccugggaaauaugugggcacccuagcagaagcugcucucuaaagugagucuguaauuaaagaccauagccccuguuucuacggcuaggaugagaaggucaagaggaagccaggccagguccuuaccugggaaugcacagccaacccagcuaggaccuguaagaagcaagugaacagcuucaugaccagcaucuucucagacauccagagccaagguccuucaaggcacaaucaccaugcucgucccccuugggggagacgcugauaccagaggagaggagaggagaggagugucccccucacugcuguccuaggcuaggucucugcagucugccugagcauccacagaaagccggggaaguccggagcucacagguagggcuguggcugaggaaacuggugaggaguguuccggcgagucggagcgaugugaaaggaucuuagggguccgaugacccuagcuccucucgugagugagcagaagucugaagaugcgguuuccuucucagacugcagcuucccuacgaacugaagcuagucggccgcugguuuucaagaccguguauggggcggggcugcagccugcccgcccacuucuaucucgaggccccaggagcagcccgggagcgcugagagccgguuggcggugagaccugagugcgcgugaccccgcagggcgcugaaggggcgcugccggcgcagaucuccuggccccucggagcuaggcguucauuagcuugccccagggucagcccgcagcgacagccaagguugcaccuggcucuucuggagccuccaggugcggacguccaacaucugccuuggagauggcuggguacuuaagugaccucugcagggagugcaguacuaagaaggcagcaucuugcuguggcccuucaugaccagugccaucccuacacaaccccgggaggagaggugacaggauuacuaaccccauuuuauagacuaacaacccgauccuaugagagggcaccaccugcagaugcugaaca

SEQ ID NO: 10632 - RNA, 2501 nt, Mus musculus
uguucagcaucugcagguggugcccucucauaggaucggguuguuagucuauaaaaugggguuaguaauccugucaccucuccucccgggguuguguagggauggcacuggucaugaagggccacagcaagaugcugccuucuuaguacugcacucccugcagaggucacuuaaguacccagccaucuccaaggcagauguuggacguccgcaccuggaggcuccagaagagccaggugcaaccuuggcugucgcugcgggcugacccuggggcaagcuaaugaacgccuagcuccgaggggccaggagaucugcgccggcagcgccccuucagcgcccugcggggucacgcgcacucaggucucaccgccaaccggcucucagcgcucccgggcugcuccuggggccucgagauagaagugggcgggcaggcugcagccccgccccauacacggucuugaaaaccagcggccgacuagcuucaguucguagggaagcugcagucugagaaggaaaccgcaucuucagacuucugcucacucacgagaggagcuagggucaucggaccccuaagauccuuucacaucgcuccgacucgccggaacacuccucaccaguuuccucagccacagcccuaccugugagcuccggacuuccccggcuuucuguggaugcucaggcagacugcagagaccuagccuaggacagcagugagggggacacuccucuccucuccucuccucugguaucagcgucucccccaagggggacgagcauggugauugugccuugaaggaccuuggcucuggaugucugagaagaugcuggucaugaagcuguucacuugcuucuuacagguccuagcuggguuggcugugcauucccagguaaggaccuggccuggcuuccucuugaccuucucauccuagccguagaaacaggggcuauggucuuuaauuacagacucacuuuagagagcagcuucugcuagggugcccacauauuucccaggggcugggcuggaccucagggaggagaccucuggcugggcaguccccaauuccugggggcugucuuagugggggcagggaagccacagggaaugagggagguuuccugucuagccccuggagcccuaguggcuuugcaaaaagcauccguccacuaaucccagucagcucccuggcccuguggucaggguuguggccccaugaccaaccaggcgcccccaggaccucugaccuggccuaguggggaaggagcugacuaaagaagcuugagguggggaggugaggcccuucccccaccauugcuccaauugagcagagggcucuugggugggcuucagauaugacaagggauccugccgugcccuuuccuccuggugggugucagaagguccugagugcagggccuggggaagugagcagggcccuuuucccaggagcugggugagucuggcagggagccagauugggcagcaaaauccugacaaagccaaugcauucccuuccugcugcacugcccgcugcacugcccacugcccugggagcccucagccccagcccaggaguggguggguuguccaguccccuugccgagcagccaggccauccgucugcuugcugcaguguuagcucgagguguaacguuacuggcaggcagcaccagcucauggcgccgccucuucuccagccccugagcucccaccagcugaucacccucccccugggcucuggcacccagccaaggcgggcuguaguaggcccagcaggacuggccugggggcugggcagaagagagaccccacaggauuacaagcacuugggaacacaagaagccuccuacccuuuuccaagugaagaaacugaggccagaaagucaggugguuuuuagcagaggaugggggaggagcuuggggugggcucaaagagccgagccccaagaauaugcccccuccuuauagcuccaccuuuguguccaccgcagggggcccugucugcugggaacaacucaacagaaguggaagguaagccagccaggccagcucugcaagcugagcccccucucuucuuuccucaugagccucagcagccaaggagaagggaucgguuggucugaagggugggagcaggccaguggcaagcuggggugggucugcaagcucgacauccaggcugaagcccaagaguccagcuuuugugacccagcagccuagagaggugcagucauggguuagggucaccaagcacacggaaagcaggacgugaucgcuaggguucguccagcuggcucagggccccugcccagcaagcuguaaggaugcagauggagucuugguggacagaaucuguguugagugccggaggccagacuggagucugggaacuggauauaguaaggagcauucaaggggcuuggucaggacgaagaguccucccugccauuccaacccugguggagcugugcagcgcugaccaggcguuuccauugauuacaaa

SEQ ID NO: 10633 - RNA, 2501 nt, Mus musculus
ucccuugacccugggaaccggguccacauugaaucaggugcgaauguucgcucgccuucucugccuuucccgccuccccucccccggccgcggccccgguucccccccugcgcugcacccucagaguuggcugcagccggcgagcuguucccgucaaucccucccuccuuuacacaggauguccauauuaggacaucugcgucagcagguuuccacggccggucccuguuguucugggggggggaccaucuccgaaauccuacacgcggaaggucuaggagacccccuaagaucccaaaugugaacacucauaggugaaagauguaugccaagacggggguugaaagccuggggcguagaguugacgacagagcgcccgcagagggccuuggggcgcgcuuccccccccuuccaguuccgcccagugacguaggaaguccauccauucacagcgcuucuauaaaggcgccagcugaggcgccuacuacuccaaccgcgacugcagcgagcaacugagaagacuggauagagccggcgguuccgcgaacgagcagugaccgcgcucccacccagcucugcucugcagcucccaccagugucuaccccuggaccccuugccgggcuuuccccaaacuucgaccaugauguucucggguuucaacgccgacuacgaggcgucauccucccgcugcaguagcgccuccccggccggggacagccuuuccuacuaccauuccccagccgacuccuucuccagcaugggcucuccugucaacacacaggugaguuuggcuuuguguagccgccagguccgcgcugagggucgccguggaggagacacuggggugugacucgcaggggcgggggggucuuccuuuuucgcucuggagggagacuggcgcggucagagcagccuuagccugggaacccaggacuugucugagcgcgugcacacuugucauaguaagacuuagugaccccuucccgcgcggcagguuuauucugaguggccugccugcauucuucucucggccgacuuguuucugagaucagccggggccaacaagucucgagcaaagagucgcuaacuagaguuugggaggcggcaaaccgcggcaauccccccucccggggcagccuggagcagggaggagggaggagggaggagggugcugcgggcggguguguaaggcaguuucauugauaaaaagcgaguucauucuggagacuccggagcagcgccugcgucagcgcagacgucagggauauuuauaacaaacccccuuucgagcgagugaugccgaagggauaacgggaacgcagcaguaggauggaggagaaaggcugcgcugcggaauucaagggaggauauugggagagcuuuuaucuccgaugaggugcauacaggaagacauaagcagucucugaccggaaugcuucucucucccugcuucaugcgacacuagggccacuugcuccaccugugucuggaaccuccucgcucaccuccgcuuuccucuuuuuguuuuguuucaggacuuuugcgcagaucuguccgucucuagugccaacuuuauccccacggugacagccaucuccaccagcccagaccugcaguggcuggugcagcccacucuggucuccuccguggccccaucgcagaccagagcgccccauccuuacggacuccccacccagucugcuggggcuuacgccagagcgggaauggugaagaccgugucaggaggcagagcgcagagcaucggcagaaggggcaaaguagagcaggugagcagcgauucuggaccuuugugggcugggggggggggggggggcggagacugacgcacagaccacacaacagagaagggacgcuacugacugcacuuccugaccaggagcuguggcugcuagcccuuucccucccuugucagauuuugacaguuggacccaagacaaacucuagacaguuucccugacagcuuccuacuucauucucuagccggggagcuucuuuguuccccugcuaaagaucucacuuuaaaugcaaaucacacucugccugccaacugcagguuagaaaaacugcuucaccgagaggugcgggugcuguaggagccaguuucacuggggugacugaauggaggugacacuagacaaccuuaacugaauguugguccuuuucuucuauagcuaucuccugaagaggaagagaaacggagaauccgaagggaacggaauaagauggcugcagccaagugccggaaucggaggagggagcugacagauacacuccaagcgguagguugaaccagcugcugcuccugaaacuuuauuaaaguuggagcuugggacuaugggcgcaggguccuugagcaugcccgugucuuaugcuuucuuauaucucucccuaugcaggagacagaucaacuugaagaugagaagucugcguugcagacugagauugccaaucugcugaaagagaaggaaaaacuggaguu

SEQ ID NO: 10634 - RNA, 2501 nt, Mus musculus
aacuccaguuuuuccuucucuuucagcagauuggcaaucucagucugcaacgcagacuucucaucuucaaguugaucugucuccugcauagggagagauauaagaaagcauaagacacgggcaugcucaaggacccugcgcccauagucccaagcuccaacuuuaauaaaguuucaggagcagcagcugguucaaccuaccgcuuggaguguaucugucagcucccuccuccgauuccggcacuuggcugcagccaucuuauuccguucccuucggauucuccguuucucuuccucuucaggagauagcuauagaagaaaaggaccaacauucaguuaagguugucuagugucaccuccauucagucaccccagugaaacuggcuccuacagcacccgcaccucucggugaagcaguuuuucuaaccugcaguuggcaggcagagugugauuugcauuuaaagugagaucuuuagcaggggaacaaagaagcuccccggcuagagaaugaaguaggaagcugucagggaaacugucuagaguuugucuuggguccaacugucaaaaucugacaagggagggaaagggcuagcagccacagcuccuggucaggaagugcagucaguagcgucccuucucuguuguguggucugugcgucagucuccgcccccccccccccccccagcccacaaagguccagaaucgcugcucaccugcucuacuuugccccuucugccgaugcucugcgcucugccuccugacacggucuucaccauucccgcucuggcguaagccccagcagacuggguggggaguccguaaggauggggcgcucuggucugcgauggggccacggaggagaccagagugggcugcaccagccacugcaggucugggcugguggagauggcugucaccguggggauaaaguuggcacuagagacggacagaucugcgcaaaaguccugaaacaaaacaaaaagaggaaagcggaggugagcgaggagguuccagacacagguggagcaaguggcccuagugucgcaugaagcagggagagagaagcauuccggucagagacugcuuaugucuuccuguaugcaccucaucggagauaaaagcucucccaauauccucccuugaauuccgcagcgcagccuuucuccuccauccuacugcugcguucccguuaucccuucggcaucacucgcucgaaaggggguuuguuauaaauaucccugacgucugcgcugacgcaggcgcugcuccggagucuccagaaugaacucgcuuuuuaucaaugaaacugccuuacacacccgcccgcagcacccuccucccuccucccuccucccugcuccaggcugccccgggaggggggauugccgcgguuugccgccucccaaacucuaguuagcgacucuuugcucgagacuuguuggccccggcugaucucagaaacaagucggccgagagaagaaugcaggcaggccacucagaauaaaccugccgcgcgggaaggggucacuaagucuuacuaugacaagugugcacgcgcucagacaaguccuggguucccaggcuaaggcugcucugaccgcgccagucucccuccagagcgaaaaaggaagacccccccgccccugcgagucacaccccagugucuccuccacggcgacccucagcgcggaccuggcggcuacacaaagccaaacucaccuguguguugacaggagagcccaugcuggagaaggagucggcuggggaaugguaguaggaaaggcuguccccggccggggaggcgcuacugcagcgggaggaugacgccucguagucggcguugaaacccgagaacaucauggucgaaguuuggggaaagcccggcaagggguccagggguagacacuggugggagcugcagagcagagcugggugggagcgcggucacugcucguucgcggaaccgccggcucuauccagucuucucaguugcucgcugcagucgcgguuggaguaguaggcgccucagcuggcgccuuuauagaagcgcugugaauggauggacuuccuacgucacugggcggaacuggaaggggggggaagcgcgccccaaggcccucugcgggcgcucugucgucaacucuacgccccaggcuuucaacccccgucuuggcauacaucuuucaccuaugaguguucacauuugggaucuuagggggucuccuagaccuuccgcguguaggauuucggagauggucccccccccagaacaacagggaccggccguggaaaccugcugacgcagauguccuaauauggacauccuguguaaaggagggagggauugacgggaacagcucgccggcugcagccaacucugagggugcagcgcagggggggaaccggggccgcggccgggggaggggaggcgggaaaggcagagaaggcgagcgaacauucgcaccugauucaauguggacccgguucccagggucaaggga

SEQ ID NO: 10635 - RNA, 2501 nt, Mus musculus
caccggacggaggaggaugguucggcgugggcugagcuggaagggguucucugcucauccggccgccgccuucgcgucgcugccucccgggcuguguagcauuuuggggguggcggccgcaaggccgagcaggggaugcgcuuacauaaccgcucgccguguccugcugccucgcgcucucgggagccgcgggcggggcgcgccgccggaccgcaaugcugccgggaccagcgcggcggggcccgggccggccccgcaggcggaggagcgcgagcaucggcgggaggagggcgccggcggcgggggaggugaaggucagugggugugaagcgggcgauccacacccccuccuccccguccccuccuucucuuccucuccgucccccucugacguguggagcuggcagcucggccgguuccgcauucccgaccccuccccgccacucagggcccgcuauauagccggggcugaugcaacccgucccgccgcccgccacagccugcgggagggacacucggcggccgcgacggggggcgcuggcggcagcggacgcugcagcggcggcggcggggcuggcgccgcggcggcucccgggccgggacgggccugggcagcgggcggcagcagcgcggagugggcaccgcgccugcagcaggguucugggcccggggccgccgccuccgccagcggcuucugcacgguggguucacggaggggggaggcggggcugcgggcaccugggguggccucccccggaguagcuaccgcuggggcucccgccaccccagggccggaauacucuaucggauggcugcagccgcugcccaccggugguuccccggcugggcaggacaguccugucuguggccgggacagcggggcgcucccuccuugcuuuccuuccccagugcucuugcugggaggcugugcacagacggaggagagggcggggugagcgggagaaaacugugccggggacugcgggggacucaagggggcaugcacgccccagaccugcugacaggucgcgccucagccucuuccguagcucucuuugcaagaccuggaggggaggguauugagaaaggcaucuaaccaacagggcuuccuucgcuuaagagcauugcugcggcgggcucuggcuggguuaggagggaaccacggggcaguccccaguucccuugggaucccgucaggcacaucagguuauauaagaagguaagcaggcuucuuuagguaaccugcccaguuuagaaggcacucuuccuccccucuuauccaagaaggcuaggcuuccuggacccuuggagcggcagaaacaggcuuugccuggguaucuggaggagcuggcaggccugggaugccuugacucauuugcagaaauggaugggccauuuggggauagagguggagaggcgggugcaagaggggaaucaaucgacuauuugagucagcucccccuagaagauuguccagcccuuauguguuggaguggcaccuuccaggggacuguggcacaggucuguguauuguuaaaucuugggccacucuacccaggaucuuaauucaggcagcaugggaaacaggcucuguaccacagcuggguaccugccugucccaaaggcuguuagcaacugucuuccucgucccucgaccucacccccaagucucccccacccuccaggguuuaaaaaucacccccucuugcuuucccugcuuuucagcaaaucuggcuggcuucagcuuggauggcgggcuuaucuucccgugcagguuucuagggaagaguuuaaccggggaucaggugugagcaggguucuuuacagaaaccugagguccggggauagaaacaacuauucuccugccucuaaggcgccagagguuucacuuugccuaaaguaguagggaggauggauuucucaaagacuccucuguuucccuuccacguuggcuucaguucagaggagcucuagaaucuuccugaagagcugggugcugggugguuugaaagguugcaggaaggacuggggggagauggccucugaaccuuuugucaauaaauugguuacaguaaucuccaaggagacaggucuaucauggugacggugucacuuaggaaaagcuucgguacaugugucccuuacucauccacugacgccuuuugcacuaccagggaacuccccugucuuccuggucuguuuaucuuucccaccuguugacaagauauccuuucccacucuuucagcuugcagaacugggccuccugggccucgguuuguuauggagguacaacugguauuacaauucauagcccugcuuccucaucccaucucccucgcucccucuuccuaauuaucccccccaccccccacacacacacacacuggaaaggaagaagccagcacaaacccuagagcacagacgcuaggcuggccugccuuguauccauucagcacuaacucucccuggucccucuaacccuccagggcuggggauaacu

SEQ ID NO: 10636 - RNA, 2501 nt, Mus musculus
aguuauccccagcccuggaggguuagagggaccagggagaguuagugcugaauggauacaaggcaggccagccuagcgucugugcucuaggguuugugcuggcuucuuccuuuccaguguguguguguguggggggugggggggauaauuaggaagagggagcgagggagaugggaugaggaagcagggcuaugaauuguaauaccaguuguaccuccauaacaaaccgaggcccaggaggcccaguucugcaagcugaaagagugggaaaggauaucuugucaacaggugggaaagauaaacagaccaggaagacaggggaguucccugguagugcaaaaggcgucaguggaugaguaagggacacauguaccgaagcuuuuccuaagugacaccgucaccaugauagaccugucuccuuggagauuacuguaaccaauuuauugacaaaagguucagaggccaucuccccccaguccuuccugcaaccuuucaaaccacccagcacccagcucuucaggaagauucuagagcuccucugaacugaagccaacguggaagggaaacagaggagucuuugagaaauccauccucccuacuacuuuaggcaaagugaaaccucuggcgccuuagaggcaggagaauaguuguuucuauccccggaccucagguuucuguaaagaacccugcucacaccugauccccgguuaaacucuucccuagaaaccugcacgggaagauaagcccgccauccaagcugaagccagccagauuugcugaaaagcagggaaagcaagagggggugauuuuuaaacccuggagggugggggagacuugggggugaggucgagggacgaggaagacaguugcuaacagccuuugggacaggcagguacccagcugugguacagagccuguuucccaugcugccugaauuaagauccuggguagaguggcccaagauuuaacaauacacagaccugugccacaguccccuggaaggugccacuccaacacauaagggcuggacaaucuucuagggggagcugacucaaauagucgauugauuccccucuugcacccgccucuccaccucuauccccaaauggcccauccauuucugcaaaugagucaaggcaucccaggccugccagcuccuccagauacccaggcaaagccuguuucugccgcuccaaggguccaggaagccuagccuucuuggauaagaggggaggaagagugccuucuaaacugggcagguuaccuaaagaagccugcuuaccuucuuauauaaccugaugugccugacgggaucccaagggaacuggggacugccccgugguucccuccuaacccagccagagcccgccgcagcaaugcucuuaagcgaaggaagcccuguugguuagaugccuuucucaauacccuccccuccaggucuugcaaagagagcuacggaagaggcugaggcgcgaccugucagcaggucuggggcgugcaugcccccuugagucccccgcaguccccggcacaguuuucucccgcucaccccgcccucuccuccgucugugcacagccucccagcaagagcacuggggaaggaaagcaaggagggagcgccccgcugucccggccacagacaggacuguccugcccagccggggaaccaccggugggcagcggcugcagccauccgauagaguauuccggcccugggguggcgggagccccagcgguagcuacuccgggggaggccaccccaggugcccgcagccccgccuccccccuccgugaacccaccgugcagaagccgcuggcggaggcggcggccccgggcccagaacccugcugcaggcgcggugcccacuccgcgcugcugccgcccgcugcccaggcccgucccggcccgggagccgccgcggcgccagccccgccgccgccgcugcagcguccgcugccgccagcgccccccgucgcggccgccgagugucccucccgcaggcuguggcgggcggcgggacggguugcaucagccccggcuauauagcgggcccugaguggcggggaggggucgggaaugcggaaccggccgagcugccagcuccacacgucagagggggacggagaggaagagaaggaggggacggggaggaggggguguggaucgcccgcuucacacccacugaccuucaccucccccgccgccggcgcccuccucccgccgaugcucgcgcuccuccgccugcggggccggcccgggccccgccgcgcuggucccggcagcauugcgguccggcggcgcgccccgcccgcggcucccgagagcgcgaggcagcaggacacggcgagcgguuauguaagcgcauccccugcucggccuugcggccgccacccccaaaaugcuacacagcccgggaggcagcgacgcgaaggcggcggccggaugagcagagaaccccuuccagcucagcccacgccgaaccauccuccuccguccggug

SEQ ID NO: 10637 - RNA, 2501 nt, Mus musculus
ggaaggaaggaaggaaggaaggaaggaaggaaggaaggaaggaaggaaggaagaaaagaaaaaaggagcacuggcagagggcugaguucauccagugugaucucccgguugacagaaggggaaacugaggccugcaaaggggagggauuuacuggaaguuacaaaggaagacagucauaaacgccaucuagaacucgggucuuccaggucagcauucuugcuucuauagcugagguguacuuucaggaaauuccgaaccgaccgccacaauuccuuccgcgcuaggaaucccccaggaguuugcgcuguguggcgaguaauaaacuuccuccgcaacucugcaguucucagcgcccuaaaaaaagagaggugagaagggaaaggacguccagggcaucccugcaauaacuuguagcuaggggcuucgggguggcagcagcaggacgacgacccggugcgaaagcgcuggcccuuuaagggggggacggagcgcaugcgcggcgcggcgcggcgcggaccggugucgagccgggugggcggcgggagggcuggggacccggcaggcggcagcgguggcuucugcuucgccgagccgggacgcagcgaucggccgaugggcugcaccuucucaggcuguugcucuccccagggauccacgcaccgacgcccgcccucgcuuugucaguggauuccagccgccgccacgggcggagccugaggaccugcgcucgcgccccgcacgcccagcuucgcucagcuuggccgcgggaacccuagcgcagcauccuuuugcccgcucaugcugcagcugcuggccagcggcgaagcugcggcuggagccugccgcucagugaccucagcccgguccccgagcgucgcccgagccgcucuccacgauggcugagcuuggggcuccgcgccccucuuuagcucagcugggaccguuuagcgccaggugcacccggugcccccgcugagccgcgccaguccaggguucccagggccugggcuccccuagcccucgccuucccgccgcgcccuuccccucccgcccucuccgcugcugcuccccggggcuaggggcuaggagacccagacaaagccccacuuugugagggaggcaggcuuggaaugugcggagcggcgcgcgcccccuccccgccccaccagcugcgagucuugguucccaggagggucgugaccgagaagucaccccggacaucgcccucuacccuugcauccccggcccccgagguccagacucggagcucacgcggguccccucugcucgcuccagugugagugagcaaggauuucguagaggaauuuguucuguccaaaacugagagugggcaccggugacuuggccugccuuuuugguguagcugcaggucugagcugucuggccucagucuccccaccccgaccccccacuuuucuccucucagccaucguagaucgcugugggucauuguucucgcugccaaauggaggugauuuauacaggcugccaaguugggguguguucucuuuauccuguuuuccaaacaaaacaaggccucuaaggucgacccugggcaacccaccuggccaucacuccugguugaugcucugaguuaccaaaugguauuuuauuguacaggagccacgcccugguuucuuaaaggcgccaggcacuguuugaccauguguuaucuuuauagcgggugugugggaggccuucugugaggcacuuauuccccccccccccaccuccugaucaucgucccacccccguugaggauuuagggaugccagggggaaagaagguggucccaaguggcagcagcagugccuccccgaacgcagccgccaccaccacugcugcugcugcugcugccgcugcugccccccacucuggcacuaaacguuuggagaccaccgaaggggccucagcacagagagaugaggaacccgaagaggaaggggaagaggaccuacgagauggaggugucccuuuuuucaucaaccgagguggacugccaguggaugaggccaccugggaaaggauguggaagcauguggccaagauccacccagauggagagaagguggcccugcgcauccguggggccaccgaccugcccaagguaagacauggaggggccaggcacagugaagauggguuuuauugaccuugaagcuaagaaaguaaccuacacuauuuuguugcugaugaaugaaguagagggaccauuguuguggugagauuuuuaaaguauagguaggugccaucuguccagaaguuucuucccagugcuuuuggagucauuugaugggggaagcucaguccccuaucuccaggaggcccucccucauggcauccugagcaggaucacaaaugaacuggagaacugguguagccuggccucucuuuggcucaggauacuugagaagccagaaaacuaugaggcuauuggugacugacugggagagugcagggcuugcuguguaugagaaaa

SEQ ID NO: 10638 - RNA, 2501 nt, Mus musculus
uuuucucauacacagcaagcccugcacucucccagucagucaccaauagccucauaguuuucuggcuucucaaguauccugagccaaagagaggccaggcuacaccaguucuccaguucauuugugauccugcucaggaugccaugagggagggccuccuggagauaggggacugagcuucccccaucaaaugacuccaaaagcacugggaagaaacuucuggacagauggcaccuaccuauacuuuaaaaaucucaccacaacaauggucccucuacuucauucaucagcaacaaaauaguguagguuacuuucuuagcuucaaggucaauaaaacccaucuucacugugccuggccccuccaugucuuaccuugggcaggucgguggccccacggaugcgcagggccaccuucucuccaucuggguggaucuuggccacaugcuuccacauccuuucccagguggccucauccacuggcaguccaccucgguugaugaaaaaagggacaccuccaucucguagguccucuuccccuuccucuucggguuccucaucucucugugcugaggccccuucgguggucuccaaacguuuagugccagaguggggggcagcagcggcagcagcagcagcagcaguggugguggcggcugcguucggggaggcacugcugcugccacuugggaccaccuucuuucccccuggcaucccuaaauccucaacgggggugggacgaugaucaggagguggggggggggggaauaagugccucacagaaggccucccacacacccgcuauaaagauaacacauggucaaacagugccuggcgccuuuaagaaaccagggcguggcuccuguacaauaaaauaccauuugguaacucagagcaucaaccaggagugauggccagguggguugcccagggucgaccuuagaggccuuguuuuguuuggaaaacaggauaaagagaacacaccccaacuuggcagccuguauaaaucaccuccauuuggcagcgagaacaaugacccacagcgaucuacgauggcugagaggagaaaaguggggggucgggguggggagacugaggccagacagcucagaccugcagcuacaccaaaaaggcaggccaagucaccggugcccacucucaguuuuggacagaacaaauuccucuacgaaauccuugcucacucacacuggagcgagcagaggggacccgcgugagcuccgagucuggaccucgggggccggggaugcaaggguagagggcgauguccggggugacuucucggucacgacccuccugggaaccaagacucgcagcugguggggcggggagggggcgcgcgccgcuccgcacauuccaagccugccucccucacaaaguggggcuuugucugggucuccuagccccuagccccggggagcagcagcggagagggcgggaggggaagggcgcggcgggaaggcgagggcuaggggagcccaggcccugggaacccuggacuggcgcggcucagcgggggcaccgggugcaccuggcgcuaaacggucccagcugagcuaaagaggggcgcggagccccaagcucagccaucguggagagcggcucgggcgacgcucggggaccgggcugaggucacugagcggcaggcuccagccgcagcuucgccgcuggccagcagcugcagcaugagcgggcaaaaggaugcugcgcuaggguucccgcggccaagcugagcgaagcugggcgugcggggcgcgagcgcagguccucaggcuccgcccguggcggcggcuggaauccacugacaaagcgagggcgggcgucggugcguggaucccuggggagagcaacagccugagaaggugcagcccaucggccgaucgcugcgucccggcucggcgaagcagaagccaccgcugccgccugccggguccccagcccucccgccgcccacccggcucgacaccgguccgcgccgcgccgcgccgcgcaugcgcuccgucccccccuuaaagggccagcgcuuucgcaccgggucgucguccugcugcugccaccccgaagccccuagcuacaaguuauugcagggaugcccuggacguccuuucccuucucaccucucuuuuuuuagggcgcugagaacugcagaguugcggaggaaguuuauuacucgccacacagcgcaaacuccugggggauuccuagcgcggaaggaauuguggcggucgguucggaauuuccugaaaguacaccucagcuauagaagcaagaaugcugaccuggaagacccgaguucuagauggcguuuaugacugucuuccuuuguaacuuccaguaaaucccuccccuuugcaggccucaguuuccccuucugucaaccgggagaucacacuggaugaacucagcccucugccagugcuccuuuuuucuuuucuuccuuccuuccuuccuuccuuccuuccuuccuuccuuccuuccuuccuucc

SEQ ID NO: 10639 - RNA, 2501 nt, Mus musculus
auuagggcuucccacagaaccccacggguucugggcuacggguagagaguuccacggccaggggaggacagaagcccuggcagggccaaagauggacugacugugcgguugcgccuguucccucccacccccaggcucaugcuucacuucuugugaggucccaggcaacaccaccugucuuuuaugccacaccuccacauuuaaacacugcuaaagauccugucuggcucagugggaggugggaccuaggagucccugacuugggcuuugggguuucgucuacuuggcggcuagcgagcaccugagagaaguggaacugugaaacugggcaaccggggcuucccagacgccagguuuggaaaggcuggggccagaaggagggggcugcccgcagaggggagcugcagagugccgugauccuccaauccugcagagugcucccaagcagaggugaccuccagcgaggggagucccuggacccuaggccuguagggcgaauccaccgguuucccggugaucucccgggagggugcaagcaaggcuggaggcgggcgcucagggcgcggccaguggcuccuggggggcgcaucggcggggcuggcuggccggccuuuggcugcuauuucugcagacugccaggagaauggcgggacggagggcuguggcccggaucgggcccggggcgcugcugguucugcgcgcucugcuggccgccgcgcacccgcagugcuuggacuucaggccgcccuuccggccgccgcagccgcugagcuucugcgcgcaguacuccgccuucggcugcugcaccgcggagcaggacgcggcgcuggcccggcgcuuccggguccuggagacccgcauggaugccggggugugggcgacgugugccggcuacgcucuggaccugcugugccaggugagcgggugcacggaggcacguggaacacuagucgcuggcggcgggggcgggggcggagcaggaauggcauccccagaagggcgauacucaggagugggucccagacuuggaggggaaugacgacccuacaggcaugagacuuaggaauggauccugaacuuuggaggugauggcaaccacaggggcaagggucgggagcggguaccagacuuuggagcuugggggguccaagagggagugacuugguaucaggcgggaagaccuggcuagcuagcucuugucauucauuugcuuugcaaagauguugggcuuuuuuuuuuuuuuucccucgagacaggguuucucuguguagcccuggcuguccuggaacucacucuguagaccaggcuggccuugaacucagaaauccgccugccucugucucccaagugcugggagacagaggcaacaccacugcccugcugauguugggccuuuuaggagccucaguuccucuuagagacucaagacuccuauucucugggacacccuggaagcucccgcccccuccccccuccuccagugccccacugcagagaguccuaucucugucagguaccaggaugaagucuuugcuaagucuaggaaggcaggaugggaagauauguagccaaaucugaggcaugacuuugucagcagucuggggacugcuuauuccgaugaggacucuuccacaggcagacugaaaggaguagucugagagcccauuccucagggccaggaugcuuaaagcacccaccuuucuuuucagcuacuggucuccucaccugguagagucucuccccagaugaguuacucucaucucuccucugauagugaagcccuuacuucgauccacgcugaacuaucgcuucccuuaugucgaugcggaguauccugccugacugaucugauugcaggaaugccagccagccagccagccagggaaaccccaaggcgggcccaaccuaggucuguaaggugaaggauucacgaauagaaaccgcccuccaaccccugccagacaguacgaaguucagaucccagccagcagggggcaaccugcaggggaagacuaaagggcggacuuggguuugauauaguacaucuucucgugacugagagcuugcgagguucacggcugucuuucaaugacauuaucuuuaaaacaggaucagaugucuaucccucaccccauaccacagagauuaaacggcauaggcagagcaguccauuugggguuuguagguaaauuccucuagugcuuccuugcuggccuagagagagagcggggaucaggagcugcuucaggaaaguggugacauggcccaguggcaggucaaaagaccuggaccacacucaacgcccuugugaaaaaaagaucauggagauaaggagaugguggaggggagaccacagcacucuaggguguccuguucaucuugccauggguucuacuaagccaacacuuggugcaucccaagagagccagaggguguggugaacccacucaccucucuccccauccuggaaguccacccagaugugcccacugcuaucccug

SEQ ID NO: 10640 - RNA, 2501 nt, Mus musculus
cagggauagcagugggcacaucuggguggacuuccaggauggggagagaggugaguggguucaccacacccucuggcucucuugggaugcaccaaguguuggcuuaguagaacccauggcaagaugaacaggacacccuagagugcuguggucuccccuccaccaucuccuuaucuccaugaucuuuuuuucacaagggcguugagugugguccaggucuuuugaccugccacugggccaugucaccacuuuccugaagcagcuccugauccccgcucucucucuaggccagcaaggaagcacuagaggaauuuaccuacaaaccccaaauggacugcucugccuaugccguuuaaucucugugguauggggugagggauagacaucugauccuguuuuaaagauaaugucauugaaagacagccgugaaccucgcaagcucucagucacgagaagauguacuauaucaaacccaaguccgcccuuuagucuuccccugcagguugcccccugcuggcugggaucugaacuucguacugucuggcagggguuggagggcgguuucuauucgugaauccuucaccuuacagaccuagguugggcccgccuugggguuucccuggcuggcuggcuggcuggcauuccugcaaucagaucagucaggcaggauacuccgcaucgacauaagggaagcgauaguucagcguggaucgaaguaagggcuucacuaucagaggagagaugagaguaacucaucuggggagagacucuaccaggugaggagaccaguagcugaaaagaaaggugggugcuuuaagcauccuggcccugaggaaugggcucucagacuacuccuuucagucugccuguggaagaguccucaucggaauaagcaguccccagacugcugacaaagucaugccucagauuuggcuacauaucuucccauccugccuuccuagacuuagcaaagacuucauccugguaccugacagagauaggacucucugcaguggggcacuggaggaggggggagggggcgggagcuuccagggugucccagagaauaggagucuugagucucuaagaggaacugaggcuccuaaaaggcccaacaucagcagggcagugguguugccucugucucccagcacuugggagacagaggcaggcggauuucugaguucaaggccagccuggucuacagagugaguuccaggacagccagggcuacacagagaaacccugucucgagggaaaaaaaaaaaaaaagcccaacaucuuugcaaagcaaaugaaugacaagagcuagcuagccaggucuucccgccugauaccaagucacucccucuuggaccccccaagcuccaaagucugguacccgcucccgacccuugccccugugguugccaucaccuccaaaguucaggauccauuccuaagucucaugccuguagggucgucauuccccuccaagucugggacccacuccugaguaucgcccuucuggggaugccauuccugcuccgcccccgcccccgccgccagcgacuaguguuccacgugccuccgugcacccgcucaccuggcacagcagguccagagcguagccggcacacgucgcccacaccccggcauccaugcgggucuccaggacccggaagcgccgggccagcgccgcguccugcuccgcggugcagcagccgaaggcggaguacugcgcgcagaagcucagcggcugcggcggccggaagggcggccugaaguccaagcacugcgggugcgcggcggccagcagagcgcgcagaaccagcagcgccccgggcccgauccgggccacagcccuccgucccgccauucuccuggcagucugcagaaauagcagccaaaggccggccagccagccccgccgaugcgccccccaggagccacuggccgcgcccugagcgcccgccuccagccuugcuugcacccucccgggagaucaccgggaaaccgguggauucgcccuacaggccuaggguccagggacuccccucgcuggaggucaccucugcuugggagcacucugcaggauuggaggaucacggcacucugcagcuccccucugcgggcagcccccuccuucuggccccagccuuuccaaaccuggcgucugggaagccccgguugcccaguuucacaguuccacuucucucaggugcucgcuagccgccaaguagacgaaaccccaaagcccaagucagggacuccuaggucccaccucccacugagccagacaggaucuuuagcaguguuuaaauguggagguguggcauaaaagacaggugguguugccugggaccucacaagaagugaagcaugagccugggggugggagggaacaggcgcaaccgcacagucaguccaucuuuggcccugccagggcuucuguccuccccuggccguggaacucucuacccguagcccagaacccgugggguucugugggaagcccuaau

SEQ ID NO: 10641 - RNA, 2501 nt, Mus musculus
cgugccaccgcccuccacgcggcugcagccacggcggucgaggaggcgcacgcgcucuuccacugggaaguccugcaccguucgcaggaugcgccgcaggaugcccacgcgguuguagcgcaccgccagcgccacgugaggcccaggcgcggugcagcagcggaagcccgcgcuagguggggcgagugcacaccgcgggaagguagcuagcagguagugugcauaggcuugguggucgugcacaagcgcauagagcagagccuccgaaggcgaauaggccgcagcgcgcccccgcucaucacaguggaaggcuucgcuggcacguauguccucgaguagccaaacuggcagcugaucucgcacugccagguagaaggcgaaggaugacuuccggcacugcuucugcacccgcaagcgagcugcgccgggacccucgggcccuccguuggcgcugcguccaggccuggugucccacggcaugcuggccuccgggagucucaaagcaugggucacaccaccccagaccaaccugugagacgaaguagggucgaaugaaucgggucugccagucacugcccccagcucuauucucuccuggacccagaaccauucuugaauuucugcaccugcacuuccucucuugccugugcuagagaaggcuggaucugcuggagccuuccgugugccaacccucugcagcccuggaaccuucaaaaagcgcuccuuucacaccugagccagguccuuccaacugcaaauaaagaggaacccaugggacaucgcagaagacucaggcucacagcacaaguugagcccaaaucacccucacacccccaaauccagccccaacucuacuucuacccugaccccaagagacuacucaaacuucuuuccaggagggucguggagauuauucacuuagaccuaccugguuccugcaggcggcccuggguucuguagaugcagguauucacucuaacacaccaaaccucaucaacaagaaagugguggcccagggcuggcagugcgcccgcccgcagccagaguuggaaaguggcucuggcucuuuuauccacaaacaauuuuccugcccaucaggaaggagcuccugggaggagggaaaaggugaagucaguggggggauuggagcauacaccaccugcaguccucucgagguccauccacaugaggccgauacugccaucucacuuuucaacgggggacaagcuaguccaaggucagucaccaagucaggcugagccaggacaagagccuaggucuccugcguucuguuugagggccguuccauacacugcagaccccaguuuaaaaacccuaccuccaccuugggucccaagccucaaaccugagcccuggccauucacccuuggucucccugcccaagagcccuacugccuccagcaaggguaagcucuagguuacaagggaccugggacagccagagggccucguccacagugucaugaccauuaacuggguuacagaggugagcacuauagagugggcugcggcagacgccccucugaggggauuggcaugacugcagcuccucccggaaccugggcccccugcgccccagaugcacugugugggcacgcguggggugccgggcggguuacguaaaguucggccgccccacgucacugggcagagucacggccgcggcucugugacuggagcuugggccgccggccagauccucccugaccccucccggggcgcgcccgagugucugcgggccgguggccaggaucaggggcugcaccugcgcaccggggcgcucggggcaggcgacucaccaagccgcgcgacccugucccugcggcgggccggagcgcgcgccguccaugcacgggcgagcagacagagaucccacgacgccgggagcggaggcagcgcccgcugcacucugagccgccgcgacaccgucucccgaugccggugcuggugccgccgaggggagggcggcgggcggcgcagugcggccggggccgggcaggaccgcgggacgggccgccgccgccauuggcucacgccgccggcccccgccgcuacccauuggucgucgcgcugcaccauuguugcgucacgggccagggggcgggacucucagagggacccgcggaaaacuucggagaaacuugagggccccgagguggcgggguggggagggguggugagagaugccgggcaccgggcagagcuuggagggcgggacgugauggaggcggggcgagucccggcaggcuccuggagcuggaucugugcgguccuagacugcacacaagaauaggcucccuggcuugcgcuugcggcugcugcaagaguccugcucugggcuucccuugcucugacccucacugaccuuggggaaacauccagcuguuaccccaucugcgugugggaaggccuagaauaggacugagcccuuaaacuauugaaccuugcucugcccugccaacgcccuggcauggcuagcc

SEQ ID NO: 10642 - RNA, 2501 nt, Mus musculus
ggcuagccaugccagggcguuggcagggcagagcaagguucaauaguuuaagggcucaguccuauucuaggccuucccacacgcagaugggguaacagcuggauguuuccccaaggucagugagggucagagcaagggaagcccagagcaggacucuugcagcagccgcaagcgcaagccagggagccuauucuugugugcagucuaggaccgcacagauccagcuccaggagccugccgggacucgccccgccuccaucacgucccgcccuccaagcucugcccggugcccggcaucucucaccaccccuccccaccccgccaccucggggcccucaaguuucuccgaaguuuuccgcgggucccucugagagucccgcccccuggcccgugacgcaacaauggugcagcgcgacgaccaauggguagcggcgggggccggcggcgugagccaauggcggcggcggcccgucccgcgguccugcccggccccggccgcacugcgccgcccgccgcccuccccucggcggcaccagcaccggcaucgggagacggugucgcggcggcucagagugcagcgggcgcugccuccgcucccggcgucgugggaucucugucugcucgcccgugcauggacggcgcgcgcuccggcccgccgcagggacagggucgcgcggcuuggugagucgccugccccgagcgccccggugcgcaggugcagccccugauccuggccaccggcccgcagacacucgggcgcgccccgggaggggucagggaggaucuggccggcggcccaagcuccagucacagagccgcggccgugacucugcccagugacguggggcggccgaacuuuacguaacccgcccggcaccccacgcgugcccacacagugcaucuggggcgcagggggcccagguuccgggaggagcugcagucaugccaauccccucagaggggcgucugccgcagcccacucuauagugcucaccucuguaacccaguuaauggucaugacacuguggacgaggcccucuggcugucccaggucccuuguaaccuagagcuuacccuugcuggaggcaguagggcucuugggcagggagaccaagggugaauggccagggcucagguuugaggcuugggacccaagguggagguaggguuuuuaaacuggggucugcaguguauggaacggcccucaaacagaacgcaggagaccuaggcucuuguccuggcucagccugacuuggugacugaccuuggacuagcuugucccccguugaaaagugagauggcaguaucggccucauguggauggaccucgagaggacugcaggugguguaugcuccaauccccccacugacuucaccuuuucccuccucccaggagcuccuuccugaugggcaggaaaauuguuuguggauaaaagagccagagccacuuuccaacucuggcugcgggcgggcgcacugccagcccugggccaccacuuucuuguugaugagguuugguguguuagagugaauaccugcaucuacagaacccagggccgccugcaggaaccagguaggucuaagugaauaaucuccacgacccuccuggaaagaaguuugaguagucucuuggggucaggguagaaguagaguuggggcuggauuugggggugugagggugauuugggcucaacuugugcugugagccugagucuucugcgaugucccauggguuccucuuuauuugcaguuggaaggaccuggcucaggugugaaaggagcgcuuuuugaagguuccagggcugcagaggguuggcacacggaaggcuccagcagauccagccuucucuagcacaggcaagagaggaagugcaggugcagaaauucaagaaugguucuggguccaggagagaauagagcugggggcagugacuggcagacccgauucauucgacccuacuucgucucacagguuggucugggguggugugacccaugcuuugagacucccggaggccagcaugccgugggacaccaggccuggacgcagcgccaacggagggcccgagggucccggcgcagcucgcuugcgggugcagaagcagugccggaagucauccuucgccuucuaccuggcagugcgagaucagcugccaguuuggcuacucgaggacauacgugccagcgaagccuuccacugugaugagcgggggcgcgcugcggccuauucgccuucggaggcucugcucuaugcgcuugugcacgaccaccaagccuaugcacacuaccugcuagcuaccuucccgcggugugcacucgccccaccuagcgcgggcuuccgcugcugcaccgcgccugggccucacguggcgcuggcggugcgcuacaaccgcgugggcauccugcggcgcauccugcgaacggugcaggacuucccaguggaagagcgcgugcgccuccucgaccgccguggcugcagccgcguggagggcgguggcacg

SEQ ID NO: 10643 - RNA, 2501 nt, Mus musculus
agucuuauugucauugugccuagaagagggguaaagucaggcuggagucccugccagaauguggccuuagaucacacccaagaaagacacuauaggugggugaccucaaacaaaaugcuuccucaacaaagugcuggaaugugagcugucaccaagacgccaaucccagcaacaguggaggaaggcagcucauauacaucucaaucaccagucaugugcuguguggcccgcaagggucuggagccuccagagcaucccaccagaggaagcacgccuccgcccgcucagucugcagggguaggagcccugcccggacgggugcggaggcuuuugcgucauuggcaccuggcacgaucccggcggaauaagggggugagaagguggagagaaaacaagaagcgccggcucccaggaggagggcggagaacagacgccaaagagacuggucaccacccuugagucccuggagacugcggccucccgcagcgcaaggaccacagucauccgcagaaccaaggucaccugggcggagggaggcacugcacaaacuaggaauucagggcaggccccaccuucuagggacugggggggggggggggcucguaccauaugccacgagcauccggccagucccgggccaugccggaggccagcagcagaggcgacacaggcuuaucgaagaggaaguggucgucaaugagcugcugcugcuccgccucagucaugcucuugagcgcguaguaccugccagacaggucgccaucuaggcuggacagagcugcggagugcagaguucaaggacagggugggcgggcgagcaagcccgccgccccgccugcagcaguguguccccgcgggcgaaggugggucuucgacccucaguccccagugggaacgcgcgcgcagagaagagcgcagcagcucuggaggcuguuacccgaccccuaccuucuacugccagcuucucgauggcgcggcgcuccccgcggcugcagugcggggggagacagaagccgcggaugcugcggccugugcgcacucgcgagcucagcacguaguugggguccaggucaucgccacccugggaauacaaggugguggcuagagugagcgccgagaccccucuccccagcacgcccggacccugauuccccgcaccugcagguugucuggguugaggucggucuugugcucaucacugggcugguagccgccgugccgcuccucaauaauggggucgaagagguccuugaauacgucguaacucuccucgucgcccgccacugcacccacagucaugauguacggguggccuggaggaggggcgcggcgacagugacgucaccgucaggcaggagcaagccgaggcucuuaaggcuaagcgcggagaggggaacaggggaccccagcccaccgaagguucagggaagagcagugggauccuugcccggggggcuucuuggggaggcggaagccugacgcuacaggggugugcauacccggauugucuacgccagucugaauggcgucguccaaaguaaagccgcucggcgugcacuuggcacggagcucggcguacagcuccggggucagcaccuuggccauaugguuguuguggcugcucagaucagggaacucauccucggccgggaagcgcagcuucugcguauuauggcuguuggagaagggcauggcggcggcagcgggcugcagggaagagcggggucagaggagauuuaaacaccggccgccagggaccugcaaaccacuugggacccccgagacuuucccuggacgccaccaaggucagcgaggucugcaucgucagaguccagcgcaucccaaguucccgggcggguccgaugagcgcucccggcagcgaggcugcgcgugaugccccggucccgcaccccacagcguagagccccgcaggacuauaccccuggcccuuggacccgcucaccgggaugccggacgaagcaggggcgauggaugccugugcuugcagcuccuggcgcagcgcagaagaacgacggcugcucgcugcucccugagcucuuaaggggcgcgucgccggccucccauuggcggcuauuuauagcccauucauuccauugguccgcgcuuugggguggugccgccgcuuuguccgaggcagcagcccuugacacccccagcggcccacccuagcgguccccaagucucgaccccgcugcgcaguuuggccaccccgguggugcucgcacaggaucccuaagacgaaaccccagagccauagauauccuagaccugcuucacacacacugccgggggcaggaaacugagucugggaagccagauggcacuugaggcuccugccuucccugucuccucaggccgacugcguuguagagagggucauggugagaguccagguuuuuaacauuggguacagcauccaaacaccgcauccaggccauauccucaagagccacagagccgccgaccuuccucaaggugcc

SEQ ID NO: 10644 - RNA, 2501 nt, Mus musculus
ggcaccuugaggaaggucggcggcucuguggcucuugaggauauggccuggaugcgguguuuggaugcuguacccaauguuaaaaaccuggacucucaccaugacccucucuacaacgcagucggccugaggagacagggaaggcaggagccucaagugccaucuggcuucccagacucaguuuccugcccccggcagugugugugaagcaggucuaggauaucuauggcucugggguuucgucuuagggauccugugcgagcaccaccgggguggccaaacugcgcagcggggucgagacuuggggaccgcuagggugggccgcugggggugucaagggcugcugccucggacaaagcggcggcaccaccccaaagcgcggaccaauggaaugaaugggcuauaaauagccgccaaugggaggccggcgacgcgccccuuaagagcucagggagcagcgagcagccgucguucuucugcgcugcgccaggagcugcaagcacaggcauccaucgccccugcuucguccggcaucccggugagcggguccaagggccagggguauaguccugcggggcucuacgcuguggggugcgggaccggggcaucacgcgcagccucgcugccgggagcgcucaucggacccgcccgggaacuugggaugcgcuggacucugacgaugcagaccucgcugaccuugguggcguccagggaaagucucgggggucccaagugguuugcaggucccuggcggccgguguuuaaaucuccucugaccccgcucuucccugcagcccgcugccgccgccaugcccuucuccaacagccauaauacgcagaagcugcgcuucccggccgaggaugaguucccugaucugagcagccacaacaaccauauggccaaggugcugaccccggagcuguacgccgagcuccgugccaagugcacgccgagcggcuuuacuuuggacgacgccauucagacuggcguagacaauccggguaugcacaccccuguagcgucaggcuuccgccuccccaagaagccccccgggcaaggaucccacugcucuucccugaaccuucggugggcugggguccccuguuccccucuccgcgcuuagccuuaagagccucggcuugcuccugccugacggugacgucacugucgccgcgccccuccuccaggccacccguacaucaugacugugggugcaguggcgggcgacgaggagaguuacgacguauucaaggaccucuucgaccccauuauugaggagcggcacggcggcuaccagcccagugaugagcacaagaccgaccucaacccagacaaccugcaggugcggggaaucaggguccgggcgugcuggggagaggggucucggcgcucacucuagccaccaccuuguauucccaggguggcgaugaccuggaccccaacuacgugcugagcucgcgagugcgcacaggccgcagcauccgcggcuucugucuccccccgcacugcagccgcggggagcgccgcgccaucgagaagcuggcaguagaagguaggggucggguaacagccuccagagcugcugcgcucuucucugcgcgcgcguucccacuggggacugagggucgaagacccaccuucgcccgcggggacacacugcugcaggcggggcggcgggcuugcucgcccgcccacccuguccuugaacucugcacuccgcagcucuguccagccuagauggcgaccugucuggcagguacuacgcgcucaagagcaugacugaggcggagcagcagcagcucauugacgaccacuuccucuucgauaagccugugucgccucugcugcuggccuccggcauggcccgggacuggccggaugcucguggcauaugguacgagcccccccccccccccagucccuagaagguggggccugcccugaauuccuaguuugugcagugccucccuccgcccaggugaccuugguucugcggaugacugugguccuugcgcugcgggaggccgcagucuccagggacucaaggguggugaccagucucuuuggcgucuguucuccgcccuccuccugggagccggcgcuucuuguuuucucuccaccuucucacccccuuauuccgccgggaucgugccaggugccaaugacgcaaaagccuccgcacccguccgggcagggcuccuaccccugcagacugagcgggcggaggcgugcuuccucuggugggaugcucuggaggcuccagacccuugcgggccacacagcacaugacuggugauugagauguauaugagcugccuuccuccacuguugcugggauuggcgucuuggugacagcucacauuccagcacuuuguugaggaagcauuuuguuugaggucacccaccuauagugucuuucuugggugugaucuaaggccacauucuggcagggacuccagccugacuuuaccccucuucuaggcacaaugacaauaagacu

SEQ ID NO: 10645 - RNA, 2501 nt, Mus musculus
cccagggucggaugaagagcacuccuaucucacuuuuacaacauacagcauuuggugcuacuuucaucuuaugaagaaacagcauugguucaaaguggaaaaugcccagucccuucaaaaagaaauguucuuucaagagauuuggcagcucuuuuguuuuaaaagggaaaccacuuuaaagaaaacagagccauagaaaaggauggugggaaaaaguucaagguguauuaacauccugcuagaaacaguuucccagacuuuccaguuacaaaauuccaucuccuuaaacaagucugcuaacuacagucagaagaacacugcccacuggauccaaauaguuccaaaacguucagcuucuugggcauugcucuuacguucuuuuuguccggggacaaaugacuccaaaaauuaaaauccuccugacgggguuagggggaaaucaccguagcagaugggggacuaggcacuuuucaguuuaguaguacuaacuucuauuuugcaaaauacaaacuuguauaugcacaaaaaccauggaaggauacagagacuuuuuuuuuuuuuagggagguaaaucauggacugaagugacauucaacuuuuuagucauuuuucugcaauguuuguaaaaaauuuuaaugacaucucaaaaagugcuuuuuacuaacacaguagguacaauagcacugguaaaugguaaaaccauuuacuauuacuuuggccauacaaagccuuuguuguuaaacgucccacagugaaacaaacagguugucacuugucaucuuucccuuuugucuuucuguacaccauuucucgaaagcuggcuaggaucuuauuuucucucuuccgccucucuucuugguuaaaggaugcaagggcucguuucucaucagcacuguaaaucugguucucuuuacgcagucuuacagccuccauucggcgaugccugcuaccacucaugacguaaccugaacauucaaaugaggcaaucucuucacuugucaacccaauuucaccucuucgugggauacgcuucccggcuuuuacauauucagccauugcugcaccuucaccaggaagcagagcauggccauaauucaaagguuucucaucuugagagguguguaucacaggugcuucugggccuauuaaauccaugcucucugcacucaucgacuguuccauccacgcaucuucuggcaagucccuuucugaagcuuugcagcuuaugucauuguauucuuuuuuaguccucuucuucuugagcuguuuugcccgauguuucuuuuucuucucuuucuucuugguuuuaacuuucuuuuuaucacuaucagagcuagaaugacagucugaacugcugucauaauauuuuuuaugcuuccuuuuggaaggcuuuuucuuucuuuuuuucuuuguugaaugacuggucuuuguccuuuuuucuucauuggugaaaucugaacugcuacucuucugauucuucaccucaucuucagcugguguauguucaucagaaucuggcucaggaaucuugggugacaguccccauaccucaggcgcucccagcucuccaauccucucucuuuccuucagccuccuuugccuauaacucuccuccuuuuccuucuccugguccucagcccacgaaggaucucccgcauaguuguggugguaacgguauccaccacagaugggagaggaagagcaggcaagcguacggauccccagcgguagcggucguucuccagaccuggggcggcugaugggaugcaguggccggacgcccugagcaccccgcggaggcuggagccccucaggaccgcugaggagagagccgaaaccgccuccccgaggugaucggcuagucuguaacgccgacggugggcucuccgagaaacgucgucguuucugagagcccagaguguccucauuagggcgagaucgggauacaggcgacaugguccgccuucaaucaaccaccgcgguggcgguuauuccagaagucacaacacagagagcacgcagcucccgcacaacccgcacacagcgcaggcgcacuagagacgggcgggcuguaggcgggucaauuccggggcguagcccggugcagcccuaguccgaaccguggcgcugagccuccgauggaagcgggaagcagcccagagccugcgcaagagcccucuucaaccucuggggcguggacagucacuucacuucucacuauuuacauuccccaccuugagccccaggggaaacaaaaggaauuaucauuaaugaguccugcugucugucuguauugcugugcuuuuuauuuuuucgauacagguuuucucuguguaguccuggcugucuguccugaaacucccucuguagaccacgcuggcuuggaacucaagagauucacaggccucugcaucccggguacugggauuaaaagugcuggccaccaccuuaaggcuauuugcuuugcuuuuuuuuuuuuuuuuuuuuuuuuuuuuuuuuua

SEQ ID NO: 10646 - RNA, 2501 nt, Mus musculus
uaaaaaaaaaaaaaaaaaaaaaaaaaaaaaaaaagcaaagcaaauagccuuaaggugguggccagcacuuuuaaucccaguacccgggaugcagaggccugugaaucucuugaguuccaagccagcguggucuacagagggaguuucaggacagacagccaggacuacacagagaaaaccuguaucgaaaaaauaaaaagcacagcaauacagacagacagcaggacucauuaaugauaauuccuuuuguuuccccuggggcucaagguggggaauguaaauagugagaagugaagugacuguccacgccccagagguugaagagggcucuugcgcaggcucugggcugcuucccgcuuccaucggaggcucagcgccacgguucggacuagggcugcaccgggcuacgccccggaauugacccgccuacagcccgcccgucucuagugcgccugcgcugugugcggguugugcgggagcugcgugcucucuguguugugacuucuggaauaaccgccaccgcggugguugauugaaggcggaccaugucgccuguaucccgaucucgcccuaaugaggacacucugggcucucagaaacgacgacguuucucggagagcccaccgucggcguuacagacuagccgaucaccucggggaggcgguuucggcucucuccucagcgguccugaggggcuccagccuccgcggggugcucagggcguccggccacugcaucccaucagccgccccaggucuggagaacgaccgcuaccgcuggggauccguacgcuugccugcucuuccucucccaucugugguggauaccguuaccaccacaacuaugcgggagauccuucgugggcugaggaccaggagaaggaaaaggaggagaguuauaggcaaaggaggcugaaggaaagagagaggauuggagagcugggagcgccugagguauggggacugucacccaagauuccugagccagauucugaugaacauacaccagcugaagaugaggugaagaaucagaagaguagcaguucagauuucaccaaugaagaaaaaaggacaaagaccagucauucaacaaagaaaaaaagaaagaaaaagccuuccaaaaggaagcauaaaaaauauuaugacagcaguucagacugucauucuagcucugauagugauaaaaagaaaguuaaaaccaagaagaaagagaagaaaaagaaacaucgggcaaaacagcucaagaagaagaggacuaaaaaagaauacaaugacauaagcugcaaagcuucagaaagggacuugccagaagaugcguggauggaacagucgaugagugcagagagcauggauuuaauaggcccagaagcaccugugauacacaccucucaagaugagaaaccuuugaauuauggccaugcucugcuuccuggugaaggugcagcaauggcugaauauguaaaagccgggaagcguaucccacgaagaggugaaauuggguugacaagugaagagauugccucauuugaauguucagguuacgucaugagugguagcaggcaucgccgaauggaggcuguaagacugcguaaagagaaccagauuuacagugcugaugagaaacgagcccuugcauccuuuaaccaagaagagaggcggaagagagaaaauaagauccuagccagcuuucgagaaaugguguacagaaagacaaaagggaaagaugacaagugacaaccuguuuguuucacugugggacguuuaacaacaaaggcuuuguauggccaaaguaauaguaaaugguuuuaccauuuaccagugcuauuguaccuacuguguuaguaaaaagcacuuuuugagaugucauuaaaauuuuuuacaaacauugcagaaaaaugacuaaaaaguugaaugucacuucaguccaugauuuaccucccuaaaaaaaaaaaaagucucuguauccuuccaugguuuuugugcauauacaaguuuguauuuugcaaaauagaaguuaguacuacuaaacugaaaagugccuagucccccaucugcuacggugauuucccccuaaccccgucaggaggauuuuaauuuuuggagucauuuguccccggacaaaaagaacguaagagcaaugcccaagaagcugaacguuuuggaacuauuuggauccagugggcaguguucuucugacuguaguuagcagacuuguuuaaggagauggaauuuuguaacuggaaagucugggaaacuguuucuagcaggauguuaauacaccuugaacuuuuucccaccauccuuuucuauggcucuguuuucuuuaaagugguuucccuuuuaaaacaaaagagcugccaaaucucuugaaagaacauuucuuuuugaagggacugggcauuuuccacuuugaaccaaugcuguuucuucauaagaugaaaguagcaccaaaugcuguauguuguaaaagugagauaggagugcucuucauccgacccuggg

SEQ ID NO: 10647 - RNA, 2501 nt, Mus musculus
caccuuuauggcaagauccuuucacgugcuauuuguguucaguacaaacugguauaaagguuacccauauuuuagugauugaugugagagagcuacccugggcugguaguucuggguuguauaacaagacaaggcaaugcacagaauuccuccaugguuucugcuucagugccuaccuccagguuccuuccaugaguuccugcccugaauucccuucaugaugaacuauaacuguaagaugaaauaaacacuuuucgcccaauuaugugggguuuuuuguuugcuucuuuguuuauuuguuuguuuguuuaacaacaauagaaaccuuagcuaagacacucucccucaaggaacagggucaguugggcuauccaucuuacucaaggcuacauuccacauuacauugcaagcugguaucacuggccuuaaugugggacugaaucagauacaacuccauuuuguaauguucuuauuuuucuuuucaaaaaauuugagaagaauuagacuguauggcccuuuuagaggaaguguuuugcuggggaaaagugggggggggggguaaggggagggagauuuuguggcuucaaaagccaagaccaggccuagccuuucuccucugccucucucucucucccccuccuccccucuacucagcaccaugucugucugcuucuagucaugaugaucaugaccuaacccaacuauaagcaagcuaucaauuaagugcuucuuauaagaguugccuugguuauggugucucuucacagcaauauagcaauaaagacaguacccaaugaguggcacugccuggaaaagccauggaaauuaacaaaacaguauuaucaaauauauauauauauauaauauuuauauauuauauauaaauauauaauuauuaauauauuaucaauaguaugaauguguacuguacagacuaggguaucaccacggcagaggaugguggacgacugugcaguagagcaggguuuucuuguuuaaacuuccuguccuugcugguucuguucaguaguagcauuaccucagccuacccaguuaacauuuucaauaucagagccagacuauacaugauguuaaagcuaugucagguuuagaaagaagcagugcccauuuagagcgaucacaaaaauaccaaggaucuaaaugcugggacagcucgacccucugacuagagauggcgucacucaaaagcauacgccgccgccgccauuuuggcaggagcaugaaaugccguuauuaccguuugucaguugacggaggcuaacauauuacacaauaaaagcauuugagaugaggcagcccuaccgacuguuacauuuccagcuaaacuaacgccugacacccucacuacaaagacaucaggccagggagcccccagcuuuaugcgcugaaucacuuuguugugugaacgccacauuugaaaagcuguucugauggcaagcgagacucaggcccuaaguacagacuggaccaggugcugcuagucaagagcccgcacacccaaccgcaguauaggaccagcaaguaaacgcagcucucucaacagaagagguggguggcucuuaaaagagccuuuggguuuguugugagcccugcgagcucacuuggagcugguguacuuggugacggccuuggugcccuccgacaccgcgugcuuggccagcuccccgggcagcagcaggcgcacggccgucuggaucucccgggacgugauggucgagcgcuuguuguaaugcgccaggcgggacgccucgcucgcgaugcgcucgaagaugucugucacaaaggaguucaugaugcucauggccuuggaggagaugccggugucggggugcacuuguuucagcaccuuauagauguaaauggaguagcucuccuugcggcaucucuuacguuuccggcccuccuuuuucugggucuuggugaccgcuuucuugaagccuuucuuggaaauaguagcacccuuuaccgccaccuccggcauggcucaaguaaccuuucccacaccaacgucucaaaacaguuccaacugcugagaaaacacacacgacuugagguugagaagcgggguauuuauaggcguggacauuggaugacguauggguacaugcaaucugauuggacaguaagugcugggugcaugcaaauaaggggaauucaagcugugauuucuaauugguuaauccaucaucaaucagccaaucagguguugagcauaagcugccauuagacuauaaauaggcguggucaugggggccucgcuuaccgcuuuaagacuuuugaagaaucaugucugguccuacaaagcgggguggcaaggcucgugccaaggucaagucucgcucuuccagggcagguuugcaguuuccugugggucgugugcaccggcuucuccgccaagggaacuacgcacaacgaauuggggcuggugcaccaguguaucuggcggcagugcuagaauacuugacagcugagguccugga

SEQ ID NO: 10648 - RNA, 2501 nt, Mus musculus
uccaggaccucagcugucaaguauucuagcacugccgccagauacacuggugcaccagccccaauucguugugcguaguucccuuggcggagaagccggugcacacgacccacaggaaacugcaaaccugcccuggaagagcgagacuugaccuuggcacgagccuugccaccccgcuuuguaggaccagacaugauucuucaaaagucuuaaagcgguaagcgaggcccccaugaccacgccuauuuauagucuaauggcagcuuaugcucaacaccugauuggcugauugaugauggauuaaccaauuagaaaucacagcuugaauuccccuuauuugcaugcacccagcacuuacuguccaaucagauugcauguacccauacgucauccaauguccacgccuauaaauaccccgcuucucaaccucaagucguguguguuuucucagcaguuggaacuguuuugagacguuggugugggaaagguuacuugagccaugccggagguggcgguaaagggugcuacuauuuccaagaaaggcuucaagaaagcggucaccaagacccagaaaaaggagggccggaaacguaagagaugccgcaaggagagcuacuccauuuacaucuauaaggugcugaaacaagugcaccccgacaccggcaucuccuccaaggccaugagcaucaugaacuccuuugugacagacaucuucgagcgcaucgcgagcgaggcgucccgccuggcgcauuacaacaagcgcucgaccaucacgucccgggagauccagacggccgugcgccugcugcugcccggggagcuggccaagcacgcggugucggagggcaccaaggccgucaccaaguacaccagcuccaagugagcucgcagggcucacaacaaacccaaaggcucuuuuaagagccacccaccucuucuguugagagagcugcguuuacuugcugguccuauacugcgguugggugugcgggcucuugacuagcagcaccugguccagucuguacuuagggccugagucucgcuugccaucagaacagcuuuucaaauguggcguucacacaacaaagugauucagcgcauaaagcugggggcucccuggccugaugucuuuguagugagggugucaggcguuaguuuagcuggaaauguaacagucgguagggcugccucaucucaaaugcuuuuauuguguaauauguuagccuccgucaacugacaaacgguaauaacggcauuucaugcuccugccaaaauggcggcggcggcguaugcuuuugagugacgccaucucuagucagagggucgagcugucccagcauuuagauccuugguauuuuugugaucgcucuaaaugggcacugcuucuuucuaaaccugacauagcuuuaacaucauguauagucuggcucugauauugaaaauguuaacuggguaggcugagguaaugcuacuacugaacagaaccagcaaggacaggaaguuuaaacaagaaaacccugcucuacugcacagucguccaccauccucugccguggugauacccuagucuguacaguacacauucauacuauugauaauauauuaauaauuauauauuuauauauaauauauaaauauuauauauauauauauauuugauaauacuguuuuguuaauuuccauggcuuuuccaggcagugccacucauuggguacugucuuuauugcuauauugcugugaagagacaccauaaccaaggcaacucuuauaagaagcacuuaauugauagcuugcuuauaguuggguuaggucaugaucaucaugacuagaagcagacagacauggugcugaguagaggggaggagggggagagagagagaggcagaggagaaaggcuaggccuggucuuggcuuuugaagccacaaaaucucccuccccuuaccccccccccccacuuuuccccagcaaaacacuuccucuaaaagggccauacagucuaauucuucucaaauuuuuugaaaagaaaaauaagaacauuacaaaauggaguuguaucugauucagucccacauuaaggccagugauaccagcuugcaauguaauguggaauguagccuugaguaagauggauagcccaacugacccuguuccuugagggagagugucuuagcuaagguuucuauuguuguuaaacaaacaaacaaauaaacaaagaagcaaacaaaaaaccccacauaauugggcgaaaaguguuuauuucaucuuacaguuauaguucaucaugaagggaauucagggcaggaacucauggaaggaaccuggagguaggcacugaagcagaaaccauggaggaauucugugcauugccuugucuuguuauacaacccagaacuaccagcccaggguagcucucucacaucaaucacuaaaauauggguaaccuuuauaccaguuuguacugaacacaaauagcacgugaaaggaucuugccauaaaggug

SEQ ID NO: 10649 - RNA, 2501 nt, Mus musculus
gaguucaugaugcucauggccuuggaggagaugccggugucggggugcacuuguuucagcaccuuauagauguaaauggaguagcucuccuugcggcaucucuuacguuuccggcccuccuuuuucugggucuuggugaccgcuuucuugaagccuuucuuggaaauaguagcacccuuuaccgccaccuccggcauggcucaaguaaccuuucccacaccaacgucucaaaacaguuccaacugcugagaaaacacacacgacuugagguugagaagcgggguauuuauaggcguggacauuggaugacguauggguacaugcaaucugauuggacaguaagugcugggugcaugcaaauaaggggaauucaagcugugauuucuaauugguuaauccaucaucaaucagccaaucagguguugagcauaagcugccauuagacuauaaauaggcguggucaugggggccucgcuuaccgcuuuaagacuuuugaagaaucaugucugguccuacaaagcgggguggcaaggcucgugccaaggucaagucucgcucuuccagggcagguuugcaguuuccugugggucgugugcaccggcuucuccgccaagggaacuacgcacaacgaauuggggcuggugcaccaguguaucuggcggcagugcuagaauacuugacagcugagguccuggagcuggcgggcaacgcagcccgggacaacaagaagacgcgcauuacuccucgccaccugcagcuggccauccgcaacgacgaggagcucaacaaguugcuuggccgcgugaccaucgcgcaggguggcguccugcccaacauccaggccgugcugcugcccaagaagaccgagagccacaagucccagaccaagugacuccugcacaagacagcaaccaucaguuuaaaacaaaaaggcucuuuucagagccaccuucauuuucacgaaaagcugugcaugacagguauaaucaacgacggucaauuucagacuucauuuggaccucuaccagcuguuaauacugacaguauucuacggccuucuguggcaaaguauuaggguaggaacguagagguguuuaaggguugugugaaugaaguauuacucaaaaguaagccacuaauucagcuccuucuuagcugaaaguuagcacaggaugauccaguucugcaauuucucaaaagugccuuaaaaaacuuguaucagugcuacaaaaugaguaaaaaccuagaauguugcucaaacaaacccauucgggaaaaaaaaaaaaugaguuauuccugucaguuuugagggcuggaguaaaaggcuuaccaacuuguaguuuuuaugaauguuugcuuguaguauccucuacagaggauagaggguuagauaucuuagcaacuggagcaaauggccaucgggagcugccguagggauauuaggaaccaagcuuagauccuuugcaaaaguagcgaguguuuuuaguauuuguuucaucuguccagcccaauugucauaauuuuuugaaauccaagaauggguauuaagaguuuuuagcuagaaaauaaaaccauuugauuuauuuauucauuuuguaaaugcuuacugacuccauuugcuaagcugggccuaacucuggaagcuucuggccucuguacaaucuuaucaaggccucgaauguucucagccucugagacuuacugcugaauaagcucacccuuucuagcucuuucugagcugugggcugacugacucaacucagcuguucuggcucaaacuugucuccaagcugacugauucaaucuagcuucuuucaguuccuuacugaauuacucugcuuggccucauacuaauuuggcaaucuguucuaaucuucuagguugcucugucuucaccugugucuacuuguucucucuucagccucucucuauaaaacucucccaguaaaacuguuacacuucuucucucugucccuuaaguggcuuuccuuuccucucuucuugggagaauugggccuauccuauucugucaaaucuuacucaccacuuugucugccacucaaccagacuuuuaaaccuaagugcuuccuucugcaaauuaacuuuaccuucauuguuuuggaauuaaagauguuauacuaagggccugucuguaucccaaccagugggaauuaauggugugugcuaagggcugaaccacaccacaacuagaaacagguuuuuuuuucaauaaguagcacaagguucacagcaugauaaaauauccugcaacacaaaauuucaauuuaaaagguaaaaacaaguuuauuuauaguaaugugacaauagccuccuuugccaaucugagagcugcugcacaaaccacagcugucucaacuuuggggauucuucugcuacaugagacaccuaccucccccucuucccugcccccgaacaagcaaaaguuaggugagauuaccaaugcagaaugagugucuggucaauauuuuaggguaacaauu

SEQ ID NO: 10650 - RNA, 2501 nt, Mus musculus
aauuguuacccuaaaauauugaccagacacucauucugcauugguaaucucaccuaacuuuugcuuguucgggggcagggaagagggggagguaggugucucauguagcagaagaauccccaaaguugagacagcugugguuugugcagcagcucucagauuggcaaaggaggcuauugucacauuacuauaaauaaacuuguuuuuaccuuuuaaauugaaauuuuguguugcaggauauuuuaucaugcugugaaccuugugcuacuuauugaaaaaaaaaccuguuucuaguuguggugugguucagcccuuagcacacaccauuaauucccacugguugggauacagacaggcccuuaguauaacaucuuuaauuccaaaacaaugaagguaaaguuaauuugcagaaggaagcacuuagguuuaaaagucugguugaguggcagacaaaguggugaguaagauuugacagaauaggauaggcccaauucucccaagaagagaggaaaggaaagccacuuaagggacagagagaagaaguguaacaguuuuacugggagaguuuuauagagagaggcugaagagagaacaaguagacacaggugaagacagagcaaccuagaagauuagaacagauugccaaauuaguaugaggccaagcagaguaauucaguaaggaacugaaagaagcuagauugaaucagucagcuuggagacaaguuugagccagaacagcugaguugagucagucagcccacagcucagaaagagcuagaaagggugagcuuauucagcaguaagucucagaggcugagaacauucgaggccuugauaagauuguacagaggccagaagcuuccagaguuaggcccagcuuagcaaauggagucaguaagcauuuacaaaaugaauaaauaaaucaaaugguuuuauuuucuagcuaaaaacucuuaauacccauucuuggauuucaaaaaauuaugacaauugggcuggacagaugaaacaaauacuaaaaacacucgcuacuuuugcaaaggaucuaagcuugguuccuaauaucccuacggcagcucccgauggccauuugcuccaguugcuaagauaucuaacccucuauccucuguagaggauacuacaagcaaacauucauaaaaacuacaaguugguaagccuuuuacuccagcccucaaaacugacaggaauaacucauuuuuuuuuuuucccgaauggguuuguuugagcaacauucuagguuuuuacucauuuuguagcacugauacaaguuuuuuaaggcacuuuugagaaauugcagaacuggaucauccugugcuaacuuucagcuaagaaggagcugaauuaguggcuuacuuuugaguaauacuucauucacacaacccuuaaacaccucuacguuccuacccuaauacuuugccacagaaggccguagaauacugucaguauuaacagcugguagagguccaaaugaagucugaaauugaccgucguugauuauaccugucaugcacagcuuuucgugaaaaugaagguggcucugaaaagagccuuuuuguuuuaaacugaugguugcugucuugugcaggagucacuuggucugggacuuguggcucucggucuucuugggcagcagcacggccuggauguugggcaggacgccacccugcgcgauggucacgcggccaagcaacuuguugagcuccucgucguugcggauggccagcugcagguggcgaggaguaaugcgcgucuucuuguugucccgggcugcguugcccgccagcuccaggaccucagcugucaaguauucuagcacugccgccagauacacuggugcaccagccccaauucguugugcguaguucccuuggcggagaagccggugcacacgacccacaggaaacugcaaaccugcccuggaagagcgagacuugaccuuggcacgagccuugccaccccgcuuuguaggaccagacaugauucuucaaaagucuuaaagcgguaagcgaggcccccaugaccacgccuauuuauagucuaauggcagcuuaugcucaacaccugauuggcugauugaugauggauuaaccaauuagaaaucacagcuugaauuccccuuauuugcaugcacccagcacuuacuguccaaucagauugcauguacccauacgucauccaauguccacgccuauaaauaccccgcuucucaaccucaagucguguguguuuucucagcaguuggaacuguuuugagacguuggugugggaaagguuacuugagccaugccggagguggcgguaaagggugcuacuauuuccaagaaaggcuucaagaaagcggucaccaagacccagaaaaaggagggccggaaacguaagagaugccgcaaggagagcuacuccauuuacaucuauaaggugcugaaacaagugcaccccgacaccggcaucuccuccaaggccaugagcaucaugaacuc

SEQ ID NO: 10651 - RNA, 2501 nt, Mus musculus
gcaggguguguccgggcacggaucgcuagguugggggcacuucugggauaggauacgggcugcuggaaggaacagagaaugaauugcugaaguuaggaguaaucgagucuggccaagguugggaguucucccugcugaaugcggguguaucugcggcuuugaagaggacagacugggaaagggaaagagccccgagaggaauuaguagugccagcaggaccccggagaguccgggaggcgauaagagcaggagcccgccgccagguccagagggggaggagugacgcgagcccugugcgcccuccccguggcgggcggcgcggagcaaggagggggcagggcggggugggguggagggagggagcgagggagggagggagcgaagcugccgcggggagggcgcgccagggaggaaguccaagagacagagagaagagcacuccugaaagaagacgacgggcuaguccccgggguccgggcugaggucuuggcucgagggcgcagcuguccagcucugggcagcgucgccucaguggcuuaggagacgguugcgcaaggagccggccggaggcucggaagagggaugcgcggggcguugccuccgacccgccgccgccgccgccgcccgaagccccagaggagcugagggaggcgacgccgaagcgcuggcccgcaguggcccgggcugcagcgcggccggcgcaguagggcacucgcccgauuuguggaccgacccggcuccggcgccgccgaucccgguccgggguccgccccccaggcccggccucguucccgauucccagaugagcaccgagggcgggccuccgccacccccgccgcgcccgccgccugccccacuccgccgcgcgugcagcccggcgcccggcgcgcuccaggccgccuugaugagcccgccacccgccgccacccuggaguccacuucgucgucgucaucaucauccucugccuccugugccucguccucuucuaacuccgucagcgccucggccggugcuugcaagagugcggcuagcagcggcggcgcgggcgccgggaguggaggcaccaagaaggcaaccucggggcugcggcggccggagaagccuccuuacucguacaucgcgcucaucgucauggccauccagagcucgcccagcaagcgccugacgcucagugagaucuaccaguuccuacaggcgcgcuuccccuuuuuccguggcgccuaccagggcuggaagaacuccgugcgccacaaccucucgcucaacgagugcuucaucaagcugcccaagggccucgggagaccugguaagggccacuacuggaccaucgacccggccagcgaauucauguuugaggaggguucguuccgccgccggccgcgcggcuucaggcggaagugccaggcucucaaacccauguaccaucgcguggugagcggcuugggcuucggggccucgcugcugccccagggcuucgacuuccaagcgcccccgucggcgccucuggguugccacggucaaggcgguuaugguggccucgacaugaugcccgcgggcuaugauacaggggcgggugcuccgggccacgcgcauccacaccaccuccaccaccaccacgucccccacaugucgcccaacccgggcuccaccuauauggccagcugcccggugcccgcagguccugcgggcgucggugcggcagcggguggcggcgguggcggcggggacuaugggccggacagcagcagcagcccugugcccucauccccggcuauggcaagcgccauugagugucacucgcccuacacuagcccugcggcacauuggagcucgccuggcgcuucaccuuaccucaagcagccgccugcccugacgccaagcaguaaucccgcggccucugcuggucugcaccccagcaugucuuccuacucguuggagcagagcuacuugcaccagaacgcccgcgaggaucucucagguaauaaagagcgccaaggcuggcugcaagcggagccucugagagccucugagggccagggcuacugcacccuugguccucaacgcuggggucuucagaacuagaaugcugggggugggguggggauucgguucccuauuccuaagugagagaaggggauuugaucuuguacccuucucuaaugcucugggccuguuggugggccccagaauucccaaauuggagaaggguggugccaaguccuaagucucuuggccuucauuaggacacuguggacuuucucccaauuaggucagacucagcucugaaagaaggccugugaccuuuggagaccuuggucgaggaauugagucuggaucauuucguuucuuccuacucuuuucaaaguccauuuugcucggcuuuaguuccuaaaggagaugacagaaagggagcgguucuguaugaagcagagcaagggaggaagaguucuuaccugagcagguaaugauaggagaugguagggaaggagagagagaaaa

SEQ ID NO: 10652 - RNA, 2501 nt, Mus musculus
uuuucucucucuccuucccuaccaucuccuaucauuaccugcucagguaagaacucuuccucccuugcucugcuucauacagaaccgcucccuuucugucaucuccuuuaggaacuaaagccgagcaaaauggacuuugaaaagaguaggaagaaacgaaaugauccagacucaauuccucgaccaaggucuccaaaggucacaggccuucuuucagagcugagucugaccuaauugggagaaaguccacaguguccuaaugaaggccaagagacuuaggacuuggcaccacccuucuccaauuugggaauucuggggcccaccaacaggcccagagcauuagagaaggguacaagaucaaauccccuucucucacuuaggaauagggaaccgaauccccaccccacccccagcauucuaguucugaagaccccagcguugaggaccaagggugcaguagcccuggcccucagaggcucucagaggcuccgcuugcagccagccuuggcgcucuuuauuaccugagagauccucgcgggcguucuggugcaaguagcucugcuccaacgaguaggaagacaugcuggggugcagaccagcagaggccgcgggauuacugcuuggcgucagggcaggcggcugcuugagguaaggugaagcgccaggcgagcuccaaugugccgcagggcuaguguagggcgagugacacucaauggcgcuugccauagccggggaugagggcacagggcugcugcugcuguccggcccauaguccccgccgccaccgccgccacccgcugccgcaccgacgcccgcaggaccugcgggcaccgggcagcuggccauauagguggagcccggguugggcgacaugugggggacgugguggugguggaggugguguggaugcgcguggcccggagcacccgccccuguaucauagcccgcgggcaucaugucgaggccaccauaaccgccuugaccguggcaacccagaggcgccgacgggggcgcuuggaagucgaagcccuggggcagcagcgaggccccgaagcccaagccgcucaccacgcgaugguacauggguuugagagccuggcacuuccgccugaagccgcgcggccggcggcggaacgaacccuccucaaacaugaauucgcuggccgggucgaugguccaguaguggcccuuaccaggucucccgaggcccuugggcagcuugaugaagcacucguugagcgagagguuguggcgcacggaguucuuccagcccugguaggcgccacggaaaaaggggaagcgcgccuguaggaacugguagaucucacugagcgucaggcgcuugcugggcgagcucuggauggccaugacgaugagcgcgauguacgaguaaggaggcuucuccggccgccgcagccccgagguugccuucuuggugccuccacucccggcgcccgcgccgccgcugcuagccgcacucuugcaagcaccggccgaggcgcugacggaguuagaagaggacgaggcacaggaggcagaggaugaugaugacgacgacgaaguggacuccaggguggcggcggguggcgggcucaucaaggcggccuggagcgcgccgggcgccgggcugcacgcgcggcggaguggggcaggcggcgggcgcggcggggguggcggaggcccgcccucggugcucaucugggaaucgggaacgaggccgggccuggggggcggaccccggaccgggaucggcggcgccggagccgggucgguccacaaaucgggcgagugcccuacugcgccggccgcgcugcagcccgggccacugcgggccagcgcuucggcgucgccucccucagcuccucuggggcuucgggcggcggcggcggcggcgggucggaggcaacgccccgcgcaucccucuuccgagccuccggccggcuccuugcgcaaccgucuccuaagccacugaggcgacgcugcccagagcuggacagcugcgcccucgagccaagaccucagcccggaccccggggacuagcccgucgucuucuuucaggagugcucuucucucugucucuuggacuuccucccuggcgcgcccuccccgcggcagcuucgcucccucccucccucgcucccucccuccaccccaccccgcccugcccccuccuugcuccgcgccgcccgccacggggagggcgcacagggcucgcgucacuccucccccucuggaccuggcggcgggcuccugcucuuaucgccucccggacucuccgggguccugcuggcacuacuaauuccucucggggcucuuucccuuucccagucuguccucuucaaagccgcagauacacccgcauucagcagggagaacucccaaccuuggccagacucgauuacuccuaacuucagcaauucauucucuguuccuuccagcagcccguauccuaucccagaagugcccccaaccuagcgauccgugcccggacacacccugc

SEQ ID NO: 10653 - RNA, 2501 nt, Mus musculus
cuuggaccucucucauucaucccaaacuuccucauucguucuccauccucuacuuccccgccccuccccaacccccacgcuucuugccaaaugucaguaauuugggacagcuucuauccaugaauuaauaaagacugaggcuccaauggggggcgggggagaaagguagauauuuaggaacauacauuuuaauuccacuaugaaaauuuuggucaucuucaggcugagguucaucaaaugcaucucuccugaaauuacuguuucauuauuucuauucucaucuacuaggaaaacagaguccccaaacauccuccaggugaagucccuaucuuaaaacauuagcuguuucuuaaucuaugaacauuagucgucuaacugcaaaaugccacacucacuuauuucuaacacuuacagcauuugcugcccuugggaucuauguccuaggaugguugcagcucuuugaacuaaugucaaaggcacaaaaccaccagaugcaaagcauuaagucaucuccuaaaauuaaaggaaaaggcaacaucccggugcaugcuccuugcuuugcaaaaaucccaguuucugcaaaacaauaaacaaauaaacaaccaaaaaaaucccccaaacaaauucucaagaauauggcaaaugcauauggaccccauagaaagaaucaguuuuaaugcuccgaaagccccaauuucucuauauuucuuaugaagaaaaaauguuaaguauuucuucucuugucccacacaaauucccugacgcaccccugaaaugcugcaaggauuugucuguaaagaacgcuccagccuggcacgaacaguuuucuccaucugcagaauaaccacugggagacuuucuauuuuuuuccuuuuguccauucuauuaauaagcugcuuuaauuucccuuuucaguuacauuaauuaauguuuccauccaguaucacauaagcggauucacuaguacuuaaaacauuugcauuuuggauggaaaaauauaaacuuuaaaaaagccucccaacaguguagcugagacucacauuccuuaacaugaaaugggggggggggcuaaauaaauccauccaauaaaccgccacaaacaaaaauuacaaacccacgaaaagacaaaaugcgaacacguuaaaccacuuuccuguauaaaaauaauagagaugcuaaucugccaaaaaucacagacacacaugacccugaaaaaguauaucagugaauauuugguugauuuauccuucucggaguagucugcggugcccggagcaaacgcugcagcuaagaucuagggggaggggcggaggaaggacaaaguucuaaaugcugcaguuugagggcagccuuagaauaucuuugcuuucugcauauaaacuuuucagcccuagcuaccuaggcaucuuauuccucccuuuaccuuuugaccccucaagauaguaucuugcaguauaacaggggacaaaugcuacgagcgcucagauccuguuuuaaccccaaagagggaggaaaaaaauggaugugcgcuuuggagaaaagggagaaccccccuuggaaaacagccggucacacacacacacuucccugcaaaagaaaucacuuucuuuaggaaaaccaaaccagaacuccuuccagaguccccaagagcuaaugccccgacucagggagucugcaggguuuucugcaaccagcggcagacccuggccagcaaguccccuuaggcgccucugggguaggcaaucuccggucgccuaccaagccguaccgggcggccacuuaccuauuugcaccgcgaggaucagugaaauauaucugccguucaacuuaagucccauccuacguuuagucaaaccauuugcgaccgcagaccuuuaaauaguuaguuuagagaacgcgggggaaagcugaaaaauaggcauugccaacaaguuccgggagcgacagagacuuuaugcacugggaaggcagagggaggagagaaagagagggagcgaggaagagacagaaagagagugagagagugagaggcuggggggggggggggagagcugggaaugguucacuccauuaggagggggcggaggaaguacagccucacgcccacgagcaggccugacgugggggaugacacggauugauuuuuuuuuuuuuuuauaauauagacaccuugguagagaaucaccauuuauagucauaagacucuggaauuaaucagauaucuccaauuaaugugcgaucucaacgaaaucucgccucucuguagugacugauuuucaucccaguggccacccccgccuccucguuccaggggcccccagccccgcccccucccugcgcagaaucggggcucccucuccucuccccgccccggagacggggaguccuggugcgcccacucgauuguucaaccugcucccuccuucacuggcgccacaacgaacccagacacuuccaacccugcagagagguuuggggagcuuugggcccagggaggacag

SEQ ID NO: 10654 - RNA, 2501 nt, Mus musculus
cuguccucccugggcccaaagcuccccaaaccucucugcaggguuggaagugucuggguucguuguggcgccagugaaggagggagcagguugaacaaucgagugggcgcaccaggacuccccgucuccggggcggggagaggagagggagccccgauucugcgcagggagggggcggggcugggggccccuggaacgaggaggcggggguggccacugggaugaaaaucagucacuacagagaggcgagauuucguugagaucgcacauuaauuggagauaucugauuaauuccagagucuuaugacuauaaauggugauucucuaccaaggugucuauauuauaaaaaaaaaaaaaaaucaauccgugucaucccccacgucaggccugcucgugggcgugaggcuguacuuccuccgcccccuccuaauggagugaaccauucccagcucuccccccccccccccagccucucacucucucacucucuuucugucucuuccucgcucccucucuuucucuccucccucugccuucccagugcauaaagucucugucgcucccggaacuuguuggcaaugccuauuuuucagcuuucccccgcguucucuaaacuaacuauuuaaaggucugcggucgcaaaugguuugacuaaacguaggaugggacuuaaguugaacggcagauauauuucacugauccucgcggugcaaauagguaaguggccgcccgguacggcuugguaggcgaccggagauugccuaccccagaggcgccuaaggggacuugcuggccagggucugccgcugguugcagaaaacccugcagacucccugagucggggcauuagcucuuggggacucuggaaggaguucugguuugguuuuccuaaagaaagugauuucuuuugcagggaagugugugugugugaccggcuguuuuccaagggggguucucccuuuucuccaaagcgcacauccauuuuuuuccucccucuuugggguuaaaacaggaucugagcgcucguagcauuuguccccuguuauacugcaagauacuaucuugaggggucaaaagguaaagggaggaauaagaugccuagguagcuagggcugaaaaguuuauaugcagaaagcaaagauauucuaaggcugcccucaaacugcagcauuuagaacuuuguccuuccuccgccccucccccuagaucuuagcugcagcguuugcuccgggcaccgcagacuacuccgagaaggauaaaucaaccaaauauucacugauauacuuuuucagggucaugugugucugugauuuuuggcagauuagcaucucuauuauuuuuauacaggaaagugguuuaacguguucgcauuuugucuuuucguggguuuguaauuuuuguuuguggcgguuuauuggauggauuuauuuagcccccccccccauuucauguuaaggaaugugagucucagcuacacuguugggaggcuuuuuuaaaguuuauauuuuuccauccaaaaugcaaauguuuuaaguacuagugaauccgcuuaugugauacuggauggaaacauuaauuaauguaacugaaaagggaaauuaaagcagcuuauuaauagaauggacaaaaggaaaaaaauagaaagucucccagugguuauucugcagauggagaaaacuguucgugccaggcuggagcguucuuuacagacaaauccuugcagcauuucaggggugcgucagggaauuugugugggacaagagaagaaauacuuaacauuuuuucuucauaagaaauauagagaaauuggggcuuucggagcauuaaaacugauucuuucuaugggguccauaugcauuugccauauucuugagaauuuguuugggggauuuuuuugguuguuuauuuguuuauuguuuugcagaaacugggauuuuugcaaagcaaggagcaugcaccgggauguugccuuuuccuuuaauuuuaggagaugacuuaaugcuuugcaucuggugguuuugugccuuugacauuaguucaaagagcugcaaccauccuaggacauagaucccaagggcagcaaaugcuguaaguguuagaaauaagugaguguggcauuuugcaguuagacgacuaauguucauagauuaagaaacagcuaauguuuuaagauagggacuucaccuggaggauguuuggggacucuguuuuccuaguagaugagaauagaaauaaugaaacaguaauuucaggagagaugcauuugaugaaccucagccugaagaugaccaaaauuuucauaguggaauuaaaauguauguuccuaaauaucuaccuuucucccccgccccccauuggagccucagucuuuauuaauucauggauagaagcugucccaaauuacugacauuuggcaagaagcguggggguuggggaggggcggggaaguagaggauggagaacgaaugaggaaguuugggaugaaugagagagguccaag

SEQ ID NO: 10655 - RNA, 2501 nt, Mus musculus
ccaggauuuucagggucccgccgcuaagcacuggcagguagaagggggaucccucccccguccccgacucccagaggccgguaacgcacccacacccaaccaccaccacgggguguguccaccccgaagcucggcgggagaaacuccuuagaacuucaaggacuauagcagcuaaagagugacaccaagggcugacgugugggcucccaagccgaacgugcuuuacaggucagggcgaagugugugcgcccuucuccaaaugcaagaagggaacgucuuuagggagaaagaaaagaaugaaugaaaaaggggguauuaaugucagggagggagugaaaggggggacaugguuuuauuuucuuccugcuacuguaggcacccccaggaucucgcucaaacacaccagagugcacaggcacgugcccaguugccagcuuuuuuuuuuuuuuuuuuuuuuuuaaauccaagcucuucucuuccuuccacucucaggcagaaccaaaaguaaccaggagaaaaggggaaagaguggaacacgagcuucgaaagacaaaagugaaagaaccgagauccauguccacuaucuccagcgucuccccugugcuauucgggcgacauggaggggugggagcugcgcggguguuaaguuugucccacucgcauuucgcguggagagaaggaggaggaggagagggagggucgaucuccaagccuguggccgcaaggaugacugagucggcgccgcgcuuaccucgcagucuucguacuugauauuauccgucaguuuccaaagcauuuucauggaucggcgugaucggauuugccccucugcgccucgcaccccagcggagcuacucucuggguuagcgcaaagugcgggcugcgggcggugagcaaaagaggaggagggggggaggaggagaggagggcgaggaggaggagaaggguaggaagggggaggaggagguggagguagaggaggaggagggccaggagaagggcgaggagggaggaggagagaaggguuagagagcucccgugugcgcucggagaucucccucuaaugguagaaacuuuucccuuuuccugcuccucgcgaacagccuaaucgccucauuagcauaucaacaauaguccaauugcucgccaggaccacaaucugccgccggccgcuccgacccagguauaaaggccucuucuagccgcuaacuugcuccuagagcacuugccugcaugccagccugcaagcccaacaacucuuccuagagcuccagcacccucccuguucgagcguccccuauccccaauuucaucucuuuccccuucgccugucuucggguccugcuagccaaagaugcuuuggauaaagcucuguacuacgcaggguaccagcggcggcgccuagggaccaacuuuuaguaccccaccucccacucuuacuacaaccgccacuaucugccuuucguccccguccgauuuuauuagaaaucauuaucccuuucgcaaugaaccguagccaccaaaccaggaccagcaaagucacuccaagaauuuugcccaacuagagaucgccuccgcucacggcuguuacccccucgggcugcagcgcccugggaguuuuauuagcuuugcgcuccccccuccccccagguuggagauucugccagccggcuccgguggcucgguugggguuugcgaucucuuaauugcuacguguaaaauaaaaguuguacccugaagagguuacucgacagauccggggguuaaaugauuuuccuccgguuuguaugaagcugaaucggacugacuauucauccgggcguuuggacuguaagguuucccaggugcaacguggacaacaacacagaauucggauggggaugcacaaccccuucuggagugagccaaaccgcagacccaugagcuccugcgacucuccaugcggugucguacaugcaucaaaauaaaacauuaggaaccaacucuuccugugcaaaucggcuccaguuuucccaagauucuccuuuuuaauuaaagaaggacgcgacccuuuaugacuugauguuacuaacgccggcguuuuggcggcgcaauggccggcuggugaagaaccugaaggcaggagacaccccuuccccaaguuggccacuccugacuccgcccaggggcuuacucacuccaccgggacccuuccucccuuacugcaauuauucuaaaguaagauauuaaaaaaaaaaaaacacuaaagacuuuaaugugacacucugauauagagggauuucucuggcugaguuuucccacuagcacuuuaaaaaauauuuuuaucugucuuuguccugcuaauuguggaucaacgacagcagaucuccucagagaccucugguucaucugauucuuuuuucuuugguuuuucuuccuucuuuucuuucuucuuuccuucccccccccccaccccaaauguccaggccuccucgauuuccauagugaaucccucaugggga

SEQ ID NO: 10656 - RNA, 2501 nt, Mus musculus
uccccaugagggauucacuauggaaaucgaggaggccuggacauuuggggugggggggggggaaggaaagaagaaagaaaagaaggaagaaaaaccaaagaaaaaagaaucagaugaaccagaggucucugaggagaucugcugucguugauccacaauuagcaggacaaagacagauaaaaauauuuuuuaaagugcuagugggaaaacucagccagagaaaucccucuauaucagagugucacauuaaagucuuuaguguuuuuuuuuuuuuaauaucuuacuuuagaauaauugcaguaagggaggaagggucccgguggagugaguaagccccugggcggagucaggaguggccaacuuggggaaggggugucuccugccuucagguucuucaccagccggccauugcgccgccaaaacgccggcguuaguaacaucaagucauaaagggucgcguccuucuuuaauuaaaaaggagaaucuugggaaaacuggagccgauuugcacaggaagaguugguuccuaauguuuuauuuugaugcauguacgacaccgcauggagagucgcaggagcucaugggucugcgguuuggcucacuccagaagggguugugcauccccauccgaauucuguguuguuguccacguugcaccugggaaaccuuacaguccaaacgcccggaugaauagucaguccgauucagcuucauacaaaccggaggaaaaucauuuaacccccggaucugucgaguaaccucuucaggguacaacuuuuauuuuacacguagcaauuaagagaucgcaaaccccaaccgagccaccggagccggcuggcagaaucuccaaccuggggggaggggggagcgcaaagcuaauaaaacucccagggcgcugcagcccgaggggguaacagccgugagcggaggcgaucucuaguugggcaaaauucuuggagugacuuugcugguccugguuugguggcuacgguucauugcgaaagggauaaugauuucuaauaaaaucggacggggacgaaaggcagauaguggcgguuguaguaagagugggaggugggguacuaaaaguuggucccuaggcgccgccgcugguacccugcguaguacagagcuuuauccaaagcaucuuuggcuagcaggacccgaagacaggcgaaggggaaagagaugaaauuggggauaggggacgcucgaacagggagggugcuggagcucuaggaagaguuguugggcuugcaggcuggcaugcaggcaagugcucuaggagcaaguuagcggcuagaagaggccuuuauaccugggucggagcggccggcggcagauugugguccuggcgagcaauuggacuauuguugauaugcuaaugaggcgauuaggcuguucgcgaggagcaggaaaagggaaaaguuucuaccauuagagggagaucuccgagcgcacacgggagcucucuaacccuucucuccuccucccuccucgcccuucuccuggcccuccuccuccucuaccuccaccuccuccucccccuuccuacccuucuccuccuccucgcccuccucuccuccucccccccuccuccucuuuugcucaccgcccgcagcccgcacuuugcgcuaacccagagaguagcuccgcuggggugcgaggcgcagaggggcaaauccgaucacgccgauccaugaaaaugcuuuggaaacugacggauaauaucaaguacgaagacugcgagguaagcgcggcgccgacucagucauccuugcggccacaggcuuggagaucgacccucccucuccuccuccuccuucucuccacgcgaaaugcgagugggacaaacuuaacacccgcgcagcucccaccccuccaugucgcccgaauagcacaggggagacgcuggagauaguggacauggaucucgguucuuucacuuuugucuuucgaagcucguguuccacucuuuccccuuuucuccugguuacuuuugguucugccugagaguggaaggaagagaagagcuuggauuuaaaaaaaaaaaaaaaaaaaaaaaagcuggcaacugggcacgugccugugcacucugguguguuugagcgagauccugggggugccuacaguagcaggaagaaaauaaaaccauguccccccuuucacucccucccugacauuaauacccccuuuuucauucauucuuuucuuucucccuaaagacguucccuucuugcauuuggagaagggcgcacacacuucgcccugaccuguaaagcacguucggcuugggagcccacacgucagcccuuggugucacucuuuagcugcuauaguccuugaaguucuaaggaguuucucccgccgagcuucgggguggacacaccccgugguggugguugggugugggugcguuaccggccucugggagucggggacgggggagggaucccccuucuaccugccagugcuuagcggcgggacccugaaaauccugg

SEQ ID NO: 10657 - RNA, 2501 nt, Mus musculus
gggggagagagggagagaaagagagggagagagagagaacacacuaguccagcuuagccucaaaauuacuagguagcuaagcugcagauugcauugaacuuccugccuccacuucucaggauuuggaguucuggcacacacuaucauccuggcagccuuugccuuauaaggaaagagcucaacuuuguuucuuguucaaaucuuggaacugguaauaagcuaucuacucuaccuuugggggagcucacagcugaaggugauggacaacuucccuuuucuccuaaaauccccaugaagaccccuuucuugucuuugugcacuuuaccaguuacccacuuguaaggagaacauacauacauaagacacagcucacaguuuuuguuguuguugacgacaucuaacaucauaucuaagagcaagugguuuggagccagaacugaauucaacugucccagugaauacaacucuaaagaaaccauacugaaugcucugggucugucuucucaucucccaaguggacggauaauaggaauuaacaucgcuguguguuaagaagcaaacaggcuaagaucugcaaauuucuuaacacgggaacaggcauucaccgaaugacaaauuuaauuauuagucuuuuaaaacugccuuaguaacugcuuuugccauucaguuaccauuacuucugucuggauggaugggugagaccaauucacucccaaugacaccaagauuucugacuccuggcuucaggauccccaucacccuccguugcccuccaucacuuuaaagacuuuuauagaaugggaugcaguauccagcacaagaagagaauucuccuuggugaaggccagugccacaggacgggagaggccgugagugauuauaggcuucagggcugggaauucuucggguuuccccaagcagacgauggcuggaccagaggugucagcaacaaucacguuuccuuggugaucgaaggucacagcagaggcaguuacuuuggaggggaagaggagguucagcccgaagcuauccaccuggccaaucagcugcauaguggaguugaacaccuucacccuuguguuguuacagccaguccucccaaaggcacaaggaugcucuaggaccgcgauggcccccgugagccaugacacugccaacccacggggacugcauaggugagcuugcaaccucucaauccuccgaaggaccccuucagggaaauccgcuuccagcaggugcaaagucccugccucugcaucagucaccaggaccccauugugaggggugaucuccacaccccaaggcagggaaaacugcuuucccacaaccagcuugaucuggccaaagaaaucaaacacuuugagggagcagucgccagcgucggugacaaccacauggcagucguuggugacggcgacauccaguggguacuucacgucgugcgcugcgucccccuuuucuccaaacuggugugcaccuccuccuccggagucaaagaucuugacccgucucuucccgucgugcacgaccacuacccguccggucuuggggcacagugcaagcccugugggguucacuagggucccccacccgccgaaggcgugguagcaggugagaguccccggcgcgaagggggcggcgcugagggcagccggggacgcguggaggguggagcccaggagcuccaggaggugcagcaccggcaggcaaucgcuggugucacaggcucggcaggcccgccggcagaagggacacucgaggcccagcguccgcgggugcgcgagagcggcgacacaggccaagcagaccacguggccgcagggcagguugcgcgggcgccgcugcugccaguggccgaaccucucgaagcacaccuugcacuccagcaggcugaccuccgccucccgcaccagcucgggccgcaccccagccgcugccaccgccgucgccuccucccccauugcucccgcugcuccgcugccuccgcgcagcccucagucacggccacggucacggucacggagcggggcaugcgcucugacgcagggcgcacacugccacccccuggcggacgcacgacgcagucguccgcaugcgccgugcgcagaccugggauaaucacgucacggguggaagauuccaggauuaaagauugagacaugucagcgggugugggggcggggugugaugagugggucucuccguguccuccuguaagugacagcuagucucucagggauggugcccaaacggacugccagucagcuucgcugggagguggguaccagggcuagacaggaacaagacauggcuccuagucucuguauaguaagauucugaagacagagacacaagaaagaagauaacuucaaggggcagaugugcauuccucucugcuguguuuuuuccuucuugugagaagguagcuacguagacgucaaagaauugggugugauaguugugaugccgggacucaggcggcagaaacaggagaacagcug

SEQ ID NO: 10658 - RNA, 2501 nt, Mus musculus
cagcuguucuccuguuucugccgccugagucccggcaucacaacuaucacacccaauucuuugacgucuacguagcuaccuucucacaagaaggaaaaaacacagcagagaggaaugcacaucugccccuugaaguuaucuucuuucuugugucucugucuucagaaucuuacuauacagagacuaggagccaugucuuguuccugucuagcccugguacccaccucccagcgaagcugacuggcaguccguuugggcaccaucccugagagacuagcugucacuuacaggaggacacggagagacccacucaucacaccccgcccccacacccgcugacaugucucaaucuuuaauccuggaaucuuccacccgugacgugauuaucccaggucugcgcacggcgcaugcggacgacugcgucgugcguccgccaggggguggcagugugcgcccugcgucagagcgcaugccccgcuccgugaccgugaccguggccgugacugagggcugcgcggaggcagcggagcagcgggagcaaugggggaggaggcgacggcgguggcagcggcuggggugcggcccgagcuggugcgggaggcggaggucagccugcuggagugcaaggugugcuucgagagguucggccacuggcagcagcggcgcccgcgcaaccugcccugcggccacguggucugcuuggccugugucgccgcucucgcgcacccgcggacgcugggccucgagugucccuucugccggcgggccugccgagccugugacaccagcgauugccugccggugcugcaccuccuggagcuccugggcuccacccuccacgcguccccggcugcccucagcgccgcccccuucgcgccggggacucucaccugcuaccacgccuucggcgggugggggacccuagugaaccccacagggcuugcacugugccccaagaccggacggguaguggucgugcacgacgggaagagacgggucaagaucuuugacuccggaggaggaggugcacaccaguuuggagaaaagggggacgcagcgcacgacgugaaguacccacuggaugucgccgucaccaacgacugccaugugguugucaccgacgcuggcgacugcucccucaaaguguuugauuucuuuggccagaucaagcugguugugggaaagcaguuuucccugccuugggguguggagaucaccccucacaaugggguccuggugacugaugcagaggcagggacuuugcaccugcuggaagcggauuucccugaagggguccuucggaggauugagagguugcaagcucaccuaugcaguccccguggguuggcagugucauggcucacgggggccaucgcgguccuagagcauccuugugccuuugggaggacuggcuguaacaacacaagggugaagguguucaacuccacuaugcagcugauuggccagguggauagcuucgggcugaaccuccucuuccccuccaaaguaacugccucugcugugaccuucgaucaccaaggaaacgugauuguugcugacaccucugguccagccaucgucugcuuggggaaacccgaagaauucccagcccugaagccuauaaucacucacggccucucccguccuguggcacuggccuucaccaaggagaauucucuucuugugcuggauacugcaucccauucuauaaaagucuuuaaagugauggagggcaacggagggugauggggauccugaagccaggagucagaaaucuuggugucauugggagugaauuggucucacccauccauccagacagaaguaaugguaacugaauggcaaaagcaguuacuaaggcaguuuuaaaagacuaauaauuaaauuugucauucggugaaugccuguucccguguuaagaaauuugcagaucuuagccuguuugcuucuuaacacacagcgauguuaauuccuauuauccguccacuugggagaugagaagacagacccagagcauucaguaugguuucuuuagaguuguauucacugggacaguugaauucaguucuggcuccaaaccacuugcucuuagauaugauguuagaugucgucaacaacaacaaaaacugugagcugugucuuauguauguauguucuccuuacaaguggguaacugguaaagugcacaaagacaagaaaggggucuucauggggauuuuaggagaaaagggaaguuguccaucaccuucagcugugagcucccccaaagguagaguagauagcuuauuaccaguuccaagauuugaacaagaaacaaaguugagcucuuuccuuauaaggcaaaggcugccaggaugauagugugugccagaacuccaaauccugagaaguggaggcaggaaguucaaugcaaucugcagcuuagcuaccuaguaauuuugaggcuaagcuggacuaguguguucucucucucucccucucuuucucucccucucuccccc

SEQ ID NO: 10659 - RNA, 2501 nt, Mus musculus
ccuccggcugggccuaguggguggggggcggcagcgcggggcggggcggggcagggcgggcggggcaaggcagugacgcggggcuggccaggcuagaggcgcggcggcgcggggcggggacgcagucccggguccgacuggccgagccccgcgcgccccgcccgcgcccugcgccuccgcccggccagccggcgggggagggggcaugagccggcgcccgcgcgccgccgcgagcugcgggccggccuagagccccgcgcgggccccgcgccggagcuuagccgccgucgcuuccuagccgcgggcgcauccccgggagccgcgaugcagcggccaggggagccgggagccgcgcgcuucgguccgcccgagggcugugcggaucaccgaccgcaucgcuaccgcagcuucaugaucgaagagauccucacugagccuccggggcccaagggcgcagcgcccgcggccgccgcugccgccgcgggcgagcugcucaaguucggcguacaggcgcugcuggccgcccggcccuuccacagccaccuggguacgugcagcggccgccgcgcagaggacugggcuuggcgggcgggugggagucggagaccugggguuguccguaauucauccucuuucuccccuguuucuggagcgaccugggaugcagcucagcgcaggcccgaggcaccuaccucucuucgcgcacuccaacgggaaaguggagggugcgagcaaugagcuaggcagaaaccaggccuuguguccucgcgucagaccagaagagaguuugucuucugcuucagggcggcuucgaguuuuuucgaaucgggugauaggcgaggccaggagccagagaccgcaucccuaugguugcuacaaaaucaaucuaccgagcacucuggaucaaaaugacuucaaaccaggggaagccugaguuucgcgguaggguuggcugggcauaacaguagcugcccagacugggaaagcucuggagaagagggucgugucgcauaguguuggaugcccaagccauccaggagccuuucagaaccccgugcuuuccagucagcaaccgaccgaggccugugcugcggccagggucuccguaggccuuguuugagggaaagaggccugguugugauccgcugcccaguugguccuuccaucccgagaucugcugggcuuucgugcgucuugaagcacuugcucagaucuuuucugucuccgucuugucucuugggagauugugaggcagucugcccuguacugcaucucggcuuagggcuuagugacucucuuugguugaccuccuuccuagccuuuugguaaaguggaucugucuccccucuaccucucccccuccgcaagauucucuucccacuuccugcuauguuuucuaugcuccccuuacccugaugguucucagccaggcagauccauccuuuccaguaucucuuuuaggagaagccuaccaggaaaggaagcguccaauauagacuccagcucagcuagcggccuccggaaccggccccagauucuguccagucuugguagcagccaguccaguuugccucuuugauguucaucugguucacagccucucugcugccguucacuauaaaaggacucuguuguuggcaauucguuugaagcgggcaaacagccgauuuagggcuaaagaacauggagaggucuucaugcuucuuggggggagggggucugaacagaggaaacaagaaagacaauuuucagguucaaaggaugcuuuggugacccuuuccucgccaauguccaagccucagccagugauguagguacagcgcccagaaaaacaaaugcucacauuccacaacguucuuuucccaaugcaaaagcucccccacccccgcccccgcuuccaaauucacccguuucuucuuaguuucucuuuuucacgaaaggcauacucuauguccucggagcagcgaacuugcucuaaagcauccugaaaucucggagccuacuggcucauggggacuccaaaaaagagcaaaggaugcgagggauacucuuuucuagacuccucgggauagcuaccugaaggagggucgcccaggaugcuggguuuaaauccccagggaguggcugguucgggcucccaaacgcagcaaagcgcuguggcgugggaggcuggaauccaguucacccagaucuuucucucuucucucucuccccuucucucuuugcucuguagcggugcugaaggcugagcaggccgcaguguucaaguucccacuggcgccgcucggcugcuccgggcugggcucggcguuguuggccgccgggccugggaugcccggccccgcaggcgcaucgcaccugccgcuggagcugcaacuccgcgggaagcuggaagcagcuggcucuggugaaccuggcgcgaaagccaagaaaggacgccggagucgcaccguauucacugagcugcagcugauggggcuggagaaacgcuucgagaagca

SEQ ID NO: 10660 - RNA, 2501 nt, Mus musculus
ugcuucucgaagcguuucuccagccccaucagcugcagcucagugaauacggugcgacuccggcguccuuucuuggcuuucgcgccagguucaccagagccagcugcuuccagcuucccgcggaguugcagcuccagcggcaggugcgaugcgccugcggggccgggcaucccaggcccggcggccaacaacgccgagcccagcccggagcagccgagcggcgccagugggaacuugaacacugcggccugcucagccuucagcaccgcuacagagcaaagagagaaggggagagagagaagagagaaagaucugggugaacuggauuccagccucccacgccacagcgcuuugcugcguuugggagcccgaaccagccacucccuggggauuuaaacccagcauccugggcgacccuccuucagguagcuaucccgaggagucuagaaaagaguaucccucgcauccuuugcucuuuuuuggaguccccaugagccaguaggcuccgagauuucaggaugcuuuagagcaaguucgcugcuccgaggacauagaguaugccuuucgugaaaaagagaaacuaagaagaaacgggugaauuuggaagcgggggcgggggugggggagcuuuugcauugggaaaagaacguuguggaaugugagcauuuguuuuucugggcgcuguaccuacaucacuggcugaggcuuggacauuggcgaggaaagggucaccaaagcauccuuugaaccugaaaauugucuuucuuguuuccucuguucagacccccuccccccaagaagcaugaagaccucuccauguucuuuagcccuaaaucggcuguuugcccgcuucaaacgaauugccaacaacagaguccuuuuauagugaacggcagcagagaggcugugaaccagaugaacaucaaagaggcaaacuggacuggcugcuaccaagacuggacagaaucuggggccgguuccggaggccgcuagcugagcuggagucuauauuggacgcuuccuuuccugguaggcuucuccuaaaagagauacuggaaaggauggaucugccuggcugagaaccaucaggguaaggggagcauagaaaacauagcaggaagugggaagagaaucuugcggagggggagagguagaggggagacagauccacuuuaccaaaaggcuaggaaggaggucaaccaaagagagucacuaagcccuaagccgagaugcaguacagggcagacugccucacaaucucccaagagacaagacggagacagaaaagaucugagcaagugcuucaagacgcacgaaagcccagcagaucucgggauggaaggaccaacugggcagcggaucacaaccaggccucuuucccucaaacaaggccuacggagacccuggccgcagcacaggccucggucgguugcugacuggaaagcacgggguucugaaaggcuccuggauggcuugggcauccaacacuaugcgacacgacccucuucuccagagcuuucccagucugggcagcuacuguuaugcccagccaacccuaccgcgaaacucaggcuuccccugguuugaagucauuuugauccagagugcucgguagauugauuuuguagcaaccauagggaugcggucucuggcuccuggccucgccuaucacccgauucgaaaaaacucgaagccgcccugaagcagaagacaaacucucuucuggucugacgcgaggacacaaggccugguuucugccuagcucauugcucgcacccuccacuuucccguuggagugcgcgaagagagguaggugccucgggccugcgcugagcugcaucccaggucgcuccagaaacaggggagaaagaggaugaauuacggacaaccccaggucuccgacucccacccgcccgccaagcccaguccucugcgcggcggccgcugcacguacccagguggcuguggaagggccgggcggccagcagcgccuguacgccgaacuugagcagcucgcccgcggcggcagcggcggccgcgggcgcugcgcccuugggccccggaggcucagugaggaucucuucgaucaugaagcugcgguagcgaugcggucggugauccgcacagcccucgggcggaccgaagcgcgcggcucccggcuccccuggccgcugcaucgcggcucccggggaugcgcccgcggcuaggaagcgacggcggcuaagcuccggcgcggggcccgcgcggggcucuaggccggcccgcagcucgcggcggcgcgcgggcgccggcucaugcccccucccccgccggcuggccgggcggaggcgcagggcgcgggcggggcgcgcggggcucggccagucggacccgggacugcguccccgccccgcgccgccgcgccucuagccuggccagccccgcgucacugccuugccccgcccgcccugccccgccccgccccgcgcugccgccccccacccacuaggcccagccggagg

SEQ ID NO: 10661 - RNA, 2501 nt, Mus musculus
gucgguugauuucagguuaaagauaguauaguuaacacuggucaccucaaggugaguaacaguauuaauaagaauccgcucaaauccuucuggacacuuagguagauaucuacccaagcccaguucugcacccgguuagguaucugcagcugcuggguucuggagcacuuaaaauuagcaggauagacgcagaaccuuggagucagaguauagguuuggggguggggguagaugaucggcagaggaauaggggcagagggauacagaggguugaagagccccagcccgagucccagaguccagacagcgcggaugcagagaaguaauccagagacugggcggggacguagcccgaggcggggacguggcugggaaccagggcguaucuggggaccagcccgcgaagcucugaagcuuggguuaggggcggcaggaggcggggugaguuugggccccgccccggagggcaguggcaaaaguuugccuucggauucucuggggcagagucugggagaacaaguucaggggcaggcgacaagguccgggugcugagcaagguggcuggacaagccuagcgggagagaaaccugaggccacgagcgaccuccggaggagccccuagacgggagucuuagcugagacacggcagcaugcaaccagcccagaugcgccuugcagaacgaggugagcggcgggaccggaucccgggguugcacagaccagagucgcggguugagcgccuggggguucacccgaacccccuuuuuggauaaaauuucaaccaagucggggcaccagagugacuugggcucgcgagugccucgcuucggccacccccuccuguucauaucccggagaacaggacauaaccgccuguuggagcugguggagagguauaggguuccuuuaaauaacaaccagggcuuucuaaauguguuuguaaacucggagcagagugagcaggcuguccaagggaaagauucuugcuuuacuuggcuaauuaagaaguuagacaaucuuaggagaagaaaaccugggcacugggaacggcuguggguuuucccucugggagaaagcaaaugauucuuuuaaguuuuauuagugacaaaauuccaguuuucuuagcacuucucaaacuaggcaauuaggagugucaggccuggagcuagaagacaaggugccagcaaagugauaaugagagagaagauuggugugucauauguucuuaacugaaauagaagaaagggaagggugaccauuaaccaugugccuguacauggucucugcgucccugucucuccagccuuuaacaauccugacaccauguuccuuagauuugauguaaaaggggguuucucgucagcuguuuaaagggaauccuuugcuuuaaacaaacaccucuucuucuugacacccccuccuccaaagccuccagagucacucauucuaaggucugcagccagaagucucugguauugcauaucaccaccuacaaaaauguaucuauucaaaguuccauccuuuauagacgaaaaccaagcagacagggagggccaagagaauauaauuccuagaaaguggagcaagggguugcauaccucagguaaaggccuggcaaguuguggcuguggucagggcuguuugguugaggugguggugguggugguggugguggugguggugguggugguggugguggugguggugguggugugugugccugugcgcaggcgcucuguuuggguagcuguggaggaaucuagaucuguaagcuucuuaagggggugcagagcucagugcuugggggaguauuguguggccauauaccuucacaucagaucuuuccaucagcagacuggcagaugcucucaucuggucagugucagucugcccacauacaucagagcuugcccuuaggaagcccccacuggcauuuggggagauugacgucauaaccacuuagcauuuccccgaagccauuugcucuuuacacacacacacacacacacacacacagcuacacacauacaaacacacacacacacacaugcaugcacaugcacaugcacauacacacacacacacaccauaccgagacccuccugguucucuaccauauuuggaugaaggaacucccauuuccugcaaagcuuuacguacugacugaccugauacccugcuucccaugagucagggacuggucccuuuucuagaaagcaugauccuuuguuacacagauuucuuccucagugccuacaguuuguggguauauaucucuauuacaagaguaauaaacauuuugaguguggcauaauuuugaaaacgccgggguccccuugugguagcugaaucccuccuuuuccaucaaagucugaaggccacucuugagcaagcuguuugugugagcugggaagugguguugggguuccuugaauccugucgucacgucuacccucacgauuccauguugaucaauuuuggaucuguuucuuccgcacaag

SEQ ID NO: 10662 - RNA, 2501 nt, Mus musculus
cuugugcggaagaaacagauccaaaauugaucaacauggaaucgugaggguagacgugacgacaggauucaaggaaccccaacaccacuucccagcucacacaaacagcuugcucaagaguggccuucagacuuugauggaaaaggagggauucagcuaccacaaggggaccccggcguuuucaaaauuaugccacacucaaaauguuuauuacucuuguaauagagauauauacccacaaacuguaggcacugaggaagaaaucuguguaacaaaggaucaugcuuucuagaaaagggaccagucccugacucaugggaagcaggguaucaggucagucaguacguaaagcuuugcaggaaaugggaguuccuucauccaaauaugguagagaaccaggagggucucgguaugguguguguguguguguaugugcaugugcaugugcaugcauguguguguguguguguuuguauguguguagcuguguguguguguguguguguguguguaaagagcaaauggcuucggggaaaugcuaagugguuaugacgucaaucuccccaaaugccagugggggcuuccuaagggcaagcucugauguaugugggcagacugacacugaccagaugagagcaucugccagucugcugauggaaagaucugaugugaagguauauggccacacaauacucccccaagcacugagcucugcacccccuuaagaagcuuacagaucuagauuccuccacagcuacccaaacagagcgccugcgcacaggcacacacaccaccaccaccaccaccaccaccaccaccaccaccaccaccaccaccaccaccaccaccaccucaaccaaacagcccugaccacagccacaacuugccaggccuuuaccugagguaugcaaccccuugcuccacuuucuaggaauuauauucucuuggcccucccugucugcuugguuuucgucuauaaaggauggaacuuugaauagauacauuuuuguagguggugauaugcaauaccagagacuucuggcugcagaccuuagaaugagugacucuggaggcuuuggaggagggggugucaagaagaagagguguuuguuuaaagcaaaggauucccuuuaaacagcugacgagaaacccccuuuuacaucaaaucuaaggaacauggugucaggauuguuaaaggcuggagagacagggacgcagagaccauguacaggcacaugguuaauggucacccuucccuuucuucuauuucaguuaagaacauaugacacaccaaucuucucucucauuaucacuuugcuggcaccuugucuucuagcuccaggccugacacuccuaauugccuaguuugagaagugcuaagaaaacuggaauuuugucacuaauaaaacuuaaaagaaucauuugcuuucucccagagggaaaacccacagccguucccagugcccagguuuucuucuccuaagauugucuaacuucuuaauuagccaaguaaagcaagaaucuuucccuuggacagccugcucacucugcuccgaguuuacaaacacauuuagaaagcccugguuguuauuuaaaggaacccuauaccucuccaccagcuccaacaggcgguuauguccuguucuccgggauaugaacaggaggggguggccgaagcgaggcacucgcgagcccaagucacucuggugccccgacuugguugaaauuuuauccaaaaaggggguucgggugaacccccaggcgcucaacccgcgacucuggucugugcaaccccgggauccggucccgccgcucaccucguucugcaaggcgcaucugggcugguugcaugcugccgugucucagcuaagacucccgucuaggggcuccuccggaggucgcucguggccucagguuucucucccgcuaggcuuguccagccaccuugcucagcacccggaccuugucgccugccccugaacuuguucucccagacucugccccagagaauccgaaggcaaacuuuugccacugcccuccggggcggggcccaaacucaccccgccuccugccgccccuaacccaagcuucagagcuucgcgggcugguccccagauacgcccugguucccagccacguccccgccucgggcuacguccccgcccagucucuggauuacuucucugcauccgcgcugucuggacucugggacucgggcuggggcucuucaacccucuguaucccucugccccuauuccucugccgaucaucuacccccacccccaaaccuauacucugacuccaagguucugcgucuauccugcuaauuuuaagugcuccagaacccagcagcugcagauaccuaaccgggugcagaacugggcuuggguagauaucuaccuaaguguccagaaggauuugagcggauucuuauuaauacuguuacucaccuugaggugaccaguguuaacuauacuaucuuuaaccugaaaucaaccgac

SEQ ID NO: 10663 - RNA, 2501 nt, Mus musculus
gcacacauauaagcgagggugcaucugugcaucugcacaugucccacacacaacccagauggggcuggcgcacagaccaaggaugaauaacuccuucccuuuggcuacauggaugcugcuggugauggaggcccgggccuguucugagcaggaugcggggcagaagucauuaguagccccagcacuggguugccaguguccagcuuucgagggguuaagagauagaagguguugucuacaccccauagacuggccaguguuucuccucaggcagggccacauccccaaacaggcuccuccaccaggccacuuguccagauugccucucaugaucucagccccccaggggcagggcugggacaauaagauggaaacugcccugcuugcccugugcuggccucuccuauaacugaccugcaagacacgagaacuugucuccugaguccaucccucugggccuggcuaccggccagugcugcaguaccauggccuggacgccugguuauuuuguuccaucuuccagccccccuacccgguugcccucccagggugagagugaggccagcccaacuggaggcucccucagaucagccccaacucggccucgguuuucucaacgauagccuacuuccagccuaaggagaggaaaagauucaaauacaauuuuuuuuuuugagaagaacacuugggggcugugcccugaauggggcaucggagcccccuugguuuuccugacacccugagacuucagaccaaggcagguggcucacacccuccuccagcucagggaggguaacagcuggggagggggagauaagccacucacucacucugccccagucggagguugauagcccccugcugcugaguggaggggcuagggucccagagaucuacucaucuggcaucccucuguggaggcucccuccacgcucccagcugccccccuagccaagcugcuccguccaucuccugagucucuuccugccuaucugccucguccuagcgaucugcuccuucagcaggggagagaagggcucagcccugccucuuccucugcgauccgugagggauaaagaagucacuucgugguugccauguggcaaucaaccuccuuguaucacacccuaaccuagauguggggggagacaaccccgagaagcccccggugggcggggcacgcuggcccccagcccucggcgcuccucccccgcccuagcuuuccuuugugcuguggccgggcaggcugcucuagcuccgcuagcuggguccccgccccguccccacccgguccucgcccgcucgaagguggcgaaggugcccuuggcuggcccgugcacaccugucccccgggcccguggagggaggcagggugagaagggggaugggcuccgacaggaccguaggaccccaggccccacgucugggcuccacacccgcguggcuggcguccggcucccgcgcccccagugagccuuagggcggccucagggcgccccggcccgcgcgcccagccuggcccgagcggccccucccccggcucgcacaaaggcagccccuccccggcucucccgagccguugcaccauuucggggucucccccucccuucccgguggcagagccucggggaaacaaaggcgcgcggcggccuggggacaaaggggccgggggcgggggcgggggcggggggcucaccagucggcugcgcucuccucccggaucaccuccucguacgccgccagcagcuccaggcgguggccgcugaagcugacgccggccaugcugcgggccggaccgaggccgaacggacagacgcacgcacaggcggaccgaccgacaccggagggaggggaugagggagucgccgccgccgccucagagccucugcagcgcugagagcgagcgagccagcggccgggggaggggagccggccggcggggggcggggggcgcuggcuccgcccggcucacucccucggcucgcucgguccuagcgccgccccggcccggcccagggggaggcccgcccccccuucccaguuugccccggggcgucccacacacgccccucacccugcuggccagcaccggacacugagcuuccgcucugcucccagggccagucccaugcaccugucuuguccucguccccaaccuggcagcacaccccucuucccuagccauaaacccaccaagauuccaggcccagauucaucccucuccaucuccccagaguaauugacccagcccaacacccuugauccauuuaacuccagcccagacucacaucauuccuggguccguuacacccuaccuuaaaccccuuaugguccuuacucugucccugcccggauucaguuccucaucagaccaggccuggguuacguguaguccauuuccucugaaaggacccucccuagucuaccaccacuacuuccaucucagcuacaggcccaugcuuaccucugcacacaucccaccuagucaccauacccucuug

SEQ ID NO: 10664 - RNA, 2501 nt, Mus musculus
caagaggguauggugacuaggugggaugugugcagagguaagcaugggccuguagcugagauggaaguaguggugguagacuagggaggguccuuucagaggaaauggacuacacguaacccaggccuggucugaugaggaacugaauccgggcagggacagaguaaggaccauaagggguuuaagguaggguguaacggacccaggaaugaugugagucugggcuggaguuaaauggaucaaggguguugggcugggucaauuacucuggggagauggagagggaugaaucugggccuggaaucuugguggguuuauggcuagggaagaggggugugcugccagguuggggacgaggacaagacaggugcaugggacuggcccugggagcagagcggaagcucaguguccggugcuggccagcagggugaggggcgugugugggacgccccggggcaaacugggaagggggggcgggccucccccugggccgggccggggcggcgcuaggaccgagcgagccgagggagugagccgggcggagccagcgccccccgccccccgccggccggcuccccucccccggccgcuggcucgcucgcucucagcgcugcagaggcucugaggcggcggcggcgacucccucauccccucccuccggugucggucgguccgccugugcgugcgucuguccguucggccucgguccggcccgcagcauggccggcgucagcuucagcggccaccgccuggagcugcuggcggcguacgaggaggugauccgggaggagagcgcagccgacuggugagccccccgcccccgcccccgcccccggccccuuuguccccaggccgccgcgcgccuuuguuuccccgaggcucugccaccgggaagggagggggagaccccgaaauggugcaacggcucgggagagccggggaggggcugccuuugugcgagccgggggaggggccgcucgggccaggcugggcgcgcgggccggggcgcccugaggccgcccuaaggcucacugggggcgcgggagccggacgccagccacgcggguguggagcccagacguggggccugggguccuacgguccugucggagcccaucccccuucucacccugccucccuccacgggcccgggggacaggugugcacgggccagccaagggcaccuucgccaccuucgagcgggcgaggaccggguggggacggggcggggacccagcuagcggagcuagagcagccugcccggccacagcacaaaggaaagcuagggcgggggaggagcgccgagggcugggggccagcgugccccgcccaccgggggcuucucgggguugucuccccccacaucuagguuagggugugauacaaggagguugauugccacauggcaaccacgaagugacuucuuuaucccucacggaucgcagaggaagaggcagggcugagcccuucucuccccugcugaaggagcagaucgcuaggacgaggcagauaggcaggaagagacucaggagauggacggagcagcuuggcuaggggggcagcugggagcguggagggagccuccacagagggaugccagaugaguagaucucugggacccuagccccuccacucagcagcagggggcuaucaaccuccgacuggggcagagugagugaguggcuuaucucccccuccccagcuguuacccucccugagcuggaggagggugugagccaccugccuuggucugaagucucagggugucaggaaaaccaagggggcuccgaugccccauucagggcacagcccccaaguguucuucucaaaaaaaaaaauuguauuugaaucuuuuccucuccuuaggcuggaaguaggcuaucguugagaaaaccgaggccgaguuggggcugaucugagggagccuccaguugggcuggccucacucucacccugggagggcaaccggguaggggggcuggaagauggaacaaaauaaccaggcguccaggccaugguacugcagcacuggccgguagccaggcccagagggauggacucaggagacaaguucucgugucuugcaggucaguuauaggagaggccagcacagggcaagcagggcaguuuccaucuuauugucccagcccugccccuggggggcugagaucaugagaggcaaucuggacaaguggccugguggaggagccuguuuggggauguggcccugccugaggagaaacacuggccagucuaugggguguagacaacaccuucuaucucuuaaccccucgaaagcuggacacuggcaacccagugcuggggcuacuaaugacuucugccccgcauccugcucagaacaggcccgggccuccaucaccagcagcauccauguagccaaagggaaggaguuauucauccuuggucugugcgccagccccaucuggguugugugugggacaugugcagaugcacagaugcacccucgcuuauaugugugc

SEQ ID NO: 10665 - RNA, 2501 nt, Mus musculus
acagccaaauguguauaaacuccagucagauggccauuucucugggaaaaagaaucuaugcaucacugcagguaaauuuuagauucccucacacaaacacugggagagauacuuuccaaacccuagauaaauacauuacagcgagaugauuuaaauucacaaaauaaaacugcuacgaauggauuuugauggggggggggggaaucucaaagaaaugcgccauuuugaauugacuuuuaaaaaaucucuccaaguaacuuguggcauguagguucuuuuaaauuucagagaaauacuccuagugaauugugucaaaggaagcauacaguuaaaauuguuaauuuaucccuguagauuugauuugaaaaucaaucucuacagguuuuuuuuuuuuaagcaaacaccacgcuuaaaacuucuaaaaacaaaaguacacucagagcuuuguuuucuaaccaagcaaacagagguuggaaaaaagucacuuagagaugcaaaacagaaacaaauaccgauuaaauaaacguggaagagaugcccagggcccgggauggcugucccaggcagccuggagaucugugacuauuugggguugggaccccccucccgugcacagccgcuccaagacaggacaggccuggaaacggacauggccgaagccacccaaucucgggcccagcucaagagaucgggguuguuuuguuuuguuuuguuuuuuaaaagacaacugggggauuuguggagucgagaacccacccuggcuggaccccugguggcucugggcugagguguccacgugggccaggauccccgcugcagcaggguucugccggcucugccgggagucaggccgcgccuccuagcuggcuggcucucgcuguccccagagcucgagcucggcuuuacggaccccucucuucuagccugcucugugaccccaccucuucuuuuaggauucuuuccuccaucugucaaggugucucuuugggcacuuugucuggccaccccuucuacucccugcacaucugcuucucgcccugagccccagcgacuccucagcaaccaguuagggaaaacucaacuuuuuucucccgcgugcuaucugcuccugcuccagaggggcugccagucccacucagggcuuggcgugugggggacuguuuggaagugacuucgcgugugcgugcgaacgcgcguguaaauuuccguguucaucgucagguuaagaccagggaggaaaaagaaagcuccucgcugcagagacgcagaggggacccggcugcgugccaagccgcccggugugcgcggaggcuggaugcccgccgcggguugggggagccgcguuuaccuggcagaucagcgucggacgauucgcuggcggaguucuccagcggcucccgggggucggcggcgcgggccagguggaagcugggccccaugucgugcgguggugguggcgguggccgcagccccuccgguagccucuccaggcucaugccucccuugaaggcguccauggagguggggaccgcaacgggcgcuccaggggccggggcugggagcucccggccgcccaggcugcgaccuguuggggacaagagaguggcgccuaagcggcugccccccagggcugcccgcgcccacagcgacgccguucgagcuccaucgaccucuccaggcugcgggaccggguucggggcucggggcuccgccacgcgcuccugcugcuccggccucagcugcccggccggcccgggccccagucccgauucgaggccgguuucuaaggcucgggucggagcccgcagagucugucugaaaacgacagugcgcgcagccagguuccagcagucccugcgccaggggugguggguggggugggccucggugggagggggcugggagagaaggagggagggcgcgagcgagugagcaagcgagcgagggagcgggcgcgggcggaauccagccucgagccgcccgcgccgcgcccuccccgccguccucccucccucccucucucccucccucccuccuggccucgcccgcgcccuccccgucgcagccaccuucccgccgccucaccucccccccucucccgcggccucaccgcgccucucccuccuuccccggugacacacgaauuucucccuuggccgcacaaaagaaacgcaucuggccagcuagccccgggcggcuggugcacaccuugggggccccaagugacuuguuucgcugagagucaacuccugucugggccaccucaaguccccagccacgggagagaacaacuuagaaugagugaagguucgcugagcaggaucgcucugagccggcgccuccgagccagcgccagggcagucaguggcagagccggggggccgguucccgguugcugcagcucccagcgguggugucguccucgaggggcagacgggccccuccuaccucagucgcuucucccaggaacucggggccggcugagugacagcagccugcga

SEQ ID NO: 10666 - RNA, 2501 nt, Mus musculus
ucgcaggcugcugucacucagccggccccgaguuccugggagaagcgacugagguaggaggggcccgucugccccucgaggacgacaccaccgcugggagcugcagcaaccgggaaccggccccccggcucugccacugacugcccuggcgcuggcucggaggcgccggcucagagcgauccugcucagcgaaccuucacucauucuaaguuguucucucccguggcuggggacuugagguggcccagacaggaguugacucucagcgaaacaagucacuuggggcccccaaggugugcaccagccgcccggggcuagcuggccagaugcguuucuuuugugcggccaagggagaaauucgugugucaccggggaaggagggagaggcgcggugaggccgcgggagagggggggaggugaggcggcgggaagguggcugcgacggggagggcgcgggcgaggccaggagggagggagggagagagggagggagggaggacggcggggagggcgcggcgcgggcggcucgaggcuggauuccgcccgcgcccgcucccucgcucgcuugcucacucgcucgcgcccucccuccuucucucccagcccccucccaccgaggcccaccccacccaccaccccuggcgcagggacugcuggaaccuggcugcgcgcacugucguuuucagacagacucugcgggcuccgacccgagccuuagaaaccggccucgaaucgggacuggggcccgggccggccgggcagcugaggccggagcagcaggagcgcguggcggagccccgagccccgaacccggucccgcagccuggagaggucgauggagcucgaacggcgucgcugugggcgcgggcagcccuggggggcagccgcuuaggcgccacucucuuguccccaacaggucgcagccugggcggccgggagcucccagccccggccccuggagcgcccguugcgguccccaccuccauggacgccuucaagggaggcaugagccuggagaggcuaccggaggggcugcggccaccgccaccaccaccgcacgacauggggcccagcuuccaccuggcccgcgccgccgacccccgggagccgcuggagaacuccgccagcgaaucguccgacgcugaucugccagguaaacgcggcucccccaacccgcggcgggcauccagccuccgcgcacaccgggcggcuuggcacgcagccggguccccucugcgucucugcagcgaggagcuuucuuuuuccucccuggucuuaaccugacgaugaacacggaaauuuacacgcgcguucgcacgcacacgcgaagucacuuccaaacagucccccacacgccaagcccugagugggacuggcagccccucuggagcaggagcagauagcacgcgggagaaaaaaguugaguuuucccuaacugguugcugaggagucgcuggggcucagggcgagaagcagaugugcagggaguagaagggguggccagacaaagugcccaaagagacaccuugacagauggaggaaagaauccuaaaagaagagguggggucacagagcaggcuagaagagagggguccguaaagccgagcucgagcucuggggacagcgagagccagccagcuaggaggcgcggccugacucccggcagagccggcagaacccugcugcagcggggauccuggcccacguggacaccucagcccagagccaccagggguccagccaggguggguucucgacuccacaaaucccccaguugucuuuuaaaaaacaaaacaaaacaaaacaaccccgaucucuugagcugggcccgagauuggguggcuucggccauguccguuuccaggccuguccugucuuggagcggcugugcacgggaggggggucccaaccccaaauagucacagaucuccaggcugccugggacagccaucccgggcccugggcaucucuuccacguuuauuuaaucgguauuuguuucuguuuugcaucucuaagugacuuuuuuccaaccucuguuugcuugguuagaaaacaaagcucugaguguacuuuuguuuuuagaaguuuuaagcgugguguuugcuuaaaaaaaaaaaaccuguagagauugauuuucaaaucaaaucuacagggauaaauuaacaauuuuaacuguaugcuuccuuugacacaauucacuaggaguauuucucugaaauuuaaaagaaccuacaugccacaaguuacuuggagagauuuuuuaaaagucaauucaaaauggcgcauuucuuugagauuccccccccccccaucaaaauccauucguagcaguuuuauuuugugaauuuaaaucaucucgcuguaauguauuuaucuaggguuuggaaaguaucucucccaguguuugugugagggaaucuaaaauuuaccugcagugaugcauagauucuuuuucccagagaaauggccaucugacuggaguuuauacacauuuggcugu

SEQ ID NO: 10667 - RNA, 2501 nt, Mus musculus
gacuccaggccccuaccucuacagguagcugcggaucggggcuaauuccccauuagaaagucuuaauuggcuuauggggugccugaaaguucucucuuguguuuacaaggcagaaggaauggauggcucaaagugccuuaaucugucucccucguucuuggcgauagucgggugcgcuuuauuuuuaaguuguuuuugaaacaggauuggagguuuggagauggugggauaauauuucacuuuacagguggagcugccaaggggaugagggaaagccccagagacaccgcuacuaggcaaggaaacgggugacuacuuuuuuuucccuuauuuuuuuuuauuuacacgaagcaucugcaguacaaaaauguaaacuuugauagcucauaauaauagaauaaauucuuuauguacaaaaauacauuuucauaugaaugaagcauccugaauaaauuaaaguacccuccaguccagugccugaauagcuaugcuagcacucagguucuuccuggagcaagcccacaguggcgggggucgggauccauaaugcaugaagcccacuccuuguggcuccuuuuuaagccuugccauuguauugucagccggcucaaaccgaauuuucaugcucguuuuucuucauuagaguucuacaaauuguaaaauugacuuuucaccucgucuucaggggcucaucugucccuuuuccaaaccacacugaagugguggcuggggucaguucugagccagucacaaagaagguuuugugaaguucagaaagugcaacaaaaacgaaaggccgucugggggcgggcggggggggggggaggccgugcuggggguggagaaauagaccgagggcagcuucagcgagggugcagcaaccuaacaaguggucagguauucccccuccccccuuuaaagcucccagaauucacuuggggguaaguguggcccccggaggcuucagccaguuccccaucuauuauugcucuuagacugggggaggaagaaaguauugauguugccuuacaaaggccuagugguaugggaugaaacagggcgucguguggagcaggucuuugggcaggccaggaaaggagaaaaggggaucgcccgggccauaggugaagucuucugaagccgagggacuacuggggucagagaguggugaugccacaguggcgcagggggaggcagcggccccggaaccccaggacucagugucgcuggccgggcucgggggcccgggcagacaggggacacacugcggaggcaggaggcgcucccgggcacugcccccggggagcccuugaucugccaggcgcagugucucagccagggcccagauguaguuguaggcgaagcgcagcgucucaaucuuggugagcuuggugucgucggggaacgagggcagcacgcugcgcaaggcguccagcgcagcguugagguugugcaugcgguugcgcucgcgaucguuggcuuugacgcgacgacuccuccgcagggagugcagcagagccucggaccgcacccgagcgcgaccucgccgccuccgccguuccugcucuucguccugggcaccgggaacauucgaugccccggagagggcgggagcgcuccuccgggcuggcacggacagccccgagguggaggcuaggggcuguagccuggcacaguccuccucgucggugaggaagcuggacaggucgcugcugcuguugcugcuggagcagucgagaucagagaugcaggucuccaaaggggcaggcaucuugcagugugcaggaccgacagacggacaggagguuuggaggucggccuucgaagcgcacuuacuguccguacgacccggggcuagccugugccugcugcaggcgcgagggccgggaagaucgcaggggcucagggagugaaugggcuuggcccuccucgccucgccugcaggggccacgcgccgggcuggucuccugagugaugucgccggcgaucagaucagcuccugugagcaccaaguguggcacacgaccggccucaggaccccuuaaguacggcgcgcaacaaugggcgcccccucccuggccaccuccgcccccgaggcggcgcgggugaauggcgagaggcggcaggucagccccgugcggcgccugcuauuugcauaauuuaugcucgcgggaggccgcccccgcccagccccccuccuggagcgugcccguaauuaccgccggccaaucgguggcccggccugcuccgggagccggaucaagcgagggaggccggggcgucucuggccgggaaacccgggcgaaggcgggggccgggggcgauuagcggcgggccgaggcacacuccucccaggggcgcgcgggugucccucgcugggguggauggggaggaggagcccuggcagaaagugugagcucuguggcgggugauggagagcuggggcugaggcuggaggcuggguucgcaucccuuugccugcuacugaguucgcaucccuu

SEQ ID NO: 10668 - RNA, 2501 nt, Mus musculus
aagggaugcgaacucaguagcaggcaaagggaugcgaacccagccuccagccucagccccagcucuccaucacccgccacagagcucacacuuucugccagggcuccuccuccccauccaccccagcgagggacacccgcgcgccccugggaggagugugccucggcccgccgcuaaucgcccccggcccccgccuucgcccggguuucccggccagagacgccccggccucccucgcuugauccggcucccggagcaggccgggccaccgauuggccggcgguaauuacgggcacgcuccaggaggggggcugggcgggggcggccucccgcgagcauaaauuaugcaaauagcaggcgccgcacggggcugaccugccgccucucgccauucacccgcgccgccucgggggcggagguggccagggagggggcgcccauuguugcgcgccguacuuaagggguccugaggccggucgugugccacacuuggugcucacaggagcugaucugaucgccggcgacaucacucaggagaccagcccggcgcguggccccugcaggcgaggcgaggagggccaagcccauucacucccugagccccugcgaucuucccggcccucgcgccugcagcaggcacaggcuagccccgggucguacggacaguaagugcgcuucgaaggccgaccuccaaaccuccuguccgucugucgguccugcacacugcaagaugccugccccuuuggagaccugcaucucugaucucgacugcuccagcagcaacagcagcagcgaccuguccagcuuccucaccgacgaggaggacugugccaggcuacagccccuagccuccaccucggggcuguccgugccagcccggaggagcgcucccgcccucuccggggcaucgaauguucccggugcccaggacgaagagcaggaacggcggaggcggcgaggucgcgcucgggugcgguccgaggcucugcugcacucccugcggaggagucgucgcgucaaagccaacgaucgcgagcgcaaccgcaugcacaaccucaacgcugcgcuggacgccuugcgcagcgugcugcccucguuccccgacgacaccaagcucaccaagauugagacgcugcgcuucgccuacaacuacaucugggcccuggcugagacacugcgccuggcagaucaagggcuccccgggggcagugcccgggagcgccuccugccuccgcaguguguccccugucugcccgggcccccgagcccggccagcgacacugaguccugggguuccggggccgcugccucccccugcgccacuguggcaucaccacucucugaccccaguagucccucggcuucagaagacuucaccuauggcccgggcgauccccuuuucuccuuuccuggccugcccaaagaccugcuccacacgacgcccuguuucaucccauaccacuaggccuuuguaaggcaacaucaauacuuucuuccucccccagucuaagagcaauaauagauggggaacuggcugaagccuccgggggccacacuuacccccaagugaauucugggagcuuuaaaggggggagggggaauaccugaccacuuguuagguugcugcacccucgcugaagcugcccucggucuauuucuccacccccagcacggccuccccccccccccgcccgcccccagacggccuuucguuuuuguugcacuuucugaacuucacaaaaccuucuuugugacuggcucagaacugaccccagccaccacuucagugugguuuggaaaagggacagaugagccccugaagacgaggugaaaagucaauuuuacaauuuguagaacucuaaugaagaaaaacgagcaugaaaauucgguuugagccggcugacaauacaauggcaaggcuuaaaaaggagccacaaggagugggcuucaugcauuauggaucccgacccccgccacugugggcuugcuccaggaagaaccugagugcuagcauagcuauucaggcacuggacuggaggguacuuuaauuuauucaggaugcuucauucauaugaaaauguauuuuuguacauaaagaauuuauucuauuauuaugagcuaucaaaguuuacauuuuuguacugcagaugcuucguguaaauaaaaaaaaauaagggaaaaaaaaguagucacccguuuccuugccuaguagcggugucucuggggcuuucccucauccccuuggcagcuccaccuguaaagugaaauauuaucccaccaucuccaaaccuccaauccuguuucaaaaacaacuuaaaaauaaagcgcacccgacuaucgccaagaacgagggagacagauuaaggcacuuugagccauccauuccuucugccuuguaaacacaagagagaacuuucaggcaccccauaagccaauuaagacuuucuaauggggaauuagccccgauccgcagcuaccuguagagguaggggccuggaguc

SEQ ID NO: 10669 - RNA, 2501 nt, Mus musculus
gcuuuggauuuugugucaaacugcugauuuuuaaaaggugagggugugagauaaacuguugcuacuaaggaacaggccaagcuacgccuagcaagauuuauaaaugaaugaccuguuuucuugaggccuuggucucuaugaagggccacugccaucaugagcaccuucuucuaugacaucagugucgggaaagaauugagccugggggaacuuaaguacauaauuucagcccuuuaaaaaaugaacaguagugacugugucgaucaacacuaucaaccaccuagcuugauccaaaacggaacuaugcaaugucaaugucaucaguuaauauggccauaugcuuugagagggcagcucucucaccauguagccugcacuggaaccaaacucucaauccuccugucccaggcuccugagucuugggaauacagguguacaccaguucgugcagcuagagaggccuugguggacucuaacagaucaaacacaacagacugaggacuugcgacuccaagaggcccuggguuugaugccaagcacugucccuacgaauuacaaaaugagaggaaaaggaauggccuggucucccucaucuucuuggcugcuugacugucauuuugacuucuuagaacuuaagguuacagggaucgaggaccaacgguccugaaacuuuugcuuccaacacacuuaucgaaaaugacauaaacuuaaaggcauacccggagcuccaccacccccccccaccccccccccccccgcaacacacacacugguuaggugcagccuuccuuuucuaauccgaagcucucaacuucuguggguugugaacucuuagaaacaaaaacaaaaagcaaacugcagacauguacuaaggaauucagucaugaagugcaaaggugauuuucacuugcacacaacgucccucugauccacguguagguucucgcucuagagugauugcuagaagccccuaggguuaauauuaaacagguguauuucgaucuuuagugaaaaaucacauuaaagaggcuuagacuaaccgauuuuaguggcauaagcuaguguagggaaaccccaggcuuucuaggaagauucucaauacagcauuaccaucuuucggcaguuucuccaguauuucuggagcuacagcuuaacuucauucccgugacaggcgggcgcaagcgccuucacauaaacagacgaggcugaagaacaaugcuuguguuuuuccagcgccucugccucucgcuagaacucuccaccgacaucccuugagaaaugucgccaguggagggagcggggcagacaaugggauaaacuuuugccccgacugcuccgcguuuacagacaccccgaggcuggcacccuaccgcugccaccgccgccgccgcgcauagcugcuggaagccccgacagcaggggcuugugcgagagccugcgcaucuaccucgggcugcugggagggagggagggaaggcgagcggcgagcagccccucucuccuccuucgggaaccgaagccaaaucucacgcacgagcaguuccgggugcuccaaaacuuguucgcgaaguacccggagaaagagcgcggcgggcugggcgagccccagccgcugccgagacgcgguguccaagccugcaagcgacaccggcgucgggugggcgccccggggagccccgaacgggcggccgcaccugcugucacucccgcggccggccgcggcggaccaggccugcggcccgcacucccccgcagccuccgcggcccucccgccgcccggccccgcucggcucagccccgcucggcuccgcuccgcuccgcuccccgccucaggccgcacucggccgcguccccucagccacgagcugcgaggcuccguagacucaccgggccucccucgccgcggugcggccgcucccgucuccccgccgcucccgcgcuacccccgggcguugggcgcgggccgcggggcguccgcaguaacgggcccgcggagggcggcggcgcgcggagggcggggcggggcggggcggggcggacccgcaagccuggcgcccgccguggccggccggcgcgcgggacuucuuugccgagggucgcagcgcggcggacgcugacgccgaggagagguccgcgggggacggacugcggaggaccagaaccaccugcuggaggagccgcgcuacgggggccgcgcaggguccaaacggcucgcguaggcggcggcuccgcgguccucggggucgcggagccgggaaggugggaggccuuccgggaggaggcuuaggccgccgcgggcggcgcgcggcgggaucgccaggcuguggggaggcccgggggcggaggcggaccuccagucggcgagggagggcggugcugcacgagaugcaaacagccggacggccuuggguucccgcgggagcaccuccggggccgcuuuaguuuugcaaaguuaagcggcuuaccggcaaacccguccgcuaccgcccagccgugcgggc

SEQ ID NO: 10670 - RNA, 2501 nt, Mus musculus
gcccgcacggcugggcgguagcggacggguuugccgguaagccgcuuaacuuugcaaaacuaaagcggccccggaggugcucccgcgggaacccaaggccguccggcuguuugcaucucgugcagcaccgcccucccucgccgacuggagguccgccuccgcccccgggccuccccacagccuggcgaucccgccgcgcgccgcccgcggcggccuaagccuccucccggaaggccucccaccuucccggcuccgcgaccccgaggaccgcggagccgccgccuacgcgagccguuuggacccugcgcggcccccguagcgcggcuccuccagcaggugguucugguccuccgcaguccgucccccgcggaccucuccucggcgucagcguccgccgcgcugcgacccucggcaaagaagucccgcgcgccggccggccacggcgggcgccaggcuugcggguccgccccgccccgccccgccccgcccuccgcgcgccgccgcccuccgcgggcccguuacugcggacgccccgcggcccgcgcccaacgcccggggguagcgcgggagcggcggggagacgggagcggccgcaccgcggcgagggaggcccggugagucuacggagccucgcagcucguggcugaggggacgcggccgagugcggccugaggcggggagcggagcggagcggagccgagcggggcugagccgagcggggccgggcggcgggagggccgcggaggcugcgggggagugcgggccgcaggccugguccgccgcggccggccgcgggagugacagcaggugcggccgcccguucggggcuccccggggcgcccacccgacgccggugucgcuugcaggcuuggacaccgcgucucggcagcggcuggggcucgcccagcccgccgcgcucuuucuccggguacuucgcgaacaaguuuuggagcacccggaacugcucgugcgugagauuuggcuucgguucccgaaggaggagagaggggcugcucgccgcucgccuucccucccucccucccagcagcccgagguagaugcgcaggcucucgcacaagccccugcugucggggcuuccagcagcuaugcgcggcggcggcgguggcagcgguagggugccagccucggggugucuguaaacgcggagcagucggggcaaaaguuuaucccauugucugccccgcucccuccacuggcgacauuucucaagggaugucgguggagaguucuagcgagaggcagaggcgcuggaaaaacacaagcauuguucuucagccucgucuguuuaugugaaggcgcuugcgcccgccugucacgggaaugaaguuaagcuguagcuccagaaauacuggagaaacugccgaaagaugguaaugcuguauugagaaucuuccuagaaagccugggguuucccuacacuagcuuaugccacuaaaaucgguuagucuaagccucuuuaaugugauuuuucacuaaagaucgaaauacaccuguuuaauauuaacccuaggggcuucuagcaaucacucuagagcgagaaccuacacguggaucagagggacguugugugcaagugaaaaucaccuuugcacuucaugacugaauuccuuaguacaugucugcaguuugcuuuuuguuuuuguuucuaagaguucacaacccacagaaguugagagcuucggauuagaaaaggaaggcugcaccuaaccaguguguguguugcggggggggggggggugggggggggugguggagcuccggguaugccuuuaaguuuaugucauuuucgauaaguguguuggaagcaaaaguuucaggaccguugguccucgaucccuguaaccuuaaguucuaagaagucaaaaugacagucaagcagccaagaagaugagggagaccaggccauuccuuuuccucucauuuuguaauucguagggacagugcuuggcaucaaacccagggccucuuggagucgcaaguccucagucuguuguguuugaucuguuagaguccaccaaggccucucuagcugcacgaacugguguacaccuguauucccaagacucaggagccugggacaggaggauugagaguuugguuccagugcaggcuacauggugagagagcugcccucucaaagcauauggccauauuaacugaugacauugacauugcauaguuccguuuuggaucaagcuaggugguugauaguguugaucgacacagucacuacuguucauuuuuuaaagggcugaaauuauguacuuaaguucccccaggcucaauucuuucccgacacugaugucauagaagaaggugcucaugauggcaguggcccuucauagagaccaaggccucaagaaaacaggucauucauuuauaaaucuugcuaggcguagcuuggccuguuccuuaguagcaacaguuuaucucacacccucaccuuuuaaaaaucagcaguuugacacaaaauccaaagc

SEQ ID NO: 10671 - RNA, 2501 nt, Mus musculus
uuaccaguacuauguguucccucaccggaaaacaguuuaaaaacaaaacaaacagacaaauaaaaacccggccccuuugcaaaccuaauucccucaacaucccuucuccaaguccauuggaacuugaaagacccccaccguucagcacucugagucuaggccuccuuugcuuuugcagggugucccgaauucugcagauuagagcuggcaguauagaucagccgguuaucucugcagccuggaaaaccgcacagaagagggccgaacauguuggcugcgguacgagcugggcccuguccacccaggaagagugugggucaguguucccgaccaucuccggucuccgagccacaggugcccugcucgggaaccagcugggucgugcauaccggccuggagcagccugcagcaggggcgcaggagcuacaagugugacccgagcagcaggagcaacagcagcagcaaacaggcaaacgggguccaggcgcuucgauucgcccaguggccuccacugccgcugcugcugcuccugcgcccgggaccguggggcaagucuccgcggccgcccgccgcagcagcgccgccgcccgggcgcgcaaggccgucgucgucguccagggguugcucgccgcccgcggccccagcgcgcugcucgucgucauauucuucgucguaguagucguccaggcccccguccgagccgcugcugcccggaccguugcucgcaucugggccgaagcacaggcgggccauguucucuuugaccgauucgcagaugggccgcuccagcccaucgcacacgcagucguugagcagcgccgccuugggcacggccagcauguccucgaugaccgcgcggcacucgucugugcagcgcagcccguugaaaagcuugccgcaguaggccagguagcggcugagcgccagguugcagcggcugucccggucgcagcgccgccgggccucagugcagcccaugaccgagcccgcucccgcgcccgggcccacgcugcuggugcgcggcagacagggcucgauggcgcgcuugguggaccugcaguguucguccugcgcgcagucgcaguccuccagcgcgggcccgcggcgcgugugguugagcuggauaagcgccgagaugcaguggcucgggcagcgccagcgcggcgaggacgcggccgaggcggggaaggcgccggcgggccccggagcaucagccccgccgcgcugcgcuagcaccggcgcacaagccucggcguacuggcuguaggcguagcugcagucgggcucgcccugacacugcagcagcgccugccagcagaugaggcggcggccgugcgcuagccccgagccccgcggugccgagcacagcagcugcagcagcgccaucaggcacagcaaggcgcccggcaagguccccgugcgggccccggcgccgcccagcagcgcggcuagcaucgcgggcagcagcggccgccggacgcggugcggagcggagacgaggcucggguggcggccgcggggccgcuggaaaaguuuguccgaguuccgcgcacuucuggcaugggcguccucauccauccaugccggcggccccgcggcugguaaaggcggguguucgcuccggcaccgcggccggggcucccugagaagcgcggcgacgcagguccggguccgguagacgguuggaggcgcucagugccguuccggggggacgcggcgaagcugcaggagcgcgcggcgccgggggugcauggugcuaggcgccugcagacagucgugcggccggcggcuccucgguucccggcucagcggcgcguagcacuucgcagcucuggcaucccgccuucccgcggccaggacgcuugguccccucccccucuaccccggucugggccgcgcuccgggaaguucugggcgccaggcgcagggaggaccccgaaacucggagcguuucucugcuccgagacccggagcuuggggagcggauccgcggagcccggcugcggacuagcucgccgcgaggcuuuaaauacaaaagugggccgggagcccccguguggugccgcggcgcccccucauuaugcaugcauagaaaagcaaacaaacaaaaacauuagcaacgcuccuccggcucgccgagcccuggccccgcgcgcuccaggcuugcccgcuuucuccuuucuccacucuccggcgcccuuugcucggcccccuuccccggcuuugcgagcugcuauugguccagccuguuguuguugaaacuuuuuuuuuuuuuuccgagccgcuggaguggggcugcagagugggggagggcggugggcagcucacauucaggcauucagggcuugaaaggaacggcuuagggagccugacacaggcccagcuccucccacucuucaggaggcugggauaccgaaccccagcucgcgcacagagccagcgggcagggcuuagggccagcugccugcauccggcucagccaccggccuuuuuguucccuu

SEQ ID NO: 10672 - RNA, 2501 nt, Mus musculus
aagggaacaaaaaggccgguggcugagccggaugcaggcagcuggcccuaagcccugcccgcuggcucugugcgcgagcugggguucgguaucccagccuccugaagagugggaggagcugggccugugucaggcucccuaagccguuccuuucaagcccugaaugccugaaugugagcugcccaccgcccucccccacucugcagccccacuccagcggcucggaaaaaaaaaaaaaaguuucaacaacaacaggcuggaccaauagcagcucgcaaagccggggaagggggccgagcaaagggcgccggagaguggagaaaggagaaagcgggcaagccuggagcgcgcggggccagggcucggcgagccggaggagcguugcuaauguuuuuguuuguuugcuuuucuaugcaugcauaaugagggggcgccgcggcaccacacgggggcucccggcccacuuuuguauuuaaagccucgcggcgagcuaguccgcagccgggcuccgcggauccgcuccccaagcuccgggucucggagcagagaaacgcuccgaguuucgggguccucccugcgccuggcgcccagaacuucccggagcgcggcccagaccgggguagagggggaggggaccaagcguccuggccgcgggaaggcgggaugccagagcugcgaagugcuacgcgccgcugagccgggaaccgaggagccgccggccgcacgacugucugcaggcgccuagcaccaugcacccccggcgccgcgcgcuccugcagcuucgccgcguccccccggaacggcacugagcgccuccaaccgucuaccggacccggaccugcgucgccgcgcuucucagggagccccggccgcggugccggagcgaacacccgccuuuaccagccgcggggccgccggcauggauggaugaggacgcccaugccagaagugcgcggaacucggacaaacuuuuccagcggccccgcggccgccacccgagccucgucuccgcuccgcaccgcguccggcggccgcugcugcccgcgaugcuagccgcgcugcugggcggcgccggggcccgcacggggaccuugccgggcgccuugcugugccugauggcgcugcugcagcugcugugcucggcaccgcggggcucggggcuagcgcacggccgccgccucaucugcuggcaggcgcugcugcagugucagggcgagcccgacugcagcuacgccuacagccaguacgccgaggcuugugcgccggugcuagcgcagcgcggcggggcugaugcuccggggcccgccggcgccuuccccgccucggccgcguccucgccgcgcuggcgcugcccgagccacugcaucucggcgcuuauccagcucaaccacacgcgccgcgggcccgcgcuggaggacugcgacugcgcgcaggacgaacacugcagguccaccaagcgcgccaucgagcccugucugccgcgcaccagcagcgugggcccgggcgcgggagcgggcucggucaugggcugcacugaggcccggcggcgcugcgaccgggacagccgcugcaaccuggcgcucagccgcuaccuggccuacugcggcaagcuuuucaacgggcugcgcugcacagacgagugccgcgcggucaucgaggacaugcuggccgugcccaaggcggcgcugcucaacgacugcgugugcgaugggcuggagcggcccaucugcgaaucggucaaagagaacauggcccgccugugcuucggcccagaugcgagcaacgguccgggcagcagcggcucggacgggggccuggacgacuacuacgacgaagaauaugacgacgagcagcgcgcuggggccgcgggcggcgagcaaccccuggacgacgacgacggccuugcgcgcccgggcggcggcgcugcugcggcgggcggccgcggagacuugccccacggucccgggcgcaggagcagcagcagcggcaguggaggccacugggcgaaucgaagcgccuggaccccguuugccuguuugcugcugcuguugcuccugcugcucgggucacacuuguagcuccugcgccccugcugcaggcugcuccaggccgguaugcacgacccagcugguucccgagcagggcaccuguggcucggagaccggagauggucgggaacacugacccacacucuuccuggguggacagggcccagcucguaccgcagccaacauguucggcccucuucugugcgguuuuccaggcugcagagauaaccggcugaucuauacugccagcucuaaucugcagaauucgggacacccugcaaaagcaaaggaggccuagacucagagugcugaacggugggggucuuucaaguuccaauggacuuggagaagggauguugagggaauuagguuugcaaaggggccggguuuuuauuugucuguuuguuuuguuuuuaaacuguuuuccggugagggaacacauaguacugguaa

SEQ ID NO: 10673 - RNA, 2501 nt, Mus musculus
guuuuucugacugagaacugccuaaaucuuacaauuuuuuucuuuuuguuuugagacaagauacucucuacauagauccuagaacucauuaaguacacaaggcugaccuugaauucacaaagauccuccaaaguacuagaauuaaaggcaugggcuaccacacccagccuuacaauuuuucuuguugaaaaucaccuaaauauucaacagagaacugccuaaaauguucauaaaacauuuaaaacuauaaacgcguuuaaauccauaaacauuuuuuauaguuuaacccuuuaaagccacacacccuuuggcuuacaaagcauuuaaaaucaaaugagauuuugaacacaucaauuggaggcuagcauucugcuaugaaguaccgugcagagcaaugcaaaaaucaaucguauaccauccugcauggguuugcaaagaauagauacauaugugugccaguggaggauauuucuggaaagauucacgagaacuuggcaacaucuguuacauuuagggggcacuucuuugucuuugccacaaaguuuucucaguauacucuguguaucuuuacaauuuagagcuauacgaaaauaaguuugccccauacaaaaaaaagagcagaaauaaugugcagauucaaccagcacgaagucucuggaaggaacccgggcaagggugucuccuccuucagggucacacaccgguagaccugggcagacacuagucaggggcuauaguuaaaacaaguccuucgucuuccuccuucaaacgcuaaaaaaaaaaacccuuuccucuccucucagcuuccuuuaaaaaccggucuuacuuucuaguugcccauuaaucuagaauauacuuucuacuaaauuuguuugucuaaacacuuccuaaauaaauaaaugucaccaaucgagagcccaccuagcaaaguccaaguucaagucuuggaaaccuuuucuaaaaaccccaccaagagguggacaccauccgccccagaaaacgcggcaccuuccuucaaccgcgcaggcagcuaugcagcugacaacgcuuuuccacguacaucaguacaacgaaggcaaagcucuggcuucucuaucaaccccagcaaaccgagcggcugccaaaacggauuucuuucgucuucaagaacugagacaccaagaaaaaaaaucacccucgaaagcggcuauucuacccgcuccggcuggcggggauuucucaaaagugacaccucugagcucuuagcacgcuuggugguucaaacgccaucaacgugacaccuuucuggaggcacgagagggagggcaaagaucccucaggaggccugagagggcgcgacagcguggggggcggggggggggugucggacggccgggggcucgggccggaucccacgcguugcuaaggcucagcgaggcuuugggcccucgggacagcaaagaccagcgggacucagcagaggcucggacucgcgugggaacaaccgcgccggcucaucccgcgaugagguggguucgagggcagagccgccccgcucccgaggccggacucacuugcaggagugaccccucggcccaucuccgguaaaguugcuaccgcgggcgcacgggcgacuagaggcucgaggaggcgcgagccucguggggguguggcggggcucacccgugauguccagguacaggucguccugcugcuccaggcggugcagcuccugcggcguggagcugcggcucuucuucacgccgggagaggaggacgagcugcggcgugagcaggggggcgcgguggcccaagccgagcgccgcucgcucuuacgcuucauggaggcggucgcggcccgucaggggaccgcgaccauggcccggcaacccggcccggguccucgcgcugcgucucccgccgcccgcgacccgggggccccacagcgcuggccgguggcuggagcaaagcgcgcgcucccugggacgcugcugccguggcguccgagcucagcgggccgcggcucccggggacccccaggagggauguuccguggagcuucauucacaaaaagaagggcccacaacccuccucggggccuaccggcucgggccgcucauuggucagugcggcgugacgucacgcaacuggagccuuccuacaggcagguacucggugacgccauaaagaaaagucugagcgcuuccgccaaucgggcagaaagcgugcuggcgacccccuuggugggaccccucuaacuuuugucucuuguguccagguguugacgccucaguccccaguuccucgagugagucuccgaguuccugcacaacccuacccuaauaacuccacuucggaucuuugagauggaauuuuuuucuuuuuuaaguguuucuugggucuccccuguaauucgcgccaagggagccuugucauggccgccugcuaggagaguguguaggcugcugaaacgguccucagcucuguggacgcaaggcagaguggaccucagaacuuagaag

SEQ ID NO: 10674 - RNA, 2501 nt, Mus musculus
cuucuaaguucugagguccacucugccuugcguccacagagcugaggaccguuucagcagccuacacacucuccuagcaggcggccaugacaaggcucccuuggcgcgaauuacaggggagacccaagaaacacuuaaaaaagaaaaaaauuccaucucaaagauccgaaguggaguuauuaggguaggguugugcaggaacucggagacucacucgaggaacuggggacugaggcgucaacaccuggacacaagagacaaaaguuagaggggucccaccaagggggucgccagcacgcuuucugcccgauuggcggaagcgcucagacuuuucuuuauggcgucaccgaguaccugccuguaggaaggcuccaguugcgugacgucacgccgcacugaccaaugagcggcccgagccgguaggccccgaggaggguugugggcccuucuuuuugugaaugaagcuccacggaacaucccuccuggggguccccgggagccgcggcccgcugagcucggacgccacggcagcagcgucccagggagcgcgcgcuuugcuccagccaccggccagcgcuguggggcccccgggucgcgggcggcgggagacgcagcgcgaggacccgggccggguugccgggccauggucgcgguccccugacgggccgcgaccgccuccaugaagcguaagagcgagcggcgcucggcuugggccaccgcgccccccugcucacgccgcagcucguccuccucucccggcgugaagaagagccgcagcuccacgccgcaggagcugcaccgccuggagcagcaggacgaccuguaccuggacaucacgggugagccccgccacacccccacgaggcucgcgccuccucgagccucuagucgcccgugcgcccgcgguagcaacuuuaccggagaugggccgaggggucacuccugcaagugaguccggccucgggagcggggcggcucugcccucgaacccaccucaucgcgggaugagccggcgcgguuguucccacgcgaguccgagccucugcugagucccgcuggucuuugcugucccgagggcccaaagccucgcugagccuuagcaacgcgugggauccggcccgagcccccggccguccgacaccccccccccgccccccacgcugucgcgcccucucaggccuccugagggaucuuugcccucccucucgugccuccagaaaggugucacguugauggcguuugaaccaccaagcgugcuaagagcucagaggugucacuuuugagaaauccccgccagccggagcggguagaauagccgcuuucgagggugauuuuuuuucuuggugucucaguucuugaagacgaaagaaauccguuuuggcagccgcucgguuugcugggguugauagagaagccagagcuuugccuucguuguacugauguacguggaaaagcguugucagcugcauagcugccugcgcgguugaaggaaggugccgcguuuucuggggcggaugguguccaccucuuggugggguuuuuagaaaagguuuccaagacuugaacuuggacuuugcuaggugggcucucgauuggugacauuuauuuauuuaggaaguguuuagacaaacaaauuuaguagaaaguauauucuagauuaaugggcaacuagaaaguaagaccgguuuuuaaaggaagcugagaggagaggaaaggguuuuuuuuuuuagcguuugaaggaggaagacgaaggacuuguuuuaacuauagccccugacuagugucugcccaggucuaccggugugugacccugaaggaggagacacccuugcccggguuccuuccagagacuucgugcugguugaaucugcacauuauuucugcucuuuuuuuuguauggggcaaacuuauuuucguauagcucuaaauuguaaagauacacagaguauacugagaaaacuuuguggcaaagacaaagaagugcccccuaaauguaacagauguugccaaguucucgugaaucuuuccagaaauauccuccacuggcacacauauguaucuauucuuugcaaacccaugcaggaugguauacgauugauuuuugcauugcucugcacgguacuucauagcagaaugcuagccuccaauugauguguucaaaaucucauuugauuuuaaaugcuuuguaagccaaaggguguguggcuuuaaaggguuaaacuauaaaaaauguuuauggauuuaaacgcguuuauaguuuuaaauguuuuaugaacauuuuaggcaguucucuguugaauauuuaggugauuuucaacaagaaaaauuguaaggcugggugugguagcccaugccuuuaauucuaguacuuuggaggaucuuugugaauucaaggucagccuuguguacuuaaugaguucuaggaucuauguagagaguaucuugucucaaaacaaaaagaaaaaaauuguaagauuuaggcaguucucagucagaaaaac

SEQ ID NO: 10675 - RNA, 2501 nt, Mus musculus
uggacagagacggaagggacuucacacuagccauucauuugugagccgugggggaggggacgcaaaagcgcagaggagguagaaaggggaaagagaagacagagaagauggagacugagaaagagacacaaagaugagggaacacagauagcgagucuccacuguggguguacuugaggcaguauugcccugcagccucgggggagauuucuuucccuuuccucgggaucccgagaacacguaggacaugcggaggcgaacguaguuggauccgagagcaaauaguuuaggcuaugacauuauuuucuuaccacuauuucuucugucuaaccccucugagcaguccacgcccauugacaccgagaacaaaccgagacaaccgggaugucccgggucugcaggcacuagagaagucucugcaaugcccacgccuacucagggcaguaggacuuucucagccagggcguccccggggaaacccggcacgcacucuccacaaccacuccaccagcccguaaaguugcucaacucaaguggagaaaugggagcggaugaagauacagaagggaacagaggacugcuguaauccaggcgagaagacugcaccaauugguccccaacucgagucuccacgccaccuuugucuggagaaucuauggguccugguuugcuaguaaagauugggggacaagccuucauuucguuuuccagagcgaggggggagauacugcacaccccuccaguucagggaaagcuuucccgcccaggagccucccagaccucuacgguguuccaacaaccccacccccauccaaugcgccuucccggcuggcucgggagcaccacgcgcaggacaaaagaacacaggggcaacgugagagagcuuugacagcccucaagucaucaaagaaaagcagccccaggacccuacccaaccccugccagauagccucccacauugccugagggguugggggaaagggucauguccgugcagguccugggccgcuaaaguauccugcugccuugucaggagcugcccagaggugacuuuccaggaaccaaagauacugaccacacacacggagccaggaaaccagguggucugcccuaaggugguuucaggggcuugcauuugggcaaguuuggggacucuccauucaaacuuuugccucgaccacuuuaaagagaacaaaaucaaggugugaggaguccauuccauuccuccaacucaagauagcaggacuuuucuaggauuucgcuacaaaaucccuucccccuauucgguuuguccuuuuccucuaccccaccccggacuucuuuugucuagcucuuuuucagcaccaaggucuaucugaauucaucucuuuaacaaguuaccuucauguuugaaagugcgcacauuuuucuaacuucgccuuacagcuaguccucuuggcuuuaauuaaagcccucuuccaauuacaaugugagucuuucccccuacuaagcuggacgguuuucuuuucccaacaaguuuucccucuuucuuuuaaaugggggaacaaaagaaaagugauuaccuugaaaggcggcuuacugcaguuuucgggguggaaauucacugcugagcugugagaaagggcuccgcguugccccggaagaucacauaggaagcgcgguggccuggggaagggugcagcgagugcgggacagagcuggagaggagagaggaugcgcugguagcggcagauccuugucccagcgcuuggccacagcaccuaaugcucacagcugcugcgcccgcgcuccuugaguucuucgcccagaaaggcucggggcagcucgccugcaaguucaaaugcggguugugacacccaccgucauuauaucacuguaccgucagagccgaggaggagacucagcgagaaggaggagggagaggaggaggaggguucauucacaggcuccugaagagcuccguagcucagucacuccaaagagcccaagcuuggaaacaggcggaggggcggaaaggagcucccucagccugcgguagggaccgccugccucccuggccaggcacucccaccucucagcguuucuuccugaugagaaguaccaaucggcuggggguggggggaauccgugcuccucauucaacgacucgguaccaccucgcugugcagucucaaacaacugccuucccacccauccccaccccacccccucuuccccgcccugggcugcuacuucugaauuaggggaaaggaguccccaggcucugcugcggccagcaagcacagagcaauuaaguauggucaguccuuaggagcggacgggacucuauaacaucagccaagaacuugcguauaauguguuuaaugcgaccacggagcuugcucgucccaucagaagaggugucaggcucaaugcuccugccaaccugaaagagauacugagaaagugagaucccaagccccagggagacgcaaaagcuuuucgugacugcucucccuagg

SEQ ID NO: 10676 - RNA, 2501 nt, Mus musculus
ccuagggagagcagucacgaaaagcuuuugcgucucccuggggcuugggaucucacuuucucaguaucucuuucagguuggcaggagcauugagccugacaccucuucugaugggacgagcaagcuccguggucgcauuaaacacauuauacgcaaguucuuggcugauguuauagagucccguccgcuccuaaggacugaccauacuuaauugcucugugcuugcuggccgcagcagagccuggggacuccuuuccccuaauucagaaguagcagcccagggcggggaagagggggugggguggggaugggugggaaggcaguuguuugagacugcacagcgaggugguaccgagucguugaaugaggagcacggauuccccccacccccagccgauugguacuucucaucaggaagaaacgcugagaggugggagugccuggccagggaggcaggcggucccuaccgcaggcugagggagcuccuuuccgccccuccgccuguuuccaagcuugggcucuuuggagugacugagcuacggagcucuucaggagccugugaaugaacccuccuccuccucucccuccuccuucucgcugagucuccuccucggcucugacgguacagugauauaaugacggugggugucacaacccgcauuugaacuugcaggcgagcugccccgagccuuucugggcgaagaacucaaggagcgcgggcgcagcagcugugagcauuaggugcuguggccaagcgcugggacaaggaucugccgcuaccagcgcauccucucuccucuccagcucugucccgcacucgcugcacccuuccccaggccaccgcgcuuccuaugugaucuuccggggcaacgcggagcccuuucucacagcucagcagugaauuuccaccccgaaaacugcaguaagccgccuuucaagguaaucacuuuucuuuuguucccccauuuaaaagaaagagggaaaacuuguugggaaaagaaaaccguccagcuuaguagggggaaagacucacauuguaauuggaagagggcuuuaauuaaagccaagaggacuagcuguaaggcgaaguuagaaaaaugugcgcacuuucaaacaugaagguaacuuguuaaagagaugaauucagauagaccuuggugcugaaaaagagcuagacaaaagaaguccggggugggguagaggaaaaggacaaaccgaauagggggaagggauuuuguagcgaaauccuagaaaaguccugcuaucuugaguuggaggaauggaauggacuccucacaccuugauuuuguucucuuuaaaguggucgaggcaaaaguuugaauggagaguccccaaacuugcccaaaugcaagccccugaaaccaccuuagggcagaccaccugguuuccuggcuccguguguguggucaguaucuuugguuccuggaaagucaccucugggcagcuccugacaaggcagcaggauacuuuagcggcccaggaccugcacggacaugacccuuucccccaaccccucaggcaaugugggaggcuaucuggcagggguuggguaggguccuggggcugcuuuucuuugaugacuugagggcugucaaagcucucucacguugccccuguguucuuuuguccugcgcguggugcucccgagccagccgggaaggcgcauuggaugggggugggguuguuggaacaccguagaggucugggaggcuccugggcgggaaagcuuucccugaacuggaggggugugcaguaucuccccccucgcucuggaaaacgaaaugaaggcuugucccccaaucuuuacuagcaaaccaggacccauagauucuccagacaaagguggcguggagacucgaguuggggaccaauuggugcagucuucucgccuggauuacagcaguccucuguucccuucuguaucuucauccgcucccauuucuccacuugaguugagcaacuuuacgggcugguggagugguuguggagagugcgugccggguuuccccggggacgcccuggcugagaaaguccuacugcccugaguaggcgugggcauugcagagacuucucuagugccugcagacccgggacaucccgguugucucgguuuguucucggugucaaugggcguggacugcucagagggguuagacagaagaaauagugguaagaaaauaaugucauagccuaaacuauuugcucucggauccaacuacguucgccuccgcauguccuacguguucucgggaucccgaggaaagggaaagaaaucucccccgaggcugcagggcaauacugccucaaguacacccacaguggagacucgcuaucuguguucccucaucuuugugucucuuucucagucuccaucuucucugucuucucuuuccccuuucuaccuccucugcgcuuuugcguccccucccccacggcucacaaaugaauggcuagugugaagucccuuccgucucugucca

SEQ ID NO: 10677 - RNA, 2501 nt, Mus musculus
ggagccgcuguaguguccuaagaaccuguagguagaguuuaaacaaaggccggagcaguaaguguugcaaugucugucagggggaaaaaggccaacuacuaaaccaaccaagcaacaaaaaacagaagccaagcucucuaaaacauuuccacagcaaaggcucugcccucuccggagagcaugcaaucccuucuaaagcucccuccucugccaaggucuucugaugaugaccauuguccugcauucuagaaacaccugucucugccccaugcguuuuggagcuagggcagcgcuccuguucugcuccgagagaggcuggcguacucuacucccucacccuccucgcccuccucgcccuccucgcgacaguccccggcugacucguaggacccugaccucucaccuccuaagcaccuggcagcgggcgcgggcagcgcccuuuggagcgggggcgggccccaggggaucgggauggccugcugcuggcgucugggguucucucagccaggacgauggagucgaugguggcgccgggugaggugcucaugagccaggccauccagccggcucaugccgacucccgcggcgagcugagcgcagggcagcugcucaaguggauggacaccaccgcuugccuggcggguaggugccggcccacgcgagggcaccgucggucggggagggcugcugcugguggccagggaggugauacuguccggggauccugaaggacuggagugucugaaauuagggaugcgcuaggcuggcguggaagccagagagagcgugggaaaaggaaggaagcaaaguaaagggcaguguucccagagcugagagcagccgcagacaggaaugacuaagauagcugcugacagcgaccuagacuagugguucucacauguuuauuuggcuggauuccuuucaacucacaaaacaaagugaagacauccucuccccgccuccacgcaaagacuuugcuauauagauugcguauaucuguacuuaaccauauuuaaaauucuaaagauagaguuuauugacuaaguagaacugaggcuggaaaaaguguucacacugcaagcaugaaaccccaauucacuuuguagucucauaggcgcgcgcgcgcgcgcgcgcacacacacacacacacacacacacacaaaugugcacauguuacuauauuuucuuaacaaacaacuacauuauuuacugcaacagcaaaaguguucuugcacaacuggucagaauucaugcuuuucaugauuuaaaagcuugauugcuccuuugccagguucucuucuguguucaguuuacuaccauuuacuguuaggcaggcaggggaaacuugauauuccugagagagaaugggaguaagaaggccugcugguauaauccaguugcgaagggcuugccuagcuugcuugaggccggugugauuuccaucccagcacuaagcguugggggugguggcacaaaaucaucuaauaaggacugaaugaugucucucuccaugccaucucugaaguuuguauuuugaaagugacagcaaguaccgugguguggcugugucguauaaucgaggauuaaagagaugagaagaacacaaccucaucucagggcacuaagucuuuuagaucuuagaagcacgugacacgugaggccgcagcaagagccggccugcaaaccaggaagagaguuuucaccagucugguggaccugacagccuucagaacucugagaaaccgaaugucuauuguccaagccacccaguccauaaugcugugcuauggccaccccagaaaaggcagcugcucagcauuguuaugauuuaugaucugacugugaccgacuuacgccuaaagauaaaagaaaggccugcuuuuaaaaccaguguguuguaauauaaauggcuuucuaacuaaaagccuagguugagcaguacaugaauuuccugugcccaugcugacuucucucaucuuuggaccagugauagucuuggauacaagcaagccuugccacgcucccuucagaagaaagucuuuugguguccuagugcuaucucgauucccugggaucucuuaucuaugcacagugaacuuucaauacaugaaucauaucucugauucccacucaggaccucucuguaucuucccaucaucccugagguaaaacccaaaguccccccauuuuucacagaugcucuuguaguggagaacucauucucugaggagccacauagauagacaugaguugauucagagccuagcuuaggacaguagacugauuggcuauaggauguuccaccagaggccauuaauacuaagaauaaguacagcauugugucucacauacaaauaaucuccaugguaacugccuccccgccagacugucugguugcggcauuggcagccuucugggguuuuucuaguguuugccaagcuuuucuccauaagaaacuuuguaccugcuguuccuucuuugcccauucccaugccuugcuc

SEQ ID NO: 10678 - RNA, 2501 nt, Mus musculus
gagcaaggcaugggaaugggcaaagaaggaacagcagguacaaaguuucuuauggagaaaagcuuggcaaacacuagaaaaaccccagaaggcugccaaugccgcaaccagacagucuggcggggaggcaguuaccauggagauuauuuguaugugagacacaaugcuguacuuauucuuaguauuaauggccucugguggaacauccuauagccaaucagucuacuguccuaagcuaggcucugaaucaacucaugucuaucuauguggcuccucagagaaugaguucuccacuacaagagcaucugugaaaaauggggggacuuuggguuuuaccucagggaugaugggaagauacagagagguccugagugggaaucagagauaugauucauguauugaaaguucacugugcauagauaagagaucccagggaaucgagauagcacuaggacaccaaaagacuuucuucugaagggagcguggcaaggcuugcuuguauccaagacuaucacugguccaaagaugagagaagucagcaugggcacaggaaauucauguacugcucaaccuaggcuuuuaguuagaaagccauuuauauuacaacacacugguuuuaaaagcaggccuuucuuuuaucuuuaggcguaagucggucacagucagaucauaaaucauaacaaugcugagcagcugccuuuucugggguggccauagcacagcauuauggacuggguggcuuggacaauagacauucgguuucucagaguucugaaggcugucagguccaccagacuggugaaaacucucuuccugguuugcaggccggcucuugcugcggccucacgugucacgugcuucuaagaucuaaaagacuuagugcccugagaugagguuguguucuucucaucucuuuaauccucgauuauacgacacagccacaccacgguacuugcugucacuuucaaaauacaaacuucagagauggcauggagagagacaucauucaguccuuauuagaugauuuugugccaccacccccaacgcuuagugcugggauggaaaucacaccggccucaagcaagcuaggcaagcccuucgcaacuggauuauaccagcaggccuucuuacucccauucucucucaggaauaucaaguuuccccugccugccuaacaguaaaugguaguaaacugaacacagaagagaaccuggcaaaggagcaaucaagcuuuuaaaucaugaaaagcaugaauucugaccaguugugcaagaacacuuuugcuguugcaguaaauaauguaguuguuuguuaagaaaauauaguaacaugugcacauuugugugugugugugugugugugugugugcgcgcgcgcgcgcgcgcgccuaugagacuacaaagugaauugggguuucaugcuugcagugugaacacuuuuuccagccucaguucuacuuagucaauaaacucuaucuuuagaauuuuaaauaugguuaaguacagauauacgcaaucuauauagcaaagucuuugcguggaggcggggagaggaugucuucacuuuguuuugugaguugaaaggaauccagccaaauaaacaugugagaaccacuagucuaggucgcugucagcagcuaucuuagucauuccugucugcggcugcucucagcucugggaacacugcccuuuacuuugcuuccuuccuuuucccacgcucucucuggcuuccacgccagccuagcgcaucccuaauuucagacacuccaguccuucaggauccccggacaguaucaccucccuggccaccagcagcagcccuccccgaccgacggugcccucgcgugggccggcaccuacccgccaggcaagcggugguguccauccacuugagcagcugcccugcgcucagcucgccgcgggagucggcaugagccggcuggauggccuggcucaugagcaccucacccggcgccaccaucgacuccaucguccuggcugagagaaccccagacgccagcagcaggccaucccgauccccuggggcccgcccccgcuccaaagggcgcugcccgcgcccgcugccaggugcuuaggaggugagaggucaggguccuacgagucagccggggacugucgcgaggagggcgaggagggcgaggagggugagggaguagaguacgccagccucucucggagcagaacaggagcgcugcccuagcuccaaaacgcauggggcagagacagguguuucuagaaugcaggacaauggucaucaucagaagaccuuggcagaggagggagcuuuagaagggauugcaugcucuccggagagggcagagccuuugcuguggaaauguuuuagagagcuuggcuucuguuuuuuguugcuugguugguuuaguaguuggccuuuuucccccugacagacauugcaacacuuacugcuccggccuuuguuuaaacucuaccuacagguucuuaggacacuacagcggcucc

SEQ ID NO: 10679 - RNA, 2501 nt, Mus musculus
gcaaguauguugcccaggcuggccuugaauucucaccuccuucaauacauaugaaaagcugaaacuaucucguuuacauaauuuccuuuuuucuucaugucucuguggaguuuaauaccucaaauuuauuuugcgaaauuuuguuagcuauuccauuaagccuuaauuagaguauaaugaaauuauaaauucauaaaauaaaaacaaaacgguugcuccuacaaacguucaguucuuuagugaggcucuggcuuuaccugaagugggggaaggaaccugugaaggcugaaucucagaccaacgagauggcuaugggauggaagggaacguggacgcagacccggaccaagggcacggggacuaguggggaggggcgucaucuuucuugggcuaccugggcucugcccauucgcucucccaccagucgcagcugucaaagcucaguggccuggaguggagacggggcggggcuuaggagcggaggcggagccucggagagcaucuucuggccccggggcccggacuggcccgccgcccccaccugcagcgcggcggagcgcgggcgcgucacucccagcggaagcgccagccccgcgucuggcgaggugcgcgccucgccgcucccgcuccagcgcuucguggcccgccugugucugcagggcaggggcgggggcccggugacacggacaggggacugagaucgcagucgccgccgaaucgucgacagucacccagcucggacggagcguccgagcaggagccgaucaggaaggugaaggaccacugccgagccgacagcgcgucccaggucaguccgcccgcugcacuuggggaaacuuugggaugcggugacagcugcgagacugaggcaccgagggucgcgaggccguguggccgcggugcgccccgcgaacaggcaccugccgcacauuugacaccgcagcugccaguguggggacggagacccugcuaccgcggaccacuacgggccaccgagggccagcgggcuucaggggccucccgggagacuccggcucgcccgcgccccgccgcgcgccuccggguucccgcaaguccccagcuccgguuggcggcucgcgcucggaccccgcgggucugcggauuccgccgccuucgggccucgcgacgcgggaggagcggcccggggcccagggcugcggggugggagccccguggcgggagcggcgcgcacucggccaguggagcgcgcgggucgcgggguccggcaggagcgcguggccgcaggugcccguggccgcugggcagcggagguacggagcgcgggcuggggccgcggagccgauugcaaccucgggcugcaggaaccggggucgccggguaggcaguccggucccugcggcucccgggugcgcacauccuuggcaccgggcauccagaccccuucagcggagagcgggcugaggaacggcgccagcccgggcggaggaccagugcugccugcucucuggcacgccaucuccccagcgagggccgagugcuaggcuacgcggggaccacugcccagggccucccggcacaagccuuuuucuugggcagcugccugcccuggcuuggaguggaggcgacgaaaugagcaccccgcccccauccgcgccccagcgcugucgccccagucaccuuccuuugcccuucuccgacagcaccuuggacuugcucucuccugaacuggggaaaaucugaggaaaccaggcacggaccuuggagacacgccgccugcacacucaacagucuggaaauccagccaccuugguaccucgccgcuucccagacacuuuggaggagcagguuugcaauuucuacccccauccucauccccucccccgucucugucucugcugagggagggaaucuucugaagagaagaugggaucuaggcacccauaaccuagccccaggaggagcucaugggagccagccuagcuuuguagcuaugugagggaaacagcacaccuuauaaacuaacuccuucccgugggcaguuccugaauauuucuuagaagacuggagacccaagaaagcugacuuuuccugggcagucagugcaucuuuuauuuggcuccgacucucugcuugcugggaacagacacauuuugcuuaugaccucuggcuggccucauuccaguugcugucuggcuuuggacugcuugcccaucaggacagugauuuugaagagcugacugggaagagaaagcugcaagccucaaguucugguuggcuccugcucaggguuguagucuuccgugggacccgugggcucccuauuccucuggacuguggcagcaacucugcccuucaccucugcaaggaaauuaauuuucaaacaacuuggggaugaugguggaggcaccccugugugagcagaugcagggcuuggaagcaaccaggaaacaaacaggaguaagaaauccuuuuuaaaggcuuacaugauucugggacuaagaaaagauggagaugccauu

SEQ ID NO: 10680 - RNA, 2501 nt, Mus musculus
aauggcaucuccaucuuuucuuagucccagaaucauguaagccuuuaaaaaggauuucuuacuccuguuuguuuccugguugcuuccaagcccugcaucugcucacacaggggugccuccaccaucauccccaaguuguuugaaaauuaauuuccuugcagaggugaagggcagaguugcugccacaguccagaggaauagggagcccacgggucccacggaagacuacaacccugagcaggagccaaccagaacuugaggcuugcagcuuucucuucccagucagcucuucaaaaucacuguccugaugggcaagcaguccaaagccagacagcaacuggaaugaggccagccagaggucauaagcaaaaugugucuguucccagcaagcagagagucggagccaaauaaaagaugcacugacugcccaggaaaagucagcuuucuugggucuccagucuucuaagaaauauucaggaacugcccacgggaaggaguuaguuuauaaggugugcuguuucccucacauagcuacaaagcuaggcuggcucccaugagcuccuccuggggcuagguuaugggugccuagaucccaucuucucuucagaagauucccucccucagcagagacagagacgggggaggggaugaggauggggguagaaauugcaaaccugcuccuccaaagugucugggaagcggcgagguaccaagguggcuggauuuccagacuguugagugugcaggcggcgugucuccaagguccgugccugguuuccucagauuuuccccaguucaggagagagcaaguccaaggugcugucggagaagggcaaaggaaggugacuggggcgacagcgcuggggcgcggaugggggcggggugcucauuucgucgccuccacuccaagccagggcaggcagcugcccaagaaaaaggcuugugccgggaggcccugggcagugguccccgcguagccuagcacucggcccucgcuggggagauggcgugccagagagcaggcagcacugguccuccgcccgggcuggcgccguuccucagcccgcucuccgcugaaggggucuggaugcccggugccaaggaugugcgcacccgggagccgcagggaccggacugccuacccggcgaccccgguuccugcagcccgagguugcaaucggcuccgcggccccagcccgcgcuccguaccuccgcugcccagcggccacgggcaccugcggccacgcgcuccugccggaccccgcgacccgcgcgcuccacuggccgagugcgcgccgcucccgccacggggcucccaccccgcagcccugggccccgggccgcuccucccgcgucgcgaggcccgaaggcggcggaauccgcagacccgcgggguccgagcgcgagccgccaaccggagcuggggacuugcgggaacccggaggcgcgcggcggggcgcgggcgagccggagucucccgggaggccccugaagcccgcuggcccucgguggcccguagugguccgcgguagcagggucuccguccccacacuggcagcugcggugucaaaugugcggcaggugccuguucgcggggcgcaccgcggccacacggccucgcgacccucggugccucagucucgcagcugucaccgcaucccaaaguuuccccaagugcagcgggcggacugaccugggacgcgcugucggcucggcagugguccuucaccuuccugaucggcuccugcucggacgcuccguccgagcugggugacugucgacgauucggcggcgacugcgaucucaguccccuguccgugucaccgggcccccgccccugcccugcagacacaggcgggccacgaagcgcuggagcgggagcggcgaggcgcgcaccucgccagacgcggggcuggcgcuuccgcugggagugacgcgcccgcgcuccgccgcgcugcaggugggggcggcgggccaguccgggccccggggccagaagaugcucuccgaggcuccgccuccgcuccuaagccccgccccgucuccacuccaggccacugagcuuugacagcugcgacuggugggagagcgaaugggcagagcccagguagcccaagaaagaugacgccccuccccacuaguccccgugcccuugguccgggucugcguccacguucccuuccaucccauagccaucucguuggucugagauucagccuucacagguuccuucccccacuucagguaaagccagagccucacuaaagaacugaacguuuguaggagcaaccguuuuguuuuuauuuuaugaauuuauaauuucauuauacucuaauuaaggcuuaauggaauagcuaacaaaauuucgcaaaauaaauuugagguauuaaacuccacagagacaugaagaaaaaaggaaauuauguaaacgagauaguuucagcuuuucauauguauugaaggaggugagaauucaaggccagccugggcaacauacuugc

SEQ ID NO: 10681 - RNA, 2501 nt, Mus musculus
gguccaguguccccuagcuggcacgagcaggggcagcgggggcgcgggugcggugggaugugugugggcuggggguggcgacucucaggucaugcagaggucauguccugcuuuggugucugaacugcccccguuccagggacacccuagcucugauacacagagccugugaagcgagcaaggcaggacaaggaaaggggagaugugcccggagaaaaucucugggaagaacugaccgaggcucggcccagaggcccagggcgaggccaagguggccgcugcugcuuuagcggcugcuggaggcuggagcugccugggcugcggccgccgccuccucccggcaggcgcaggcgggcgggcgggcggagugggggacucuccgggcgcugacauuugcaggcugcccuccugauugguccccucgccgagcugcucacggguucauucaucuguuaagcaccuccccgucucucuaaaggacauuauaaugcaagaagcccccuuuuuaaccacaaaccgaauuuucuuucauuuaggugaucuauauauaucuauaucguauagcuuauagcuuauaucuauuuuaaauaacuuaaagccgcuaaaauuugggggggaacagcuuucgcccuggagcggugcgcgaugcugucucacgccgaccuccuggacgccaggcuaggugagugagcgccucucacccgggcagccaggagaagccggggcaggaaauugucaauuuguuccuuauuuuaccuuaaugcgcccuaaauggacuaauuucuuuaaaaguaauugugcuguauuaaaguuuaauuugauuuaacaucgucuuaaaaaaaaucuauggaauauguagauuccaaaacaaaacggaguuggggaugcugacaccuuuuuguuuuucuuauuuuuuucuuucucucuccccuucauuauuaauauuauuauuuuuggaaggaguucuagcccgcgauaauuuguuuggagguguuucucucuuuuuccacucuuguuugcuuugauuuggaauuucuuucaucccuuuuuccccuucuuccuuucuaucaucaccuucuccucuaagugugcuuaaauuuguuuucuuuuuuuaaaaaaaaaucuucuccuuugugaaggagaagccgcuguaugaagguggauuugcuaagugugcugguugagaagaaaagcccaacucauccucucgggcaucccugccuucuacaagggacucgguguuaccagugacggggagggacgagccguuuauuucucgggagagaaaaguugaauucucuaaaguuugauucacuguuauggcuauagaguuuacuuaaauuucuuugaagcuaucuggguuaccaaguucugggcuucaggcuuggggagcuuuagugauggaugugacuccguuucccaaacacuuucucugauuugagggggaggcggagcugauuugggcuuauuuugagagguggaaggcuuggagacauauucaucuuccgaaagucagagggaauuggccagaguucauuuagcgccuuugcucaggaggagcagccuccaaaggcucucucuugauuucuuuuucucccgcaccacccgacuaagaauuuucucaagguuuccugggacaccaggguuacaguuagugaaaggacucggguguguuucauugucaggccugggagugguuuuuuuguuuuuguuuuuguuuuguuuuuuguuuuguuuugugggagacacgaaggccggagcugugaagcaccagagcgggcuguggagagaaggaggccaggagaugcuauuucaaccuagcuguccaauuccugggaaaccgggcugaggaccaggcaguuuccgccucggggcaagcgugggcgcagagggagcgguggauggggcugaagcagaaccucucagggaagucaccggcuccucacgucgccaggacaguacugaucgagaucccuuucccuccucagguaugaaagaugccgccgagcuucugggccaccgggaggcggugaaguguaggcuggguguggggggcucugacccugggggucauccaggggaccuggcacccaacucggacccggucgaaggagccacucugcugccgggcgaggacaucaccaccgugggcucuaccccugcuucgcuggcggugagcgccaaagacccagacaagcagccggggccccagggcggccccaaccccagccaagccggccaacagcagggccaacagaaacagaagcgccaccggacacgcuucaccccagcacagcucaacgaauuggagaggagcuucgccaagacucacuaccccgacaucuucaugcgugaggagcuagcgcugcguaucgggcugaccgagucgcgggugcagguaaggcgggcuugggcucaggggaggaaggcaaggagggaaggggaggauuagagcacggaguagguauugugcucugcugggaucccgagcugcgcgcuug

SEQ ID NO: 10682 - RNA, 2501 nt, Mus musculus
caagcgcgcagcucgggaucccagcagagcacaauaccuacuccgugcucuaauccuccccuucccuccuugccuuccuccccugagcccaagcccgccuuaccugcacccgcgacucggucagcccgauacgcagcgcuagcuccucacgcaugaagaugucgggguagugagucuuggcgaagcuccucuccaauucguugagcugugcuggggugaagcguguccgguggcgcuucuguuucuguuggcccugcuguuggccggcuuggcugggguuggggccgcccuggggccccggcugcuugucugggucuuuggcgcucaccgccagcgaagcagggguagagcccacgguggugauguccucgcccggcagcagaguggcuccuucgaccggguccgaguugggugccagguccccuggaugacccccagggucagagccccccacacccagccuacacuucaccgccucccgguggcccagaagcucggcggcaucuuucauaccugaggagggaaagggaucucgaucaguacuguccuggcgacgugaggagccggugacuucccugagagguucugcuucagccccauccaccgcucccucugcgcccacgcuugccccgaggcggaaacugccugguccucagcccgguuucccaggaauuggacagcuagguugaaauagcaucuccuggccuccuucucuccacagcccgcucuggugcuucacagcuccggccuucgugucucccacaaaacaaaacaaaaaacaaaacaaaaacaaaaacaaaaaaaccacucccaggccugacaaugaaacacacccgaguccuuucacuaacuguaacccuggugucccaggaaaccuugagaaaauucuuagucggguggugcgggagaaaaagaaaucaagagagagccuuuggaggcugcuccuccugagcaaaggcgcuaaaugaacucuggccaauucccucugacuuucggaagaugaauaugucuccaagccuuccaccucucaaaauaagcccaaaucagcuccgccucccccucaaaucagagaaaguguuugggaaacggagucacauccaucacuaaagcuccccaagccugaagcccagaacuugguaacccagauagcuucaaagaaauuuaaguaaacucuauagccauaacagugaaucaaacuuuagagaauucaacuuuucucucccgagaaauaaacggcucgucccuccccgucacugguaacaccgagucccuuguagaaggcagggaugcccgagaggaugaguugggcuuuucuucucaaccagcacacuuagcaaauccaccuucauacagcggcuucuccuucacaaaggagaagauuuuuuuuuaaaaaaagaaaacaaauuuaagcacacuuagaggagaaggugaugauagaaaggaagaaggggaaaaagggaugaaagaaauuccaaaucaaagcaaacaagaguggaaaaagagagaaacaccuccaaacaaauuaucgcgggcuagaacuccuuccaaaaauaauaauauuaauaaugaaggggagagagaaagaaaaaaauaagaaaaacaaaaaggugucagcauccccaacuccguuuuguuuuggaaucuacauauuccauagauuuuuuuuaagacgauguuaaaucaaauuaaacuuuaauacagcacaauuacuuuuaaagaaauuaguccauuuagggcgcauuaagguaaaauaaggaacaaauugacaauuuccugccccggcuucuccuggcugcccgggugagaggcgcucacucaccuagccuggcguccaggaggucggcgugagacagcaucgcgcaccgcuccagggcgaaagcuguucccccccaaauuuuagcggcuuuaaguuauuuaaaauagauauaagcuauaagcuauacgauauagauauauauagaucaccuaaaugaaagaaaauucgguuugugguuaaaaagggggcuucuugcauuauaauguccuuuagagagacggggaggugcuuaacagaugaaugaacccgugagcagcucggcgaggggaccaaucaggagggcagccugcaaaugucagcgcccggagagucccccacuccgcccgcccgcccgccugcgccugccgggaggaggcggcggccgcagcccaggcagcuccagccuccagcagccgcuaaagcagcagcggccaccuuggccucgcccugggccucugggccgagccucggucaguucuucccagagauuuucuccgggcacaucuccccuuuccuuguccugccuugcucgcuucacaggcucuguguaucagagcuagggugucccuggaacgggggcaguucagacaccaaagcaggacaugaccucugcaugaccugagagucgccacccccagcccacacacaucccaccgcacccgcgcccccgcugccccugcucgugccagcuaggggacacuggacc

SEQ ID NO: 10683 - RNA, 2501 nt, Mus musculus
ucagccaaagucugugcuugcuacauucccagauaggaggaggaaagucaacagcagaggcauuccuucuaacuucuuagaaaagcagaauaaacgacccugucccaaacuacaagacacaaguaccucagggaauaaaacaaaaacaaaagaaaacaaauaaacaaagccaaggugcuccaaaauucaauagccaagaaagacuaaaaaacaaaaauacaaguuugcuuggggguugggaguacacagcucagcuuuaagguccuuagagcugagcccuaaauuguauuccccaauguguaaaacuguucaauguguaaaugauacuuagucauuucuauuuuaaagguggaagugguacaaugggcugguuugauaauugccucggcucgcuauaguaguuauuuucucugaaauucucuacaguuaacuacuccuugugaguuugcuuaaguuuucuguauccugccuucuguagauuuuugaagcuuugcugagauuccaaccuuagccuaccccccccccuuccccaaccuuuaaaauagaguucugguaggauuuaccuuucacaaagaugcucauacuuucuaaguugccuggaagcugcuggaauguggacugugcccacucccuacuuaagucuaucuggccaaccucgccauuccauugccuaacaaagaaagcacuaacaacuaagauaaauccaaacgaaaaaagaaaagaaaaccaccaacaguggaaauuuaagauuuauacauacggcgcaaaggaacuacaguuauacucagggauauguaguugaacaacgcacgaaccacugaaagcgucaccagaaagcgcauuacugagaggcauuccucuuuuccggugaucccaacaacacaccuguuguauaugaaagccacgcauugcuaaccugccuggaaagcugccuucuccccgccccagguaauuccccuaguggcaguuugcccggugagccccgggcaggcccgaggauaccuccgcucccgcuggaaccccgguuacuccaccugggucgaaaggggcucagaguuguuccagcgccaagaugcagaggccauuuugguccccacccauuuguccccgcauacuuccucugaugcaaggccacucgccgcuagacucgcggggccgacuuugcccaggaggucugcaaaguggaccgccuauacaggcugcggguccccgagaccgugcgccccaccgcagcuuugcgcucgggagccgccaggccagagcagggcagcagagcaggcccugccccggggcagguccccggcccgcggucacggaugagaauccaccgcgugagcagcuucccucgaaauccagccucacucgaaaagaacaccaaaagcugaaaucaacaaggacgcacgcaccgcccccuguuccaaacagccagaauaauacacuccacgacucuggggacgcugcagaggacccccggccucccuccugggaugaauuacccaaaagagcggaaaccagaagggccacagggaucuuuaucgcccugcgucgcccagcaccagcccuaacuagagaccccgaguaacccacagaucuccagcgcccaguugagcgcuggauccgcccccgacgcucccgccucggcaaaaguagaaaguagcucgggcauuucugguggacaagguuucgcccgcgacuccgagagagaaagggagccccccagauccucccgcgcugcgcucaggcacacgcgcuucucugguuuccgugagagccgaguccagggcgaaacugccaccgaaacuggcuccgcgugcccuccccgcgccucgccucccagccccggcgcgucacccugggggaccccgggcaccgcaccugccucgcacccaccuuggcggccggaaucccaaggugcucaccuggccggugcaccugccgccgcccgcgcugccaauccacaguucaacugagccaggaggaccguccuccgcuucccccacccccuacccccgggcaugcgcaccaauuucuggccgaacccgcccggggcugugcgcugggacccaccugccgagccccuagccgguugcuccgugcgcuggaccgcucucccgcaacuccaccgcugucgccuaaggaaagaggggccgggaggugggcacuagcgacgagguguggcguggccagccuccucccucggugacccauucaccugaaacuccgaugggagggggagggagcgacggagaaggaggcgggaggaccgggcagggcucaccacccagagcaagccgaguuaaaggaacagcaccgacguugccuggagaggggcgggggcgugcggagagaagggucucaagaucguggaggcaauggggugauccuagaccauuuugggugugcucggagauacgccugcuucagggccccugugggguguugguuccgggaggagagucagaggucaggagggagcuguugugcugcuacucagagagggu

SEQ ID NO: 10684 - RNA, 2501 nt, Mus musculus
acccucucugaguagcagcacaacagcucccuccugaccucugacucuccucccggaaccaacaccccacaggggcccugaagcaggcguaucuccgagcacacccaaaauggucuaggaucaccccauugccuccacgaucuugagacccuucucuccgcacgcccccgccccucuccaggcaacgucggugcuguuccuuuaacucggcuugcucuggguggugagcccugcccgguccucccgccuccuucuccgucgcucccucccccucccaucggaguuucaggugaaugggucaccgagggaggaggcuggccacgccacaccucgucgcuagugcccaccucccggccccucuuuccuuaggcgacagcgguggaguugcgggagagcgguccagcgcacggagcaaccggcuaggggcucggcaggugggucccagcgcacagccccgggcggguucggccagaaauuggugcgcaugcccggggguagggggugggggaagcggaggacgguccuccuggcucaguugaacuguggauuggcagcgcgggcggcggcaggugcaccggccaggugagcaccuugggauuccggccgccaaggugggugcgaggcaggugcggugcccggggucccccagggugacgcgccggggcugggaggcgaggcgcggggagggcacgcggagccaguuucgguggcaguuucgcccuggacucggcucucacggaaaccagagaagcgcgugugccugagcgcagcgcgggaggaucuggggggcucccuuucucucucggagucgcgggcgaaaccuuguccaccagaaaugcccgagcuacuuucuacuuuugccgaggcgggagcgucgggggcggauccagcgcucaacugggcgcuggagaucuguggguuacucggggucucuaguuagggcuggugcugggcgacgcagggcgauaaagaucccuguggcccuucugguuuccgcucuuuuggguaauucaucccaggagggaggccggggguccucugcagcguccccagagucguggaguguauuauucuggcuguuuggaacagggggcggugcgugcguccuuguugauuucagcuuuugguguucuuuucgagugaggcuggauuucgagggaagcugcucacgcgguggauucucauccgugaccgcgggccggggaccugccccggggcagggccugcucugcugcccugcucuggccuggcggcucccgagcgcaaagcugcgguggggcgcacggucucggggacccgcagccuguauaggcgguccacuuugcagaccuccugggcaaagucggccccgcgagucuagcggcgaguggccuugcaucagaggaaguaugcggggacaaauggguggggaccaaaauggccucugcaucuuggcgcuggaacaacucugagccccuuucgacccagguggaguaaccgggguuccagcgggagcggagguauccucgggccugcccggggcucaccgggcaaacugccacuaggggaauuaccuggggcggggagaaggcagcuuuccaggcagguuagcaaugcguggcuuucauauacaacagguguguuguugggaucaccggaaaagaggaaugccucucaguaaugcgcuuucuggugacgcuuucagugguucgugcguuguucaacuacauaucccugaguauaacuguaguuccuuugcgccguauguauaaaucuuaaauuuccacuguuggugguuuucuuuucuuuuuucguuuggauuuaucuuaguuguuagugcuuucuuuguuaggcaauggaauggcgagguuggccagauagacuuaaguagggagugggcacaguccacauuccagcagcuuccaggcaacuuagaaaguaugagcaucuuugugaaagguaaauccuaccagaacucuauuuuaaagguuggggaagggggggggguaggcuaagguuggaaucucagcaaagcuucaaaaaucuacagaaggcaggauacagaaaacuuaagcaaacucacaaggaguaguuaacuguagagaauuucagagaaaauaacuacuauagcgagccgaggcaauuaucaaaccagcccauuguaccacuuccaccuuuaaaauagaaaugacuaaguaucauuuacacauugaacaguuuuacacauuggggaauacaauuuagggcucagcucuaaggaccuuaaagcugagcuguguacucccaacccccaagcaaacuuguauuuuuguuuuuuagucuuucuuggcuauugaauuuuggagcaccuuggcuuuguuuauuuguuuucuuuuguuuuuguuuuauucccugagguacuugugucuuguaguuugggacagggucguuuauucugcuuuucuaagaaguuagaaggaaugccucugcuguugacuuuccuccuccuaucugggaauguagcaagcacagacuuuggcuga

SEQ ID NO: 10685 - RNA, 2501 nt, Mus musculus
gacccggauugugccugguucccuagcugcucuggcucugccuggugcccgguuccgcaaggccggccacugagccucccgccugcgguggcggcggagguccccaagcgcuccgggucuccgggugccaccccgcggggcucgcuggaugacaggguguggggcugcacacagucaggagggcggugccaacccugcggcucccccgggcugcuaccccgcauccccgcuccuccaggacccagacagggcguccgcccuuggguuucuguuucccacguccaaagucagggcacgcgacgaacugggggcacuuggcguaccgccgccuucaggccaggucgaagcccacgacauccaggcggccaccccgcaccuauccacagcgcggacuccggggccgguggguggagcgcucgccgugacgucacgaggccccgccccagccagccggcgcguauuuaaagcuucgcugcucgcucuugcucgcacaagcgaagcaggacgucagacuagagaguagggagagagacuggugcucgagggacagggcuagcccggacgcuuguccgcgccucggagguggcaaguaggcagugucggguggcgaggcaacgauggagcuccugcggacuaucaccuaccagccggccgccggcaccaagaugugcgagcaggcucugggcaaagcuugcggcggggacucaaagaagaagcgaccgcagcagccuucugaagaugggcagccccaagcccaggugaccccggcggccccgcaccaccaucaccaccauucccacucgggacccgagaucucgcggauuauagucgaccccacgacggggaagcgcuacugccggggcaaagugcugggcaaggugaggagcggcggacgucaggcugccgggcgggagggcgggcugcccgggcaagcugagcgagcagggacccagcgcccgcacuucucgcuccuucagcugucugguuccccgaacgaucgacguggguuccucuccugcccuccugggcuucugugcgccgacagcgcugggguucggauuugcauccuuagccuguuuuucucccgagucuaagaaggaggacugaaggcauucuaccuuggccuugggcucucacuaucugauccccagggagcuagccugucaaauuucuucagagggcauuuuccucccuuucccccuuccacucccuucuccauagaguucuuuguaaaggggaaacgagaaaacuggacugguuucuaggaaugugcugcccuuccugaaaaaccauuauacaaagcagauuguacugcucugcccacccucuguuccucaaauuuugcuucccguucccauuuacguauucauuuauuuuaaacguuggcccuucauuuuuuuuuuuuuuccuuuuuucuguccugcucaauuccaucucggcuuuguuuccucgcaggguggauuugcaaaguguuacgaaaugacagaucugacaaacaacaaagucuacgcugcaaaaauuauuccucacagcagaguagcuaaaccucaucagagggaaaagguggguaugacugucgacuaaaguauuuucuuugugugcagggauggcccuacccuguuagaaaaaaaaugucuucugcauguguaagcacugccuuuccagacacgacgagagacuaauaagccuucucuugcuuuuuuuauuuuuccuuagaucgacaaagaaaucgagcuucacagacuacugcaccauaagcaugucgugcaguuuuaccacuacuuugaagacaaagaaaacauuuacauucucuuggaauacugcaguagaaggguaaguguugacuccugggucagcgagcuugccgacaggaagccggagugguguuuggauuacauuuuaucagcgguuuuagccgugacaguuaauuagucucccaccauaugagacugcgucgucaguccagcaaagggaugcccgaucuagguaacuuuauuugacaaauucuccucucuccccuucucuuccuaguccauggcucacaucuugaaagcaagaaagguguugacagagccagaaguccgauacuaccucaggcagauugugucaggacucaaguaucuucacgaacaagaaaucuugcacagggaucucaagcuagguaaggcuucuccugcagcgacggggguggggguggggugggggugggggggugggggcuagagagugggagguuuuccaguguugugaaucuagcuuuuugaaugggugccuucacuggagggugcugaucuccaagugugaaccuuuccaagggaguucauguuuccuuuuguuuaucuucuagggaacuuuuuuauuaaugaagccauggagcugaaggugggagacuuugguuuggcagccagacuggaaccacuggaacacagaaggaggugagagccaugcucuuccugggguuuguggagaccaaauaugccucuauuauuaguuaauagaaa

SEQ ID NO: 10686 - RNA, 2501 nt, Mus musculus
uuucuauuaacuaauaauagaggcauauuuggucuccacaaaccccaggaagagcauggcucucaccuccuucuguguuccagugguuccagucuggcugccaaaccaaagucucccaccuucagcuccauggcuucauuaauaaaaaaguucccuagaagauaaacaaaaggaaacaugaacucccuuggaaagguucacacuuggagaucagcacccuccagugaaggcacccauucaaaaagcuagauucacaacacuggaaaaccucccacucucuagcccccacccccccacccccaccccacccccacccccgucgcugcaggagaagccuuaccuagcuugagaucccugugcaagauuucuuguucgugaagauacuugaguccugacacaaucugccugagguaguaucggacuucuggcucugucaacaccuuucuugcuuucaagaugugagccauggacuaggaagagaaggggagagaggagaauuugucaaauaaaguuaccuagaucgggcaucccuuugcuggacugacgacgcagucucauauggugggagacuaauuaacugucacggcuaaaaccgcugauaaaauguaauccaaacaccacuccggcuuccugucggcaagcucgcugacccaggagucaacacuuacccuucuacugcaguauuccaagagaauguaaauguuuucuuugucuucaaaguagugguaaaacugcacgacaugcuuauggugcaguagucugugaagcucgauuucuuugucgaucuaaggaaaaauaaaaaaagcaagagaaggcuuauuagucucucgucgugucuggaaaggcagugcuuacacaugcagaagacauuuuuuuucuaacaggguagggccaucccugcacacaaagaaaauacuuuagucgacagucauacccaccuuuucccucugaugagguuuagcuacucugcugugaggaauaauuuuugcagcguagacuuuguuguuugucagaucugucauuucguaacacuuugcaaauccacccugcgaggaaacaaagccgagauggaauugagcaggacagaaaaaaggaaaaaaaaaaaaaaugaagggccaacguuuaaaauaaaugaauacguaaaugggaacgggaagcaaaauuugaggaacagagggugggcagagcaguacaaucugcuuuguauaaugguuuuucaggaagggcagcacauuccuagaaaccaguccaguuuucucguuuccccuuuacaaagaacucuauggagaagggaguggaagggggaaagggaggaaaaugcccucugaagaaauuugacaggcuagcucccuggggaucagauagugagagcccaaggccaagguagaaugccuucaguccuccuucuuagacucgggagaaaaacaggcuaaggaugcaaauccgaaccccagcgcugucggcgcacagaagcccaggagggcaggagaggaacccacgucgaucguucggggaaccagacagcugaaggagcgagaagugcgggcgcugggucccugcucgcucagcuugcccgggcagcccgcccucccgcccggcagccugacguccgccgcuccucaccuugcccagcacuuugccccggcaguagcgcuuccccgucguggggucgacuauaauccgcgagaucucgggucccgagugggaaugguggugaugguggugcggggccgccggggucaccugggcuuggggcugcccaucuucagaaggcugcugcggucgcuucuucuuugaguccccgccgcaagcuuugcccagagccugcucgcacaucuuggugccggcggccggcugguaggugauaguccgcaggagcuccaucguugccucgccacccgacacugccuacuugccaccuccgaggcgcggacaagcguccgggcuagcccugucccucgagcaccagucucucucccuacucucuagucugacguccugcuucgcuugugcgagcaagagcgagcagcgaagcuuuaaauacgcgccggcuggcuggggcggggccucgugacgucacggcgagcgcuccacccaccggccccggaguccgcgcuguggauaggugcgggguggccgccuggaugucgugggcuucgaccuggccugaaggcggcgguacgccaagugcccccaguucgucgcgugcccugacuuuggacgugggaaacagaaacccaagggcggacgcccugucuggguccuggaggagcggggaugcgggguagcagcccgggggagccgcaggguuggcaccgcccuccugacugugugcagccccacacccugucauccagcgagccccgcgggguggcacccggagacccggagcgcuuggggaccuccgccgccaccgcaggcgggaggcucaguggccggccuugcggaaccgggcaccaggcagagccagagcagcuagggaaccaggcacaauccggguc

SEQ ID NO: 10687 - RNA, 2501 nt, Mus musculus
aaauaaaauagucgcaaaucaaguccuuuuaugggucacugaagaaaaccuagccugaucuugguccggagcucagaggcggacccaccuggaugaggguuggcauaaaagaugaucacaccaggccagacaaucuaaccaaggaccagguuccccggagcagccuuucccuuuuuccgggggcggcugaaccgcucagacggcccauggcuccccuagguggccagugaucuuuacgcucuuccaccgagcucaagcagcuggcgccaggacccgggcugcgguugccacggugacgacagacgcgcggagccugcagcugaaggcgggugagaggcgggaguugcaacgccuccucccccugcaaccagcgcgggggccacgcguugcucgcacgcgagggguguggcucugccuccgggaaagcgcggcccgugggcggcucggggcucagccagugagaggccgggggagugguggagggaaggcacaguccggguacuuagagcugcgccgccagcgggaccggaucuuccucgcagcucucgcgccgacgcuccgggcgucguagacgcuaggagcgcuacccgauuguaacaugguuaccccuugcccugccagcccgggcagccccgccgcgggagccgggaggcgagacagccaccagaaccuccgcgccccagugaagaagagcagacgcccgugccuccggagaaagaagccgcugcggccgcugaacgcguguucgcucccgggagacucgggcgucugugaccuuuucgagucccccagcuccagcucggacggcgccgacagccccgcagugucugcggcgcgggacugcagcucccuacucaacccugcccagcccuugacagcgcuggaucuccagaccuuccgagaauacggccagagcugcuacgacuuccgaaaggcgcaggagaaucuuuuccacccgcgggagucgcuggcgcgccagccacaagugaggcgcuggcaagagccagacccggggccgucgcgcuucugucucucccaggcuagcucgcucucuccauggcugcuggcugcccuucgcacagcccuagucauugcagcccauuaucugccaucaguaggagcaauugggaccuucaaggauuggcccacugaccuauuuagauggagaaagguuguggguggagagguggauaucggaaguuauaggggguggguagaggaguuuuauuauaacgcaguucgacagcuucuacgucagauccagaacuccuaaauuugcuugcacuucuguuuaaaaaaaaaacaaaaacuuuaccccccaccccccaccccuuauagucccuuugacuugcugagaggguuagacuggguagugugcccuaaugcacugugcacaauaccaggcgcgagcccaaacguucccaggcguuccggaacgccugguuuaaggcaggcccguaccucccccccucccccccacgugccuccuauuuuucagucauuuagcguuuuccccuuugccucucugccucucuggauuguuuuguucgggcgcgcgcuucagcacacucccccucucgcucccggccaggugacugccgaaucgcgcuguaaacugcucagcuggcuccugcaaguccaccgccaguucggccucucuuucgagucgcugugucugaccgugaauacucuggaccguuuucuccucacgaccccuguugcugcagacugcuuccagcugcucggggucaccugucugcucaucgcuugcaagcagguaccaccaggcgaaagagugcgauguguuugcagccagcgccccccuuccccaacucgugcauggcuuagggcuggguugcuuggcuuaucugggcagaugcucgaagaucuuuccaugucauagccuuaacuucucuuaccacucacagcaacaauccuuucagacuacaaagagguuaggcuguagcuggccgcccaaccaaagcuuugugguacuugucucuggaaaagaugcuuuuaaagucaaucucucucucucucucucucucucucucucucacacacacacacacacacacacauuuuaaaguuggguuguagauagagaaggugcacuagcagcuguggguggggggagagguuucaggagcggaauuguggaaguggaaggaauauagaguucgagucccaguuuucucccggguuuuaggcuggauggauuugggucccagguacccaccaguccggaacuggagcacacucuguguugcagguagaggugcacccaccucgcuugaaacagcuccuggcccugugcggcggugcguucucccggcagcagcugugcaaccuggagugcaucgugcugcauaagcuccacuucagccugggcgcgcccaccaucaacuucuuccuggagcacuucacucaguggcgcauggaagccggccaggcugaggucaccgaagcucuagaggcucaaacccuggcccggggagugg

SEQ ID NO: 10688 - RNA, 2501 nt, Mus musculus
ccacuccccgggccaggguuugagccucuagagcuucggugaccucagccuggccggcuuccaugcgccacugagugaagugcuccaggaagaaguugauggugggcgcgcccaggcugaaguggagcuuaugcagcacgaugcacuccagguugcacagcugcugccgggagaacgcaccgccgcacagggccaggagcuguuucaagcgaggugggugcaccucuaccugcaacacagagugugcuccaguuccggacugguggguaccugggacccaaauccauccagccuaaaacccgggagaaaacugggacucgaacucuauauuccuuccacuuccacaauuccgcuccugaaaccucuccccccacccacagcugcuagugcaccuucucuaucuacaacccaacuuuaaaaugugugugugugugugugugugugagagagagagagagagagagagagagagagauugacuuuaaaagcaucuuuuccagagacaaguaccacaaagcuuugguugggcggccagcuacagccuaaccucuuuguagucugaaaggauuguugcugugagugguaagagaaguuaaggcuaugacauggaaagaucuucgagcaucugcccagauaagccaagcaacccagcccuaagccaugcacgaguuggggaaggggggcgcuggcugcaaacacaucgcacucuuucgccuggugguaccugcuugcaagcgaugagcagacaggugaccccgagcagcuggaagcagucugcagcaacaggggucgugaggagaaaacgguccagaguauucacggucagacacagcgacucgaaagagaggccgaacuggcgguggacuugcaggagccagcugagcaguuuacagcgcgauucggcagucaccuggccgggagcgagagggggagugugcugaagcgcgcgcccgaacaaaacaauccagagaggcagagaggcaaaggggaaaacgcuaaaugacugaaaaauaggaggcacgugggggggagggggggagguacgggccugccuuaaaccaggcguuccggaacgccugggaacguuugggcucgcgccugguauugugcacagugcauuagggcacacuacccagucuaacccucucagcaagucaaagggacuauaagggguggggggugggggguaaaguuuuuguuuuuuuuuuaaacagaagugcaagcaaauuuaggaguucuggaucugacguagaagcugucgaacugcguuauaauaaaacuccucuacccacccccuauaacuuccgauauccaccucuccacccacaaccuuucuccaucuaaauaggucagugggccaauccuugaaggucccaauugcuccuacugauggcagauaaugggcugcaaugacuagggcugugcgaagggcagccagcagccauggagagagcgagcuagccugggagagacagaagcgcgacggccccgggucuggcucuugccagcgccucacuuguggcuggcgcgccagcgacucccgcggguggaaaagauucuccugcgccuuucggaagucguagcagcucuggccguauucucggaaggucuggagauccagcgcugucaagggcugggcaggguugaguagggagcugcagucccgcgccgcagacacugcggggcugucggcgccguccgagcuggagcugggggacucgaaaaggucacagacgcccgagucucccgggagcgaacacgcguucagcggccgcagcggcuucuuucuccggaggcacgggcgucugcucuucuucacuggggcgcggagguucugguggcugucucgccucccggcucccgcggcggggcugcccgggcuggcagggcaagggguaaccauguuacaaucggguagcgcuccuagcgucuacgacgcccggagcgucggcgcgagagcugcgaggaagauccggucccgcuggcggcgcagcucuaaguacccggacugugccuucccuccaccacucccccggccucucacuggcugagccccgagccgcccacgggccgcgcuuucccggaggcagagccacaccccucgcgugcgagcaacgcguggcccccgcgcugguugcagggggaggaggcguugcaacucccgccucucacccgccuucagcugcaggcuccgcgcgucugucgucaccguggcaaccgcagcccggguccuggcgccagcugcuugagcucgguggaagagcguaaagaucacuggccaccuaggggagccaugggccgucugagcgguucagccgcccccggaaaaagggaaaggcugcuccggggaaccugguccuugguuagauugucuggccuggugugaucaucuuuuaugccaacccucauccagguggguccgccucugagcuccggaccaagaucaggcuagguuuucuucagugacccauaaaaggacuugauuugcgacuauuuuauuu

SEQ ID NO: 10689 - RNA, 2501 nt, Mus musculus
agggagggagggagggagggagagagagagagagagagagagagagagagagagagagagagagagagagagagaauaugaaucuccaaaggggagaguggggaaggacccgucaccgaggugggaggugggaggugggcuagagcggccgccgcugcgccccagccauaucaaugucaguuaccagugacccagacacaacacgugcagcuugcauugacuuuuacuagacuguuuacuuuuauucgucccauuucauaaccugcagcgacuggaagaccagauuaaagaaccugacaaaaacaggaugcgacggauguuuuuacaugucgguuucauguaggcgguaagagaauuauuugugacagggguuaagaaaguaagagaggggagacguggaagggaggggaggagggaggggagaggggggaguguagggagaaugaauaugaaucugcaggaacagaucaagcauaaagauacuugugaaaaaugaaaggaaaaaaaaaagcagucgggcccagccuggaucugcccugagcggccucgaggcgcagcccgcccgacgggcccguuuugcaauccgccagcccggagcacgcccgcagccaccgcggucuuucgaaauuuccgagggcugcuuucucuggcgcccacgucccggcacccaggcagcgccccuaucagcaaggcugguagcccagccuagugucgggcagacggcuaggaccggugccggggagggcagcuuacgacacacaaaaccuuaccgcuccaacaggcaacgcagcaggguuagaacccggaggcgucuaccgggucacacauaccuaccuuaugucucccaagaaccucuuuacaaauaguuucuuucucugucccuauuuaauguguucggacuuugggcaagcagacgucucaugaaucaccaaagugacucgagaguaauugucgugaagcugcgggguuaccacuauuuuuaaaaaagaaauccagccuggagacuaauuguaauaaaaucaauucauuuuuaauuuuagaagauaaacuucagaaauuugcucuuuaauccaggucggagucuaaauagcuugugggcugcuugguucacagaaguuaacaggaaugaggcaaaguggagaaaacuguaaaguacuuaaaacacuucgggcuaauaauuugguuugucuuucuucuuuuucgcggggcuugggggaaagaggcagaaggagcauccgcuaagcguaaaacuaccucccucuaaaaauuucaguacccacauuuccaaguuugggcaaaguuucugaaaccacgucccccggccacccaagaaaauucgguaucucccaucccccaccccgucauuuuuuuuuuaaagagucuccaaaagauauggaaggaagauggauagauugcuaguaggucgacuguaaucuccaggcuacggaugcucgcccuucucccgagccagccaggggagauaacaucuaaagucauuaggaccagaacuuggagcaucuaccccuaacuacugaggcuccagcuccuccacucaagcccuuuccuuuuugaggguaaccuggcucuaaacuccgcucucuauccuaaagugucacugccuucagucuuucccucccguuccguucuacaggaguagccgggugguuccaacaucuuccgagagcagcguaggucagaacagaccaaguggagacagcagaaaaguagaaccccugccccagccgagccucugggcgcaucccuuccacucacccugggcgcugcgguccuccaugaacuggcagaguagcagcagcaggaggcagagcccgccgggcuggugccuggcgcagaccauccuggggcaggcgcggggcgaggagcgcggcggcggguggcucgggcgagcggcgcgcgucgcagaggcgagcggcggagggcgcagcgaucccggcgcagccccgcgcucgccaccggccgcccgcgcgauucaauggacgucagaagccgggcgcagccgcgcuuuaaaucuagacgggggucuccgagguuugcggugggcggucucccaguguguggggcugugggagggcggccgcgaccgagggugugccggcucuuuggggguggggagcuuuuaaaaguucagugugaaucaggugacauuucccaccuucuggaaacccuucccaauuaucugucggaggugcccgaaaucaaagcggcaggaggggaaucgccgaguucuuauuugcguaggagcgggaggggaggggggaaggaggcaggggcgggggcugggggcgacgcgucggggguggggaggaacauccacuucaguccugcacgccgccgcucggagccggcgcgcccgggguggcgugcgagugugugugugcgcgcgugugugcgugugcgcgugugagugagggcgcuggaggaggcggccggcggagcgcggggaccccggaggaccccgggaauggguccccagcaccucu

SEQ ID NO: 10690 - RNA, 2501 nt, Mus musculus
agaggugcuggggacccauucccgggguccuccgggguccccgcgcuccgccggccgccuccuccagcgcccucacucacacgcgcacacgcacacacgcgcgcacacacacacucgcacgccaccccgggcgcgccggcuccgagcggcggcgugcaggacugaaguggauguuccuccccacccccgacgcgucgcccccagcccccgccccugccuccuuccccccuccccucccgcuccuacgcaaauaagaacucggcgauuccccuccugccgcuuugauuucgggcaccuccgacagauaauugggaaggguuuccagaaggugggaaaugucaccugauucacacugaacuuuuaaaagcuccccacccccaaagagccggcacacccucggucgcggccgcccucccacagccccacacacugggagaccgcccaccgcaaaccucggagacccccgucuagauuuaaagcgcggcugcgcccggcuucugacguccauugaaucgcgcgggcggccgguggcgagcgcggggcugcgccgggaucgcugcgcccuccgccgcucgccucugcgacgcgcgccgcucgcccgagccacccgccgccgcgcuccucgccccgcgccugccccaggauggucugcgccaggcaccagcccggcgggcucugccuccugcugcugcuacucugccaguucauggaggaccgcagcgcccagggugaguggaagggaugcgcccagaggcucggcuggggcagggguucuacuuuucugcugucuccacuuggucuguucugaccuacgcugcucucggaagauguuggaaccacccggcuacuccuguagaacggaacgggagggaaagacugaaggcagugacacuuuaggauagagagcggaguuuagagccagguuacccucaaaaaggaaagggcuugaguggaggagcuggagccucaguaguuagggguagaugcuccaaguucugguccuaaugacuuuagauguuaucuccccuggcuggcucgggagaagggcgagcauccguagccuggagauuacagucgaccuacuagcaaucuauccaucuuccuuccauaucuuuuggagacucuuuaaaaaaaaaaugacggggugggggaugggagauaccgaauuuucuuggguggccgggggacgugguuucagaaacuuugcccaaacuuggaaauguggguacugaaauuuuuagagggagguaguuuuacgcuuagcggaugcuccuucugccucuuucccccaagccccgcgaaaaagaagaaagacaaaccaaauuauuagcccgaaguguuuuaaguacuuuacaguuuucuccacuuugccucauuccuguuaacuucugugaaccaagcagcccacaagcuauuuagacuccgaccuggauuaaagagcaaauuucugaaguuuaucuucuaaaauuaaaaaugaauugauuuuauuacaauuagucuccaggcuggauuucuuuuuuaaaaauagugguaaccccgcagcuucacgacaauuacucucgagucacuuuggugauucaugagacgucugcuugcccaaaguccgaacacauuaaauagggacagagaaagaaacuauuuguaaagagguucuugggagacauaagguagguaugugugacccgguagacgccuccggguucuaacccugcugcguugccuguuggagcgguaagguuuugugugucguaagcugcccuccccggcaccgguccuagccgucugcccgacacuaggcugggcuaccagccuugcugauaggggcgcugccugggugccgggacgugggcgccagagaaagcagcccucggaaauuucgaaagaccgcgguggcugcgggcgugcuccgggcuggcggauugcaaaacgggcccgucgggcgggcugcgccucgaggccgcucagggcagauccaggcugggcccgacugcuuuuuuuuuuccuuucauuuuucacaaguaucuuuaugcuugaucuguuccugcagauucauauucauucucccuacacuccccccucuccccucccuccuccccucccuuccacgucuccccucucuuacuuucuuaaccccugucacaaauaauucucuuaccgccuacaugaaaccgacauguaaaaacauccgucgcauccuguuuuugucagguucuuuaaucuggucuuccagucgcugcagguuaugaaaugggacgaauaaaaguaaacagucuaguaaaagucaaugcaagcugcacguguugugucugggucacugguaacugacauugauauggcuggggcgcagcggcggccgcucuagcccaccucccaccucccaccucggugacggguccuuccccacucuccccuuuggagauucauauucucucucucucucucucucucucucucucucucucucucucucucucucucucucccucccucccucccucccu

SEQ ID NO: 10691 - RNA, 2501 nt, Mus musculus
gccccccaccaagguuaaggagaauccaauacuaccgcucagacuagggcagugauguucgccgacugggccugaucuaggggccacguaccuggguauggauaauuuugugucugcagagagugcuggccuggcggaagccuuugccacagacuuugcacacaaacggucuagcuccgguguggacaggcauguggcgggugagguuauagugagcauugaacaccuauggaaggaugagagcggaacuuaggcugagucugccaagggccuagaaucaggcccggaggcuacaauuuaccucccuuaaccaaccaucccaucugaagccagcaaguccuuuugucaacuguguggcgauuuuacagccccauuuuacagaauaggaaacugaggcucaacugagcaucgaacggagcgcgcagcuauugggaagcuccucugcuugagagaaagguguacaaggcagcccaagaaagucaggggcuacuagcucccuccccccagaaccguaggccucaccuugccgcacacuucgcaggugaaguuuuuggguuugcugucaguagagccccccgguaguuugcuguggcucuugacucccccucguucagcugucaaggccgaguucuccuucagcaccugcuccaguggcgcaugcaagcgcuccuuauggggauaggaagcugggugggggaacuuguccgcagccaggcuggccaguuuggcguucuccagcagaaaaagcuuggggugagcagccagggaagugggggccugugcguugaggaggccggaugggaaaagguggccuccgaggagcuccgaagguggguaagcgguggaguccagguaguugaaguaguagagagagccgcuggcaggcagccccacagccugguugaugaccugcgguuugaugacccugccggcgggcagcgcagaaggcgcgaggcccaguucggccuugcagcacacgccacaguugguuuugcacaagccgcuggcgccgcacacuggggcccccccgccgcugccuccuccuccaccgccgcccgcccggaggcugcucuuccagaacuccgaguaacugagcagcgucuuggacggcaccucguagccuagaggcuggagagggaucauacagggcagcggcgagcagagguugagcaguuucuugcucuggcugcugucugccucuaacgcagcaggccggggcucgaaaggcgcucggggcucggacgucuuggccaugaugcgcucgauagagaaagcuaguguuuuagaaguggccggugacgcuccagcgcgcgggcaggccgggggcaccauggucuccagggaagcugagcuggccauggcgcgccaagcugggccaggcugggccagggcacagccucucuccucuaagucugcauuccggaaaaggcaggggggaaaccgcaauuuaauaagcaccuagucggcccggucacccauuugcauucaaaugaacagaagcagaacaaagugcacccaaggguaccaaauuaccgcccauuaacccggcgcgcaaaggaacccaccagcuauugcccugggacuaugaaagggggaagaagggggaggcuguacaaaggaaaggagaagggguagaagaaaggagucucaaauuaacacucccagcccuucccuggacccaggccuucgccacgcgugcugggaacugggcacugaaagagcaaaguuaaagagggccggaagaaccaccucgcuuuuaccucuuucccccaccgccaaggagaugcguuccgagccaugcagcgugucucuucugucacauuuugauggcaaacaucuuccccuccgcgugagaucacugucuuuuacauucagcugacaucacaugaagucacuugaaguggaaugacaugggcggcggcgcgacucccguugaggacccugcguucccccgcgccugccggccgccgccaccgccccucaaacuuuaaaggaggcaacuagcgcccgcgcucccuucgggaaagugcgagcgguuugcgaaucgggaaggagggaagagagggaggggggagggggaagaaucgugaugguuuugccgguggaaggaggugggggccgcccaaacccaaaccuaggcagaguuccuugggugauucacaacuuuggggggccuacaguuuuaggguacgcggggaaggcgggguguccccgacgcgcuaccucaaagggccccugguguccgucuaaucaccaaaguaucccuuagcccugcgcagccgaacugggcaccgugcuaauaaacugccauuuaccuacggagccagcgccagccccgaacacgcgcaaaugauaauuaccucauuaggauguggcgcauggacgcgggcgucgcguuuggaggggggaacuuguuaauggggaaauauuaauuuaugcaaaagcaacgagcucgccuuggcuggcgucggaggucgagagagagcuccccgccgccuaag

SEQ ID NO: 10692 - RNA, 2501 nt, Mus musculus
cuuaggcggcggggagcucucucucgaccuccgacgccagccaaggcgagcucguugcuuuugcauaaauuaauauuuccccauuaacaaguuccccccuccaaacgcgacgcccgcguccaugcgccacauccuaaugagguaauuaucauuugcgcguguucggggcuggcgcuggcuccguagguaaauggcaguuuauuagcacggugcccaguucggcugcgcagggcuaagggauacuuuggugauuagacggacaccaggggcccuuugagguagcgcgucggggacaccccgccuuccccgcguacccuaaaacuguaggccccccaaaguugugaaucacccaaggaacucugccuagguuuggguuugggcggcccccaccuccuuccaccggcaaaaccaucacgauucuucccccuccccccucccucucuucccuccuucccgauucgcaaaccgcucgcacuuucccgaagggagcgcgggcgcuaguugccuccuuuaaaguuugaggggcgguggcggcggccggcaggcgcgggggaacgcaggguccucaacgggagucgcgccgccgcccaugucauuccacuucaagugacuucaugugaugucagcugaauguaaaagacagugaucucacgcggaggggaagauguuugccaucaaaaugugacagaagagacacgcugcauggcucggaacgcaucuccuuggcggugggggaaagagguaaaagcgaggugguucuuccggcccucuuuaacuuugcucuuucagugcccaguucccagcacgcguggcgaaggccuggguccagggaagggcugggaguguuaauuugagacuccuuucuucuaccccuucuccuuuccuuuguacagccucccccuucuucccccuuucauagucccagggcaauagcugguggguuccuuugcgcgccggguuaaugggcgguaauuugguacccuugggugcacuuuguucugcuucuguucauuugaaugcaaaugggugaccgggccgacuaggugcuuauuaaauugcgguuuccccccugccuuuuccggaaugcagacuuagaggagagaggcugugcccuggcccagccuggcccagcuuggcgcgccauggccagcucagcuucccuggagaccauggugcccccggccugcccgcgcgcuggagcgucaccggccacuucuaaaacacuagcuuucucuaucgagcgcaucauggccaagacguccgagccccgagcgccuuucgagccccggccugcugcguuagaggcagacagcagccagagcaagaaacugcucaaccucugcucgccgcugcccuguaugaucccucuccagccucuaggcuacgaggugccguccaagacgcugcucaguuacucggaguucuggaagagcagccuccgggcgggcggcgguggaggaggaggcagcggcgggggggccccagugugcggcgccagcggcuugugcaaaaccaacuguggcgugugcugcaaggccgaacugggccucgcgccuucugcgcugcccgccggcagggucaucaaaccgcaggucaucaaccaggcuguggggcugccugccagcggcucucucuacuacuucaacuaccuggacuccaccgcuuacccaccuucggagcuccucggaggccaccuuuucccauccggccuccucaacgcacaggcccccacuucccuggcugcucaccccaagcuuuuucugcuggagaacgccaaacuggccagccuggcugcggacaaguucccccacccagcuuccuauccccauaaggagcgcuugcaugcgccacuggagcaggugcugaaggagaacucggccuugacagcugaacgagggggagucaagagccacagcaaacuaccggggggcucuacugacagcaaacccaaaaacuucaccugcgaagugugcggcaaggugaggccuacgguucuggggggagggagcuaguagccccugacuuucuugggcugccuuguacaccuuucucucaagcagaggagcuucccaauagcugcgcgcuccguucgaugcucaguugagccucaguuuccuauucuguaaaauggggcuguaaaaucgccacacaguugacaaaaggacuugcuggcuucagaugggaugguugguuaagggagguaaauuguagccuccgggccugauucuaggcccuuggcagacucagccuaaguuccgcucucauccuuccauagguguucaaugcucacuauaaccucacccgccacaugccuguccacaccggagcuagaccguuugugugcaaagucuguggcaaaggcuuccgccaggccagcacucucugcagacacaaaauuauccauacccagguacguggccccuagaucaggcccagucggcgaacaucacugcccuagucugagcgguaguauuggauucuccuuaaccuugguggggggc

SEQ ID NO: 10693 - RNA, 2501 nt, Mus musculus
gacuuauaccccucuaucagacaucugaaucagugucguaggcagguagggggacagguuggagaagaacugauuaaaccacuaaggaagaggcuugagaucagcgagccaauggcuggagcgcccucaccacgcuacacuggggccgcacuaggugaaugaaagaaaggaagaauguucaagccgccggaucaucgcucgauccagacagacugcguuaaguuugcucagcuggaaauuccgugacuucgucaaaguugggaagcaagcgcgguccaguugcggugggaugcaggaaaaggaaaaggagagagagagagagagagagagagagagagagagagagagagagagagagagagagagagagagagagagagccgcccuccagcaaaccugggcggggccagggcucuggcgggcccuaauaaagggcgagcagcgccgagcagagccuguagccccagagcucugucugucauccauccaguccuugcgugucugccagcgcccuuccgcugcagucaccggugagugcuguuggucugaagcaagccuagcgggaugaggcagccagggcucccgcaugccucccuucccacuaccuuggcuggcggaacugugggcaaggucaccacuccagcccuucgcgccccucuacagagagguuccaugguguugugcggauucagagcccgcagaggggagagacugcccggcuuggggagguuggucacugauggcuugccccgcaggacaccuggaguggcuucccuuggucuguaguaacucugccaccuucaagcugcuccgcuucuuguccugacuucuccuuccuuugcagaacugcugucuagagcccagcggcacuaccaugaaagucuggcuggcgagccuguuccucugcgccuugguggugaaaaacucugaagugaguggucucgcugcuuuagcaccaucaggaaggggcuugcaggaucccuuaagcagcaucaggggaaaaaugggggcugcacggggaacuuaggcaucaaaggcagguccaggcuuucccaggaaauaggacaauguaucagcggagggcuugugcacccaaagagguuugcacuaucuggcaagggaggaagaagccacggggagugccuuagcccaagggcaccugguuugugugaaguuugcuugagucaguccaugucugggugcuggcuaguaauaaacagaaaggggagagacagacagggguggggugggagaaagagagagagagagagagagagagagagagagagagagagagagagagaauauuaugagugaaugaauaucacuggaagggauuuugagguggggaccuguuuauccugaacaugaauucccuagagcaugucaccuucaucucuugcaggguggcaguguacuuggagcuccugaugaaugugaguaucugcuuccuugcacaauaguuggcugcacagagacccuugaaaaaccuuaggagacauacccucccugucccugcugaaaggcuggcuccccacuugauccuugcuuaccccuccuuugcauuugcuagcaaacuguggcugucagaacggagguguaugcguguccuacaaguacuucuccagaauucgccgaugcagcugcccaaggaaauuccagggggagcacugugagauagguauggggauuuggacuuggaaugugggagugggggaggaccagagaucuuagaacagggacagaugggugggaugcagaagcaggcagaagcuggccuuggaggugugggucuguuaccccagcacuuaggaggagacugaagccuggccuccauaguaaguccuugucucaaaaggcgggcgaggcgcagcuagagagacagcuuagugauuaagaacacuggcugcucuucuagacauccuauaguuugaguuucagcacccauagagguggguuacagccaucuguacccccagucccagagaaucugaugcccucuucugaccucuuccagcccaagugacauacaugguguacagauauacauggaggaaaaacacucauacacauaaaauaagcaaacaaacaaacaaaacaggcagcagaaguugggagucacacacacacacacacacacacacacacacacacacacacacucaugaaguaguggcuauacaagugugaaaaaaaagggugaaucucccucauaucaccugacaggucugaaaccgugucaccucugaaaugccuguccaaaccgccucccuuuucuaauacucugcacuccucaaaucauuucuagaugcaucaaaaaccugcuaucauggaaauggugacucuuaccgaggaaaggccaacacugauaccaaaggucggcccugccuggccuggaaugcgccugcuguccuucagaaacccuacaaugcccacagaccugaugcuauuagccuaggccuggggaaacacaauuacugcagguagguggugacugagua

SEQ ID NO: 10694 - RNA, 2501 nt, Mus musculus
uacucagucaccaccuaccugcaguaauuguguuuccccaggccuaggcuaauagcaucaggucugugggcauuguaggguuucugaaggacagcaggcgcauuccaggccaggcagggccgaccuuugguaucaguguuggccuuuccucgguaagagucaccauuuccaugauagcagguuuuugaugcaucuagaaaugauuugaggagugcagaguauuagaaaagggaggcgguuuggacaggcauuucagaggugacacgguuucagaccugucaggugauaugagggagauucacccuuuuuuuucacacuuguauagccacuacuucaugagugugugugugugugugugugugugugugugugugugugugugacucccaacuucugcugccuguuuuguuuguuuguuugcuuauuuuauguguaugaguguuuuuccuccauguauaucuguacaccauguaugucacuugggcuggaagaggucagaagagggcaucagauucucugggacuggggguacagauggcuguaacccaccucuaugggugcugaaacucaaacuauaggaugucuagaagagcagccaguguucuuaaucacuaagcugucucucuagcugcgccucgcccgccuuuugagacaaggacuuacuauggaggccaggcuucagucuccuccuaagugcugggguaacagacccacaccuccaaggccagcuucugccugcuucugcaucccacccaucugucccuguucuaagaucucugguccucccccacucccacauuccaaguccaaauccccauaccuaucucacagugcucccccuggaauuuccuugggcagcugcaucggcgaauucuggagaaguacuuguaggacacgcauacaccuccguucugacagccacaguuugcuagcaaaugcaaaggagggguaagcaaggaucaaguggggagccagccuuucagcagggacagggaggguaugucuccuaagguuuuucaagggucucugugcagccaacuauugugcaaggaagcagauacucacauucaucaggagcuccaaguacacugccacccugcaagagaugaaggugacaugcucuagggaauucauguucaggauaaacagguccccaccucaaaaucccuuccagugauauucauucacucauaauauucucucucucucucucucucucucucucucucucucucucucucucucuuucucccaccccaccccugucugucucuccccuuucuguuuauuacuagccagcacccagacauggacugacucaagcaaacuucacacaaaccaggugcccuugggcuaaggcacuccccguggcuucuuccucccuugccagauagugcaaaccucuuugggugcacaagcccuccgcugauacauuguccuauuuccugggaaagccuggaccugccuuugaugccuaaguuccccgugcagcccccauuuuuccccugaugcugcuuaagggauccugcaagccccuuccugauggugcuaaagcagcgagaccacucacuucagaguuuuucaccaccaaggcgcagaggaacaggcucgccagccagacuuucaugguagugccgcugggcucuagacagcaguucugcaaaggaaggagaagucaggacaagaagcggagcagcuugaagguggcagaguuacuacagaccaagggaagccacuccagguguccugcggggcaagccaucagugaccaaccuccccaagccgggcagucucuccccucugcgggcucugaauccgcacaacaccauggaaccucucuguagaggggcgcgaagggcuggaguggugaccuugcccacaguuccgccagccaagguagugggaagggaggcaugcgggagcccuggcugccucaucccgcuaggcuugcuucagaccaacagcacucaccggugacugcagcggaagggcgcuggcagacacgcaaggacuggauggaugacagacagagcucuggggcuacaggcucugcucggcgcugcucgcccuuuauuagggcccgccagagcccuggccccgcccagguuugcuggagggcggcucucucucucucucucucucucucucucucucucucucucucucucucucucucucucucucucucucucuccuuuuccuuuuccugcaucccaccgcaacuggaccgcgcuugcuucccaacuuugacgaagucacggaauuuccagcugagcaaacuuaacgcagucugucuggaucgagcgaugauccggcggcuugaacauucuuccuuucuuucauucaccuagugcggccccaguguagcguggugagggcgcuccagccauuggcucgcugaucucaagccucuuccuuagugguuuaaucaguucuucuccaaccugucccccuaccugccuacgacacugauucagaugucugauagagggguauaaguc

SEQ ID NO: 10695 - RNA, 2501 nt, Mus musculus
gcgcgcucgcccggggagcgggagcagcuggaggaggagcuggcgcggcggacgcgggagccccgcgcgcuuucucgccgccgggagccagaagcgaauaauccuggguggcccgcagcggagccgugauggggcuagaagagcaggacagacugcgggaguguccccgcggugcgcggugucugccucgggcugcgcccugcgcugcgcucucccggccccgagccggcgcugcgcucugcgaugugugucgcugcuuguccagcccgggcucuggcgaggaaacucacuucaaaagcagcugcaccgagggggagauuaaagccuuugccgccuuccaaucaaaugggagcccgaggugauuggagggucaaggggaugugacgcgucccgcgccgccgccaccgccaggaaucucagagcugguuuuaaugggcagcucccucuucgccgccccucggcuuguccccucccucgauuucgcuacccggacgagauggacauuuauucuacguuugucaucuaccgccuuccuucuuuuuucucuucgucguucuucguuuucccagcaggaaaacaaacugaaaccuuuggagggagggaguguuaacagacuucgggagaagaaacgcaggcgguaauguggauaccugcugaacagucaacuccagggaugagugggagccuguauacaaaaaaaaucuuuucagaaauuaagauuuugcguggcgcggccacccggguaaggaaagucgaugcugcagaaagucugcccgcccgcuuggauuuccagagguucagcagcagagaaaccagaagcuagaagggcaacggaggcgguggcugcucguccucgcgacgugcgccgggcucuccgcccuucccggucacgugacaccgaaggacgcucagauuggggcuugagcggggggucacauguuuccccuguuucacacuucagccccccccccauucuugcuuucgucuugcuacucucccccccccccgcacccccuguuucucugggcaucuccaccccuccaucaauugucaaugugccucgaccgcaaucaaucaguuauuugucagcucuugucaaucugcccgugauuuaugucagcuuuuguugcugauuacaaggcgggugagacuugaagggaaaaagagagaccuagagugagacagaggaaggaagagaccgagaagaaacugaaggagggggaaagagcagcagccuccuggcaccuguguguguguuuguguguguggaggguguguaagaaaaagaaagaggggaaaggggcguccacagucaggaaaaugaaauagugagaguaaagugcgcaggugcacccaggacuccuagucuggagcaccggccugggaugugcucacucccucuugggguuguggagacagacacaccuucuaccuuugggugcuucggucaauccgggucgcccaguucgggucugcugaguaccuaagaacgacgcuggaggcgacgucuaacgcggagguuucccgccucucuggcauaaucccucccgggaauguaacuugaggauguccaguugucgaccucgguaguguucccaccccagacucgggaauuucuuuccaaagagccaugccaucaaauauagcccgaguucuggagguuacuuguagaauaaaccuccuuaauucugugacccguguucguagcgagaguugaauagcucaagagaagaggccugaccaugugcauaggcaaacaggucucaggcucgcucuccuccucucccggguccuucgccacuacccuccgcuggccaucccgacaguccugggagccgggacuuaaucgggcugcuggacggcaugauguagaccauccagacaggacugaccuaugcggggagaggagagggaaggaacgcgagagggaggggcggcugccuguggaaaccgguucuuccagggaagcggagcgggacuucggcguuccccucgauuugcgccgucgcucgggcuguuuggaaagaagaggggaggcgcugugcaugcugacuuguaccuggaucugggugcacagugcguaugcacuccugugccgcugggcgacuuccauaacguccgcuccgggguuacucccagaaacucguagaaaguagaagggggugagaagaggacacacccccuugcucggagggacuugggagacuuugaauuuccccuccccccacuuuuccgcagagcucuucuuuuguugucaaguccuuuugauaaaugguggggcugggagagcugggagccaggagccgaucugcgcccugcgcaggggcgggggcccagccuggagaccggguucggaccaccgcgcacccugagcugaaccgggcacgcucaggggacuuuuccuucuguuugccagccuauuucuuuccuaccaucccagucccccuucccuucuguuucuguccacgcggauaacgagaacuuucuggggugggggugag

SEQ ID NO: 10696 - RNA, 2501 nt, Mus musculus
cucacccccaccccagaaaguucucguuauccgcguggacagaaacagaagggaagggggacugggaugguaggaaagaaauaggcuggcaaacagaaggaaaaguccccugagcgugcccgguucagcucagggugcgcggugguccgaacccggucuccaggcugggcccccgccccugcgcagggcgcagaucggcuccuggcucccagcucucccagccccaccauuuaucaaaaggacuugacaacaaaagaagagcucugcggaaaaguggggggaggggaaauucaaagucucccaagucccuccgagcaaggggguguguccucuucucacccccuucuacuuucuacgaguuucugggaguaaccccggagcggacguuauggaagucgcccagcggcacaggagugcauacgcacugugcacccagauccagguacaagucagcaugcacagcgccuccccucuucuuuccaaacagcccgagcgacggcgcaaaucgaggggaacgccgaagucccgcuccgcuucccuggaagaaccgguuuccacaggcagccgccccucccucucgcguuccuucccucuccucuccccgcauaggucaguccugucuggauggucuacaucaugccguccagcagcccgauuaagucccggcucccaggacugucgggauggccagcggaggguaguggcgaaggacccgggagaggaggagagcgagccugagaccuguuugccuaugcacauggucaggccucuucucuugagcuauucaacucucgcuacgaacacgggucacagaauuaaggagguuuauucuacaaguaaccuccagaacucgggcuauauuugauggcauggcucuuuggaaagaaauucccgagucuggggugggaacacuaccgaggucgacaacuggacauccucaaguuacauucccgggagggauuaugccagagaggcgggaaaccuccgcguuagacgucgccuccagcgucguucuuagguacucagcagacccgaacugggcgacccggauugaccgaagcacccaaagguagaaggugugucugucuccacaaccccaagagggagugagcacaucccaggccggugcuccagacuaggaguccugggugcaccugcgcacuuuacucucacuauuucauuuuccugacuguggacgccccuuuccccucuuucuuuuucuuacacacccuccacacacacaaacacacacacaggugccaggaggcugcugcucuuucccccuccuucaguuucuucucggucucuuccuuccucugucucacucuaggucucucuuuuucccuucaagucucacccgccuuguaaucagcaacaaaagcugacauaaaucacgggcagauugacaagagcugacaaauaacugauugauugcggucgaggcacauugacaauugauggagggguggagaugcccagagaaacagggggugcgggggggggggagaguagcaagacgaaagcaagaauggggggggggcugaagugugaaacaggggaaacaugugaccccccgcucaagccccaaucugagcguccuucggugucacgugaccgggaagggcggagagcccggcgcacgucgcgaggacgagcagccaccgccuccguugcccuucuagcuucugguuucucugcugcugaaccucuggaaauccaagcgggcgggcagacuuucugcagcaucgacuuuccuuacccggguggccgcgccacgcaaaaucuuaauuucugaaaagauuuuuuuuguauacaggcucccacucaucccuggaguugacuguucagcagguauccacauuaccgccugcguuucuucucccgaagucuguuaacacucccucccuccaaagguuucaguuuguuuuccugcugggaaaacgaagaacgacgaagagaaaaaagaaggaaggcgguagaugacaaacguagaauaaauguccaucucguccggguagcgaaaucgagggaggggacaagccgaggggcggcgaagagggagcugcccauuaaaaccagcucugagauuccuggcgguggcggcggcgcgggacgcgucacauccccuugacccuccaaucaccucgggcucccauuugauuggaaggcggcaaaggcuuuaaucucccccucggugcagcugcuuuugaagugaguuuccucgccagagcccgggcuggacaagcagcgacacacaucgcagagcgcagcgccggcucggggccgggagagcgcagcgcagggcgcagcccgaggcagacaccgcgcaccgcggggacacucccgcagucuguccugcucuucuagccccaucacggcuccgcugcgggccacccaggauuauucgcuucuggcucccggcggcgagaaagcgcgcggggcucccgcguccgccgcgccagcuccuccuccagcugcucccgcuccccgggcgagcgcgc

SEQ ID NO: 10697 - RNA, 2501 nt, Mus musculus
ccuccguccucucgcucuguucucucuggaaaggcggggggguggaaagaagaagguuaacccgaagaaaggaagaaagaaagaaggggaccagaagggggaagccaacguucccccacaggcuagcuguccaucaaccgcucaagccaccaagcggcagaaaguucagggcugccuugaacccauuuucuuugcgccugguuuuugccagacucuaaaaugaaaggacaaaauuuggcgcugacucuugcagcucugauggcgacuugugcgauuucagcggcaucucccggagaaaaaaccaugcgugccugauuguucuguggucccauagccgccgccgcugcugcugcucugugugugugugugugugucugugugugugugugagcgcgugucucugugucugcgugugugugcguuuguguguguguauguguguguguuugggugugugucuguguguacacagagguucacuagcuaacucagcugcaggagcagucccuggaagcagacguuucggccacagacccagagaggaggagcugacaaucaggaggcgugagccgccuggagucugcagaauucguggugugaaugaacugggggcaucuugggcacagggauugcccccccuccuuccccgccucgggccacaguugaguaguggggcauuuuuuuucaccuucuugugaagaauuuuuuuuauuauuuguuguaaagucuuuugcacaaucacgcccacauuugggguuggaaagcccuaauuaccgccgucgcugauggacguuagagagggagcgccucgccgcggaacagucgccugcgcgcccucgucggacccgcggcuccugcacuguguccccgcucggcccugcgcuugcugcucgcccgcgcgcgccggcgcccucucgguuccugggcacauuuccacgcuauaccaacuccucugcccgaguccgggcgccagugcucgcuuccgcuccgggucgcugcgcccacccgacgcgcccaggaggacuccgcagcccugcuuuggauugucccccaaggcuuaaccccgacgcuucgcuugaauuccucggccgccuucgcucggguggcgacuuccucuccgugcccccucccccucgccaugaagguaaguguucugugcgcacggacgcucccuacuuuuucccccccuuuucaaaguuaacugaacucuuucaaucuaucccuauccucuccauuucucuaacugccuggagaaagcuaaacuccaauaucgccggcagggacuccuaucuuuucgucccuuacccuggggacacugccucugcguccuuggagacuuuuugcaccggcuauucuucaaaccuuuucaacuauggagaagagcgagggcaggaaagacaguucgggucacaggcggcgcgccuuuuuaccucgagaacuggaguguaguuuuacuacguguauuucagugacuggauaaugauucgauucaucaaguauauaucaaacgcucauuucaccggcacgcggagauuguguggcugaagcucugaggccggaugaggacuguguuaggagaaacggcugcgagacuaaggaaacuaggggccaccuacccuagagcaacgcacaccccacccccaaccuccgaucagggcccaguucccggcucuccaggucgaguaacccgagcguucccggccccugugccuuuaagagugccuggcggggggccagagcgcaccccgcgcggggagcagggucgcguuauuagcuuuauuagcggccucugggugagcucagguccuuuacugcagcauugggggcggggaguagugguccuaguggcuuuaauccugcccccugagcggagucaaccuagugcuuuggagacucuagggccucugcguuucgagaucgggcggggguuaguuugugaacucguguuuguuuuaauugucaguuguauguuaaagccgagucacacacucugagggucaccgagaguucacuuuuacaaaaaaguuaacguuucgucuugaaauauaacuagcaauuuuccaaacaacuuuuccuucgguuauccuccacgccucgauaacaauuuccauuuauacuucauaccucucauuuccagcuuucuaguagggaguaaggugaagaucgguacgaagcuguuuccuaaaagcaaacaacguucuuucuucaaagaaaggguuuuaaaccccggugcuucuaaggcccuguuuuacccucuaugcccuguccgagccacagcuccguggucucacuuuaaaugaacaauucgcuccugggaaauaacuugggucgggugaugaggucguaccuccucagcaucugcugucuugacgauauuagcacaccuagccagauuuaauuucaagacauuuuccaucaggcgaggcuuugcgggggggggggggauuuggaggagacaauguuguaaguacccagcaauugaggaauggcggaaaguaggg

SEQ ID NO: 10698 - RNA, 2501 nt, Mus musculus
cccuacuuuccgccauuccucaauugcuggguacuuacaacauugucuccuccaaaucccccccccccccgcaaagccucgccugauggaaaaugucuugaaauuaaaucuggcuaggugugcuaauaucgucaagacagcagaugcugaggagguacgaccucaucacccgacccaaguuauuucccaggagcgaauuguucauuuaaagugagaccacggagcuguggcucggacagggcauagaggguaaaacagggccuuagaagcaccgggguuuaaaacccuuucuuugaagaaagaacguuguuugcuuuuaggaaacagcuucguaccgaucuucaccuuacucccuacuagaaagcuggaaaugagagguaugaaguauaaauggaaauuguuaucgaggcguggaggauaaccgaaggaaaaguuguuuggaaaauugcuaguuauauuucaagacgaaacguuaacuuuuuuguaaaagugaacucucggugacccucagagugugugacucggcuuuaacauacaacugacaauuaaaacaaacacgaguucacaaacuaacccccgcccgaucucgaaacgcagaggcccuagagucuccaaagcacuagguugacuccgcucagggggcaggauuaaagccacuaggaccacuacuccccgcccccaaugcugcaguaaaggaccugagcucacccagaggccgcuaauaaagcuaauaacgcgacccugcuccccgcgcggggugcgcucuggccccccgccaggcacucuuaaaggcacaggggccgggaacgcucggguuacucgaccuggagagccgggaacugggcccugaucggagguuggggguggggugugcguugcucuaggguagguggccccuaguuuccuuagucucgcagccguuucuccuaacacaguccucauccggccucagagcuucagccacacaaucuccgcgugccggugaaaugagcguuugauauauacuugaugaaucgaaucauuauccagucacugaaauacacguaguaaaacuacacuccaguucucgagguaaaaaggcgcgccgccugugacccgaacugucuuuccugcccucgcucuucuccauaguugaaaagguuugaagaauagccggugcaaaaagucuccaaggacgcagaggcaguguccccaggguaagggacgaaaagauaggagucccugccggcgauauuggaguuuagcuuucuccaggcaguuagagaaauggagaggauagggauagauugaaagaguucaguuaacuuugaaaagggggggaaaaaguagggagcguccgugcgcacagaacacuuaccuucauggcgagggggagggggcacggagaggaagucgccacccgagcgaaggcggccgaggaauucaagcgaagcgucgggguuaagccuugggggacaauccaaagcagggcugcggaguccuccugggcgcgucgggugggcgcagcgacccggagcggaagcgagcacuggcgcccggacucgggcagaggaguugguauagcguggaaaugugcccaggaaccgagagggcgccggcgcgcgcgggcgagcagcaagcgcagggccgagcggggacacagugcaggagccgcggguccgacgagggcgcgcaggcgacuguuccgcggcgaggcgcucccucucuaacguccaucagcgacggcgguaauuagggcuuuccaaccccaaaugugggcgugauugugcaaaagacuuuacaacaaauaauaaaaaaaauucuucacaagaaggugaaaaaaaaugccccacuacucaacuguggcccgaggcggggaaggagggggggcaaucccugugcccaagaugcccccaguucauucacaccacgaauucugcagacuccaggcggcucacgccuccugauugucagcuccuccucucugggucuguggccgaaacgucugcuuccagggacugcuccugcagcugaguuagcuagugaaccucuguguacacacagacacacacccaaacacacacacauacacacacacaaacgcacacacacgcagacacagagacacgcgcucacacacacacacagacacacacacacacacacagagcagcagcagcggcggcggcuaugggaccacagaacaaucaggcacgcaugguuuuuucuccgggagaugccgcugaaaucgcacaagucgccaucagagcugcaagagucagcgccaaauuuuguccuuucauuuuagagucuggcaaaaaccaggcgcaaagaaaauggguucaaggcagcccugaacuuucugccgcuugguggcuugagcgguugauggacagcuagccugugggggaacguuggcuucccccuucugguccccuucuuucuuucuuccuuucuucggguuaaccuucuucuuuccacccccccgccuuuccagagagaacagagcgagaggacggagg

SEQ ID NO: 10699 - RNA, 2501 nt, Mus musculus
uuuuccuuuuuuaaaaaggaaaggccuaggauagccuagaacuugccaccuuccuaccucagccuccuuagugcugcaauuuuaggcauaggccaccucacuggguggucuuuaucuuuugcaggguucagaugaacucacucacuguccuaggaagguaaaacagacaacaacaacaacaacaaaaaagaauagaacaauuucuccagcaguguuacugcaagucagcuuucugggugaaaguuccaggcccgggggaguccugccuuacguccacauucuccacagcacauacucugaguuaacucuuuggcucucccacaacugcuccugguagugccaaaggcaaagguuacugcucaacuucaaucugccuuggcaagggccaaagagcucaugggugaggcuggcuucuuccacagcaacgcuggacagguccugccacauuaagacucuguccaagcagacucugagcuuagcauuucaaagaagcagauagccaacuagcaggagaguugcuuuuaaucugggauacuaaugaaaucguaugcaccuuaaaauuccagaccucaccaaacaaaccuucuggugccacacaagcuugaaaugaucauugcaaucccagcaaucaggaggcagagacagggggacugcaaauucaaagaaagccuccgggaaauucaaagcuacccugaacuacauaaggcccacccccucaagaagaaaaggggaaagaggugggguagagugcuuuguaccccuucagggacaacacaaagggucucagguaaaugccaucccuuauaaggaaggacaccaaggaaaggucggacgagaagaaccaaguugcaugagccuggaccagccauguuucacauuagcaaaaugggaacaauuuccuaaucaccuucuacagagaugaaucacugaagaugcuauaagcucuuugcaaagacugccagagauguuaaauucuuacuuauuucuggauuacucauugaucaccccaaauauuugaaacaaaggauuuucugaugaguaucuugugaggacccagauucuauuagcagggcuccaugacaagcaggaggauuucuggguuuggggccagccuggucuacagaaugaguuccaggauagccagagguacacagagaaacccugucucgaaacaaaacauccaaugaguauuuucuuuucacauaaaucauuuaccaaguuccaagacaagaaauguugaaguaaaaauaaaaccaaaaaucuagguaacagggcugugaaaacauuggaggcacgguggcagcgagacucggauugucaccuucccaugcaaacccugccagguuggaccuuaacuuugcucucccuugggccauuuucaccaacuccaacaaccuaacaauucggaggaugggcuguccuggagcucugauuaucucauuaccacaccucagcagcgguuugaaauuuacaacggagcuuucuaaggcaaagguuuguaacccuuagaagagaaggaggagcagguaucucagagacuuccucacaggacaccccaauaccgaaacuggauagccacggccaccccuggcagccuucagccuagcccauguuggguggaugccccuuccugagaggugggcaaacguuuuuguuuuuuuuuuuuuuuccuucaguucucugucccaacaauucaaacaucugggugggcaagaguuuuucuguccucugucccaacgauucagacugcugggugccgccagcgccauuccgggacaggggucucugggccccaagcguggagucuguccugaucgcuguggugggcugagggcacaucggagagcgguaccuggagaggaucgggucacauccucuauccagcaucuagucuccgcggucccuggccugccucgauccucaccugcgccccaaggaccccgccuccguggaccucacuggccccugagcugcgccagcggacgcaggugccuccucgguuguagugcaguuuugagggcgggugagacuaaggucuccccgcgccugcgcagcucagcgccuacgccaccacgccacuuucacgugacagacacgcccccgcagcuccagacuggggacuggguagaacugggucgccuucgggcacuucuuugcucgcugauuuccacggagcuaguuuggaacuagcguggcuuugugggguagaugucccagcguccaucuucacccccaaaugcugguuauuagaaugaagaaaaccagcugagaacuggcucuaaggauaauaccagcuccucuagcuucuuugagcaacccugugacaggcuugucuuaauacucuaacgugguugguugcuuaauguagcucagacuggucuggaauuguucauccuccugccacaguuccccaggggcugggaucacaggcgugcaccgccaugccuggcuuuuacccauuuuucucacuccuguaauaaguguucauuacugucguauca

SEQ ID NO: 10700 - RNA, 2501 nt, Mus musculus
ugauacgacaguaaugaacacuuauuacaggagugagaaaaauggguaaaagccaggcauggcggugcacgccugugaucccagccccuggggaacuguggcaggaggaugaacaauuccagaccagucugagcuacauuaagcaaccaaccacguuagaguauuaagacaagccugucacaggguugcucaaagaagcuagaggagcugguauuauccuuagagccaguucucagcugguuuucuucauucuaauaaccagcauuugggggugaagauggacgcugggacaucuaccccacaaagccacgcuaguuccaaacuagcuccguggaaaucagcgagcaaagaagugcccgaaggcgacccaguucuacccaguccccagucuggagcugcgggggcgugucugucacgugaaaguggcgugguggcguaggcgcugagcugcgcaggcgcggggagaccuuagucucacccgcccucaaaacugcacuacaaccgaggaggcaccugcguccgcuggcgcagcucaggggccagugagguccacggaggcgggguccuuggggcgcaggugaggaucgaggcaggccagggaccgcggagacuagaugcuggauagaggaugugacccgauccucuccagguaccgcucuccgaugugcccucagcccaccacagcgaucaggacagacuccacgcuuggggcccagagaccccugucccggaauggcgcuggcggcacccagcagucugaaucguugggacagaggacagaaaaacucuugcccacccagauguuugaauuguugggacagagaacugaaggaaaaaaaaaaaaaaacaaaaacguuugcccaccucucaggaaggggcauccacccaacaugggcuaggcugaaggcugccagggguggccguggcuauccaguuucgguauugggguguccugugaggaagucucugagauaccugcuccuccuucucuucuaaggguuacaaaccuuugccuuagaaagcuccguuguaaauuucaaaccgcugcugaggugugguaaugagauaaucagagcuccaggacagcccauccuccgaauuguuagguuguuggaguuggugaaaauggcccaagggagagcaaaguuaagguccaaccuggcaggguuugcaugggaaggugacaauccgagucucgcugccaccgugccuccaauguuuucacagcccuguuaccuagauuuuugguuuuauuuuuacuucaacauuucuugucuuggaacuugguaaaugauuuaugugaaaagaaaauacucauuggauguuuuguuucgagacaggguuucucuguguaccucuggcuauccuggaacucauucuguagaccaggcuggccccaaacccagaaauccuccugcuugucauggagcccugcuaauagaaucuggguccucacaagauacucaucagaaaauccuuuguuucaaauauuuggggugaucaaugaguaauccagaaauaaguaagaauuuaacaucucuggcagucuuugcaaagagcuuauagcaucuucagugauucaucucuguagaaggugauuaggaaauuguucccauuuugcuaaugugaaacauggcugguccaggcucaugcaacuugguucuucucguccgaccuuuccuugguguccuuccuuauaagggauggcauuuaccugagacccuuuguguugucccugaagggguacaaagcacucuaccccaccucuuuccccuuuucuucuugagggggugggccuuauguaguucaggguagcuuugaauuucccggaggcuuucuuugaauuugcagucccccugucucugccuccugauugcugggauugcaaugaucauuucaagcuuguguggcaccagaagguuuguuuggugaggucuggaauuuuaaggugcauacgauuucauuaguaucccagauuaaaagcaacucuccugcuaguuggcuaucugcuucuuugaaaugcuaagcucagagucugcuuggacagagucuuaauguggcaggaccuguccagcguugcuguggaagaagccagccucacccaugagcucuuuggcccuugccaaggcagauugaaguugagcaguaaccuuugccuuuggcacuaccaggagcaguugugggagagccaaagaguuaacucagaguaugugcuguggagaauguggacguaaggcaggacucccccgggccuggaacuuucacccagaaagcugacuugcaguaacacugcuggagaaauuguucuauucuuuuuuguuguuguuguuguugucuguuuuaccuuccuaggacagugagugaguucaucugaacccugcaaaagauaaagaccacccagugagguggccuaugccuaaaauugcagcacuaaggaggcugagguaggaagguggcaaguucuaggcuauccuaggccuuuccuuuuuaaaaaaggaaaa

SEQ ID NO: 10701 - RNA, 2501 nt, Mus musculus
uuguuccaacaggucuuugcacgggguccauccgaggaccggagucccaggacucccccgcuccagagcccgcuccaccccgccucuuugccucacuuaggaacucgacguguccagcugguuuucaaccuaaccucucccccccccccgcaccggccccaguuuucgaggcggggggcacuuucgggaaaccuuugagaaagaaguguaaaggauggagagucacguccuuccuggcggcgguggcugcccagcgccaucccacacugcugcccugggugcagagaccgcgggcgccccugagcgacaguccgcucucaccaccaucagcgcagcuuucugagacgauuucucuauuccccgaccagcgucgccgcugggaauaacugggaaagcgcuggaaagggcaaagggcuuauuguugauuuguuuauuugcuuuuaagggggaaagagauggcgauaugcuagcgacuggcgcacgcggagcgagggcaccguggaaccgccgacgcucaggauccccggacaauccugugccuuuggcgguguguggagcgcucucgacguuaaagcccaguaaauagacgaaggacuuguuucaauuucaacuucacaaggaucccuuucuaaucacuccuuucuucccugauuuuuuuuaauuaaaaaauacagaucaaaguaaauuuucaucuccugguauuuuuuuuuuucuuaaugggguugauacagcuccuggaggcaguuacccuucacuuucuccccagaaucuucuucuaaaaccaaaauuuaauaguagccucgguuugccaaauaugacccugcuagugauucaacaucucacaaaaccuucaguucauaaaccaggauacuaaaaaaacuaucaaccaaagccguggcgggaaaccuucugaguccccggggcccaacuccacugcguguaaggaccccgcaauucccgaacccuuuggaguaucgcaagcuccucauuagcccugcuggcauguccgcacagacacagcauggcagaagacccgcacagguagccuuucggcauccuggccacgguccgucgaaccuuacaccccuucccagggaggggagaguaccagaaggcagaaugcaugggugcccaugucuaagaaaauagcuccuggagaugggagcgaguucuguaccuacaguucgcuagcucucaggggcugggagggggugcguuggggacaagauuaggugacaccccgcucaaggaagccucucuaucccgggucgcgcuuuagagcaaagcaggacuacagccucuuuugcaaagcuagcucuggcuagguucucucuccuaaugaagcaguccucagucccccacugguguugaaacuuagaguugacucccuccucucccacucuuauagucuaaguggaagcaaacccaccaaaccccacaguucuucccaaugaccucucuuccaaggccuucucuccuucccgccucuccuggcccgcaccucccuaaaguagguuggauagacgcaguaacauauauggaggugccuuuuagccuccaucaucccaccuccaacacuguuggagaaggaaggaggaauaggccaacuuuugccucgguuacagccugagccccauccccagcuucuacuacgggugcaccucgaauccucagaauagcgccccucuccagguugcccugcucaccauugguuccugcagaagcgggcucgccagcagcugcuucuggggaccucuagaaagcugcaaugaaccuggucgagggccagagacuggaucgcugcaggcuccaagacgguuuagacgagaaucccaucagggacggagaccagauacucaggcuggguugcagcgcagcggcgucuuaggcuggggucucucagcucggaugccgaacucaccuagcuuccgggccaggccucgcgcucuugccuucccacccuccagcaccacccucucacaucuacuccuuccuucucuuuucccucccucucuuucuucccuuccuccccagucuuuccccccagcggccccucccuucuucccuccucccuuaaucgccuccccuucuggggaugggagccccgcccacauccucccauccagccacggggccucgccucgccuggcaaggcccggguccggaagauugcacagcuccccagcccucaguugccaccuuggcugggaccgaugccuccagcucgggaagcagccggggcucaccuggggaccacgugcaagagguacuagaaagcaugcaccaacuagucucuguaccuuccaaaaauacccaugggagucugggcuucccugaguuuagaauaacugcugcccaaacugaugauuaaaacacugaguaaucaccauuuaccccgaguaauuagagauaaugaaacaccucuaaaaucagguuauggagaagggagcuguuggauugguuuaaaggguggccuuccguaaacuguuaaaggauuccca

SEQ ID NO: 10702 - RNA, 2501 nt, Mus musculus
ugggaauccuuuaacaguuuacggaaggccacccuuuaaaccaauccaacagcucccuucuccauaaccugauuuuagagguguuucauuaucucuaauuacucgggguaaauggugauuacucaguguuuuaaucaucaguuugggcagcaguuauucuaaacucagggaagcccagacucccauggguauuuuuggaagguacagagacuaguuggugcaugcuuucuaguaccucuugcacgugguccccaggugagccccggcugcuucccgagcuggaggcaucggucccagccaagguggcaacugagggcuggggagcugugcaaucuuccggacccgggccuugccaggcgaggcgaggccccguggcuggaugggaggaugugggcggggcucccauccccagaaggggaggcgauuaagggaggagggaagaagggaggggccgcuggggggaaagacuggggaggaagggaagaaagagagggagggaaaagagaaggaaggaguagaugugagaggguggugcuggagggugggaaggcaagagcgcgaggccuggcccggaagcuaggugaguucggcauccgagcugagagaccccagccuaagacgccgcugcgcugcaacccagccugaguaucuggucuccgucccugaugggauucucgucuaaaccgucuuggagccugcagcgauccagucucuggcccucgaccagguucauugcagcuuucuagagguccccagaagcagcugcuggcgagcccgcuucugcaggaaccaauggugagcagggcaaccuggagaggggcgcuauucugaggauucgaggugcacccguaguagaagcuggggauggggcucaggcuguaaccgaggcaaaaguuggccuauuccuccuuccuucuccaacaguguuggaggugggaugauggaggcuaaaaggcaccuccauauauguuacugcgucuauccaaccuacuuuagggaggugcgggccaggagaggcgggaaggagagaaggccuuggaagagaggucauugggaagaacugugggguuugguggguuugcuuccacuuagacuauaagagugggagaggagggagucaacucuaaguuucaacaccagugggggacugaggacugcuucauuaggagagagaaccuagccagagcuagcuuugcaaaagaggcuguaguccugcuuugcucuaaagcgcgacccgggauagagaggcuuccuugagcggggugucaccuaaucuuguccccaacgcacccccucccagccccugagagcuagcgaacuguagguacagaacucgcucccaucuccaggagcuauuuucuuagacaugggcacccaugcauucugccuucugguacucuccccucccugggaagggguguaagguucgacggaccguggccaggaugccgaaaggcuaccugugcgggucuucugccaugcugugucugugcggacaugccagcagggcuaaugaggagcuugcgauacuccaaaggguucgggaauugcgggguccuuacacgcaguggaguugggccccggggacucagaagguuucccgccacggcuuugguugauaguuuuuuuaguauccugguuuaugaacugaagguuuugugagauguugaaucacuagcagggucauauuuggcaaaccgaggcuacuauuaaauuuugguuuuagaagaagauucuggggagaaagugaaggguaacugccuccaggagcuguaucaaccccauuaagaaaaaaaaaaauaccaggagaugaaaauuuacuuugaucuguauuuuuuaauuaaaaaaaaucagggaagaaaggagugauuagaaagggauccuugugaaguugaaauugaaacaaguccuucgucuauuuacugggcuuuaacgucgagagcgcuccacacaccgccaaaggcacaggauuguccggggauccugagcgucggcgguuccacggugcccucgcuccgcgugcgccagucgcuagcauaucgccaucucuuucccccuuaaaagcaaauaaacaaaucaacaauaagcccuuugcccuuuccagcgcuuucccaguuauucccagcggcgacgcuggucggggaauagagaaaucgucucagaaagcugcgcugaugguggugagagcggacugucgcucaggggcgcccgcggucucugcacccagggcagcagugugggauggcgcugggcagccaccgccgccaggaaggacgugacucuccauccuuuacacuucuuucucaaagguuucccgaaagugccccccgccucgaaaacuggggccggugcgggggggggggagagguuagguugaaaaccagcuggacacgucgaguuccuaagugaggcaaagaggcgggguggagcgggcucuggagcgggggaguccugggacuccgguccucggauggaccccgugcaaagaccuguuggaacaa

SEQ ID NO: 10703 - RNA, 2501 nt, Mus musculus
ugcugauaacaaagcccauuggugagaaacaaagaaacaauucaagaaaucuaccucuucccagacuguugccuuucccuggcagagauuuuaauuaucuuagcugauuuuuuuuuaaauuauuaccacuuucaacugcugugaaccuaaaauguaaacgcauucaacauuuaaaacaccaacuugcugaacaacaaacuugugaaaacugcccaaucacuauuaucccacauuugaagucauuuccaguaaucauuuucaccuaauuaguagucuggauaauuagauuucgaaguaaguaacagauuuauuaggguuuuggaggaguuugauuacaugugucuaaagaacuauagcuaaacaaacaacuauuuaacuuuuaagcgacacccaucaaauauuuaauuuaaacauacugagagggaaaaaaaaaagucuuuucuucaagacuagcacagggcuugacagaaaugcuuaaguuagaauccuaacugaaguaaagucagauaaacugcugcccccacauuuugcaaguccagaggggugcauuccuacagcaagccgcuuccauguuuuuuaugucaggaggcuacagauccagcgggaaacacuuuuucuuggauuuuggguuggggggagagggggcugcaacgggagccaccuuucccauauauuuagguuugaagucaauaaacauccaaagcaauggaacuaaccgcacuucucucugcuuuuuaaauuuccuacaauuuuguaagaaaaggagcuggguggggggagaaaaagaaaagucaucuguguuccuuugcugaaccccuccccccaucgauguuaauacaggcaggcaauguguguaaggcuggcuuuuauuuuccaaaaauaaggcacuuaaagcgcucucucucucucucucucucucucucucucucucucucucucucucucucucucucugcuuugaaacuuugacacucugagaaacuuccucaaaauggcggauacaagacugaguucucugucacuucauaaaguucauuaaugaaaaaauuaagaccuuagguuuucauauuuaccuugcuuaagagacaaaggcaaagcuucacaaacaaaacucaacagcugugauuucuuccagauuuacauucagaacacaagucuuauuuccccacccuaaaaugugauuuuuauaaauguccuucuaagagaacuggauuguuaacgagugaaacuaguuacuuuugcgaagaacacuuuauauucuguguuccuucuuccaagaucuagcuauuuguaacugugaacguaagauucuuuaaaaacccagucguuccuuauuuaaauacccucuaaagaggaauucuuugaaaauacacucuuauucccuuggacaguucugaccuguuauauaugauguuaagaugggcauguauuuauuuacuagucuagcucucacccaauuagaucgccuaaacagaucauuugauaaaagcggcauguuccaggauaaaaagcaguaacagaaaguucggggcgagguccuucuuggagagucaaaacggcucaaauugucagggaaaacuauuuucacuuuuccuccuggagaugugggcggaauaaaacaaaacaaaaacaaaacaggaaaaccaaaacccaaaccacggucacuucuccacagcgagcuuagauaauaaacacggauagauaauaaagacggcugcggggcccuuccaccuaacuuucaccgcuugcuaaggauuccauucuagcuuccucuccacgcacagugcaaaggggaauggggguggggacucuuucuaagacacaagaguuaaggugaccgcucucgaggagagauggcuuccgagagcucauaccuaggagcaaauagcgauagcgcggcgacuccccgacugcucucuccuccaggagcaagcgacuggguccggcgucucugcccugcaguccggcagaucagcagcucugaugcccaagccccgucuccacugccugcgccggccugcacagccuuauaucuaacggucaauucgugcaaucugucgcuucccccuccagaucgcccccccuccuuggugguuuuuuuuccccuucuuccaagaagcccaucuaccaguugcuguguccucgcucaauaauaauuaccucguccgagaauuaauuauaauaaauguuuucuugauaaacuaacgagauaauccgaggggcacacgucccuuaauuacaggccgucgugcucagcucugcuucucguccuggcugauuaauuuucugcaugauagaaaggaaacaaaacuucgcugacuggcggcucggccugaggcaggggagaggaccgagagccggagggaaaggaagaaggagguacgcgggcauuuggaaaacagccggcgccaggcccgccaacucgagugaaaguuucuggccucggggaaucaacaucaccacccgcgagggagggagaaagaaaugugccaaaggguugc

SEQ ID NO: 10704 - RNA, 2501 nt, Mus musculus
gcaacccuuuggcacauuucuuucucccucccucgcggguggugauguugauuccccgaggccagaaacuuucacucgaguuggcgggccuggcgccggcuguuuuccaaaugcccgcguaccuccuucuuccuuucccuccggcucucgguccucuccccugccucaggccgagccgccagucagcgaaguuuuguuuccuuucuaucaugcagaaaauuaaucagccaggacgagaagcagagcugagcacgacggccuguaauuaagggacgugugccccucggauuaucucguuaguuuaucaagaaaacauuuauuauaauuaauucucggacgagguaauuauuauugagcgaggacacagcaacugguagaugggcuucuuggaagaaggggaaaaaaaaccaccaaggagggggggcgaucuggagggggaagcgacagauugcacgaauugaccguuagauauaaggcugugcaggccggcgcaggcaguggagacggggcuugggcaucagagcugcugaucugccggacugcagggcagagacgccggacccagucgcuugcuccuggaggagagagcagucggggagucgccgcgcuaucgcuauuugcuccuagguaugagcucucggaagccaucucuccucgagagcggucaccuuaacucuugugucuuagaaagaguccccacccccauuccccuuugcacugugcguggagaggaagcuagaauggaauccuuagcaagcggugaaaguuagguggaagggccccgcagccgucuuuauuaucuauccguguuuauuaucuaagcucgcuguggagaagugaccgugguuuggguuuugguuuuccuguuuuguuuuuguuuuguuuuauuccgcccacaucuccaggaggaaaagugaaaauaguuuucccugacaauuugagccguuuugacucuccaagaaggaccucgccccgaacuuucuguuacugcuuuuuauccuggaacaugccgcuuuuaucaaaugaucuguuuaggcgaucuaauugggugagagcuagacuaguaaauaaauacaugcccaucuuaacaucauauauaacaggucagaacuguccaagggaauaagaguguauuuucaaagaauuccucuuuagaggguauuuaaauaaggaacgacuggguuuuuaaagaaucuuacguucacaguuacaaauagcuagaucuuggaagaaggaacacagaauauaaaguguucuucgcaaaaguaacuaguuucacucguuaacaauccaguucucuuagaaggacauuuauaaaaaucacauuuuaggguggggaaauaagacuuguguucugaauguaaaucuggaagaaaucacagcuguugaguuuuguuugugaagcuuugccuuugucucuuaagcaagguaaauaugaaaaccuaaggucuuaauuuuuucauuaaugaacuuuaugaagugacagagaacucagucuuguauccgccauuuugaggaaguuucucagagugucaaaguuucaaagcagagagagagagagagagagagagagagagagagagagagagagagagagagagagagcgcuuuaagugccuuauuuuuggaaaauaaaagccagccuuacacacauugccugccuguauuaacaucgauggggggagggguucagcaaaggaacacagaugacuuuucuuuuucuccccccacccagcuccuuuucuuacaaaauuguaggaaauuuaaaaagcagagagaagugcgguuaguuccauugcuuuggauguuuauugacuucaaaccuaaauauaugggaaagguggcucccguugcagcccccucuccccccaacccaaaauccaagaaaaaguguuucccgcuggaucuguagccuccugacauaaaaaacauggaagcggcuugcuguaggaaugcaccccucuggacuugcaaaaugugggggcagcaguuuaucugacuuuacuucaguuaggauucuaacuuaagcauuucugucaagcccugugcuagucuugaagaaaagacuuuuuuuuuucccucucaguauguuuaaauuaaauauuugaugggugucgcuuaaaaguuaaauaguuguuuguuuagcuauaguucuuuagacacauguaaucaaacuccuccaaaacccuaauaaaucuguuacuuacuucgaaaucuaauuauccagacuacuaauuaggugaaaaugauuacuggaaaugacuucaaaugugggauaauagugauugggcaguuuucacaaguuuguuguucagcaaguugguguuuuaaauguugaaugcguuuacauuuuagguucacagcaguugaaagugguaauaauuuaaaaaaaaaucagcuaagauaauuaaaaucucugccagggaaaggcaacagucugggaagagguagauuucuugaauuguuucuuuguuucucaccaaugggcuuuguuaucagca

SEQ ID NO: 10705 - RNA, 2501 nt, Mus musculus
cggugaaggcgaaacgaagcugcacaaggaggcuucccuuccucagagcucucaucugccugaggacuuuuguagcuccugaagaggccgagugaaggaccuagacaguaggguggccauucuccagcuucacaucccuugauucauuucugucuuuccauuuagucuuuagucgucugucacacucuuuagccacugagcacccacccuaagcuggacgauggggugggggcuggaaacaacagacaagguuuauagucuuggacacuggagcagaaguccucuggcucucagggucccugccuccugccacucucaacuccuuuaucugcagcccccugccuccacaccgcccucugaaaccuuuucuuccgucccccugacugcucuguucugcccguaugccaagcugugccuaugcagggaguaugcucccagagggaagugacacaaagaaaaaggagggagacagaaggagggaaucccgcuuacaucacugcucauuagcauaugugaccucaucaggaggcgggacaauuuccccaggugucuggagcggggagggguggggaauaugaugggggggggcaguauuuaaagggaaaagcugacagugcugcugagugaggaaccggugcucugagccgcugggcugcacucgcacaugcacgccgaugcacacggaccuugacaccgacauggacauggacacagaaaccguagcacuuuguucuuccagcagccgccaggccuccccacuggggacacccacaccaggugagggcuaaggggaguaggauguggcuaaagcugugggugggggagcugaagcuuuggugggaaggucugggcaggauccaacgagaagggaagagcaaaugcggcaagggagaccccugcacuuuugagguccggacggccaaggggaagggggaaagcugccagggugccccucccccaacgcucccagggcuucgccagagaaacuggcacuuggccccuagguuaaccucagcccuguuaggcagagccugccagaagggaagggggaagaaaagaagcagcccacaaaccuaggaauccccagcuaagggggcuucccuggggaccuguuguaagggcuucuucuagcuccaucguuggcugccugccaaauauugauccugugcuauuuauagccucgcuccaucccccuuuguugugucuguuguuguuccucuaguuaccccaaccccugaauugucauccuccucacacacacucuccaccgcuaccuccccacgaacacaacauugucucccacucgccaggacaggcaaggauccaggaggauucucucucacacacaaacacucacgcaugcgaugcucaccuaccuacggggacacaggaaacaguacgcuccccuucuuuagcccuccucccccagaccuagaaauaaggucccugcggaguuucugauucugccuacaccugccagucugggacuggggugcaggaagaaauaggaggcagggcccauuagagggaagauauagcuucccaacucacuaggccuaauguaggggcgugccuaugacgguguaaggugugagugguguguaacccugugcacaggaccucccucagugacacaaguuuugaucauguuguggcuaggaucaacaugggaaacuaucaugccagcgccuugaaaguucauugcuuuugaguuucaggggaauuuuuagugcacaaggcuagacuaaugacucucagcucuuuuggggucacgcucuuuaucuggguguagcugaagaagcagccugaauuaaccgcucauccgaugucuagauauaucucacccauggcuuccuucucucccccucccuagaagcagauacuacacuucugaaacagaagccagagaaacuguuagcagaguuggaccugagcgggccuccuccugcuccugggguccccagacgaagaggaagcaugcccgugcccuacaaacaccagcugcggcgggcccaagcuguagaugaacuugacuggccaccccaggccucccccucuggcuccucugacuccuugggcucaggggaggcagcccuuacccaaaaagauggcgucuuuaaggucaugcucgugggggagaguggcgugggcaagagcacucuagcgggcacuuuuggaggucuccagggagaccaugcucacgagauggagaacucagguauucaggggcacccuggagggcucuagucaggcaugaaaguguuugcauugugaacagucccuggaggacagaaucuaagagaaauuucuccauugcuuucuaugaaguuugccuggaggcgacucccuaaugucaggagguguuccuggacaccaggucucacacguguuggggaaucuccucauguuuucuuccuucuuucccaacagaggacaccuaugagagacggaucaugguggacaaagaagaagugacuuuaauuguuuaugacaucugggaa

SEQ ID NO: 10706 - RNA, 2501 nt, Mus musculus
uucccagaugucauaaacaauuaaagucacuucuucuuuguccaccaugauccgucucucauagguguccucuguugggaaagaaggaagaaaacaugaggagauuccccaacacgugugagaccugguguccaggaacaccuccugacauuagggagucgccuccaggcaaacuucauagaaagcaauggagaaauuucucuuagauucuguccuccagggacuguucacaaugcaaacacuuucaugccugacuagagcccuccagggugccccugaauaccugaguucuccaucucgugagcauggucucccuggagaccuccaaaagugcccgcuagagugcucuugcccacgccacucucccccacgagcaugaccuuaaagacgccaucuuuuuggguaagggcugccuccccugagcccaaggagucagaggagccagagggggaggccugggguggccagucaaguucaucuacagcuugggcccgccgcagcugguguuuguagggcacgggcaugcuuccucuucgucuggggaccccaggagcaggaggaggcccgcucagguccaacucugcuaacaguuucucuggcuucuguuucagaaguguaguaucugcuucuagggagggggagagaaggaagccaugggugagauauaucuagacaucggaugagcgguuaauucaggcugcuucuucagcuacacccagauaaagagcgugaccccaaaagagcugagagucauuagucuagccuugugcacuaaaaauuccccugaaacucaaaagcaaugaacuuucaaggcgcuggcaugauaguuucccauguugauccuagccacaacaugaucaaaacuugugucacugagggagguccugugcacaggguuacacaccacucacaccuuacaccgucauaggcacgccccuacauuaggccuagugaguugggaagcuauaucuucccucuaaugggcccugccuccuauuucuuccugcaccccagucccagacuggcagguguaggcagaaucagaaacuccgcagggaccuuauuucuaggucugggggaggagggcuaaagaaggggagcguacuguuuccuguguccccguagguaggugagcaucgcaugcgugaguguuugugugugagagagaauccuccuggauccuugccuguccuggcgagugggagacaauguuguguucguggggagguagcgguggagagugugugugaggaggaugacaauucagggguugggguaacuagaggaacaacaacagacacaacaaagggggauggagcgaggcuauaaauagcacaggaucaauauuuggcaggcagccaacgauggagcuagaagaagcccuuacaacagguccccagggaagcccccuuagcuggggauuccuagguuugugggcugcuucuuuucuucccccuucccuucuggcaggcucugccuaacagggcugagguuaaccuaggggccaagugccaguuucucuggcgaagcccugggagcguugggggaggggcacccuggcagcuuucccccuuccccuuggccguccggaccucaaaagugcaggggucucccuugccgcauuugcucuucccuucucguuggauccugcccagaccuucccaccaaagcuucagcucccccacccacagcuuuagccacauccuacuccccuuagcccucaccugguguggguguccccaguggggaggccuggcggcugcuggaagaacaaagugcuacgguuucuguguccauguccaugucggugucaagguccgugugcaucggcgugcaugugcgagugcagcccagcggcucagagcaccgguuccucacucagcagcacugucagcuuuucccuuuaaauacugcccccccccaucauauuccccaccccuccccgcuccagacaccuggggaaauugucccgccuccugaugaggucacauaugcuaaugagcagugauguaagcgggauucccuccuucugucucccuccuuuuucuuugugucacuucccucugggagcauacucccugcauaggcacagcuuggcauacgggcagaacagagcagucagggggacggaagaaaagguuucagagggcgguguggaggcagggggcugcagauaaaggaguugagaguggcaggaggcagggacccugagagccagaggacuucugcuccaguguccaagacuauaaaccuugucuguuguuuccagcccccaccccaucguccagcuuagggugggugcucaguggcuaaagagugugacagacgacuaaagacuaaauggaaagacagaaaugaaucaagggaugugaagcuggagaauggccacccuacugucuagguccuucacucggccucuucaggagcuacaaaaguccucaggcagaugagagcucugaggaagggaagccuccuugugcagcuucguuucgccuucaccg

SEQ ID NO: 10707 - RNA, 2501 nt, Mus musculus
aacucacaacaauacacagaacauaggcggucaaccuaaucuaaaagcgcauuaaucaaaaaacuacagcaugugcagguuguuaaugugaaguacaaagauaauauuuuuaaaaucagcagucucaaucuuagccuucucccuugcuuccuucuccuacaauucaauccguaacuuugcucacuccuccugucuagaccugcacuuuuagaccacaccccaagccaagucacuccuggcaccccucuuuccuacuucacugccccuuucuggcuacuacucacuuagccccacccaaagagucuuccucucuuuuggacugcguuggaacacagacugucccaccccaacagugaagggagguguggggguuuucagccucacccucaggaagaugcucccccgccccgccuccuuugcucugcucugugguacuuccucucuggcugacuuagcugacagaccuagaagugggaccaggacccuggcacuaagacagauucaaggauuguauauccaacaacuagacaagacauuaccuucugaucagcaucagggaaacccuguaaguauccuaggaaugauaugguguguguguguguguguauuugaauauguuuauguguaugugugugaguaugucaguaugguguguguguuuauguaugcgucaguguguugugugugagagagucaguauggugucugugugugugugugugugugugugugugugugugguguguguguaugugugugugaguguguuuaugugugugugugaauguaugucaguauguuguguguguuuaugaaugugagugucaguguguuaugggugaguauguaugugagugugugugugugugugagugugugugugugugugugaguaugguguguguguuugaguguguaugugaaugucaguguguugugggugagugugugugugugucaguauggugugugugucaauuauaacuugaagagauggugagacagaauccccaaagaaagcccgaccucuguaaagggaugguucuuguccauuaacucuucccugcccugcucuuccuggugccccauggucagcucuagagaguguggguaggugacuggagaaaguggacaguggccucuugggagauagaggaguuagccuuucaaggcgugcacagugcugaggaaagucucccagccuggugcuggguuccaggcucucuuaaggaaacgagugugaaggguuuuggaaauacugcuguugcuguacauuuugcaacugggucugaagcaaagaaggggccccacagccugguuaggaaauuagucuuucuauucaaccaggcgccuuuaagacaaugagguuggcagggcgugguggugcacgccuuuaaucccagcacuugggaggcagaggcaggcaaauuucugaguucgaggccagccuggucuacagagugaguuccaggacagccaggacuacacagagaaacccugucucaaaaaaccaaaaaaaaaaaaaaaaaaaaaaaaaaaaaaaaaaagagcaaugagguugacagugauggggugacauauuuugaaggugccucugaaacuucugauuuuggagaccagaguacuccaugcuaguuugauguggcugggggucaagaauccuuuggcuuuccccucauggguguguccacuuucacucucuagguccuuuugauggcugcaaacacuacaucuccugcagcaccuucuucuccugguggcaugucccugucucuguugcccauuguucuacugucuguggcccuggcuguggggcuuccuggcaauagcuuuguaguguggagcauccugaaaaggaugcagaaacgcacggucaccgcccugcuggugcugaacuuggcccuggccgacuuggcuguguugcucacugcucccuuuuuccuccacuuucuggcucgaggcaccuggaguuuuagagagauggguugccgccugugccacuaugucuguggaauaagcauguaugccaguguccugcuuauaaccaucaugagucuggaccgaucacuggcaguggcccgccccuuuaugucccaaaagguucguacuaaggccuuugcccgaugggugcuggcaggcaucuggguggugucuuuucugcuggccauaccgguccuuguguaccguacaguaaaauggaacaacaggacucugaucugcgcuccgaacuaucccaacaaagagcauaaagucuuccaucugcucuucgaagccaucacgggcuuccugcugcccuuccuagcggugguggccagcuacucugacaucgggcgcaggcugcaggcucggcgcuuccgccguagucgccgcaccggccgccugguggugcucauuauccuggccuucgccgccuucuggcugccuuaccaccuggugaaccugguggaagccggccgcacaguggccggcugggacaagaacagcccugcggggcagcgucu

SEQ ID NO: 10708 - RNA, 2501 nt, Mus musculus
agacgcugccccgcagggcuguucuugucccagccggccacugugcggccggcuuccaccagguucaccaggugguaaggcagccagaaggcggcgaaggccaggauaaugagcaccaccaggcggccggugcggcgacuacggcggaagcgccgagccugcagccugcgcccgaugucagaguagcuggccaccaccgcuaggaagggcagcaggaagcccgugauggcuucgaagagcagauggaagacuuuaugcucuuuguugggauaguucggagcgcagaucagaguccuguuguuccauuuuacuguacgguacacaaggaccgguauggccagcagaaaagacaccacccagaugccugccagcacccaucgggcaaaggccuuaguacgaaccuuuugggacauaaaggggcgggccacugccagugaucgguccagacucaugaugguuauaagcaggacacuggcauacaugcuuauuccacagacauaguggcacaggcggcaacccaucucucuaaaacuccaggugccucgagccagaaaguggaggaaaaagggagcagugagcaacacagccaagucggccagggccaaguucagcaccagcagggcggugaccgugcguuucugcauccuuuucaggaugcuccacacuacaaagcuauugccaggaagccccacagccagggccacagacaguagaacaaugggcaacagagacagggacaugccaccaggagaagaaggugcugcaggagauguaguguuugcagccaucaaaaggaccuagagagugaaaguggacacacccaugaggggaaagccaaaggauucuugacccccagccacaucaaacuagcauggaguacucuggucuccaaaaucagaaguuucagaggcaccuucaaaauaugucaccccaucacugucaaccucauugcucuuuuuuuuuuuuuuuuuuuuuuuuuuuuuuuuuuugguuuuuugagacaggguuucucuguguaguccuggcuguccuggaacucacucuguagaccaggcuggccucgaacucagaaauuugccugccucugccucccaagugcugggauuaaaggcgugcaccaccacgcccugccaaccucauugucuuaaaggcgccugguugaauagaaagacuaauuuccuaaccaggcuguggggccccuucuuugcuucagacccaguugcaaaauguacagcaacagcaguauuuccaaaacccuucacacucguuuccuuaagagagccuggaacccagcaccaggcugggagacuuuccucagcacugugcacgccuugaaaggcuaacuccucuaucucccaagaggccacuguccacuuucuccagucaccuacccacacucucuagagcugaccauggggcaccaggaagagcagggcagggaagaguuaauggacaagaaccaucccuuuacagaggucgggcuuucuuuggggauucugucucaccaucucuucaaguuauaauugacacacacaccauacugacacacacacacacucacccacaacacacugacauucacauacacacucaaacacacacaccauacucacacacacacacacacacucacacacacacacacacucacauacauacucacccauaacacacugacacucacauucauaaacacacacaacauacugacauacauucacacacacacauaaacacacucacacacacauacacacacaccacacacacacacacacacacacacacacacacagacaccauacugacucucucacacacaacacacugacgcauacauaaacacacacaccauacugacauacucacacacauacacauaaacauauucaaauacacacacacacacacaccauaucauuccuaggauacuuacaggguuucccugaugcugaucagaagguaaugucuugucuaguuguuggauauacaauccuugaaucugucuuagugccaggguccuggucccacuucuaggucugucagcuaagucagccagagaggaaguaccacagagcagagcaaaggaggcggggcgggggagcaucuuccugagggugaggcugaaaacccccacaccucccuucacuguuggggugggacagucuguguuccaacgcaguccaaaagagaggaagacucuuuggguggggcuaagugaguaguagccagaaaggggcagugaaguaggaaagaggggugccaggagugacuuggcuugggguguggucuaaaagugcaggucuagacaggaggagugagcaaaguuacggauugaauuguaggagaaggaagcaagggagaaggcuaagauugagacugcugauuuuaaaaauauuaucuuuguacuucacauuaacaaccugcacaugcuguaguuuuuugauuaaugcgcuuuuagauuagguugaccgccuauguucuguguauuguugugaguu

SEQ ID NO: 10709 - RNA, 2501 nt, Mus musculus
ggaaccccagcaaugaaucauuaacuccuucaguuuuuccaagccgggagucucagggcuaccuggaggcagcucugucaguggaggacgacucugccugucacacacuguuucccggauuagugaagucuugucuaccacuggaguugggggauaacauaaggaauucaugaaaugaggggacagcccauucuaucgcggacaggagcagggagagucauccaagugagaggugaggugggaagagggcaguguguuagugggucaggguaaaagggagggcuccagggggguuuaggugcuuucggguacuccauuuggagucuuacacucagcuucucugccagccagcacugcccacacgaggaucccaaagcuguacagacacaaauggaggcuuagauggccucuggcgagacuucuuuccuguaucauucccuuuagaagggcccaaauugguauagagauuuggaguguguuugggguggaugguuuaccuguagacaucacucgcuuuagaagccuucagguugacaucaaauaacagcucuggguccaaguacgcuagggugcccccagagucccuggauccugauccugauccugacccugacugggacccucccugaaacguggacaggccaaaaucugcuagcuguaaaggaaaggaaagggaagguauuagaugaaggggggggucagagauuuuucccucucuugcuccccagaagaugcagcagccucagcuuuuuggaagguguuauggaggaccagagggaagguaaagucauugagaacuuagcaggagaucugaguugcugaugggcaggccugagauaagucagccuggguccgugagggugcauuaggccuguggaacugagccaggggguuaagaagggcgucugguaaggagggucaccugguaugacuagaaauaaaacuccuaguugggucuugucauguguguagucuuguauucagagggacagguacucaacauggucccaagucuacacuagguuguagauggacuaaccuuggcguggagcucuggauccagcagaauguuagagggcuugaggucccggugcaggagcggaggguucaagcuguguagguagcacauccccagcaccacuuccugcagcaggcgacagaggaguggccagggccgagggcacucggguugcagcagcccugcgagggagccauucuccaugaaucuugucaccagagccugcccggacacgaagucccacuggagguccucagugacccccagcaggagcagaacguucucauuacgaagauuaaccauagccuucaccucccaggauaucuucuuccuacacgccgaaagggggccaaaauuggauugcgcucuggaagaccccacccuugccccacucaggcucgugaccacacucugacuacagcuggggucacucacgaguucacgaucuugacugcuacaucaugguuccauguucuguggugugcccggaacacgacuccgaacccuccuuuacccacaaacuccagcuucuucaguucuucacggcucaccagaggaaccgcugacgcaccaguaggccugagaaagguucuuguccgguagggggcccaucccccagccuagcgcauccucugucucccaagcuccgggauuccgugacugcgcgugggcagcguaggcagcgagucuagccuccccacugcugcccgccucacccccagcuuuguccccugccucagaaaaggcguccuuugaguguguccccgggccaccugugugggugugccggagacacagcucacuccccacucaccauaacuugacagaagacaucgucgggagcuagcggcuuccuggaguuaugugugcacagacggagcuggaaacccgacgucuacggcucggaguguggacugagaggaaggcagggucugcaaagggaacaaucaguaggucaaggcacggagguucaggccccgaauuccgcuucccaggucgcucccccggacuuugaaugagcgacuucacaacuucccuuucaaauaagaggcuccuucuaucuccgcccccugggguggagcauugaaaacuuuggggcuauuuccugugcacgugccuugaaacugcuuccacccgagaagcgcccaggcacugggcgugccacaaaagguguccucaccauccaggaacgauugacuccccacgauagccagucucucuuggaccccuuagcuccaccgcuugccaaccacauuuugaugaagggaggauggagaucaggaggauuuuaugguccuaagaucacggaguaacgcuucuaguaaggguugucuugggccagguacacauacuggcuucuuagaucaaccguguuuucuuuucuauagaggaggaaacccaaguacuuaaaguuuaaaucgcuuggccaaguaaguaugggacuaguuuagaaccgaguucugcuccaccaagguagcccuua

SEQ ID NO: 10710 - RNA, 2501 nt, Mus musculus
uaagggcuaccuugguggagcagaacucgguucuaaacuagucccauacuuacuuggccaagcgauuuaaacuuuaaguacuuggguuuccuccucuauagaaaagaaaacacgguugaucuaagaagccaguauguguaccuggcccaagacaacccuuacuagaagcguuacuccgugaucuuaggaccauaaaauccuccugaucuccauccucccuucaucaaaaugugguuggcaagcgguggagcuaagggguccaagagagacuggcuaucguggggagucaaucguuccuggauggugaggacaccuuuuguggcacgcccagugccugggcgcuucucggguggaagcaguuucaaggcacgugcacaggaaauagccccaaaguuuucaaugcuccaccccagggggcggagauagaaggagccucuuauuugaaagggaaguugugaagucgcucauucaaaguccgggggagcgaccugggaagcggaauucggggccugaaccuccgugccuugaccuacugauuguucccuuugcagacccugccuuccucucaguccacacuccgagccguagacgucggguuuccagcuccgucugugcacacauaacuccaggaagccgcuagcucccgacgaugucuucugucaaguuauggugaguggggagugagcugugucuccggcacacccacacagguggcccggggacacacucaaaggacgccuuuucugaggcaggggacaaagcugggggugaggcgggcagcaguggggaggcuagacucgcugccuacgcugcccacgcgcagucacggaaucccggagcuugggagacagaggaugcgcuaggcugggggaugggcccccuaccggacaagaaccuuucucaggccuacuggugcgucagcgguuccucuggugagccgugaagaacugaagaagcuggaguuuguggguaaaggaggguucggagucguguuccgggcacaccacagaacauggaaccaugauguagcagucaagaucgugaacucgugagugaccccagcuguagucagaguguggucacgagccugaguggggcaaggguggggucuuccagagcgcaauccaauuuuggcccccuuucggcguguaggaagaagauauccugggaggugaaggcuaugguuaaucuucguaaugagaacguucugcuccugcugggggucacugaggaccuccagugggacuucguguccgggcaggcucuggugacaagauucauggagaauggcucccucgcagggcugcugcaacccgagugcccucggcccuggccacuccucugucgccugcugcaggaaguggugcuggggaugugcuaccuacacagcuugaacccuccgcuccugcaccgggaccucaagcccucuaacauucugcuggauccagagcuccacgccaagguuaguccaucuacaaccuaguguagacuugggaccauguugaguaccugucccucugaauacaagacuacacacaugacaagacccaacuaggaguuuuauuucuagucauaccaggugacccuccuuaccagacgcccuucuuaacccccuggcucaguuccacaggccuaaugcacccucacggacccaggcugacuuaucucaggccugcccaucagcaacucagaucuccugcuaaguucucaaugacuuuaccuucccucugguccuccauaacaccuuccaaaaagcugaggcugcugcaucuucuggggagcaagagagggaaaaaucucugaccccccccuucaucuaauaccuucccuuuccuuuccuuuacagcuagcagauuuuggccuguccacguuucagggagggucccagucagggucaggaucaggaucaggauccagggacucugggggcacccuagcguacuuggacccagagcuguuauuugaugucaaccugaaggcuucuaaagcgagugaugucuacagguaaaccauccaccccaaacacacuccaaaucucuauaccaauuugggcccuucuaaagggaaugauacaggaaagaagucucgccagaggccaucuaagccuccauuugugucuguacagcuuugggauccucgugugggcagugcuggcuggcagagaagcugaguguaagacuccaaauggaguacccgaaagcaccuaaaccccccuggagcccucccuuuuacccugacccacuaacacacugcccucuucccaccucaccucucacuuggaugacucucccugcuccuguccgcgauagaaugggcuguccccucauuucaugaauuccuuauguuaucccccaacuccagugguagacaagacuucacuaauccgggaaacagugugugacaggcagagucguccuccacugacagagcugccuccagguagcccugagacucccggcuuggaaaaacugaaggaguuaaugauucauugcugggguucc

SEQ ID NO: 10711 - RNA, 2501 nt, Mus musculus
acagaugauaaaggaaaaggcauuguucuuuguggacaugggggacgcauguguuaauuuuugaagcugcgauccuaggaaaagcugggcuagaggaagaagaaccugagguggugagaaucaacgcacugggauccaaagcccauaauuaugaauuucauuuuuuucuuucgccucgaggcugcgaugaaggcucuugcuacacaaaaaccuauguggcacccaggauauuauauaagcccuuggcaggaggggagauaguccgguuugugcgcuucagccgccgcaguugcaguagccacagcgcagcagcgagagccgcucagguugauuuagaacgcgggugacaguggccuggcgcgagccuacggcugacgacagcggcugaucccacucgguuuccauggagacgggcaggagccgcggcggcggcgcggcugucagcgagcgcggcggcggcgcgcgcgcgggggucugcgggaggcaggagcaggccggggcccucgcugcagacauggacucgcauugugagugcgccgcggagacgcccgccgcagagccgccgucggggaagaucaauaaggcugcguucaaguuauucaagaaaaggaaaucggggggcaccaugcccagcauuuuuggggucaaaaacaaaggggaugggaagagcucggggccgacgggaauggugagaagcaggacccacgacggacuagccgagguguuggugcuggagggcagcaagaaggaggagccgccuggcgggagcgaucacagcggggcccggccgauccccggaccccccaaacccuccgggccuggccugggcucccuggccagcagcucgguggccaagucccacagcuucuucucccugcugaaaaagaacgggcgaucggagaccggcaagggagaccaugccgaggcgagcaaggcuggcggcaaacaaaagagggggcugaaagggaucuucagcagcaugcgcuggcaccggagggacaagcgcggcaaggaggaggaggagaaggcggugcgcgcggcgggcccgggcaaccugguucugcccgguucgcucaccgccagccuggagugcgucaaggaggagccgccccgagccgcgcgccgcccggacagcccgggccaggacgccucgcgacacgcagcaggugagcccgcagggggagagcaggcgcccgcguccgccgagagcgccccggagcggaucugccucgaggccgggagccccaccggcucuggcgaucaaagcucccggggagaggacgccgaggggcaucggcgcgaggagaagcccggggcagcccucgagucgggagccggugagguccaggcggccgaggaugcguccaagacaggugacguuccgauaaagaccgucccccuugucgacuccgaagguggcagcggccgggcgucugcugucccugacccuuccucuguugauccacccucagacccgucggcagaucguauuuguuugauguuuucugacgugacuucacugaaaagcuuugacucucuuacaggcuguggagauauuauugcagacccagaagaagaggcaggccccagcugugacaagcauguccccgggccaggcaagccaguucucucuaaaaagaacgccagcgugguggccuaccaaggaggaggggaggagauggccagcccggaucagguggacgacaccuaucucccggaauucugggacauguugucccagacugaggaccaaggacaaggaacucaagaaggcgcagcgaaggcagccacugcuuccgacaucaaguuggccccugagaccuccagugauacccgguguggggaagcagccaaggacauguccucggucaagcgcaggaggcuccacagaauucccauugagucccagcagaaggaggagcccaaacauccggagaaggagcaucaagaagguguuccuaacagcgaugagggcuacugggacuccaccaccccuggcccagaagaagagagcaucagcaacagcagcagcagcaagaagguggucauccccagggauagcgacaguggcgaugcucucugcgaucucuacguugaaccugaagcaagcccagccacccuuccugccacagaggacccacccugcuugucccggcuaaagccggugucuccaggcaccaucacguguccucugagaacaccgggcagcuugcugaaggacucuaaaaucccuauuagcaucaagcaucucuccaaccuuccguccagccauccgguggugcaccagcaaccagccaggagugaggugcccagaacaaaaaucccuguuuccaaagugcugguccguagggucagcaaccggggcuuggcugggaccaccaucagggcagcagcaugccaugacagugccaaaaaguugugagguccccaaggccaaggaggauggaugggccauauguuaaggaauacaacuuuccccuggaaaccacugaaggaaguuc

SEQ ID NO: 10712 - RNA, 2501 nt, Mus musculus
gaacuuccuucagugguuuccaggggaaaguuguauuccuuaacauauggcccauccauccuccuuggccuuggggaccucacaacuuuuuggcacugucauggcaugcugcugcccugaugguggucccagccaagccccgguugcugacccuacggaccagcacuuuggaaacagggauuuuuguucugggcaccucacuccuggcugguugcuggugcaccaccggauggcuggacggaagguuggagagaugcuugaugcuaauagggauuuuagaguccuucagcaagcugcccgguguucucagaggacacgugauggugccuggagacaccggcuuuagccgggacaagcaggguggguccucuguggcaggaaggguggcugggcuugcuucagguucaacguagagaucgcagagagcaucgccacugucgcuaucccuggggaugaccaccuucuugcugcugcugcuguugcugaugcucucuucuucugggccaggggugguggagucccaguagcccucaucgcuguuaggaacaccuucuugaugcuccuucuccggauguuugggcuccuccuucugcugggacucaaugggaauucuguggagccuccugcgcuugaccgaggacauguccuuggcugcuuccccacaccggguaucacuggaggucucaggggccaacuugaugucggaagcaguggcugccuucgcugcgccuucuugaguuccuuguccuugguccucagucugggacaacaugucccagaauuccgggagauaggugucguccaccugauccgggcuggccaucuccuccccuccuccuugguaggccaccacgcuggcguucuuuuuagagagaacuggcuugccuggcccggggacaugcuugucacagcuggggccugccucuucuucugggucugcaauaauaucuccacagccuguaagagagucaaagcuuuucagugaagucacgucagaaaacaucaaacaaauacgaucugccgacgggucugaggguggaucaacagaggaagggucagggacagcagacgcccggccgcugccaccuucggagucgacaagggggacggucuuuaucggaacgucaccugucuuggacgcauccucggccgccuggaccucaccggcucccgacucgagggcugccccgggcuucuccucgcgccgaugccccucggcguccucuccccgggagcuuugaucgccagagccgguggggcucccggccucgaggcagauccgcuccggggcgcucucggcggacgcgggcgccugcucucccccugcgggcucaccugcugcgugucgcgaggcguccuggcccgggcuguccgggcggcgcgcggcucggggcggcuccuccuugacgcacuccaggcuggcggugagcgaaccgggcagaaccagguugcccgggcccgccgcgcgcaccgccuucuccuccuccuccuugccgcgcuugucccuccggugccagcgcaugcugcugaagaucccuuucagcccccucuuuuguuugccgccagccuugcucgccucggcauggucucccuugccggucuccgaucgcccguucuuuuucagcagggagaagaagcugugggacuuggccaccgagcugcuggccagggagcccaggccaggcccggaggguuugggggguccggggaucggccgggccccgcugugaucgcucccgccaggcggcuccuccuucuugcugcccuccagcaccaacaccucggcuaguccgucguggguccugcuucucaccauucccgucggccccgagcucuucccauccccuuuguuuuugaccccaaaaaugcugggcauggugccccccgauuuccuuuucuugaauaacuugaacgcagccuuauugaucuuccccgacggcggcucugcggcgggcgucuccgcggcgcacucacaaugcgaguccaugucugcagcgagggccccggccugcuccugccucccgcagacccccgcgcgcgcgccgccgccgcgcucgcugacagccgcgccgccgccgcggcuccugcccgucuccauggaaaccgagugggaucagccgcugucgucagccguaggcucgcgccaggccacugucacccgcguucuaaaucaaccugagcggcucucgcugcugcgcuguggcuacugcaacugcggcggcugaagcgcacaaaccggacuaucuccccuccugccaagggcuuauauaauauccugggugccacauagguuuuuguguagcaagagccuucaucgcagccucgaggcgaaagaaaaaaaugaaauucauaauuaugggcuuuggaucccagugcguugauucucaccaccucagguucuucuuccucuagcccagcuuuuccuaggaucgcagcuucaaaaauuaacacaugcgucccccauguccacaaagaacaaugccuuuuccuuuaucaucugu

SEQ ID NO: 10713 - RNA, 2501 nt, Mus musculus
uuaaauucagcagacuuaaaaaaaacaaaaacaaaacaaaacuaaaacuaaaaccaaaccaaaacaaaaacgagcaggcccagcucgaagacucugggugguuaguuuuuccuggggucgcaauuauccguaaagucuuguguaacugaacugcgcagcugaaagagcagagguggaucuuaucucgaccauuuucucccccacccucccucuuuuguuggauaacugccgaaugcaacuaggccucuuauuuucuuacacucaacuguaccucaagccacccugccuccccuuuaagccugaaauuaaagaccuggaguuaggguacaccaucaacgcgacuccagccccccuccccagucugugcaaagagagccccagccagcuuucaagucagucacugcuguagagagagaccaagucuuccggagcaccaucccgccugcgcagucuguagucacaguuugccccugaggugaagugacgugcucagguccccuucaauggagacucaagcagucucugaaagcgcaagcuuccuuuucgcucgccgggcaaacgugcaccccaggcgcuguguccucuagcggcgaacucucgcagcucgucugugagcgcucaccuacagcuaggggguccggucaggagucaauugacacucaaaccugagcccugagccgggaggaaagacucccgacuguaaugaugcugagaggcucgggugcagucgcucgaaccgcggcgcagcugauugucugcuccacggcagauggucuuugagcacagauuugcauucauugucuucaaaucuguuuucgcgcuggcguucuagauuucaacagcagaucuacgcgcagaucagaauacaaaaagagaagcaagaaaauaacacccagccaggaggauuuuuuuuuaauaggcaccuccagccgucuaggguuucagcuauuuuguggagccucggcuucccgaccaccaaccuucgcgaccacagcgcucggcggacaaaguuuccaggacuucuucacagacgccucgugucucuaacgcaggguuccccggccuucagggauuggggagggagauuuuaaaaggggggaggauucgaaacuucaucccgcaguucucagccagccaagcugucagcaaccucuccuaucugcaaaggugcguacucccgcccucccggggcuguuuuccuuaacuccuucaccauuucccuucacaguauauuuauuuaaacugcacuugagccucauucguccacacuccgcucucuccuuccuucaucucgccucuccuucuaacacuuguggccuucgcacgaaaugauugcuucccuggaacucucugagacuugguagaccgguucagaaagacggaugcccugaggguaguguuugcgaaaagcauaaauacagguggucacagguccaaaccccgggaaugaaucuguagggucucccgcaggcgacaaaaaaccugcaucuagaggcaaauccgcgcuggcuuccugcucccgcgaucggaaagaaccaucaugauccuaacucucagaguccugcuacucuguuuuggugcaggauuuggggacccccuuucccacucaggccaaacacucgggacucuggucgggacucggugcuuguggcuugcuguagccuuucaccucccggacuucgggcaaagcaaagcuuggcuaacgccgcgggaggacguccgcccagcuugcccagagccggccaaucccgggcguccaugcaaaugaggcuccuuaucgggccucggcuccgccucccgcggccuggguuguaguaaccauucauggggcccgcgcgcugcagcagcccggcucugcggcgcucucagccaccgccuccuccccgcuccgggucuuccccuuccucuuacaacugauccuguuggggauuuuuuuuuuuuuuccuauaucggaacgguggggaggagcagggaggggggaacaaggaggaaggggagagaucaggcagcuaucuaucuccuccuguuuuucccagaacaggugaugcuuccaaauuguggccacuuucuggagaacguucugcagcuggaaggaugcgggcgaccuagaguggaagccccgaggcggcagaucugaagccaccgaggauaaaaaacgcaaacuuugcauugugcguggaggaacgggcuggcuauuucuuuccaagagggcccccaaacuucggcccuugccgccuuucucggauugcuuuuggagaacaccauuugcuggcagcauuggagagugaggacgguguuguuguaaagucacuuuuaaggcgacaguagaggaccagacuuuuuaaauguuugggauucaagauacgcuaggaagaggaccagcucugaaagacaagucgcugggugccgagauggauucggucagguccuggguccggaaugucggcgugguggacgccaaugucgcggcucagagguaaugagacuggagccguugugcu

SEQ ID NO: 10714 - RNA, 2501 nt, Mus musculus
agcacaacggcuccagucucauuaccucugagccgcgacauuggcguccaccacgccgacauuccggacccaggaccugaccgaauccaucucggcacccagcgacuugucuuucagagcugguccucuuccuagcguaucuugaaucccaaacauuuaaaaagucugguccucuacugucgccuuaaaagugacuuuacaacaacaccguccucacucuccaaugcugccagcaaaugguguucuccaaaagcaauccgagaaaggcggcaagggccgaaguuugggggcccucuuggaaagaaauagccagcccguuccuccacgcacaaugcaaaguuugcguuuuuuauccucgguggcuucagaucugccgccucggggcuuccacucuaggucgcccgcauccuuccagcugcagaacguucuccagaaaguggccacaauuuggaagcaucaccuguucugggaaaaacaggaggagauagauagcugccugaucucuccccuuccuccuuguuccccccucccugcuccuccccaccguuccgauauaggaaaaaaaaaaaaaauccccaacaggaucaguuguaagaggaaggggaagacccggagcggggaggaggcgguggcugagagcgccgcagagccgggcugcugcagcgcgcgggccccaugaaugguuacuacaacccaggccgcgggaggcggagccgaggcccgauaaggagccucauuugcauggacgcccgggauuggccggcucugggcaagcugggcggacguccucccgcggcguuagccaagcuuugcuuugcccgaaguccgggaggugaaaggcuacagcaagccacaagcaccgagucccgaccagagucccgaguguuuggccugagugggaaaggggguccccaaauccugcaccaaaacagaguagcaggacucugagaguuaggaucaugaugguucuuuccgaucgcgggagcaggaagccagcgcggauuugccucuagaugcagguuuuuugucgccugcgggagacccuacagauucauucccgggguuuggaccugugaccaccuguauuuaugcuuuucgcaaacacuacccucagggcauccgucuuucugaaccggucuaccaagucucagagaguuccagggaagcaaucauuucgugcgaaggccacaaguguuagaaggagaggcgagaugaaggaaggagagagcggaguguggacgaaugaggcucaagugcaguuuaaauaaauauacugugaagggaaauggugaaggaguuaaggaaaacagccccgggagggcgggaguacgcaccuuugcagauaggagagguugcugacagcuuggcuggcugagaacugcgggaugaaguuucgaauccuccccccuuuuaaaaucucccuccccaaucccugaaggccggggaacccugcguuagagacacgaggcgucugugaagaaguccuggaaacuuuguccgccgagcgcuguggucgcgaagguugguggucgggaagccgaggcuccacaaaauagcugaaacccuagacggcuggaggugccuauuaaaaaaaaauccuccuggcuggguguuauuuucuugcuucucuuuuuguauucugaucugcgcguagaucugcuguugaaaucuagaacgccagcgcgaaaacagauuugaagacaaugaaugcaaaucugugcucaaagaccaucugccguggagcagacaaucagcugcgccgcgguucgagcgacugcacccgagccucucagcaucauuacagucgggagucuuuccucccggcucagggcucagguuugagugucaauugacuccugaccggacccccuagcuguaggugagcgcucacagacgagcugcgagaguucgccgcuagaggacacagcgccuggggugcacguuugcccggcgagcgaaaaggaagcuugcgcuuucagagacugcuugagucuccauugaaggggaccugagcacgucacuucaccucaggggcaaacugugacuacagacugcgcaggcgggauggugcuccggaagacuuggucucucucuacagcagugacugacuugaaagcuggcuggggcucucuuugcacagacuggggaggggggcuggagucgcguugaugguguacccuaacuccaggucuuuaauuucaggcuuaaaggggaggcaggguggcuugagguacaguugaguguaagaaaauaagaggccuaguugcauucggcaguuauccaacaaaagagggagggugggggagaaaauggucgagauaagauccaccucugcucuuucagcugcgcaguucaguuacacaagacuuuacggauaauugcgaccccaggaaaaacuaaccacccagagucuucgagcugggccugcucguuuuuguuuugguuugguuuuaguuuuaguuuuguuuuguuuuuguuuuuuuuaagucugcugaauuuaa

SEQ ID NO: 10715 - RNA, 2501 nt, Mus musculus
aggaagcggcggggcugguugguggugauagcagcggcggcggcagcagcagcagaggagguggcggcggcagcggcggcggcggcuguggcagaucggggggcggggggggucggcgggcucgugucugugagaucaauacugaagccgcgucugacccccuggagccuagaucacccccccagcccagcccccaucccacuccucgcacacgccccaccccacccccacgacccagcgucgcaccgcaccagccgaggcacccgagaggauuacccucuuugccccucucccauccaccccuccaaaaaagaauagauccccuccccugacccaccccuuccccuuuucacuccccccucccuccgaacuuucccucucgcaugcuuuuccccugcaccacggaucgccucucggaugccgcucgccuggaagcugcguuaggaacaggcggcggcggcgguggcggcggcggcgguggcggcgguagcucgggagugcuaugaccggcaaacucgccgagaagcugccggugaccaugagcaguuugcuaaaucaauugccugacaaucuguaccccgaggagauccccagcgcgcucaaccucuucuccggcagcagcgacucgguagcccauuacaaucagauggcuacagguaaggguggcggugaggcggcgaggcagcgaggaaggaaagggggaggacgaggaggagggagcgagcuagcgauggaugcacauaucgauggaugcagaaauggauggauggagagacggauggaaagauggggggcgcgcugggaauuuucuggggggcgaguugcuuuucccacccacuccucccgcccuccgagaucgggaaggcuugguuggagacgccacgguugaggcuucgguucucccgggugggggcagccgccgacuggagggagguaggugcgagcagcucugggguucucccuccccacgcagggggcccgaucgcugggcugcgugcaaggcguggugcuguagcccccuuucucgggaggagcccagcgucuuuuucacccgcgcucuccccccuccuuacucccucagccucccacccgggauggagccaugugcggcguggaguccccacggugggagagguacugcgacgcugccuuuccggggcguucagcaaagccauuggggguguggggacgguggggagagggagggggcucacccacggggcgggggaaaggguuugccaccgggggcgauccugggacccgggagcuugggaacggcggccgcucccgccguggagacaugggcugguuuuccgccgcucuccacucuccuuagcuggguuuaggcuuuuccccuccagcccgagcagaaagcuccuucaggccgggaggagacuggggccgggagaggcucccuuuacgggcggcacccuucugcgcuccgaggacaaaagcgucgaagcucuuugggucggccacccgggcucagcgcgcguagggggaccucgcuuggggcaugaaggcgcggcgucuuggaguagacagggccgggggaagaggccgaguugugugugcuggagagcgagagccgggcgcgcuccgggucugaaacuaccuguagcugcagcuaccuguccgccccaccucgggaagaacaacaaugcucucuugcgcgcgugcgugucugugugugguacgugagugugugcgcggcgugugcggugugugugccggagccacuccacaccccgauccguaguauuuugcuguauccagguugcgccggggagcgcggcaccgcccgcuuugcgccgggcucggcguuccucuuaccccacgcgcugcgcacuccagccggccgcacccucuacuccugggcaaggaccugggcgccgcggccgggagccggcucggcuucacucaccccuccccucucucccccgcucuccgcagagaaugugauggacaucggucugaccaacgagaagcccaauccggaacucucuuauucgagcucuuuccagccagcccccggcaacaagaccgugaccuacuugggaaaguucgcuuucgacucuccuuccaacuggugccaggacaacaucauuagccucaugagugccggcaucuugggggugcccccggccucaggggcgcucaguacgcagacguccacggcuagcauggugcagccuccucagggagacguggaggccauguauccggcgcugccuccuuauuccaacugcggcgaucucuacucggagcccgugucuuuccacgacccccagggaaacccugggcucgccuauuccccccaggauuaccaaucggccaagccggccuuggacagcaaucuuuuccccaugauuccugacuacaaccuguaccaccaucccaacgacaugggcuccauuccggaacauaagcccuuccagggcauggaccccauccgggucaacccacccccuauuaccccacuggagaccaucaaggccuuc

SEQ ID NO: 10716 - RNA, 2501 nt, Mus musculus
gaaggccuugauggucuccagugggguaauaggggguggguugacccggaugggguccaugcccuggaagggcuuauguuccggaauggagcccaugucguugggauggugguacagguuguagucaggaaucauggggaaaagauugcuguccaaggccggcuuggccgauugguaauccuggggggaauaggcgagcccaggguuucccugggggucguggaaagacacgggcuccgaguagagaucgccgcaguuggaauaaggaggcagcgccggauacauggccuccacgucucccugaggaggcugcaccaugcuagccguggacgucugcguacugagcgccccugaggccgggggcacccccaagaugccggcacucaugaggcuaaugauguuguccuggcaccaguuggaaggagagucgaaagcgaacuuucccaaguaggucacggucuuguugccgggggcuggcuggaaagagcucgaauaagagaguuccggauugggcuucucguuggucagaccgauguccaucacauucucugcggagagcgggggagagaggggaggggugagugaagccgagccggcucccggccgcggcgcccagguccuugcccaggaguagagggugcggccggcuggagugcgcagcgcgugggguaagaggaacgccgagcccggcgcaaagcgggcggugccgcgcuccccggcgcaaccuggauacagcaaaauacuacggaucgggguguggaguggcuccggcacacacaccgcacacgccgcgcacacacucacguaccacacacagacacgcacgcgcgcaagagagcauuguuguucuucccgagguggggcggacagguagcugcagcuacagguaguuucagacccggagcgcgcccggcucucgcucuccagcacacacaacucggccucuucccccggcccugucuacuccaagacgccgcgccuucaugccccaagcgaggucccccuacgcgcgcugagcccggguggccgacccaaagagcuucgacgcuuuuguccucggagcgcagaagggugccgcccguaaagggagccucucccggccccagucuccucccggccugaaggagcuuucugcucgggcuggaggggaaaagccuaaacccagcuaaggagaguggagagcggcggaaaaccagcccaugucuccacggcgggagcggccgccguucccaagcucccgggucccaggaucgcccccgguggcaaacccuuucccccgccccgugggugagcccccucccucuccccaccguccccacacccccaauggcuuugcugaacgccccggaaaggcagcgucgcaguaccucucccaccguggggacuccacgccgcacauggcuccaucccgggugggaggcugagggaguaaggaggggggagagcgcgggugaaaaagacgcugggcuccucccgagaaagggggcuacagcaccacgccuugcacgcagcccagcgaucgggcccccugcguggggagggagaaccccagagcugcucgcaccuaccucccuccagucggcggcugcccccacccgggagaaccgaagccucaaccguggcgucuccaaccaagccuucccgaucucggagggcgggaggagugggugggaaaagcaacucgccccccagaaaauucccagcgcgccccccaucuuuccauccgucucuccauccauccauuucugcauccaucgauaugugcauccaucgcuagcucgcucccuccuccucguccucccccuuuccuuccucgcugccucgccgccucaccgccacccuuaccuguagccaucugauuguaaugggcuaccgagucgcugcugccggagaagagguugagcgcgcuggggaucuccucgggguacagauugucaggcaauugauuuagcaaacugcucauggucaccggcagcuucucggcgaguuugccggucauagcacucccgagcuaccgccgccaccgccgccgccgccaccgccgccgccgccuguuccuaacgcagcuuccaggcgagcggcauccgagaggcgauccguggugcaggggaaaagcaugcgagagggaaaguucggagggaggggggagugaaaaggggaaggggugggucaggggaggggaucuauucuuuuuuggagggguggaugggagaggggcaaagaggguaauccucucgggugccucggcuggugcggugcgacgcugggucgugggggugggguggggcgugugcgaggagugggaugggggcugggcugggggggugaucuaggcuccagggggucagacgcggcuucaguauugaucucacagacacgagcccgccgaccccccccgccccccgaucugccacagccgccgccgccgcugccgccgccaccuccucugcugcugcugccgccgccgcugcuaucaccaccaaccagccccgccgcuuccu

SEQ ID NO: 10717 - RNA, 2501 nt, Mus musculus
aucaaacccagcccugagacauaucaagaaacgaacaucacugaauggauaugagacaccguacagggucagagagauguuagcuuuuucuaaaauccaaauccacacccucucaaagacauugaucaagagcuggaggcacagagcacaggaaaugaacauuuauauagugucugcuguguguuaauaauaagugaauuauauauguucucagauuuagcccuuacccaccagcuaguucucuaaugaggaacuuaaguucagagacugugcucagccuuccugguggcuaaugaguccuucagauuucaugccuugcucauucuuccuccugcccuccuaccacgcacgaugugauggagacuuuuacuguccugguuugccuacagcauaccaggcauggaagaggaaagacugaaggguuugguuuguccuguccuguaaaauggucccuauccuaccuaaggguggauggagcaaggagagucccugauuagguccucugugcucaagauuguagcugccugucccaaaacuuuguguccauuucuugugucccaaucccuggcucuagcucuucgcagacaggcugaagucagaagcgggaagucgaggaaaaguugugauaacuuguccccaguguauuccagacagccugcuugggaacaucaauuaggccaauggccugagugugucuggucaucuggucacuccaagggaaucacagcaggagaguccucaugaacaaagaucacacacacacacacacacacacacacacacacacacacacacacacacacuagaagcccugacuugacuaauuagccucaggugucuguagggcgagagagcugauguagaauaucugagaccucuuugugagacucauuugcuaaccuaacugagcucuggcaaagcucuccuggcacacaaaggcacagguaagucccccugugccccccaagcccccaccccugccgccaauuucucugacuuugacagcugucucuugaguguucagagagcuccugcugcuggcuagauucauaggauugccuaugaagaaguauuccauagaaccuccugaaaaacuuucuccuuccacugggcugagaagccgggaaaaucuaucccuuuggagcugcaggccuucuuucugggcaucaaaccagacagaugugcugugcggcacuauggcaaacagacaagcaggcaaacaccaguauuccacaaagcaggagggauaggggagaagggacacggacggacggacggacggacacacacacacacacacacacacacacacacacacacacaguuuggccaguaaaguuucccgguggagaaaaagccuccuugccagcgggauucgcugggaccgagggagguuuccccaggauuccucugugaaggcgaacggcagccgcagcaguuuccacaaacagcagcaaaacuucaguccuaaaagucccccaaacuucccccucccuuucucccucggucuuuuguucccccacugcauugccaaccaagcagcucccagcuucccacacuggacuguccucccccaaccccaacuacaaccccaaccccaaccccugcccggccgggagccucgaucccagccugcccacgcccggcuuccgugcgcccugggggagccgggggucgcucacccgccuugcaagggucuuuguaguugaggagcuccggggcguccuccucgcccaggucguagguguagucggccaaguccagcggccggccggcgcgcgggagcagcagcagcagcaguagcagcggcagcgacagcagcggcagcggcgggcgggccacgccgggcaugcuggcgggcggcgguggcgguggcggucgcgcccggacgcgggagcggggcgacggggaagggagcgcugaaggcgaaggggaggcgcucuccccccgaggccaccucuucccgucccguuuccugucucccgccccccgcucggcccggcucucuccggcccugggcuccggcguccccucgcccuccucucggucgcucccuuucuuuucucgccgcccucccacuccccaccccacccccccuuuuagggaaaugagcucgcuggagggcggguuuucgcccagcucagccccccucggggccgggaccgugcucggccgggccgggaagcacgccagccgggcggggaggacgagaguagcaccgcccgccccggaggggaauccgcugccugggacuggggcaggggccggggagggggcgcgggccagggaugcccggaggcaccgcuccgcgaggggcccccuacaggccgcuguccuguaccaggcggagugccuccgggcacgggacacgcugucagguccguuccuuccucuuagacacuggaucagcgaucgaucguucucucccagagacuccagagucugucugucuuagaucucggcucucucgcuucucacugucucucugucuagcugucucc

SEQ ID NO: 10718 - RNA, 2501 nt, Mus musculus
ggagacagcuagacagagagacagugagaagcgagagagccgagaucuaagacagacagacucuggagucucugggagagaacgaucgaucgcugauccagugucuaagaggaaggaacggaccugacagcgugucccgugcccggaggcacuccgccugguacaggacagcggccuguagggggccccucgcggagcggugccuccgggcaucccuggcccgcgcccccuccccggccccugccccagucccaggcagcggauuccccuccggggcgggcggugcuacucucguccuccccgcccggcuggcgugcuucccggcccggccgagcacggucccggccccgaggggggcugagcugggcgaaaacccgcccuccagcgagcucauuucccuaaaagggggggugggguggggagugggagggcggcgagaaaagaaagggagcgaccgagaggagggcgaggggacgccggagcccagggccggagagagccgggccgagcggggggcgggagacaggaaacgggacgggaagagguggccucggggggagagcgccuccccuucgccuucagcgcucccuuccccgucgccccgcucccgcguccgggcgcgaccgccaccgccaccgccgcccgccagcaugcccggcguggcccgcccgccgcugccgcugcugucgcugccgcugcuacugcugcugcugcugcucccgcgcgccggccggccgcuggacuuggccgacuacaccuacgaccugggcgaggaggacgccccggagcuccucaacuacaaagacccuugcaaggcgggugagcgacccccggcucccccagggcgcacggaagccgggcgugggcaggcugggaucgaggcucccggccgggcagggguugggguugggguuguaguugggguugggggaggacaguccagugugggaagcugggagcugcuugguuggcaaugcagugggggaacaaaagaccgagggagaaagggagggggaaguuugggggacuuuuaggacugaaguuuugcugcuguuuguggaaacugcugcggcugccguucgccuucacagaggaauccuggggaaaccucccucggucccagcgaaucccgcuggcaaggaggcuuuuucuccaccgggaaacuuuacuggccaaacuguguguguguguguguguguguguguguguguguguguguccguccguccguccguccgugucccuucuccccuaucccuccugcuuuguggaauacugguguuugccugcuugucuguuugccauagugccgcacagcacaucugucugguuugaugcccagaaagaaggccugcagcuccaaagggauagauuuucccggcuucucagcccaguggaaggagaaaguuuuucaggagguucuauggaauacuucuucauaggcaauccuaugaaucuagccagcagcaggagcucucugaacacucaagagacagcugucaaagucagagaaauuggcggcaggggugggggcuuggggggcacagggggacuuaccugugccuuugugugccaggagagcuuugccagagcucaguuagguuagcaaaugagucucacaaagaggucucagauauucuacaucagcucucucgcccuacagacaccugaggcuaauuagucaagucagggcuucuagugugugugugugugugugugugugugugugugugugugugugugugugugaucuuuguucaugaggacucuccugcugugauucccuuggagugaccagaugaccagacacacucaggccauuggccuaauugauguucccaagcaggcugucuggaauacacuggggacaaguuaucacaacuuuuccucgacuucccgcuucugacuucagccugucugcgaagagcuagagccagggauugggacacaagaaauggacacaaaguuuugggacaggcagcuacaaucuugagcacagaggaccuaaucagggacucuccuugcuccauccacccuuagguaggauagggaccauuuuacaggacaggacaaaccaaacccuucagucuuuccucuuccaugccugguaugcuguaggcaaaccaggacaguaaaagucuccaucacaucgugcgugguaggagggcaggaggaagaaugagcaaggcaugaaaucugaaggacucauuagccaccaggaaggcugagcacagucucugaacuuaaguuccucauuagagaacuagcugguggguaagggcuaaaucugagaacauauauaauucacuuauuauuaacacacagcagacacuauauaaauguucauuuccugugcucugugccuccagcucuugaucaaugucuuugagaggguguggauuuggauuuuagaaaaagcuaacaucucucugacccuguacggugucucauauccauucagugauguucguuucuugauaugucucagggcuggguuugau

SEQ ID NO: 10719 - RNA, 2501 nt, Mus musculus
gcucuuccaacuccaacuguggccgugcagugugaaacgguccacacuucccacuccggcgguuacccuuucccuuuucagcucacaggcacaaaagcacgcuguguuccucagcugaugcaaacaagcucgcacccccaagcucccaaucucucaugccaaccuggauguacaugagucacuugcgacauaccccuuaguucuacgcccccucacaaccaagacacacacacaggugcaccguagguccacagauccaugugcacccugcauagacacaauucuuauacaaaugcauucucugcacacacaacucuggagaucagacacagagccugguggccugguagggcacgcugcggacgggugcaaccacuccauccuuuggcugcucucccgcgggcgccgggccugggccuccccgcuccgcccccacgcgcgcccccgccgccugcgccgcaguccgcguccaccagccccggcagccaguaguugcggucccaguuccgcgcagcgcuccggagcugaaaggacugcaaucagcgcccgaggucaggaggaauagguggcgccuagagagcggguggcaccagaguugcggcagcccggagguggaagcucucgagaggggcagaacagccugcagggagcagcggggcgccggcaggcugguguggggggagacccugcaggagucauggccgggcuacgagccaggcggggcccugggcgcaggcuacugguguuguccacgcuggguuuuugccuaaugcugcaagucagugccaagagaccuccuaagacgccccccugcccacccagcugcuccugcaccagggacaccgccuucugcguggacucuaagucggugcccaagaaccugccuucagaggucaucucccugugagugucuaccuagccuuggggguggggaaaggaaagaaggcacagaaagcucuggaagagagaaacccugcuccucuuuugagaggauauggaccaggagcacucccagguauccucagaacuggagacuccaggccccagucugcagggagcgcugcaaucuguacagcagccauagcuuggguaaaccagaauucauggccaaggaugaaucaucaccaucagcagcgcaaugagaccuacuguguguggguuggagggagugucuacaagagcaugcuggccccacccugugaggucacaccaaggacagaaagcaggacuaauagcagcagggggaggggugacaaguaugcuugcccucgugguaccuuggcauggaccagacuccugccacugggucugcuauugugcacacagcugggccagccucacuugcagcaacuggcccaugacucccaccccuuugccuguggggcuagagagacugugaggucccccuucuugcugccccaucucucagcagcaccaagacauuguggguguuggguaauggugcugaugcugguaauggaaccugcucuuggcugagagggaaggugagccucgggccacugucgcuucuggaggcagcagggggagaagaauggaggacauugaguuuuggggaagaaaggguagcugcaggugggggcuagggcugcugaacacagaagccacugcccuguccaccucuguccacaguacagguccuucagacacuuacacagucuuggcuccuguguucccugcaggacgcuggugaaugcugccuucucagagauccaggauggagccuucucccaucugccguuguugcaguucuuguauggauagcuuuguggaagaggggguuggggggaacgugguagaaccugacagaugcugaaccugggugagaguagguggagggaggguuugaaaaugcagaugucccgauagaagcagaagguggagugacaugaggucaggaguccggguagcagggaaacugcacacagaagccaagagagggggauauacagagcauuagacuccacuucucuagggggucuagggaguuggguugaaauggccuggcccagugccagaaccuggacacuucagaggagaggguugugcuaaacacaggugagcccaggggucagaguucgggaggcaugguggacagcugucggugcagggcuagggugaguuaaggugaggaugagaagacuggacaaggagaugccauggaagugggccaggagccagcucggcaggauaacguugccucccaccauauucaggagcuaacagggaucuuggggcauggaaacaaguucacacccggccuugcugaccagggguccugagggaugagggaagggcagccaggucuugaggaagcucacgggugaggcaguaggcaugggcagcaggcacacccucacaaagucuaauuccugcuuugucuucccagguuacucaacucuaacaaguucacacugauuggagacaaugccuucauaggacugucgcaccugcaguaccugugugugggagggaagggucaa

SEQ ID NO: 10720 - RNA, 2501 nt, Mus musculus
uugacccuucccucccacacacagguacugcaggugcgacaguccuaugaaggcauugucuccaaucagugugaacuuguuagaguugaguaaccugggaagacaaagcaggaauuagacuuugugagggugugccugcugcccaugccuacugccucacccgugagcuuccucaagaccuggcugcccuucccucaucccucaggaccccuggucagcaaggccgggugugaacuuguuuccaugccccaagaucccuguuagcuccugaauauggugggaggcaacguuauccugccgagcuggcuccuggcccacuuccauggcaucuccuuguccagucuucucauccucaccuuaacucacccuagcccugcaccgacagcuguccaccaugccucccgaacucugaccccugggcucaccuguguuuagcacaacccucuccucugaaguguccagguucuggcacugggccaggccauuucaacccaacucccuagacccccuagagaaguggagucuaaugcucuguauaucccccucucuuggcuucugugugcaguuucccugcuacccggacuccugaccucaugucacuccaccuucugcuucuaucgggacaucugcauuuucaaacccucccuccaccuacucucacccagguucagcaucugucagguucuaccacguuccccccaacccccucuuccacaaagcuauccauacaagaacugcaacaacggcagaugggagaaggcuccauccuggaucucugagaaggcagcauucaccagcguccugcagggaacacaggagccaagacuguguaagugucugaaggaccuguacuguggacagagguggacagggcaguggcuucuguguucagcagcccuagcccccaccugcagcuacccuuucuuccccaaaacucaauguccuccauucuucucccccugcugccuccagaagcgacaguggcccgaggcucaccuucccucucagccaagagcagguuccauuaccagcaucagcaccauuacccaacacccacaaugucuuggugcugcugagagauggggcagcaagaagggggaccucacagucucucuagccccacaggcaaaggggugggagucaugggccaguugcugcaagugaggcuggcccagcugugugcacaauagcagacccaguggcaggagucugguccaugccaagguaccacgagggcaagcauacuugucaccccucccccugcugcuauuaguccugcuuucuguccuuggugugaccucacaggguggggccagcaugcucuuguagacacucccuccaacccacacacaguaggucucauugcgcugcugauggugaugauucauccuuggccaugaauucugguuuacccaagcuauggcugcuguacagauugcagcgcucccugcagacuggggccuggagucuccaguucugaggauaccugggagugcuccugguccauauccucucaaaagaggagcaggguuucucucuuccagagcuuucugugccuucuuuccuuuccccacccccaaggcuagguagacacucacagggagaugaccucugaaggcagguucuugggcaccgacuuagaguccacgcagaaggcggugucccuggugcaggagcagcugggugggcaggggggcgucuuaggaggucucuuggcacugacuugcagcauuaggcaaaaacccagcguggacaacaccaguagccugcgcccagggccccgccuggcucguagcccggccaugacuccugcagggucuccccccacaccagccugccggcgccccgcugcucccugcaggcuguucugccccucucgagagcuuccaccuccgggcugccgcaacucuggugccacccgcucucuaggcgccaccuauuccuccugaccucgggcgcugauugcaguccuuucagcuccggagcgcugcgcggaacugggaccgcaacuacuggcugccggggcugguggacgcggacugcggcgcaggcggcgggggcgcgcgugggggcggagcggggaggcccaggcccggcgcccgcgggagagcagccaaaggauggagugguugcacccguccgcagcgugcccuaccaggccaccaggcucugugucugaucuccagaguugugugugcagagaaugcauuuguauaagaauugugucuaugcagggugcacauggaucuguggaccuacggugcaccugugugugugucuugguugugagggggcguagaacuaagggguaugucgcaagugacucauguacauccagguuggcaugagagauugggagcuugggggugcgagcuuguuugcaucagcugaggaacacagcgugcuuuugugccugugagcugaaaagggaaaggguaaccgccggagugggaaguguggaccguuucacacugcacggccacaguuggaguuggaagagc

SEQ ID NO: 10721 - RNA, 2501 nt, Mus musculus
ccuguaucuagggacuaagggcacaagaacaaacagaauuuaaaguucacauugaaaaacagugaauaagccaagauuugaaaacaauuauauaauaauaaauaaaaggucaccaaauucacuguucuugcaggucacuugaguuacugaaaacuaacucucucucucccccucccccucccccucccccuccccucccccuuccccucuccagaggcaauguggaaaagguuacuaggaugaccuucuguggguaaccuggagggugggcgugccugaaacccuguacuugaacucagcagcccagcgggagacuguuucaaaagugccuggaguggcgaaagagccugggagcuaggcagaaagugaacgaaguuauuucaagcauuccaaaaacagcagcuuaugaaaccauuuugguuucacaaauguuucauucuugugcucacucguguccucauguuccccaacacccauucuggaaaaggaaagggagggugcuguuggucuaguguuugccuagcgugcaagaagcccuaggucugacccccagcauugccuauaaacugaugugccuaaaugugguggcauugcacugucaccccagcacccugaagcccgaggaaagaggaucagagagguucgaggucacccgcagcuacauagaucaccuugggagagucucaaaauaaaauaaaauaaaaaaaaaaaaaugaagagcgaagaguggguagaaaggcgggaaaagguuggaaggccuggcuggacucccaggaguucuggcugacugcacaaacccucaggccucaugguacacaccugccgugacagguagacccacagcucuuuaagagccacccacccacccucguaccucucuccccaagaacgccuuaaugacccccgcacaucugggcuaacgacucagaaagucaacucuucaggcaucucagagccgugcagauccccgggucugacuuuccccagaugucgugccucaguuuaaagauaacccaggugaaucuagagcuuuaggaagccugagucugaggauuacugacuucaacagggcuucacuuacucuccgagucgcugaagccgcugcugucgcugacgcuggcgcugcugcgccgcuucaugcgcucuaggugcuccucauaguggaaguggcgcucguggaagggcgacgcgaagucggccagcaccgcgucgaacucgcacagcacgucggucaggucugcagcggccgcggaguccauggccggggcuaggggagggagggcacagagggcaucuggaggggcggccagcguucccuagaacuccacucugccuuugccagugacagccacgcagucaguuacuccguaaccucccaaccacccucuaaagcgccugucaccagacacggaggagaagaagccuccguggguugagcugaaagucuggaagucaccuagcccaccccacgcgcuuuccuacuguugcccacgcucgcucccuggagcgcguggcggcgggaagucugagucagcaggcacccguuacgugucagacuccgguuccuugucccgcguggaaaaccaaacuaaaccugcaucggacgagcgauccggagacgggaugccagggugauggaggacagaagggugggcaguggaagaagaccuuagcgaccucuguucucucgccccuacuugcaggcuccagcucucaggggccccggagcugagaguguagcuuagcguggacgcagucccuggcuucgaucccggggcgcagagguggagaagacaccuccaaauaggcacucaccugcggccgcgaccgccgcgggacugcucugcgcugagggcggcuucauggagaaguugcucagugacacgcguagcagagaugcugcgagguguuggcccugguggcugccgccugcacugcagucugcuccggugccucugccuugcuccuugccgagccugagcgcuagcuacucgccugagccgcgccacccgccggcuacuccgucuuauagccaccggcaggggcggggcggggcggggcugcugaguaagucccagacgaccuaggggacgccccugucccuccacccccuacucccggcaccgcccuagccacgcgcuggccucugaagaaccgcagugacgggugucgccggaguccaggauaccgccccaaauauuuacccgccgcuuucucuaccacccugacaacccgacccaaggaagugucuuugcgggcaucagaguucuccaagaguuuacccuguuucccgccuucuggcugagccuccuugagccucaucuaugaaauggaacugcacaugcagaaagccuccuuguuugcugcaaaaauaaaggagccaagggccucaguagccucugcaaagaaccaguccuccaucugacuuuucucaaggaauuuauaagguugugcguggacagaguggacagcugagggcaguggguugaggugaaugcagu

SEQ ID NO: 10722 - RNA, 2501 nt, Mus musculus
acugcauucaccucaacccacugcccucagcuguccacucuguccacgcacaaccuuauaaauuccuugagaaaagucagauggaggacugguucuuugcagaggcuacugaggcccuuggcuccuuuauuuuugcagcaaacaaggaggcuuucugcaugugcaguuccauuucauagaugaggcucaaggaggcucagccagaaggcgggaaacaggguaaacucuuggagaacucugaugcccgcaaagacacuuccuugggucggguugucagggugguagagaaagcggcggguaaauauuuggggcgguauccuggacuccggcgacacccgucacugcgguucuucagaggccagcgcguggcuagggcggugccgggaguaggggguggagggacaggggcguccccuaggucgucugggacuuacucagcagccccgccccgccccgccccugccgguggcuauaagacggaguagccggcggguggcgcggcucaggcgaguagcuagcgcucaggcucggcaaggagcaaggcagaggcaccggagcagacugcagugcaggcggcagccaccagggccaacaccucgcagcaucucugcuacgcgugucacugagcaacuucuccaugaagccgcccucagcgcagagcagucccgcggcggucgcggccgcaggugagugccuauuuggaggugucuucuccaccucugcgccccgggaucgaagccagggacugcguccacgcuaagcuacacucucagcuccggggccccugagagcuggagccugcaaguaggggcgagagaacagaggucgcuaaggucuucuuccacugcccacccuucuguccuccaucacccuggcaucccgucuccggaucgcucguccgaugcagguuuaguuugguuuuccacgcgggacaaggaaccggagucugacacguaacgggugccugcugacucagacuucccgccgccacgcgcuccagggagcgagcgugggcaacaguaggaaagcgcguggggugggcuaggugacuuccagacuuucagcucaacccacggaggcuucuucuccuccgugucuggugacaggcgcuuuagagggugguugggagguuacggaguaacugacugcguggcugucacuggcaaaggcagaguggaguucuagggaacgcuggccgccccuccagaugcccucugugcccucccuccccuagccccggccauggacuccgcggccgcugcagaccugaccgacgugcugugcgaguucgacgcggugcuggccgacuucgcgucgcccuuccacgagcgccacuuccacuaugaggagcaccuagagcgcaugaagcggcgcagcagcgccagcgucagcgacagcagcggcuucagcgacucggagaguaagugaagcccuguugaagucaguaauccucagacucaggcuuccuaaagcucuagauucaccuggguuaucuuuaaacugaggcacgacaucuggggaaagucagacccggggaucugcacggcucugagaugccugaagaguugacuuucugagucguuagcccagaugugcgggggucauuaaggcguucuuggggagagagguacgaggguggguggguggcucuuaaagagcugugggucuaccugucacggcagguguguaccaugaggccugaggguuugugcagucagccagaacuccugggaguccagccaggccuuccaaccuuuucccgccuuucuacccacucuucgcucuucauuuuuuuuuuuuuauuuuauuuuauuuugagacucucccaaggugaucuauguagcugcgggugaccucgaaccucucugauccucuuuccucgggcuucagggugcuggggugacagugcaaugccaccacauuuaggcacaucaguuuauaggcaaugcugggggucagaccuagggcuucuugcacgcuaggcaaacacuagaccaacagcacccucccuuuccuuuuccagaauggguguuggggaacaugaggacacgagugagcacaagaaugaaacauuugugaaaccaaaaugguuucauaagcugcuguuuuuggaaugcuugaaauaacuucguucacuuucugccuagcucccaggcucuuucgccacuccaggcacuuuugaaacagucucccgcugggcugcugaguucaaguacaggguuucaggcacgcccacccuccagguuacccacagaaggucauccuaguaaccuuuuccacauugccucuggagaggggaagggggaggggagggggagggggagggggagggggagagagagaguuaguuuucaguaacucaagugaccugcaagaacagugaauuuggugaccuuuuauuuauuauuauauaauuguuuucaaaucuuggcuuauucacuguuuuucaaugugaacuuuaaauucuguuuguucuugugcccuuagucccuagauacagg

SEQ ID NO: 10723 - RNA, 2501 nt, Mus musculus
aucggagaaugaucauucugguccagcacccgcacuugcaccagagcauugcuggaaagcugaggggaaccgccgucgcuggccuggacacgcacgucaagcuggcgcagagucucauagucaaaacuacggagagcguagauggcuccgguagccgggucuacugagacguaaguggacacggcuuccccagagcggcccacuucggccucuaccaggcgguaggugacuugaccguugcgacccacgucagggucgcgggcugccacuguggccagguaggcgccuggaggguuguuuucgcggaccgacaccucauagacuggcuuggugaagaucggugcguugucguucucgucccccacucgcacgguguagggccugacggugcgaagagggggugugccacggucuucggccaccagcgucagguuguacuccgcgaugcgcucccgguccagagaugcagcggucaccaccagguagcugccagcauaggccggcugcagccuaaagugcucgugcccguagagggcgcagcgcaccugcccguuggcgcccgagucccuguccgaggugcugaccagcgccacuagacucucgcgcgccgcccccucuggcaccagcgaggugauaccggcuuccugugucccggacccagucgacgaggccgcguccgcuccuccgagugcggcggcagcggcggcggcggcgaagggcgagguggcuggagcccccggggcggccagaggagugauagaaauuucaggagcguugucguugacgucucggaugcgcacgauaaccuugcagguggcuguccggggcccuggaccucggucuugagcccgcacguccagcucguagguguccuggcgcucguaguccaccugcccagccaaggugaggcggccagagcgcgggucgagccggaagagguggcgggcuucgggaggggugcgggcgccgaaggugaacacaacgucgccguugggaccuucgucgggaucggcagcguccaggucgagcagcagcgaucccacaggugcguccucggccaauuccaccucugccacggcacccugugggaaggccgggcuguggucauuggcaucuagcacacgcacgcugagggcugcuguggcggaacgcggcggucgcccgccauccugagccaccagcuccaggcuguaggaggccuggcucucgcgguccaacuccuguagcagcaccagguccgcacacugggcaccguccgcgcgcgucugcagcuccacgcggaaggggcugugaggcucggcuaggcguacacucugcagcccguuggcacccacguccucguccacgggcaccuccagggggaugcgugugccuaccggagcgcucucugagaccuccaccgggaucugggcucggggaaagcggggcgcguggucguuuacaucccucaccuccaccuccacgugcaccaggcggaacuguuccugcgagaagcugacaacaucgaaggccagcacgcacuguggggacgggccacacagacgcucacgguccaggcccgcauccccgacggucagcugcccgucgcccucgcguacccggagcagagagcuguugaauugcuucaucaggcggaagcuugugucuccagacacuuucaugugcaggucuucugcaaggguuccgaugacugugccaggggcauccucuucgaacgugcuguaucggacugucuugcucugggccacugagagcacccagcagagacuaaauagcugcaaggggaaaaggcaagggcugccccagcgcuucgcaggacucauaucgccaauccccaacugcuauuccgaaaggcuaaccuaaagagucuuccccggcgugcagaucggagcgugagucccaggcucugcgagccccgugcgggaaaagcugcagcuccggcucgggcuggcucggaggacgcgcagacccacccucacucggcgccuccgccuccuuucccugggcuggagcugcgcuggcgagcgccgccuccgucuuuauagcugccgauaugcaaaucacuggaaggggccagccaauggucgcuuagccacagcgccgcuccuccgccaaccaccgacaaucccuuuaauguggaaaggcuuagaggagaaaacagggaaggaaaaugagggaaucuuuccuuuguuuuaaaaacuccugcucccauuuucuguuagcaccuugcuugcaaugaguuagcacugggcucugaaguaaacgaagcugaugauuuuuggaaauugggugccaggcacccggucucuucugcccgccgcugcggguacuaagcccgaacaagcuggguuucucuucagaagcuccgggucucacauccuaccccccauccgccccuuuauuuugcauuuuaaaggcuucaaaacuugcucuggggagcgaggcucucuguucgccuccucccucagcuucccaccgguguggggaauaaccugucgaug

SEQ ID NO: 10724 - RNA, 2501 nt, Mus musculus
caucgacagguuauuccccacaccggugggaagcugagggaggaggcgaacagagagccucgcuccccagagcaaguuuugaagccuuuaaaaugcaaaauaaaggggcggaugggggguaggaugugagacccggagcuucugaagagaaacccagcuuguucgggcuuaguacccgcagcggcgggcagaagagaccgggugccuggcacccaauuuccaaaaaucaucagcuucguuuacuucagagcccagugcuaacucauugcaagcaaggugcuaacagaaaaugggagcaggaguuuuuaaaacaaaggaaagauucccucauuuuccuucccuguuuucuccucuaagccuuuccacauuaaagggauugucggugguuggcggaggagcggcgcuguggcuaagcgaccauuggcuggccccuuccagugauuugcauaucggcagcuauaaagacggaggcggcgcucgccagcgcagcuccagcccagggaaaggaggcggaggcgccgagugagggugggucugcgcguccuccgagccagcccgagccggagcugcagcuuuucccgcacggggcucgcagagccugggacucacgcuccgaucugcacgccggggaagacucuuuagguuagccuuucggaauagcaguuggggauuggcgauaugaguccugcgaagcgcuggggcagcccuugccuuuuccccuugcagcuauuuagucucugcugggugcucucaguggcccagagcaagacaguccgauacagcacguucgaagaggaugccccuggcacagucaucggaacccuugcagaagaccugcacaugaaagugucuggagacacaagcuuccgccugaugaagcaauucaacagcucucugcuccggguacgcgagggcgacgggcagcugaccgucggggaugcgggccuggaccgugagcgucuguguggcccguccccacagugcgugcuggccuucgauguugucagcuucucgcaggaacaguuccgccuggugcacguggagguggaggugagggauguaaacgaccacgcgccccgcuuuccccgagcccagaucccgguggaggucucagagagcgcuccgguaggcacacgcaucccccuggaggugcccguggacgaggacgugggugccaacgggcugcagaguguacgccuagccgagccucacagccccuuccgcguggagcugcagacgcgcgcggacggugcccagugugcggaccuggugcugcuacaggaguuggaccgcgagagccaggccuccuacagccuggagcugguggcucaggauggcgggcgaccgccgcguuccgccacagcagcccucagcgugcgugugcuagaugccaaugaccacagcccggccuucccacagggugccguggcagagguggaauuggccgaggacgcaccugugggaucgcugcugcucgaccuggacgcugccgaucccgacgaaggucccaacggcgacguuguguucaccuucggcgcccgcaccccucccgaagcccgccaccucuuccggcucgacccgcgcucuggccgccucaccuuggcugggcagguggacuacgagcgccaggacaccuacgagcuggacgugcgggcucaagaccgagguccagggccccggacagccaccugcaagguuaucgugcgcauccgagacgucaacgacaacgcuccugaaauuucuaucacuccucuggccgccccgggggcuccagccaccucgcccuucgccgccgccgccgcugccgccgcacucggaggagcggacgcggccucgucgacuggguccgggacacaggaagccgguaucaccucgcuggugccagagggggcggcgcgcgagagucuaguggcgcuggucagcaccucggacagggacucgggcgccaacgggcaggugcgcugcgcccucuacgggcacgagcacuuuaggcugcagccggccuaugcuggcagcuaccugguggugaccgcugcaucucuggaccgggagcgcaucgcggaguacaaccugacgcugguggccgaagaccguggcacacccccucuucgcaccgucaggcccuacaccgugcgagugggggacgagaacgacaacgcaccgaucuucaccaagccagucuaugaggugucgguccgcgaaaacaacccuccaggcgccuaccuggccacaguggcagcccgcgacccugacgugggucgcaacggucaagucaccuaccgccugguagaggccgaagugggccgcucuggggaagccguguccacuuacgucucaguagacccggcuaccggagccaucuacgcucuccguaguuuugacuaugagacucugcgccagcuugacgugcguguccaggccagcgacggcgguuccccucagcuuuccagcaaugcucuggugcaagugcgggugcuggaccagaaugaucauucuccgau

SEQ ID NO: 10725 - RNA, 2501 nt, Mus musculus
ugccaggugacuucuagaagcgcugccucccgcucccugccugcuccuagccuagaagccuuaaccaacaaaaccuaaagcucggcaaacagcugaagagaaagggcgccuccgcaggcaggaggauugcuuucuacaauuuuaagccacaggagaucuaauguguuggggguaaauagaacucuccccuguugccaguacuagaauuuacuucuaccuguaacuuuaaaaacaaacaaaaaaaucucuuuauuuacagucucugaacugcguccuuggggucuuccagcauacggucuaccauucaauugucuaaaacucucuuucuaaugagggucaaaucucuaacaaccuuuuaaagcacucucuccacacagcacucucaguucugaucucugaaaccgcuauggagucaaaggguuuaagaugucaaggacucguccgaacugcacgccggacaccgugcaauccgauucugaucaauucagucauucccagguacuuggugacugucccacuagaucacgacaaucugggggaagggugguuggaggccaggaguagaggaagcaugagugaagggcuacaucagaacacucucucggcuagugggguccaaagaugaugaagacgcccagaggauuuguggcugcagauucgcaaguggggugcagacgggucugggugaccuacuaggagaucugggggugggggcagaaggaaucgggaaacagggaggaagcgagggcaucuauaauccugucccccgaggggaggaagggaagugggcaccggaguggcgaggggcgggcguggggagcucacucccugcagaagacguacucgguguagcugguccagaucuuguccucgcucuggucggugcugcuagcaaaagcgcaggugcccguggagcugcacgccaccauguggaagcccgacucggacagcuuaucgaaggccugcucuaggaaguugaacuugagguaauagcgggagguguagcgcuccgggggccggucggggucccggcucucauucaggguguccccaaacaccuccuuggccagcgacgucuugccgcacacggugaugcgcgccacccgccggaacuuggcguccgccugagcgucgcgcccgaugguguaggagccgcgguagccgauggugauguagccggagcgccggcugccguccaaagacugggacggcgugagcaggggccccgccgcgcccccggacgggcugcggcuagccagcuccagcgugggcgaaggcgccccggccgaggcgcccuccugcggcucgggcucugcguagcccagcggcagcagcucaucgcccagagagcccuccuugugcaccccgcggcgcgagugcggcggcgguggccccggaccggguugcuggggcgccccgaggcgacgcacgagcuccggcagcucgaaguacucggccucgcgcugcagccggcugcgcuccgggaaguagucgggcagcacgagcugcaagucccgcagguaauccaggauguagcggaagaggaagccgucccgguccagaaagaagcggccuuugcugucccgggccagcuccugcggcugcugcugcgugaacauacgccagagcagcgagucgggcacggacaccacggugcagcgccgggucacauacaccugcccucccacguucagcucuacgauguccgggaagagcggcggcuccgccgaggacgacgacgagccgcugccaccuccgccuccgcccccguuggguaauccucgggugcuguccgccagagccauggccaaaaagagguggcccggaugggccaaguggcagggagcggggucgcgaucggaagccccagcggcucuuaucggggagcccugcgcucaggcggcggccggccacugagagccgcgcggugcgagcgcgcagcagugcgcccacgagagccccggugcgcugcgccugccucgcccgcgcgcuccaggcgaguggcgggucgcggcccgcgcgccgcuuaaguagagccgcccgcuugggcggcgcggcgcgcaggaggcggugggcggcugcggagccgcugagcucgcucccggggcggggagggcuggggcggggugggggugggggaggagcggggaaugcauuugcaugcuaaacgcugacgcggcucggggcugcaggcuccacccugacccgcgcgcuccgggggacgaccggacugucaccgcccguccgcccacccgcuccgggcccagcuccucuuccucuuccgcagugggucagagccuccaggcgcuucuccaggaggcugaucacuaaagcgauccucuuguguucccaccuccccucccgccgcccuucucggcugaccgcagccggcacccggggacuccagaagggguuggaaacuuucuggcagaguggaaaagcuugauugccugcggcuagcgcccucuagaccuacccgcuucuaacagugcagagcgcug

SEQ ID NO: 10726 - RNA, 2501 nt, Mus musculus
cagcgcucugcacuguuagaagcggguaggucuagagggcgcuagccgcaggcaaucaagcuuuuccacucugccagaaaguuuccaaccccuucuggaguccccgggugccggcugcggucagccgagaagggcggcgggaggggaggugggaacacaagaggaucgcuuuagugaucagccuccuggagaagcgccuggaggcucugacccacugcggaagaggaagaggagcugggcccggagcgggugggcggacgggcggugacaguccggucgucccccggagcgcgcgggucaggguggagccugcagccccgagccgcgucagcguuuagcaugcaaaugcauuccccgcuccucccccacccccaccccgccccagcccuccccgccccgggagcgagcucagcggcuccgcagccgcccaccgccuccugcgcgccgcgccgcccaagcgggcggcucuacuuaagcggcgcgcgggccgcgacccgccacucgccuggagcgcgcgggcgaggcaggcgcagcgcaccggggcucucgugggcgcacugcugcgcgcucgcaccgcgcggcucucaguggccggccgccgccugagcgcagggcuccccgauaagagccgcuggggcuuccgaucgcgaccccgcucccugccacuuggcccauccgggccaccucuuuuuggccauggcucuggcggacagcacccgaggauuacccaacgggggcggaggcggagguggcagcggcucgucgucguccucggcggagccgccgcucuucccggacaucguagagcugaacgugggagggcagguguaugugacccggcgcugcaccgugguguccgugcccgacucgcugcucuggcguauguucacgcagcagcagccgcaggagcuggcccgggacagcaaaggccgcuucuuucuggaccgggacggcuuccucuuccgcuacauccuggauuaccugcgggacuugcagcucgugcugcccgacuacuucccggagcgcagccggcugcagcgcgaggccgaguacuucgagcugccggagcucgugcgucgccucggggcgccccagcaacccgguccggggccaccgccgccgcacucgcgccgcggggugcacaaggagggcucucugggcgaugagcugcugccgcugggcuacgcagagcccgagccgcaggagggcgccucggccggggcgccuucgcccacgcuggagcuggcuagccgcagcccguccgggggcgcggcggggccccugcucacgccgucccagucuuuggacggcagccggcgcuccggcuacaucaccaucggcuaccgcggcuccuacaccaucgggcgcgacgcucaggcggacgccaaguuccggcggguggcgcgcaucaccgugugcggcaagacgucgcuggccaaggagguguuuggggacacccugaaugagagccgggaccccgaccggcccccggagcgcuacaccucccgcuauuaccucaaguucaacuuccuagagcaggccuucgauaagcuguccgagucgggcuuccacaugguggcgugcagcuccacgggcaccugcgcuuuugcuagcagcaccgaccagagcgaggacaagaucuggaccagcuacaccgaguacgucuucugcagggagugagcuccccacgcccgccccucgccacuccggugcccacuucccuuccuccccucgggggacaggauuauagaugcccucgcuuccucccuguuucccgauuccuucugcccccacccccagaucuccuaguaggucacccagacccgucugcaccccacuugcgaaucugcagccacaaauccucugggcgucuucaucaucuuuggaccccacuagccgagagaguguucugauguagcccuucacucaugcuuccucuacuccuggccuccaaccacccuucccccagauugucgugaucuagugggacagucaccaaguaccugggaaugacugaauugaucagaaucggauugcacgguguccggcgugcaguucggacgaguccuugacaucuuaaacccuuugacuccauagcgguuucagagaucagaacugagagugcuguguggagagagugcuuuaaaagguuguuagagauuugacccucauuagaaagagaguuuuagacaauugaaugguagaccguaugcuggaagaccccaaggacgcaguucagagacuguaaauaaagagauuuuuuuguuuguuuuuaaaguuacagguagaaguaaauucuaguacuggcaacaggggagaguucuauuuacccccaacacauuagaucuccuguggcuuaaaauuguagaaagcaauccuccugccugcggaggcgcccuuucucuucagcuguuugccgagcuuuagguuuuguugguuaaggcuucuaggcuaggagcaggcagggagcgggaggcagcgcuucuagaagucaccuggca

SEQ ID NO: 10727 - RNA, 2501 nt, Mus musculus
auaacacauuucccaagacucaacguuuucacugacauacacacauuuacaaucuuaaggugaacucagccuugaggggaaacagcuuguguacuuuccacgcguucguaaacugugucacaaguccaagccagcggacucagagacuucuagcugauauuucagggguagaauaucgaacugacaacuuccaccucacauguauuucuuugcauuucuuguucuugggaaagaaguagaagaaaaaccaaaaaaggucuugcuuugauuugcacaugggaugaaacaaaaggaacggcggucaucucucauauacaggccggauucgagcuggucauucacuggucaagaagagauccgggcuguguucugcagaggccuacagaauucaacaguacaaucagaguaaggcugcccagagccacccuacucuaaaaagcuaaagacacgagucaccggcucuccccuuggccagcuauuucagaccgaacaucagaaccgagcucaugcaacacggaccaagugggaccgggagggaggaaggaugagacgcaaaaagcaaaauccaaccaacaaaacuggaaagcccaacguaucguaaagcaccgccccucccccucugugggucaaaacgcaacagguuccgaagugcaaagcaaacaccaacugcuggcgcuaacaaccgcucuccuuuaaaguuggcugcagaagugcggcggcuggggaaugaugcugcgaaauccacacgcucucucgcccgcgcccucgaaggcucggccuuucaagcccggacuggcaucuccgccucugccugacaccuauacaucuauguacauacaaaccgggcccccugucgcccgagggcgcagcggaaggccgcgagucucgaaccuauacauauguacacgugugugcacagguccccgcggggucauagcgcggcagcguaggccgcgggguagggguccagcugaggcuugcccaugccuggcagcaggauguaggcgagcggcggcugcagccccgggcugggccacgcgcugcaguugcacgggaucauguagccgggguugccgggacuggggugcgagugcgugugcccuccggcggccgccgcggccgcagcagccgccgcggccgccccguggaaggcgcccgcacccgccgugggguaccccagcgacgacgcguacggcaggccggacgacgacgacgagaucucugccaucuuggagcccaggucgagcagugaguaggggcugccagcggcggcggcggcagcggcggcggcggcagcggccgcagacugcgggaagaagacgcgcgcggcggcggcggcagcugcggcggccgccuucucgggguucgcgagcagagacucggggaccaggccgccgcccgcgcccgcgugcagcccggcucccgccuugagcgccgggugcucggcguccgccacgcugcccaggccguagggcacggggaaggcgaacuuguccuuuuugagcagcgucuugggcuugcgccgcggccgguacuuguagucgggaugcuccuucaugugcauggcucgcaggcgcuucgccucgucgaugaacggccgcuucuccgacucggugagcagcuuccacucggcgcccaggcgcuugcugaucuccgaguugugcaucuuaggguucuccugggccaucuuccgccgcugagcccgcgaccacaccaugaaggcguucaugggccgcuugacgugguccacaggcuuggacaugcugucgccgugccgcggcugcagcccgccgccgccgccaccggggcccucggccuccgcccggaggaaaucaauguuggcugccagagggaaccggcucagcgggcggccgugcguccccgcgucguucccgcgcgggaagagaggaccagacgaccagcccugggucggggcgcugcgucccggaccgcuuuggucugucuggucgagcucuaagaaaaaauccucuccgggacccugaaacuucuccucgguguccccacuccgcggugucacucugcccucugcuuuuuuguccucugucccguugcuuuggcucgccaacucccugcagguggccgcugccugguucugcucuccccucuccucugucuucagcgccuuaaaagccaagcagccccgaaaguugagcggcggaggauccaccaaguugagccgagaagcccgccgccgcgugcugccaagugccaaagggggcucucggcggcuggaguguuuggguucuccccggugacuuucucauuugacagaagcagaugggagugggggagggguggccgcgaagaggaagaggagggguagggucggggcgcgcagagcagggcggcggacagaaacacaaacacugcagcggcccgucuucugugucggggucagggcgcgcugauggaacccccaauccuguaguucugcugagggcugacgcuguccccgggcaccugccuggagaaucuugcug

SEQ ID NO: 10728 - RNA, 2501 nt, Mus musculus
cagcaagauucuccaggcaggugcccggggacagcgucagcccucagcagaacuacaggauuggggguuccaucagcgcgcccugaccccgacacagaagacgggccgcugcaguguuuguguuucuguccgccgcccugcucugcgcgccccgacccuaccccuccucuuccucuucgcggccaccccucccccacucccaucugcuucugucaaaugagaaagucaccggggagaacccaaacacuccagccgccgagagcccccuuuggcacuuggcagcacgcggcggcgggcuucucggcucaacuugguggauccuccgccgcucaacuuucggggcugcuuggcuuuuaaggcgcugaagacagaggagaggggagagcagaaccaggcagcggccaccugcagggaguuggcgagccaaagcaacgggacagaggacaaaaaagcagagggcagagugacaccgcggaguggggacaccgaggagaaguuucagggucccggagaggauuuuuucuuagagcucgaccagacagaccaaagcgguccgggacgcagcgccccgacccagggcuggucgucugguccucucuucccgcgcgggaacgacgcggggacgcacggccgcccgcugagccgguucccucuggcagccaacauugauuuccuccgggcggaggccgagggccccgguggcggcggcggcgggcugcagccgcggcacggcgacagcauguccaagccuguggaccacgucaagcggcccaugaacgccuucaugguguggucgcgggcucagcggcggaagauggcccaggagaacccuaagaugcacaacucggagaucagcaagcgccugggcgccgaguggaagcugcucaccgagucggagaagcggccguucaucgacgaggcgaagcgccugcgagccaugcacaugaaggagcaucccgacuacaaguaccggccgcggcgcaagcccaagacgcugcucaaaaaggacaaguucgccuuccccgugcccuacggccugggcagcguggcggacgccgagcacccggcgcucaaggcgggagccgggcugcacgcgggcgcgggcggcggccugguccccgagucucugcucgcgaaccccgagaaggcggccgccgcagcugccgccgccgccgcgcgcgucuucuucccgcagucugcggccgcugccgccgccgccgcugccgccgccgccgcuggcagccccuacucacugcucgaccugggcuccaagauggcagagaucucgucgucgucguccggccugccguacgcgucgucgcugggguaccccacggcgggugcgggcgccuuccacggggcggccgcggcggcugcugcggccgcggcggccgccggagggcacacgcacucgcaccccagucccggcaaccccggcuacaugaucccgugcaacugcagcgcguggcccagcccggggcugcagccgccgcucgccuacauccugcugccaggcaugggcaagccucagcuggaccccuaccccgcggccuacgcugccgcgcuaugaccccgcggggaccugugcacacacguguacauauguauagguucgagacucgcggccuuccgcugcgcccucgggcgacagggggcccgguuuguauguacauagauguauaggugucaggcagaggcggagaugccaguccgggcuugaaaggccgagccuucgagggcgcgggcgagagagcguguggauuucgcagcaucauuccccagccgccgcacuucugcagccaacuuuaaaggagagcgguuguuagcgccagcaguugguguuugcuuugcacuucggaaccuguugcguuuugacccacagagggggaggggcggugcuuuacgauacguugggcuuuccaguuuuguugguuggauuuugcuuuuugcgucucauccuuccucccucccggucccacuugguccguguugcaugagcucgguucugauguucggucugaaauagcuggccaaggggagagccggugacucgugucuuuagcuuuuuagaguaggguggcucugggcagccuuacucugauuguacuguugaauucuguaggccucugcagaacacagcccggaucucuucuugaccagugaaugaccagcucgaauccggccuguauaugagagaugaccgccguuccuuuuguuucaucccaugugcaaaucaaagcaagaccuuuuuugguuuuucuucuacuucuuucccaagaacaagaaaugcaaagaaauacaugugagguggaaguugucaguucgauauucuaccccugaaauaucagcuagaagucucugaguccgcuggcuuggacuugugacacaguuuacgaacgcguggaaaguacacaagcuguuuccccucaaggcugaguucaccuuaagauuguaaauguguguaugucagugaaaacguugagucuugggaaauguguuau

SEQ ID NO: 10729 - RNA, 2501 nt, Mus musculus
aaccgcgaagccgaacaauaccggcagcgcucugggcggcgugagcaaggccucgggggagggagcggccacccgagagcgccguggacucgacgccuagccuccuccucccggcugcccagcgccccugcggagaucagguggagcggcgggugcgccaggcucuggggcuggcggagcuuguugcuguccgcucccugccagcuugugugcgcacagccacugcccuagggcacuguggccccgcagccgcguugacuucauucggcggaugccgcugaucucagccaggcuccugguccgccggcaguacaaggcagcuagcgagugagugcgugcgugcgugcgcgcgcgggggcgcgcaggggugggggccgcggcgcugagcucgcccuccggcggccccccucuccuccgcuccccacaccucccuccgcucccuccucccgcccgcccuccccugcccugcccgcccgcccccgccgcagcuccuuuaauacacuuugguucuccgccuggcuuuggacucuucuccuccuccaccuccuccucccgcgccuccuccgccgccgccuccucuuccucuccgcgccuucgcucggugcccggccgccugaggcagauacaggcggcggcggcgggcgcaccagcccggcucccgagacugcagucgccaguauuuccaccgccgguucacggagccgggcguccagaggacgcgccucgccgauccgaagaggaaauccaggcggcgggguucaccggcgccggcggggcggccgggcgcgcuggccaugcuucuggacgcggggccgcaguucccggccaucggggugggcagcuucgcgcgccaccaccaccacucggccgcggcagcggcggcugcggcggccgagaugcaggaccgcgagcugagccuggcggcagcucagaacggcuucguggacucggccgcggcgcacaugggcgccuucaagcucaaccccggggcacacgaacugucuccuggucagaguucggcguucacgucgcaagguccgggugcuuacccggguucggcugcugcagccgcugcggccgcggcucuagggccccacgccgcacacguuggcuccuauucggggccucccuuuaauuccacccgggacuuccuguuccgcagccggggcuucggggacucggcgccgggaggcgggcagcacgggcucuucggacccggcgccggcggccuucaccacgcgcacucggacgcgcagggccaccuucuuuucccuggccucccggagcagcacgggccgcacgccucgcagaacgugcucaaugggcaaaugcgccuagggcugccgggcgagguguucgggcgcucggagcaauaccgccaaguggccagcccgcggaccgaccccuacucggcggcgcagcuccacaaccaguacggcccuaugaauaugaacauggggaugaacauggcagcggccgcagcccaccaccaccaucaccaccaccacccuggugccuuuuuccgcuacaugcggcagcagugcaucaagcaagagcucaucugcaaguggaucgacccggagcagcuaagcaaucccaagaaaagcugcaacaaaacuuucagcaccaugcacgagcuggugacccacgucucuguggagcacgucggcggcccggaacagagcaaccacgucugcuucugggaggaguguccacgcgagggcaaacccuuuaaggccaaauacaaacuggucaaccacauccgcgugcacacuggcgagaagcccuuccccuguccuuucccgggcuguggcaaggucuucgcacgcuccgagaaccucaagauccacaaaagaacucauacagguaaucgugggucagcagugggaagaggcaccucgaggagaaauaaaugcacagacugagcguguguguguguguguguguguguguguguguguguucguacgcguuggggaaugaccaucagccagggaccuggaaugggagagcgcaggacagccagggcuuguuuuuguuggaggaugguaagaguauuauuagacugggauuuuuccaugugcggaaauugaacuuuuaaacgaucagcguaauaccaaauauaugcuuggagugaugcgauugccaccccccacccgcccguccugcucaauauuuccguucuaaauagagcgcacaaaauaaaacaauucggcucuagcucgauguccgggaagcgagcauagcaaggauuuugccagcuugucugacugagcuuuucugccccgaguggauuaucuauuuuucagaggcucguguuucccccauuuuuuuuuuuuuuuuacacaggguccaaacguccuucucaggacuguuucccauuaaaugaaucuggugugagccgaagcuguaaagagguucucauuuaaaaaguguuuuuaaagcccauuuuggggugggucgcaggggacugacggugguuugucagcaguuugugagau

SEQ ID NO: 10730 - RNA, 2501 nt, Mus musculus
aucucacaaacugcugacaaaccaccgucaguccccugcgacccaccccaaaaugggcuuuaaaaacacuuuuuaaaugagaaccucuuuacagcuucggcucacaccagauucauuuaaugggaaacaguccugagaaggacguuuggacccuguguaaaaaaaaaaaaaaaaugggggaaacacgagccucugaaaaauagauaauccacucggggcagaaaagcucagucagacaagcuggcaaaauccuugcuaugcucgcuucccggacaucgagcuagagccgaauuguuuuauuuugugcgcucuauuuagaacggaaauauugagcaggacgggcgggugggggguggcaaucgcaucacuccaagcauauauuugguauuacgcugaucguuuaaaaguucaauuuccgcacauggaaaaaucccagucuaauaauacucuuaccauccuccaacaaaaacaagcccuggcuguccugcgcucucccauuccaggucccuggcugauggucauuccccaacgcguacgaacacacacacacacacacacacacacacacacacacgcucagucugugcauuuauuucuccucgaggugccucuucccacugcugacccacgauuaccuguaugaguucuuuuguggaucuugagguucucggagcgugcgaagaccuugccacagcccgggaaaggacaggggaagggcuucucgccagugugcacgcggaugugguugaccaguuuguauuuggccuuaaaggguuugcccucgcguggacacuccucccagaagcagacgugguugcucuguuccgggccgccgacgugcuccacagagacgugggucaccagcucgugcauggugcugaaaguuuuguugcagcuuuucuugggauugcuuagcugcuccgggucgauccacuugcagaugagcucuugcuugaugcacugcugccgcauguagcggaaaaaggcaccaggguggugguggugauggugguggugggcugcggccgcugccauguucauccccauguucauauucauagggccguacugguuguggagcugcgccgccgaguaggggucgguccgcgggcuggccacuuggcgguauugcuccgagcgcccgaacaccucgcccggcagcccuaggcgcauuugcccauugagcacguucugcgaggcgugcggcccgugcugcuccgggaggccagggaaaagaagguggcccugcgcguccgagugcgcguggugaaggccgccggcgccggguccgaagagcccgugcugcccgccucccggcgccgaguccccgaagccccggcugcggaacaggaagucccggguggaauuaaagggaggccccgaauaggagccaacgugugcggcguggggcccuagagccgcggccgcagcggcugcagcagccgaacccggguaagcacccggaccuugcgacgugaacgccgaacucugaccaggagacaguucgugugccccgggguugagcuugaaggcgcccaugugcgccgcggccgaguccacgaagccguucugagcugccgccaggcucagcucgcgguccugcaucucggccgccgcagccgccgcugccgcggccgagugguggugguggcgcgcgaagcugcccaccccgauggccgggaacugcggccccgcguccagaagcauggccagcgcgcccggccgccccgccggcgccggugaaccccgccgccuggauuuccucuucggaucggcgaggcgcguccucuggacgcccggcuccgugaaccggcgguggaaauacuggcgacugcagucucgggagccgggcuggugcgcccgccgccgccgccuguaucugccucaggcggccgggcaccgagcgaaggcgcggagaggaagaggaggcggcggcggaggaggcgcgggaggaggagguggaggaggagaagaguccaaagccaggcggagaaccaaaguguauuaaaggagcugcggcgggggcgggcgggcagggcaggggagggcgggcgggaggagggagcggagggagguguggggagcggaggagaggggggccgccggagggcgagcucagcgccgcggcccccaccccugcgcgcccccgcgcgcgcacgcacgcacgcacucacucgcuagcugccuuguacugccggcggaccaggagccuggcugagaucagcggcauccgccgaaugaagucaacgcggcugcggggccacagugcccuagggcaguggcugugcgcacacaagcuggcagggagcggacagcaacaagcuccgccagccccagagccuggcgcacccgccgcuccaccugaucuccgcaggggcgcugggcagccgggaggaggaggcuaggcgucgaguccacggcgcucucggguggccgcucccucccccgaggccuugcucacgccgcccagagcgcugccgguauuguucggcuucgcgguu

SEQ ID NO: 10731 - RNA, 2501 nt, Mus musculus
aaagaccaaggaugauucucaaacacaggucaacuggggaacuccugugacucaucccaggcaaaacagagcaguacagagaccucagccccacuccggaaaaaaaccuaguauuggaagaauagcagagaggcuaugagacaaggaagugaagucuccagucugucaucuaacuauuugccauaaagucgcuuaaaaugaagcacacaguuccuggucaaaaguuauaggaaacuguauuguuguguaaacaagaaaacugaaacuaagauguaaaagguaaccugaacccguuccaagucuguuuacaucaggguuaggaccuauuggggauaucgcugccccuccagaccugcccccucacacacacacacacacacacacacacacacacacacacagacacacaaacagacagacagacacacacacagacagacagacacacacacagagacacacagacagacacacagacagacacagacacacacacacacacacacacacagacacagacacacacacagacacacacacacagacacacacacacacagacacacagagagagacacagacacagacacacacacacacacacagagacacacacacagacagacagacacacacacacacagacagacacacacacacaaacacagacagacacacagacacacacacacagacagacacacacacacacacacacacagagacacacacacacagacacacacacacacacacagagagacacagacacacacacacacacacacagagacacacacacacagacacacacacacacacacagagagacacagacacacacacacacacacacacagagacacacacacagagacacacacacagagacacacacacagagagacacagacacacacacacagacacacagacacacagacacacagacacacagacacacagacacacagacacacacacacacacacacacacacacacacggucucccccgacauccaccaccaccaccaccucucaaaagcagaaugccuuuggucugcaccuagcuuccacuuucaauucugucugcuuugcuuacauccauccucacguccacgaguccugagcugaaaaacagcuugaucgcaaagcgcuuucaccauguccugcaggcagguagcaucuguccgucugaaaguaaucccuauaucugugcccuuggucacucacaaggcaggcagggaagaugaagagugugugaacaagcggcccgucaagaacuguuacagggaaccuguauucacgcucccguuucagcaucucacuggugccuacucucagagacacugaccccuaugcgcauccuugccuguuaguggugacacuuccguucaagcagcucgagaggugguaccugcucuccccacccgcauagaagcucugcccccaaggcuguggggugcucuucucugaguggagagggaagcaccuagucccggagaaaugacagggacgggugggaguuaaggacuggaaagcaagaggcugggggaaaccaucaacucccacucccacgggguauugugagagaaaccaaauuggcccaaaugggaguucuaacucagcaaguguuuccccagcugcuugagugagaggccaggggacggugaaccucaaagcaggccuggacuggugucccagcgacgugcacgcugagaguaucuagucuuuuagaguugcccaccaauuagguggcacuuuucuggcacaaccucuugcggcuccugagagugcagucucgggaggcaaaaacuaacgcaggacagggcagaggcgcggggcagcaaagcucucggcucgcccgucggaaaguggauggaggcggcagcgcgggcacacgggucccguacucacccgccuggcgaccugcuccggagccuugccgguccucggccucacaggggaacgggcgcggacgucuguccaggcguguggaggcggccccgcgccccagcuaugaaucaacuacggggcaaguguccaggggcgggaguuacgggaaagcgccgggggagggccgaggggccaaguacuguugcaauuucccgucucgcugagcacuuuuggcacuccugggacccacaggaauuugcuccuggucccaaggggauguaggggggaacgaucgggacccugcgacgggcgcgguucccgggaccgggcgggcagcaccggugagaagggaagugggagaggccugggaggaaaagcugguccuugagcaucguuguuccuggagggagaggggacgagcugcgacccagugccccgugccagguguccugcacagagccaauuguguugcuugggagauccaaccccagcgcuccgucugaaaauuaccugaaaugucaaacuguuggaucaaacuugugaucgaguugacuuucggcguucagagcaagacagacguguuagaacagagaucuaugaacu

SEQ ID NO: 10732 - RNA, 2501 nt, Mus musculus
aguucauagaucucuguucuaacacgucugucuugcucugaacgccgaaagucaacucgaucacaaguuugauccaacaguuugacauuucagguaauuuucagacggagcgcugggguuggaucucccaagcaacacaauuggcucugugcaggacaccuggcacggggcacugggucgcagcucguccccucucccuccaggaacaacgaugcucaaggaccagcuuuuccucccaggccucucccacuucccuucucaccggugcugcccgcccggucccgggaaccgcgcccgucgcagggucccgaucguuccccccuacauccccuugggaccaggagcaaauuccugugggucccaggagugccaaaagugcucagcgagacgggaaauugcaacaguacuuggccccucggcccucccccggcgcuuucccguaacucccgccccuggacacuugccccguaguugauucauagcuggggcgcggggccgccuccacacgccuggacagacguccgcgcccguuccccugugaggccgaggaccggcaaggcuccggagcaggucgccaggcgggugaguacgggacccgugugcccgcgcugccgccuccauccacuuuccgacgggcgagccgagagcuuugcugccccgcgccucugcccuguccugcguuaguuuuugccucccgagacugcacucucaggagccgcaagagguugugccagaaaagugccaccuaauuggugggcaacucuaaaagacuagauacucucagcgugcacgucgcugggacaccaguccaggccugcuuugagguucaccguccccuggccucucacucaagcagcuggggaaacacuugcugaguuagaacucccauuugggccaauuugguuucucucacaauaccccgugggagugggaguugaugguuucccccagccucuugcuuuccaguccuuaacucccacccgucccugucauuucuccgggacuaggugcuucccucuccacucagagaagagcaccccacagccuugggggcagagcuucuaugcggguggggagagcagguaccaccucucgagcugcuugaacggaagugucaccacuaacaggcaaggaugcgcauaggggucagugucucugagaguaggcaccagugagaugcugaaacgggagcgugaauacagguucccuguaacaguucuugacgggccgcuuguucacacacucuucaucuucccugccugccuugugagugaccaagggcacagauauagggauuacuuucagacggacagaugcuaccugccugcaggacauggugaaagcgcuuugcgaucaagcuguuuuucagcucaggacucguggacgugaggauggauguaagcaaagcagacagaauugaaaguggaagcuaggugcagaccaaaggcauucugcuuuugagagguggugguggugguggaugucgggggagaccgugugugugugugugugugugugugugugugucugugugucugugugucugugugucugugugucugugugucugugugucugugugugugugucugugucucucugugugugugucucugugugugugucucugugugugugucucugugugugugugugugugugugucugugucucucugugugugugugugugugucugugugugugugucucugugugugugugugugugugucugugucucucugugugugugugugugugucugugugugugugucucugugugugugugugugugugugucugucugugugugugugucugugugucugucuguguuugugugugugugucugucugugugugugugugucugucugucugugugugugucucugugugugugugugugugucugugucugugucucucucugugugucugugugugugugugucugugugugugugucugugugugugucugugucugugugugugugugugugugugugucugugucugucugugugucugucugugugucucugugugugugucugucugucugugugugugucugucugucuguuugugugucugugugugugugugugugugugugugugugugugugugugagggggcaggucuggaggggcagcgauauccccaauagguccuaacccugauguaaacagacuuggaacggguucagguuaccuuuuacaucuuaguuucaguuuucuuguuuacacaacaauacaguuuccuauaacuuuugaccaggaacugugugcuucauuuuaagcgacuuuauggcaaauaguuagaugacagacuggagacuucacuuccuugucucauagccucucugcuauucuuccaauacuagguuuuuuuccggaguggggcugaggucucuguacugcucuguuuugccugggaugagucacaggaguuccccaguugaccuguguuugagaaucauccuuggucuuu

SEQ ID NO: 10733 - RNA, 2501 nt, Mus musculus
cuguuuuacauaggaggaagggcgguauaugcuggaaaacaaaaucuaaaacugauagcuuuggcccuuugaagcagaugaucauauuaaaaguguuaagauguguaaaaugacgcgacagcuaaccgaguaaaaguacgaaaugcccuuuggacuucucugcgggcuugggggagcaaagauccaguagucggacuucuaucggugugaggaaagugucauccaaaaagaggggaugggcguugucuuugugugagguuugaauugagucaccuugggcucugugucuggguuaacugggaaaaccucaagcaaaccugcgccuuuaagacucaguugcuauccaaacacaaguaaacagaguggaccauuagcgggcgccgggcuuggaggcggagccugggcgcugcagccuugcuccucugcaggacgcccgccgcgaggggaggcggggccgcuacuaaagccuuggacuccgggccaggggcagccuggggcgggacgcgggcugggacggagcucagcgcgcucgcagccggagggugauggcccugcagggcugcgggcuccgacuuuacccgcaguccgcggucagaaacuggcccaggcaccgggaucugggcgagcucugagcacucaucccaacacgcucgcucuuuacacaucccgcuuccacggacugccgaagaccaauuaccgcugucgcuuucgcucccccagaucauguucucgguucccgggacaacgcgccgaaaaagaaguucucccaguuuggaccucaugaccuuuccaagcugugcguccugcuguccggaccuagucugaaccgcgcugcccaggcagacaucgguucuggcggugaguguccuuuccagggccaggcuguagccuuccaaaggaagggagggaugugggugcucaaggggcgcccagguucucagucuggagcgcuacaaguucagaaaaugaaaggcagccgugcggacccuagucccgggccucguguucuggccuccuccggucccugcacgcgacucccagcuaauacacucaguuguacuuuugugcgcugucccuuaguuugguuuugguagauuuacgcauucggcaagauuuauaaaggccgaucaucguacuuuguggccagaucccaucaccccgugauauugcuccccugcucuagaaagcgggauccacgcuuccuccuacugcagcuccggcacucagcacggaagggccgggacacacggugcaaucaagccagcgacuccgaaggcgcauuucacaggggaauaguccagucaugggugauuauuuuuuccaaccguguacuggccucuugcuuuuccuccugcuccggucuucgcccagaggccaacaggcaagcuucucaggagcugagacgcuuggguugucgagaaauagcucggaauggagucgcgguuguaggaaggaggcaggacaagguguuuguggaggcagcaacgcuggaucggucuccccaccugugagcagagaacaaaagaguucugacugcuuucgaagcgaaacugggugcagacagcaacuuucucugcuccacaaauuccagucuugaacagaacaagaaaaugaaauggagagggagggagcggagacaaacccaguuuaugcggagggcgccuuaauuuaauuaacucuucgggaaggcagaggcacggggaaggggcagaaacuucgugccccccccccacuugaccaaauucuccucccccaccaugaucguagaucucuuucuacuauagcucucuggcuuuuacacaguucugcuguguuugaacugaaaaucagcgaacauaaccauucauccaucugucauuuuacucagaagcccauacacagggucuagcagauaacgccgaacgauauuauuauuauuauuauuauuauucaauguaacaucacuauuaccaacgauuggagagucuuuaucaaauaaucaggaccccugugcucuccaguguuuuuaaaguuuuaccaaacugaaauuaauauguacuuugcugacagccagcgaaauuaaauuuuacaaaucgucuaacaugccugagaauuccauugaaaaccgaugaaagaaauguagcuuucucuccauugaaccguuuaugacuuuucaugguuuaacuuuccucgcaaaauuaaagguaaccagugguccgaaacaugcuaguggagagaugacagcagagggcccauaguuagugccugagauggaguaaguccgcagccccaacaaaacgaaaguaccuuaguuccauggguugacuugagcgaugauuugacuuacauugcuagagacuaaacaggggcgugggaaucugaacucucugguuauuuauguuugguagguguuuaagggcacucuauuuguaaagagauaucagagggcagacuggcuugcucuuccucaaaccagaugacucuuccuugcaaagaaagcaaacuuucuaugaaguggcaau

SEQ ID NO: 10734 - RNA, 2501 nt, Mus musculus
auugccacuucauagaaaguuugcuuucuuugcaaggaagagucaucugguuugaggaagagcaagccagucugcccucugauaucucuuuacaaauagagugcccuuaaacaccuaccaaacauaaauaaccagagaguucagauucccacgccccuguuuagucucuagcaauguaagucaaaucaucgcucaagucaacccauggaacuaagguacuuucguuuuguuggggcugcggacuuacuccaucucaggcacuaacuaugggcccucugcugucaucucuccacuagcauguuucggaccacugguuaccuuuaauuuugcgaggaaaguuaaaccaugaaaagucauaaacgguucaauggagagaaagcuacauuucuuucaucgguuuucaauggaauucucaggcauguuagacgauuuguaaaauuuaauuucgcuggcugucagcaaaguacauauuaauuucaguuugguaaaacuuuaaaaacacuggagagcacagggguccugauuauuugauaaagacucuccaaucguugguaauagugauguuacauugaauaauaauaauaauaauaauaauaucguucggcguuaucugcuagacccuguguaugggcuucugaguaaaaugacagauggaugaaugguuauguucgcugauuuucaguucaaacacagcagaacuguguaaaagccagagagcuauaguagaaagagaucuacgaucauggugggggaggagaauuuggucaaguggggggggggcacgaaguuucugccccuuccccgugccucugccuucccgaagaguuaauuaaauuaaggcgcccuccgcauaaacuggguuugucuccgcucccucccucuccauuucauuuucuuguucuguucaagacuggaauuuguggagcagagaaaguugcugucugcacccaguuucgcuucgaaagcagucagaacucuuuuguucucugcucacagguggggagaccgauccagcguugcugccuccacaaacaccuuguccugccuccuuccuacaaccgcgacuccauuccgagcuauuucucgacaacccaagcgucucagcuccugagaagcuugccuguuggccucugggcgaagaccggagcaggaggaaaagcaagaggccaguacacgguuggaaaaaauaaucacccaugacuggacuauuccccugugaaaugcgccuucggagucgcuggcuugauugcaccgugugucccggcccuuccgugcugagugccggagcugcaguaggaggaagcguggaucccgcuuucuagagcaggggagcaauaucacggggugaugggaucuggccacaaaguacgaugaucggccuuuauaaaucuugccgaaugcguaaaucuaccaaaaccaaacuaagggacagcgcacaaaaguacaacugaguguauuagcugggagucgcgugcagggaccggaggaggccagaacacgaggcccgggacuaggguccgcacggcugccuuucauuuucugaacuuguagcgcuccagacugagaaccugggcgccccuugagcacccacaucccucccuuccuuuggaaggcuacagccuggcccuggaaaggacacucaccgccagaaccgaugucugccugggcagcgcgguucagacuagguccggacagcaggacgcacagcuuggaaaggucaugagguccaaacugggagaacuucuuuuucggcgcguugucccgggaaccgagaacaugaucugggggagcgaaagcgacagcgguaauuggucuucggcaguccguggaagcgggauguguaaagagcgagcguguugggaugagugcucagagcucgcccagaucccggugccugggccaguuucugaccgcggacugcggguaaagucggagcccgcagcccugcagggccaucacccuccggcugcgagcgcgcugagcuccgucccagcccgcgucccgccccaggcugccccuggcccggaguccaaggcuuuaguagcggccccgccuccccucgcggcgggcguccugcagaggagcaaggcugcagcgcccaggcuccgccuccaagcccggcgcccgcuaaugguccacucuguuuacuuguguuuggauagcaacugagucuuaaaggcgcagguuugcuugagguuuucccaguuaacccagacacagagcccaaggugacucaauucaaaccucacacaaagacaacgcccauccccucuuuuuggaugacacuuuccucacaccgauagaaguccgacuacuggaucuuugcucccccaagcccgcagagaaguccaaagggcauuucguacuuuuacucgguuagcugucgcgucauuuuacacaucuuaacacuuuuaauaugaucaucugcuucaaagggccaaagcuaucaguuuuagauuuuguuuuccagcauauaccgcccuuccuccuauguaaaacag

SEQ ID NO: 10735 - RNA, 2501 nt, Mus musculus
gucguccuucgguuugacccacgguaccuagugucuguaguggcgcuccccgcuccgucucucccaucaccucuacccugccccuagucagggaagaaagccaaaaguggguagaagucagcucgcagagucuccagcgugccaccgcuccacucagguaaacuucgcagugagugaccugcacuuggagaagggccuuaccugagcgcgccucugccaauggcagcucaccugagggagcaccgcagccaaucaccgcgcagcucggcccucgggcuuguacccuuuagugaaagaauucagcgccuugcgagaaaguuaccuguggccgcccaaguccgccacuuugcgcucugugucugcccauugcagcgauccgggaggacuccgcgccgccgggccgccuccgagcgcgggccccaugugagggcucccuccccccaucccaccuuuccggcuaggugagggcgcgagcgagcgggcgagcgagaguggugaggggggacgaaagcagaauuaccuguagcucuuguucugccaucucgggcgcucucacacaccuucaccugcacagacuugaaaguccaguuucaccagaggcugaggcuccaggaaaaggggagcgaguucauuggaucaaacaugucacaagagucggacaaguaagugggucgcacgcgccggcggcggcugccgcugccccuuugggcugauggcaacugguuuguuguguuuuuguuuuuuuuguuuuuguuuuuguuuuuuaagucgcuauuguuggauuuugauuuuguauuuuuuuccucucuuuuuacuuuuuucuuuuugguguauccagacccucucggauuauuucuaccccgauucaggggagagacccuacucgaacgugaauguuuaaaacccguuuuggggccuugcaaguaaacguggguuuucuuugcuuccuccccgacgaaugagcucagcucccacugccccgaccaacggacccuugggcacugauugagguuuuggcagaugguggcgggaggccuguaguuaacccccuugccuggaggugcuccccagccucagacuuccugggccgguuggaaguucagucgacuuccuucgauuaggccaaagggccugcuggaaaagcggucugggccucuuuugugugcgcucaacaaaggccuuuuaugcgauugcagacacggccaucuuccccacugcggcgacccggggugcaugugcgccccagcgcgggucuccgacgggacggaggagcgggcaggccgcgauggcggguccgugggugugcccgcgccucgcuccuucccgcagcccacgcaguggccagucaccucgcgcaggugcgggacaggaccucucgggaaugggggacugauuuugaggccgaguacgaaggggugcccacacuugggccggucucccugcgccccgacgucucuggcucauacgcguccggugaccgcgcggcccacuguucggaggccgccaccucgggcguggggcucgaucggccuucgccgaggcugucgagggcaagggggugggggagcaugguggagcaccgggacuccgggcucucugcguccucgaccggagcucaggccugccgggagccgcgugagccgcggggcgcggggccugguccgucgcgguccccgccuuggggacggcuuugugcgagccgggggagguggggccgagggcgggagcgggcgggagcgggagggagcgggaggugggucccgcugcccuccuuccauucgguggcgacacuuccuucccccuccucccggggcguccuaggccgggaacuggcugcguccuauuggaaaggcucagaggccgcacuuuugcugccccuaguaacuuaacccggcugguguggccauuccaaggagaccuuccugagagucuugaccgagaaaagcacaggaccaguccccagguugaggaccuggaagggaggagggcggagaaggaaagccugccuaacccgauuuuggaugggcacugucacgaugcggccgauguccaggacgcuuguuuucauacuuuaaaacuuacuacucugucgcccuuuaagauuuaucugcgcaaguagauaccggaaucgaagaacuaguauuaggaacugggccaggagcuagaaaguuuaggguugggaaagcguaggagauacucccacgcacaucuugaccuccacuucagcucucuugguaguggaguuaucaccugagguugaaaacucauauaacccaaauccaagacaacaacaacguuuguuuuuucguuuuuauuuugguuuguuuugaguuugauguguaaaagggugcacaguuacuuuaauugcacaauuaacacucaguuugcuugcuuaguucuguggcacugcaugagucaaaggaacgaagaacgaaaguggauggguauuuauuuucuccaaguuauacuuagcaccaauagggauaauuuauucacuauug

SEQ ID NO: 10736 - RNA, 2501 nt, Mus musculus
caauagugaauaaauuaucccuauuggugcuaaguauaacuuggagaaaauaaauacccauccacuuucguucuucguuccuuugacucaugcagugccacagaacuaagcaagcaaacugaguguuaauugugcaauuaaaguaacugugcacccuuuuacacaucaaacucaaaacaaaccaaaauaaaaacgaaaaaacaaacguuguuguugucuuggauuuggguuauaugaguuuucaaccucaggugauaacuccacuaccaagagagcugaaguggaggucaagaugugcgugggaguaucuccuacgcuuucccaacccuaaacuuucuagcuccuggcccaguuccuaauacuaguucuucgauuccgguaucuacuugcgcagauaaaucuuaaagggcgacagaguaguaaguuuuaaaguaugaaaacaagcguccuggacaucggccgcaucgugacagugcccauccaaaaucggguuaggcaggcuuuccuucuccgcccuccucccuuccagguccucaaccuggggacugguccugugcuuuucucggucaagacucucaggaaggucuccuuggaauggccacaccagccggguuaaguuacuaggggcagcaaaagugcggccucugagccuuuccaauaggacgcagccaguucccggccuaggacgccccgggaggagggggaaggaagugucgccaccgaauggaaggagggcagcgggacccaccucccgcucccucccgcucccgcccgcucccgcccucggccccaccucccccggcucgcacaaagccguccccaaggcggggaccgcgacggaccaggccccgcgccccgcggcucacgcggcucccggcaggccugagcuccggucgaggacgcagagagcccggagucccggugcuccaccaugcucccccacccccuugcccucgacagccucggcgaaggccgaucgagccccacgcccgagguggcggccuccgaacagugggccgcgcggucaccggacgcguaugagccagagacgucggggcgcagggagaccggcccaagugugggcaccccuucguacucggccucaaaaucagucccccauucccgagagguccugucccgcaccugcgcgaggugacuggccacugcgugggcugcgggaaggagcgaggcgcgggcacacccacggacccgccaucgcggccugcccgcuccuccgucccgucggagacccgcgcuggggcgcacaugcaccccgggucgccgcaguggggaagauggccgugucugcaaucgcauaaaaggccuuuguugagcgcacacaaaagaggcccagaccgcuuuuccagcaggcccuuuggccuaaucgaaggaagucgacugaacuuccaaccggcccaggaagucugaggcuggggagcaccuccaggcaaggggguuaacuacaggccucccgccaccaucugccaaaaccucaaucagugcccaaggguccguuggucggggcagugggagcugagcucauucgucggggaggaagcaaagaaaacccacguuuacuugcaaggccccaaaacggguuuuaaacauucacguucgaguagggucucuccccugaaucgggguagaaauaauccgagagggucuggauacaccaaaaagaaaaaaguaaaaagagaggaaaaaaauacaaaaucaaaauccaacaauagcgacuuaaaaaacaaaaacaaaaacaaaaaaaacaaaaacacaacaaaccaguugccaucagcccaaaggggcagcggcagccgccgccggcgcgugcgacccacuuacuuguccgacucuugugacauguuugauccaaugaacucgcuccccuuuuccuggagccucagccucuggugaaacuggacuuucaagucugugcaggugaaggugugugagagcgcccgagauggcagaacaagagcuacagguaauucugcuuucguccccccucaccacucucgcucgcccgcucgcucgcgcccucaccuagccggaaaggugggauggggggagggagcccucacauggggcccgcgcucggaggcggcccggcggcgcggaguccucccggaucgcugcaaugggcagacacagagcgcaaaguggcggacuugggcggccacagguaacuuucucgcaaggcgcugaauucuuucacuaaaggguacaagcccgagggccgagcugcgcggugauuggcugcggugcucccucaggugagcugccauuggcagaggcgcgcucagguaaggcccuucuccaagugcaggucacucacugcgaaguuuaccugaguggagcgguggcacgcuggagacucugcgagcugacuucuacccacuuuuggcuuucuucccugacuaggggcaggguagaggugaugggagagacggagcggggagcgccacuacagacacuagguaccgugggucaaaccgaaggacgac

SEQ ID NO: 10737 - RNA, 2501 nt, Mus musculus
ucugaagugaugguggcagagcugguucucaaaaccacguugacuaaagcaguuaacuuucuguggggcuuuugcagcaguaaagcuguagaaccggccgaagcuggcaccugccguucaaggugguggccagacuccccgaguuaauaggcuuuucagccaagaacucaggaaguuccucgcuaacucugaucucagcuaccacucacuacagagcagauccccgcggcuaaggcuccucgcuuccagaacggaaagugugcucugcagggcacuuccccaacggccugggucucacgccuggguccgcggugcgagcggaggcgacagcucggcggcccccgcaccgcggccggcugggcugggcggggcgcagggccggucccgccgccgcgagccccaaccugcccgcccgaccuggcggcgcagucucgcgggaucgcccagcucucgcuccccguugcggccccggaggcggucgaggcccggacgcugccccccaccgaaagcucgccccggcugucugggguggcggggccgcgcgacgccgagggacagccaccuuccucugccgcccgaggugaggcguccccggcccgacggggcgggcgggcagcggccgggaucggagccgcaggugcgucgccucggagucccacgcaacuccuggaaagugacucuggguccccgcaggccggggacggagcugcucggcugcaggccgggaacaggugcccgacgcgggaccccgggggcucaggggagccucccgcaguccccaugagcugaccguggaagguuugcgcuggguggaauucgggguacagggggcacggggugagcgcguugaaggggaaagugcuggaggugaagaagcgcaaaggagucaccacccaggcccacucuuccuagggggaccucgcucaaccccagcagacugauuuucgccuuugcgaaaacaggaaaggcacauccgcagaagucugcgauuguagagagagcuaaaguugaagaacucugucugggucacuuguccucauuuuccccauauagugagauggccaaggggccccuagacccccuuucuucuaaccaccaucaccccuuuccucgcuccaacuugcuuaugccgugccuccucuuacccgguguuuuagacaguauaacccuucaucagcaguucccuagaauugaggcuuccuuagcaaagugauacauccgcgcccgggcagguggauaugucucuugcuaggauggaauuuuccacauuuuuuucuuucuuuguagcauuaguuaccuagcaugacauuugacuuggauuugacuuugugacgaauguuacugauaacacacuuuggguuuguuuuuacagcaguugccccagaauucauuuucaggaaacagcuucuaucaaaaugguacaaagaaugcaaugaggaauuuguacauuuuaucucugauuugagaaucuuuuugaugcggaaaggagcauaagaauaauccaagccaugugguaaaaucggagucuggcaagauggaaagguccccguuucuguuggcgugcauucuucugccccucguaagaggacacagccuuuucaccugugagccaaucaccguucccagauguaugaaaaugacuuacaacaugacguucuucccuaaccugaugggucauuaugaccaggggaucgcugcuguggaaaugggggugaguggauuuucaugccuauauugaaaauuaguuuauacguaguauuuuucucuuaacuauuacuuuuuaaucuuuaaacauaguuuuuuucccaaucauauuuuuuaaaguaguuuugaacauuaaguuccccuccucccgcugucauauuuugucuacaguuggacgguuaguuaauuugcuuauaaaaagguugcauucauaaugaagggugcuuacagauaauaaaaauauuuugcuuuuuugaauuugugucauugcuucuccaagacugugauuucugaauuuuuaaauuuuuaauauuuauuuguuuguuugauuuuucaagauaaggguucuucucuguguaguccuggcuguccuggaacucacucucuagaccaggcuggccucaaaacucagagauccaccggccucugcugggaugugugcgcuaccacgcucggccccaaauucugaauuuuuuuaaugguugacugaacauauaaucuauauugcuugagcuaaaaugaaacuuaaauguuuuuuaaaaguacuugucaaauucauuugacuuaguuuucccaaagcuaauaaauuauuggaauguuuuggcgcuaaagagaauguuuuacuaaaaggugacuuucaggcauagcauguaaguguuuucuuuauauaagauacuugcuaaaagaaaguccacuuguagggcgaagggcagugugacacuaacaaucgccucaggcgccucaguuaccugacucugguuuagagauaugaaaaugucccaggaggugugggaaga

SEQ ID NO: 10738 - RNA, 2501 nt, Mus musculus
ucuucccacaccuccugggacauuuucauaucucuaaaccagagucagguaacugaggcgccugaggcgauuguuagugucacacugcccuucgcccuacaaguggacuuucuuuuagcaaguaucuuauauaaagaaaacacuuacaugcuaugccugaaagucaccuuuuaguaaaacauucucuuuagcgccaaaacauuccaauaauuuauuagcuuugggaaaacuaagucaaaugaauuugacaaguacuuuuaaaaaacauuuaaguuucauuuuagcucaagcaauauagauuauauguucagucaaccauuaaaaaaauucagaauuuggggccgagcgugguagcgcacacaucccagcagaggccgguggaucucugaguuuugaggccagccuggucuagagagugaguuccaggacagccaggacuacacagagaagaacccuuaucuugaaaaaucaaacaaacaaauaaauauuaaaaauuuaaaaauucagaaaucacagucuuggagaagcaaugacacaaauucaaaaaagcaaaauauuuuuauuaucuguaagcacccuucauuaugaaugcaaccuuuuuauaagcaaauuaacuaaccguccaacuguagacaaaauaugacagcgggaggaggggaacuuaauguucaaaacuacuuuaaaaaauaugauugggaaaaaaacuauguuuaaagauuaaaaaguaauaguuaagagaaaaauacuacguauaaacuaauuuucaauauaggcaugaaaauccacucacccccauuuccacagcagcgauccccuggucauaaugacccaucagguuagggaagaacgucauguuguaagucauuuucauacaucugggaacggugauuggcucacaggugaaaaggcuguguccucuuacgaggggcagaagaaugcacgccaacagaaacggggaccuuuccaucuugccagacuccgauuuuaccacauggcuuggauuauucuuaugcuccuuuccgcaucaaaaagauucucaaaucagagauaaaauguacaaauuccucauugcauucuuuguaccauuuugauagaagcuguuuccugaaaaugaauucuggggcaacugcuguaaaaacaaacccaaaguguguuaucaguaacauucgucacaaagucaaauccaagucaaaugucaugcuagguaacuaaugcuacaaagaaagaaaaaaauguggaaaauuccauccuagcaagagacauauccaccugcccgggcgcggauguaucacuuugcuaaggaagccucaauucuagggaacugcugaugaaggguuauacugucuaaaacaccggguaagaggaggcacggcauaagcaaguuggagcgaggaaaggggugauggugguuagaagaaagggggucuaggggccccuuggccaucucacuauauggggaaaaugaggacaagugacccagacagaguucuucaacuuuagcucucucuacaaucgcagacuucugcggaugugccuuuccuguuuucgcaaaggcgaaaaucagucugcugggguugagcgaggucccccuaggaagagugggccuggguggugacuccuuugcgcuucuucaccuccagcacuuuccccuucaacgcgcucaccccgugcccccuguaccccgaauuccacccagcgcaaaccuuccacggucagcucauggggacugcgggaggcuccccugagcccccggggucccgcgucgggcaccuguucccggccugcagccgagcagcuccguccccggccugcggggacccagagucacuuuccaggaguugcgugggacuccgaggcgacgcaccugcggcuccgaucccggccgcugcccgcccgccccgucgggccggggacgccucaccucgggcggcagaggaagguggcugucccucggcgucgcgcggccccgccaccccagacagccggggcgagcuuucgguggggggcagcguccgggccucgaccgccuccggggccgcaacggggagcgagagcugggcgaucccgcgagacugcgccgccaggucgggcgggcagguuggggcucgcggcggcgggaccggcccugcgccccgcccagcccagccggccgcggugcgggggccgccgagcugucgccuccgcucgcaccgcggacccaggcgugagacccaggccguuggggaagugcccugcagagcacacuuuccguucuggaagcgaggagccuuagccgcggggaucugcucuguagugagugguagcugagaucagaguuagcgaggaacuuccugaguucuuggcugaaaagccuauuaacucggggagucuggccaccaccuugaacggcaggugccagcuucggccgguucuacagcuuuacugcugcaaaagccccacagaaaguuaacugcuuuagucaacgugguuuugagaaccagcucugccaccaucacuucaga

SEQ ID NO: 10739 - RNA, 2501 nt, Mus musculus
gaggccacgugaacaaagcuuuacauuuuggaguuuagaaggggguaacacucaaacacuaucgauuauuugagucauaggacucuuauagacuguuauauucuggcucucuccauuuaauaccccaaaugucacuuuuuuuuuuuuuuuuuuaaauaaugagccuuaguuuuuuaggaaugaaggaacacgaaggugauuccugaggccgaguuaagacacgugccucuaagaaacucaggaguugcggucuccauucccccaccaccaccaccugugguuucugaccacugucaaccugccuggucucugcauuccucucugguucugcagcaccccgcgggggucugggcgggcggagcugcggaggaggggcgggcuagacccgggacccaggccuauaacaguaugcaagcuccgggcguccagggggugggagggaagaagggagggcggcgcucagugaaaggcgcauugaugcggcaggcugcagggcugggccagacgcugagcagggucaggcuccugccgaccccuuuaccuccugcuccgcgcuucgcagccaccgcacaccaugcacccccaaggccgcgcggcccccccgcagcugcugcucggucucuuccuugugcugcugcugcugcuacaguuguccgcaccgaucagcgccucugagaaccccaaggugaagcaaaaagcgcugauccggcagagggaggugguagaccugguaagucugagagucgguccugaccucagugcuggaggagaagacucagccaggaucgcaccgggagggcaucaguauagauggugguggugcugaccguaggggugaguguagggcagcacguuaagaagcuugagugccucaguguccugccuguguaccuguguggggacggaucugacgcacgccugcagcagagucuugaaccgcuacgggagaucaugagaggucaccacaugcuccgacgugggucaggugggaugcccaaauccguguaagucgcccaguaauuucuggcuccaggggaggccaccguugggagaaguggggggaugcuguggcugcaacuggaguagauugaguuagucaguugauuucaaaagaaagcccgaggaagacccuaggccagcuggccgcuuggcccugggccaaggcugugcaacguguccuuugugaggaccaguggccacggucuggccacgucugccuggaggagaggcuaacaacccccacaaagcauuuguucagcuaacuugaagauuaugaaucacuuugugucaucucccugggaaauaugaacugcaguuuacuccuuagaggaccacagcuugagccaggaguggucagaggcuuugaagcugaaggggaaaaaugaaggccccacuaggagcccuuccaaggacccauuuugccugaucuguuuaaaacagaugagcagucaggucuuaaccagucaggaacacuguacucaagcuaaggggaaggaaagcgcucccaggaaagcaaauaucccaagggcuuucugagaggcuaaucugugggaaagucuguuugcuuaaaaccuuucccucuaaaagucaauaaaccuaguggagggcagagaguuugucugucccacucaaaagccagccaucgauagauuuguagucuuuggcacaucauaaacuucuguccuuaaaccaagcuauaugguugucaggcacugcgauacauaaaggacaggggacauuuacuuauuuuauuauuauuauuuuuuuuuuagauuugaauuucuuccacugacauucuaaguugagcuaauaaaccaagcuccuugacagcuaguucuaaacugauucaaaagcacugggggaaaaucccugcuguuucacgcagcagugguaggguuuuguuguuuuaugcucugauauauaauuuuccuccacaaaagcauacuguguuggagcuacaguucuauuuugagugccuaaguuguuaaaaaaaaaaaaagugccacaugaauguggcucgugugcaguuugcguauuaugaauguguaguuaagauacauaaaauagucauuuccccauaaagcuagcauuuucccccucuaaggauuauacaguaccacaacucuaccccaacuuggaaaagcauacugugcugccaggcucaggugcauccuguagauuggauuugguucuggugucagaaaaaguccacacagucauuaggaagguuuccacagauucuauaaagcgacuuuguauaggcgcuuucaaagcgugucuuucacgcucccacugaauucugcccccugguggccaacacaggaaauggggcguugggugagggaauuugagcuuccauucacauguuuucauuuuguugacuuucacuaaugauucuaaauaccuauuggaacuagcauuuuaaguuaagaaaagacaaacauacucuauguagcaucuuuccugagaggaauuuagaaauuaucaaaucauacuagagg

SEQ ID NO: 10740 - RNA, 2501 nt, Mus musculus
ccucuaguaugauuugauaauuucuaaauuccucucaggaaagaugcuacauagaguauguuugucuuuucuuaacuuaaaaugcuaguuccaauagguauuuagaaucauuagugaaagucaacaaaaugaaaacaugugaauggaagcucaaauucccucacccaacgccccauuuccuguguuggccaccagggggcagaauucagugggagcgugaaagacacgcuuugaaagcgccuauacaaagucgcuuuauagaaucuguggaaaccuuccuaaugacuguguggacuuuuucugacaccagaaccaaauccaaucuacaggaugcaccugagccuggcagcacaguaugcuuuuccaaguugggguagaguugugguacuguauaauccuuagagggggaaaaugcuagcuuuauggggaaaugacuauuuuauguaucuuaacuacacauucauaauacgcaaacugcacacgagccacauucauguggcacuuuuuuuuuuuuuaacaacuuaggcacucaaaauagaacuguagcuccaacacaguaugcuuuuguggaggaaaauuauauaucagagcauaaaacaacaaaacccuaccacugcugcgugaaacagcagggauuuucccccagugcuuuugaaucaguuuagaacuagcugucaaggagcuugguuuauuagcucaacuuagaaugucaguggaagaaauucaaaucuaaaaaaaaaauaauaauaauaaaauaaguaaauguccccuguccuuuauguaucgcagugccugacaaccauauagcuugguuuaaggacagaaguuuaugaugugccaaagacuacaaaucuaucgauggcuggcuuuugagugggacagacaaacucucugcccuccacuagguuuauugacuuuuagagggaaagguuuuaagcaaacagacuuucccacagauuagccucucagaaagcccuugggauauuugcuuuccugggagcgcuuuccuuccccuuagcuugaguacaguguuccugacugguuaagaccugacugcucaucuguuuuaaacagaucaggcaaaauggguccuuggaagggcuccuaguggggccuucauuuuuccccuucagcuucaaagccucugaccacuccuggcucaagcugugguccucuaaggaguaaacugcaguucauauuucccagggagaugacacaaagugauucauaaucuucaaguuagcugaacaaaugcuuuguggggguuguuagccucuccuccaggcagacguggccagaccguggccacugguccucacaaaggacacguugcacagccuuggcccagggccaagcggccagcuggccuagggucuuccucgggcuuucuuuugaaaucaacugacuaacucaaucuacuccaguugcagccacagcauccccccacuucucccaacgguggccuccccuggagccagaaauuacugggcgacuuacacggauuugggcaucccaccugacccacgucggagcauguggugaccucucaugaucucccguagcgguucaagacucugcugcaggcgugcgucagauccguccccacacagguacacaggcaggacacugaggcacucaagcuucuuaacgugcugcccuacacucaccccuacggucagcaccaccaccaucuauacugaugcccucccggugcgauccuggcugagucuucuccuccagcacugaggucaggaccgacucucagacuuaccaggucuaccaccucccucugccggaucagcgcuuuuugcuucaccuugggguucucagaggcgcugaucggugcggacaacuguagcagcagcagcagcacaaggaagagaccgagcagcagcugcgggggggccgcgcggccuugggggugcauggugugcgguggcugcgaagcgcggagcaggagguaaaggggucggcaggagccugacccugcucagcgucuggcccagcccugcagccugccgcaucaaugcgccuuucacugagcgccgcccucccuucuucccucccacccccuggacgcccggagcuugcauacuguuauaggccugggucccgggucuagcccgccccuccuccgcagcuccgcccgcccagacccccgcggggugcugcagaaccagagaggaaugcagagaccaggcagguugacaguggucagaaaccacagguggugguggugggggaauggagaccgcaacuccugaguuucuuagaggcacgugucuuaacucggccucaggaaucaccuucguguuccuucauuccuaaaaaacuaaggcucauuauuuaaaaaaaaaaaaaaaaaagugacauuugggguauuaaauggagagagccagaauauaacagucuauaagaguccuaugacucaaauaaucgauaguguuugaguguuacccccuucuaaacuccaaaauguaaagcuuuguucacguggccuc

SEQ ID NO: 10741 - RNA, 2501 nt, Mus musculus
gaacuaagcgauaccuccuccagccauaggauuguaucagguaccuaccggggucagggcagaaagcagagcugucccaaugauuuuuaauaaugucagagcucuuccuaugggucaagcuacuguccuugguauggcugaaaaaguccuccuuccccaguacuggccacggagauaccaagcaccaccaagcuaagaaggcccaggugggauuagcucccugacagcaucuacuguagucucaccucuuggagcuuuuccagaccuuccuguaaagccucccucacaccuuucagcuccgacuugguacccuucuggccuggggcugguugcgccacacccauaaaacaguggccccucccugccacuguccagaaguuggcaagucccaugaagaugguuuugggggguuuuccucugcaccuagcuuucucucauucacuucacacaugugaaauagacaaauugcuaggaucucuaacaguaagaagcaaccugaaagauuugccuugaaauccauagcuagcgccuguccguucacuuuaggugguguaggagaucacugaaggggguaaggggggggggaacauuggcuguccugaauuucccaucuucuucaggaguuucaaggacucaaauaagcugaccugcccaggaagucugugagggagagcugaaggcuguucuaggacacggaccacuggacuucccuccccgaccuguccucccacauuaaagcccaagggacagugcauggggauccgugaugacugccagcaaaggcgacagacaagggaagacggaagguggcagaguaaggaagccauccacaaaucuuagcuucagcuacuaauuugacagaggcgguggugacagcauguuuccccagagccugcagcauuccucacgccccucccgaaucuacccuacaggcugaaucagagaccgcgaccggucucccgggaacggacgagcgguuccagcugcucuccgggcuaaaacagcagggaggaccgccugggagaaagaaagggagguggggcggggggaggcggaggcgaaaaugacgacacucagagcuccagccaacucuggggcugccagaugcccgcgcgacccuggaggcacaaaccaccacucccgcgcaguuacagagccaacccgguacuaccuagagggccgcacccuugccugggcuccucucgccgccgacacucgcaguggcgcgugcagcacgcgccgggacacaccccggacucucccccagcacacacacguucucucacacgcacagcuuggagagagcacugggcucuggacuggaugggaaccuggacucagaucacacugguucgggaccaggcuccagaguagacacacccucgcccccuucuccacacuccccgccaagucugcucacccuuacucauccccuggauacacgcgcuacagucgcucuuuuccuagucaccccaucacccauccacaccccuucacacgcgagagcacacacaaaguguccccuugagcccaguggacagagaagucagcuguggcucaggguugacgccaggaagugcgacccagguauucccaggcucuccgccccaacuucgaccccuuaaucccacuuccccaauuagagagaaagcgagacccaacacgucuuuuugugccuuauaguaaucgaaacccgcuccagugaugccagcuaucccuccggcgccgguuccaccgaagaccaccaguuguggucuucgcaagggccacaaaagacgggcgggguguccaguagcaccccgaaagcaagcuuugcuggggguccuugucuugcuccggaggaagaaggcguccggagggcuuaccuaaugagcaagcaagcacggaaaggagccaaccacaagguuggaggugcagcgccccgcgggaggugaagagggagacgaagaugggugagcaaucugccugcaacgcgagaggguagccuggcaagguuuguuuauguccgugcgugcguagggcgauuuuauaggcgccggggccccgcccccagggccucgccccucccagacccucugcucccagcgcagcaggagacggggacacaccccuuucuccggcccgccucgugcugcacccugccugggcugggcggggcgggcuggagccgccgccuguugcgcaagccuuugcaggggcgcgacuggagagacugcccggcccugccugccgcuccucccugugauccgcucucgggaccgcggcgugugcagcgaacgugugcccaccgagugguagcguggugugcccgugcgcgcucgugcgcgugugcauaaggacucccuugugucucucugcgcgaccgcuugccccccuauagccuuugaguuuccuaagccucugcccgcgccacgcccuucugggcggcaccccccacuuccuccgggucuccacgcagucacucccgagccccauuuacagccuagacggcagacuuuauc

SEQ ID NO: 10742 - RNA, 2501 nt, Mus musculus
gauaaagucugccgucuaggcuguaaauggggcucgggagugacugcguggagacccggaggaaguggggggugccgcccagaagggcguggcgcgggcagaggcuuaggaaacucaaaggcuauaggggggcaagcggucgcgcagagagacacaagggaguccuuaugcacacgcgcacgagcgcgcacgggcacaccacgcuaccacucggugggcacacguucgcugcacacgccgcggucccgagagcggaucacagggaggagcggcaggcagggccgggcagucucuccagucgcgccccugcaaaggcuugcgcaacaggcggcggcuccagcccgccccgcccagcccaggcagggugcagcacgaggcgggccggagaaagggguguguccccgucuccugcugcgcugggagcagagggucugggaggggcgaggcccugggggcggggccccggcgccuauaaaaucgcccuacgcacgcacggacauaaacaaaccuugccaggcuacccucucgcguugcaggcagauugcucacccaucuucgucucccucuucaccucccgcggggcgcugcaccuccaaccuugugguuggcuccuuuccgugcuugcuugcucauuagguaagcccuccggacgccuucuuccuccggagcaagacaaggacccccagcaaagcuugcuuucggggugcuacuggacaccccgcccgucuuuuguggcccuugcgaagaccacaacugguggucuucgguggaaccggcgccggagggauagcuggcaucacuggagcggguuucgauuacuauaaggcacaaaaagacguguugggucucgcuuucucucuaauuggggaagugggauuaaggggucgaaguuggggcggagagccugggaauaccugggucgcacuuccuggcgucaacccugagccacagcugacuucucuguccacugggcucaaggggacacuuugugugugcucucgcgugugaagggguguggaugggugauggggugacuaggaaaagagcgacuguagcgcguguauccaggggaugaguaagggugagcagacuuggcggggaguguggagaagggggcgagggugugucuacucuggagccuggucccgaaccagugugaucugaguccagguucccauccaguccagagcccagugcucucuccaagcugugcgugugagagaacgugugugugcugggggagaguccggggugugucccggcgcgugcugcacgcgccacugcgagugucggcggcgagaggagcccaggcaagggugcggcccucuagguaguaccggguuggcucuguaacugcgcgggaguggugguuugugccuccagggucgcgcgggcaucuggcagccccagaguuggcuggagcucugagugucgucauuuucgccuccgccuccccccgccccaccucccuuucuuucucccaggcgguccucccugcuguuuuagcccggagagcagcuggaaccgcucguccguucccgggagaccggucgcggucucugauucagccuguaggguagauucgggaggggcgugaggaaugcugcaggcucuggggaaacaugcugucaccaccgccucugucaaauuaguagcugaagcuaagauuuguggauggcuuccuuacucugccaccuuccgucuucccuugucugucgccuuugcuggcagucaucacggauccccaugcacugucccuugggcuuuaaugugggaggacaggucggggagggaaguccagugguccguguccuagaacagccuucagcucucccucacagacuuccugggcaggucagcuuauuugaguccuugaaacuccugaagaagaugggaaauucaggacagccaauguuccccccccccuuacccccuucagugaucuccuacaccaccuaaagugaacggacaggcgcuagcuauggauuucaaggcaaaucuuucagguugcuucuuacuguuagagauccuagcaauuugucuauuucacaugugugaagugaaugagagaaagcuaggugcagaggaaaaccccccaaaaccaucuucaugggacuugccaacuucuggacaguggcagggaggggccacuguuuuauggguguggcgcaaccagccccaggccagaaggguaccaagucggagcugaaaggugugagggaggcuuuacaggaaggucuggaaaagcuccaagaggugagacuacaguagaugcugucagggagcuaaucccaccugggccuucuuagcuugguggugcuugguaucuccguggccaguacuggggaaggaggacuuuuucagccauaccaaggacaguagcuugacccauaggaagagcucugacauuauuaaaaaucauugggacagcucugcuuucugcccugaccccgguagguaccugauacaauccuauggcuggaggagguaucgcuuaguuc

SEQ ID NO: 10743 - RNA, 2501 nt, Mus musculus
uuggcgggcggggacaaguaacgugcaugcagacugagacugaaagacacccggaagaccaugaacgucccaggggccgugcagaaaugggaugucuggauaggcucucagcauccuuggagaugcauuguuuguuuuccuggcaaaguuccccagcugcuccgcagaaguucuggaauucuuuggcuaugcucaucugagcuacugacuggaucacuagcgggagcaggcuuccuugucacucuugcaccugcagggccgagcgccguagccagguggcgcuguacugcucggagcgucccgccgugacccgccccgccccgagaaaagcgaaagccgcuaacgcagaggacccagacuaggccaucgaggacgcgcgcaggggggaaccaguaucugugcgagcuacuccagcucacggcgccgcugccucuggaguacucccccucggacugcuggaagaguuggugcgcuccaguccucggagcucccaggcuucagggccggccggcagcaggcaaccugcgcagcgggcuccuggacaccaggugcccgcugccaagaugcuggagcuguugguggcgucguuaucccuggcgcucgccuucuuugcgcugcuggacggcugguaccuggugcgcgugccgugugcuguucugcgcgcacgcuugcugcagccgcggguccgcgacuuauuggcggagcagcgguaugccggccgggugcugccaucggaccuggaccugcugcuacacaugaacaacgcgcgcuaccugcgcgaggcggauguggcgcgcgcugcgcaccugacccgcugcggugugcugggggcgcugcgcgaccugaacgcgcacacggugcuggccgccucgugcgcgcgcuaucgccgcucgcugcgccuguuugagccguucgagguacacacgcgacugcaaggcugggacgaccgcgccuucuaccuggaggcgcguuuugucagccuucgcgaugguuucgugugcgccuugcugcguuuccgacagcacgugcugggcaccucgccggaucgaguaguacagcacuugugcaaacggagggugagcagccccaccccgaugccccggcccuguuuggcucucagcccucucccgcgagaaaaaccccuuugaaguucugggacuguuccaaugucggaacacuuuugcacguuuccucuguguccaaggaguugcccuucuugggguccccaucaucuaugaaccaaggcuuuuccguucaggccuagccaguuuugaauuuacucccaagcacagaguuucuccucucucccucucuucuagaacugagaugcucagaguagguaucucagcuaggagucugaguccuaguucuguguguucuacagugcugagucacccucuguggucuuugguuuugaguaugggauaaaaggaugucaguuagaagcaguugcugggaauucuaguggacucgaggcccucuuuggcgcagcuugcagcagagaggacuggggguuggauugaccccaggggaccacaagccuugagucuuuccaagguuggaaggaggagaacccugugccugcugggacacaaggccccuccccaggguccacuccucuagcacgguggcagagcuagcuacugcaguauagcaacugugaccuuggagacagccagaguagugaugguugccaaggcaggcuccugaagaguaccagggcaugccccacccuauuguucccgccugucuuggacaagugccuccucuuagaguauaggaaugaccuuacaucagugcugaggggcuauaucugaagggaaacacgggcucgagaaguccucccagcaauugguggcagagaaggcucucccucgcuuucucucuuuaucuagucaugaguucccaugggcuguuugguacugguugauaaagugccuguaaggggugaggggacuggaggugcagccccagcuagcaguaacagcuuggaggaggcgaacugaagcacccuggcaacucagcucagcuggaggccagggggguuggcugggaguuuccaugguuacuugggucccaggcagaggcagauaugguacaagacaggccaagucugggguaggguucuguaagcugaggaacuguucugaggccaggugccaggauggggugucucugacaguaaagugugcccagauagagccuagacuauaggucagucauuccuggcugccguguagcacuugcugugagaagagagcaccuuaucgagccucuucccucacccucaguccucagaaccuaucugcaaggacuccggggcagcagcuuugucagguagucuccugcaggagcaccuccccacauccugcucuucucuaggcagcuggugguggucagucacccagccaaccucauaggcuuuugccugauucuggggacagacacuugaagcguggucccgcuggugagggccuggcagaaguagaugggcuagaaag

SEQ ID NO: 10744 - RNA, 2501 nt, Mus musculus
cuuucuagcccaucuacuucugccaggcccucaccagcgggaccacgcuucaagugucuguccccagaaucaggcaaaagccuaugagguuggcugggugacugaccaccaccagcugccuagagaagagcaggauguggggaggugcuccugcaggagacuaccugacaaagcugcugccccggaguccuugcagauagguucugaggacugagggugagggaagaggcucgauaaggugcucucuucucacagcaagugcuacacggcagccaggaaugacugaccuauagucuaggcucuaucugggcacacuuuacugucagagacaccccauccuggcaccuggccucagaacaguuccucagcuuacagaacccuaccccagacuuggccugucuuguaccauaucugccucugccugggacccaaguaaccauggaaacucccagccaaccccccuggccuccagcugagcugaguugccagggugcuucaguucgccuccuccaagcuguuacugcuagcuggggcugcaccuccaguccccucaccccuuacaggcacuuuaucaaccaguaccaaacagcccaugggaacucaugacuagauaaagagagaaagcgagggagagccuucucugccaccaauugcugggaggacuucucgagcccguguuucccuucagauauagccccucagcacugauguaaggucauuccuauacucuaagaggaggcacuuguccaagacaggcgggaacaauaggguggggcaugcccugguacucuucaggagccugccuuggcaaccaucacuacucuggcugucuccaaggucacaguugcuauacugcaguagcuagcucugccaccgugcuagaggaguggacccuggggaggggccuugugucccagcaggcacaggguucuccuccuuccaaccuuggaaagacucaaggcuugugguccccuggggucaauccaacccccaguccucucugcugcaagcugcgccaaagagggccucgaguccacuagaauucccagcaacugcuucuaacugacauccuuuuaucccauacucaaaaccaaagaccacagagggugacucagcacuguagaacacacagaacuaggacucagacuccuagcugagauaccuacucugagcaucucaguucuagaagagagggagagaggagaaacucugugcuugggaguaaauucaaaacuggcuaggccugaacggaaaagccuugguucauagaugauggggaccccaagaagggcaacuccuuggacacagaggaaacgugcaaaaguguuccgacauuggaacagucccagaacuucaaagggguuuuucucgcgggagagggcugagagccaaacagggccggggcaucgggguggggcugcucacccuccguuugcacaagugcuguacuacucgauccggcgaggugcccagcacgugcugucggaaacgcagcaaggcgcacacgaaaccaucgcgaaggcugacaaaacgcgccuccagguagaaggcgcggucgucccagccuugcagucgcguguguaccucgaacggcucaaacaggcgcagcgagcggcgauagcgcgcgcacgaggcggccagcaccgugugcgcguucaggucgcgcagcgcccccagcacaccgcagcgggucaggugcgcagcgcgcgccacauccgccucgcgcagguagcgcgcguuguucauguguagcagcagguccagguccgauggcagcacccggccggcauaccgcugcuccgccaauaagucgcggacccgcggcugcagcaagcgugcgcgcagaacagcacacggcacgcgcaccagguaccagccguccagcagcgcaaagaaggcgagcgccagggauaacgacgccaccaacagcuccagcaucuuggcagcgggcaccugguguccaggagcccgcugcgcagguugccugcugccggccggcccugaagccugggagcuccgaggacuggagcgcaccaacucuuccagcaguccgagggggaguacuccagaggcagcggcgccgugagcuggaguagcucgcacagauacugguuccccccugcgcgcguccucgauggccuagucuggguccucugcguuagcggcuuucgcuuuucucggggcggggcgggucacggcgggacgcuccgagcaguacagcgccaccuggcuacggcgcucggcccugcaggugcaagagugacaaggaagccugcucccgcuagugauccagucaguagcucagaugagcauagccaaagaauuccagaacuucugcggagcagcuggggaacuuugccaggaaaacaaacaaugcaucuccaaggaugcugagagccuauccagacaucccauuucugcacggccccugggacguucauggucuuccgggugucuuucagucucagucugcaugcacguuacuuguccccgcccgccaa

SEQ ID NO: 10745 - RNA, 2501 nt, Mus musculus
gcucuggauccagacggggaacagacguagccaaagccucuggaagagagcaugcaaccggaugggggaaggacuguaaaagcaagaagccucuggggaaaugauugugucgguccgguuccagcuuccacaaaggggucagcuuggauuuggucucuggcagccugggggagaacggggauggggagaggcggguccccagagaaaggcauccauuuccauucccugauuguggucaacuccuagagacagcacaguacagcaggaggugggacucaccuuccuggucuccgagucaaaggguucuggcguuggaguuuuggccuuuugggcuuccucuggggguggggccaacacacggggaagccccaagggccgagcagccgcaaaguucaucaguggauagaucccguuccuggggauagacaaggggguggguagcuaggugggggcucaggccugauagugcuuuuucuucagucucaugccagcucucaccugacauccucuaggaauuuguccagcuccaagaaggagaccucugaguaccuagaaugguguggaagguacaugagagaugucagggcaaagccuagccaagcagcuaggaagggaggcuccguuuggccacuacucaccgccacugcauuggggguccauggggcugcggcaucucagccaaaacugcauggagguccauggccuuggucuuuuccucuaccacauucucaggcaugaggucugugaacgacacaagugcucauggggauggacccaaccuaaggguccugcaaagacccuuccacuaccugaccccaggauccugacccaccccggcccuucugccccucacacuggugcuggaugaagcagugagcugccagcagcuucagcgagugcaccucaaagagcacucgguggaagaggagguugugggcugagggucggcgggcagggucccgggccaggcaggagaggaugaauuccuagguuguaaacaagaaagacaggugauagcuggaaaaguccucgcucuagaggagguccuucaagacucuagaccccaccgguccaaucaccacauccucccaccucagggaugcugaaagagccuuccuguaugaaugagcagagaagucaucccauuagcagcucaagaucugauucuggacacuugaggacaggcaagccuugggcuccaaacacguaugccuacuuccauucacccuuguggagucugugagcuucuggaagagucuuccuuucaggugggccuuaguccuccugcuacacucucagauguacugaccaggcugccccucucagauuuaccgaccaggcugccccucuggccugccuagagcacuucaaggguaagcugaagcaccugcagccagccccagaggggcaagguaagcugcucacccgcauguuggggucacucagugagugccuggcucgagcgauggccucuucugugacucugguauccccguuggcuuggaucucgaguacagccaucugggugcagggacaaauuggaauuggugggauggcguagacccuggagcaggggcuaugaggagaguggacaguaccuccagugcacacaucccgaaggagaagauguccacagcagucccaucauugacuucugaaaugggagaagcaagacagcguuggucaguucugaugugcuagcccgucagaugccugagagcagcucagggacucaccgccauacucuggugggaaaaagugcagguuucggaguucuucccguucagcucgaauagggcuccggagaucaucaggaagugcugaggaaaaggguggagcuaaacagacaaguuucuccaugguccccacacccccagagaccccacacaccauuggagaagaugcgguaccacacugcaacagccaacgcagagagaaagacaggaugucaguugggcggggagacugggcagucucuguccagggcucccgcagguuccccaccccugcccccugcccccugccccgccucgccagcaccggagccgaucuugaugaggccauugugcugaaugaagauggugucgcucgucagguucccguggaugauggggggacugcaggcgugcaaaaaacugcaagcauagaggaugagaggcaggaagaaccgggucagagagcagcggaaaggugcagagcagggggcaagcgcgugggcaaggccaggcucucaccugagugcagacaggaucugcguacaccagcgcuuccaggccuggcagcggacgcacgacuccgucgggugggcaccaaaaggcugcugagccugcggagcccgcccgcuaccccacuccugaaccgagguuuuucggagucccccgccccacuacugucccuaaguucugcuggacucccuccaguccccagcccacuccccauacccgggcguucauggccuugugguucuucuuggucuuuuugaggaacugcuugaggcugcc

SEQ ID NO: 10746 - RNA, 2501 nt, Mus musculus
ggcagccucaagcaguuccucaaaaagaccaagaagaaccacaaggccaugaacgcccggguauggggagugggcuggggacuggagggaguccagcagaacuuagggacaguaguggggcgggggacuccgaaaaaccucgguucaggagugggguagcgggcgggcuccgcaggcucagcagccuuuuggugcccacccgacggagucgugcguccgcugccaggccuggaagcgcugguguacgcagauccugucugcacucaggugagagccuggccuugcccacgcgcuugcccccugcucugcaccuuuccgcugcucucugacccgguucuuccugccucucauccucuaugcuugcaguuuuuugcacgccugcaguccccccaucauccacgggaaccugacgagcgacaccaucuucauucagcacaauggccucaucaagaucggcuccggugcuggcgaggcggggcagggggcagggggcagggguggggaaccugcgggagcccuggacagagacugcccagucuccccgcccaacugacauccugucuuucucucugcguuggcuguugcagugugguaccgcaucuucuccaaugguguguggggucucuggggguguggggaccauggagaaacuugucuguuuagcuccacccuuuuccucagcacuuccugaugaucuccggagcccuauucgagcugaacgggaagaacuccgaaaccugcacuuuuucccaccagaguauggcggugagucccugagcugcucucaggcaucugacgggcuagcacaucagaacugaccaacgcugucuugcuucucccauuucagaagucaaugaugggacugcuguggacaucuucuccuucgggaugugugcacuggagguacuguccacucuccucauagccccugcuccagggucuacgccaucccaccaauuccaauuugucccugcacccagauggcuguacucgagauccaagccaacggggauaccagagucacagaagaggccaucgcucgagccaggcacucacugagugaccccaacaugcgggugagcagcuuaccuugccccucuggggcuggcugcaggugcuucagcuuacccuugaagugcucuaggcaggccagaggggcagccuggucgguaaaucugagaggggcagccuggucaguacaucugagaguguagcaggaggacuaaggcccaccugaaaggaagacucuuccagaagcucacagacuccacaagggugaauggaaguaggcauacguguuuggagcccaaggcuugccuguccucaaguguccagaaucagaucuugagcugcuaaugggaugacuucucugcucauucauacaggaaggcucuuucagcaucccugaggugggaggauguggugauuggaccgguggggucuagagucuugaaggaccuccucuagagcgaggacuuuuccagcuaucaccugucuuucuuguuuacaaccuaggaauucauccucuccugccuggcccgggacccugcccgccgacccucagcccacaaccuccucuuccaccgagugcucuuugaggugcacucgcugaagcugcuggcagcucacugcuucauccagcaccagugugaggggcagaagggccggggugggucaggauccuggggucagguaguggaagggucuuugcaggacccuuagguuggguccauccccaugagcacuugugucguucacagaccucaugccugagaaugugguagaggaaaagaccaaggccauggaccuccaugcaguuuuggcugagaugccgcagccccauggacccccaaugcaguggcggugaguaguggccaaacggagccucccuuccuagcugcuuggcuaggcuuugcccugacaucucucauguaccuuccacaccauucuagguacucagaggucuccuucuuggagcuggacaaauuccuagaggaugucaggugagagcuggcaugagacugaagaaaaagcacuaucaggccugagcccccaccuagcuacccacccccuugucuauccccaggaacgggaucuauccacugaugaacuuugcggcugcucggcccuuggggcuuccccguguguuggccccacccccagaggaagcccaaaaggccaaaacuccaacgccagaacccuuugacucggagaccaggaaggugagucccaccuccugcuguacugugcugucucuaggaguugaccacaaucagggaauggaaauggaugccuuucucuggggacccgccucuccccauccccguucucccccaggcugccagagaccaaauccaagcugaccccuuuguggaagcuggaaccggaccgacacaaucauuuccccagaggcuucuugcuuuuacaguccuucccccauccgguugcaugcucucuuccagaggcuuuggcuacgucuguuccccgucuggauccagagc

SEQ ID NO: 10747 - RNA, 2501 nt, Mus musculus
aagccagggccuccagcccagagaccccgacgguccugccucuuugggauccccgaggccuucuuuaggccccagaaucugcuuccagacuuggugcugccccucuuguucuuuagaugugccaacaaaacccuagcaacuccuaccuagucagcaucucuggccaucaccuggacuccaucuuccaucucucuaaccacucacuggacuugcggcucgaacucacauaccucucuacccacuacuuuccauuauccuggguccuacuuuguuccacguucuuguuuucuccccaugucccaacccuacugggggccuucucaagucaccaacaggggacuaggaagacugccagggcacccacuaggggacaccuuaacagaaacaagcugcagguggacaucguucaugccaguagcugcaguuguucccaagguacaaaauggaucucauaaucucagucaugaaugcauacccuucaggaggcagacucugccucguucaggguuacacuugggcucucagcaaccauugggccugguggcaucucgcaggguaugcuguacccugacccuaguacugaaacccaacuccuacacuggcagggucacauaugcaaucauccagacacacgcucagucacauggugcacagcggccucagagucacguggucucauguaguggcacacagacaggcacacacacagggucacacacaagcgcacaaagucacauggccacacgcagucacaugggcccacacaggcuuaugcucuugcaggucauacuugcucugccaccccacacugcuggcacuccugucccccuugccugcaugcuaacaguuguccuugaacuugggcauccuuacacaaagagccuccccucacuccagugccuuggcuucccuugcucaccucuuccucccuaauccugaguccagggaagauacugcuguugcaucuucugguaccuaggcccugacagguggguggcccugacagaccccaagccuauucccuagaguucccagcauucccuagcuggcccuagcaaggggcuuugaaggugcagccaaaaaaagugaaacagauccagauuccgggguauggguuugcaugugcccauuuaacuggguccuguugugucagcaggugucugugcagcuguguaugucucaacagaagucugugugugggucagugugugccuuuaguguuuccuguuccugagcccucuuuccuaccucuccucuacccauacucuguccuaccuaucuuggaagcugucuggccuuacucucugcuccccuuuccucagccuuccuucucuguuccagccucaggcuguuuccguuggaucuacauccccuccuaccuugccacuccacccccacacuuuggccacccaccccuuccugcaaagcccugggcccugccccagcugcaguccagagcgcaccuuuaucuugcagucgcacuccgagaucgcugcgggcgcgcccguaggagcugucgaggucugccgaagagaaugugucaaguuugaccuucuuaaccaggaaggaccugggcaugauuccugcagggcuccggcagugagggccugcagagccggggcucagggggacugcguccgcggcgaggccccgucaccauccgaggagcgguggaagcagcacuguccccugucuggccuguggaugcugcugggcgagugugguccucucucuucuuucugcccugcgucuuuucuucuuccucuccggaucccuccucucuuucucucuccuuccuuccuuccuucuuuccuuccuuccuccucuucucuucuuuucucuucuuuccuuccuuccuuccuucccuccucuggucccggcuucccagcccgcagugccgccccuggacaggcgggggaggaggcugggggggcggagagggggggagcggcuccgucccgggcccggaggcugcgaaugggugcagggcuggcccggccccacggcccccuuccccucccccccccgccgcggcggcggagccucagucagcggcgccccaugcccccgggggcggcagcgccgggccaagagaacacgacaguagcagcggcaggagcaccagcagcuucagcaccgcggccagcgcuggcuagggcagcaccgcggccagcgcccgggcgcgcucagcuggcguugccggagaggggcgggccaccugggccuggucgcggggcggggguccucggcgggggucucuaggaggcuggcuuuauuguucugcagucagagcgggcggcggcggcagcggcgggcggggguccucagggggaggggugcucagggagggcgggccgagagagggaaggagagagggagggacggggguccgggggcggggcuccgcucucggacagcucuggggcaggccuucugagcccgcaagccucuucugccuaccgccgagcgcagccucuggcuuuuaaagccaagcgcugggg

SEQ ID NO: 10748 - RNA, 2501 nt, Mus musculus
ccccagcgcuuggcuuuaaaagccagaggcugcgcucggcgguaggcagaagaggcuugcgggcucagaaggccugccccagagcuguccgagagcggagccccgcccccggacccccgucccucccucucuccuucccucucucggcccgcccucccugagcaccccucccccugaggacccccgcccgccgcugccgccgccgcccgcucugacugcagaacaauaaagccagccuccuagagacccccgccgaggacccccgccccgcgaccaggcccagguggcccgccccucuccggcaacgccagcugagcgcgcccgggcgcuggccgcggugcugcccuagccagcgcuggccgcggugcugaagcugcuggugcuccugccgcugcuacugucguguucucuuggcccggcgcugccgcccccgggggcauggggcgccgcugacugaggcuccgccgccgcggcgggggggggaggggaagggggccguggggccgggccagcccugcacccauucgcagccuccgggcccgggacggagccgcucccccccucuccgcccccccagccuccucccccgccuguccaggggcggcacugcgggcugggaagccgggaccagaggagggaaggaaggaaggaaggaaagaagagaaaagaagagaagaggaggaaggaaggaaagaaggaaggaaggaaggagagagaaagagaggagggauccggagaggaagaagaaaagacgcagggcagaaagaagagagaggaccacacucgcccagcagcauccacaggccagacaggggacagugcugcuuccaccgcuccucggauggugacggggccucgccgcggacgcagucccccugagccccggcucugcaggcccucacugccggagcccugcaggaaucaugcccagguccuuccugguuaagaaggucaaacuugacacauucucuucggcagaccucgacagcuccuacgggcgcgcccgcagcgaucucggagugcgacugcaagauaaaggugcgcucuggacugcagcuggggcagggcccagggcuuugcaggaagggguggguggccaaaguguggggguggaguggcaagguaggaggggauguagauccaacggaaacagccugaggcuggaacagagaaggaaggcugaggaaaggggagcagagaguaaggccagacagcuuccaagauagguaggacagaguauggguagaggagagguaggaaagagggcucaggaacaggaaacacuaaaggcacacacugacccacacacagacuucuguugagacauacacagcugcacagacaccugcugacacaacaggacccaguuaaaugggcacaugcaaacccauaccccggaaucuggaucuguuucacuuuuuuuggcugcaccuucaaagccccuugcuagggccagcuagggaaugcugggaacucuagggaauaggcuuggggucugucagggccacccaccugucagggccuagguaccagaagaugcaacagcaguaucuucccuggacucaggauuagggaggaagaggugagcaagggaagccaaggcacuggagugaggggaggcucuuuguguaaggaugcccaaguucaaggacaacuguuagcaugcaggcaagggggacaggagugccagcagugugggguggcagagcaaguaugaccugcaagagcauaagccugugugggcccaugugacugcguguggccaugugacuuugugcgcuugugugugacccugugugugugccugucugugugccacuacaugagaccacgugacucugaggccgcugugcaccaugugacugagcgugugucuggaugauugcauaugugacccugccaguguaggaguuggguuucaguacuagggucaggguacagcauacccugcgagaugccaccaggcccaaugguugcugagagcccaaguguaacccugaacgaggcagagucugccuccugaaggguaugcauucaugacugagauuaugagauccauuuuguaccuugggaacaacugcagcuacuggcaugaacgauguccaccugcagcuuguuucuguuaagguguccccuagugggugcccuggcagucuuccuaguccccuguuggugacuugagaaggcccccaguaggguugggacauggggagaaaacaagaacguggaacaaaguaggacccaggauaauggaaaguaguggguagagagguaugugaguucgagccgcaaguccagugagugguuagagagauggaagauggaguccaggugauggccagagaugcugacuagguaggaguugcuaggguuuuguuggcacaucuaaagaacaagaggggcagcaccaagucuggaagcagauucuggggccuaaagaaggccucggggaucccaaagaggcaggaccgucggggucucugggcuggaggcccuggcuu

SEQ ID NO: 10749 - RNA, 2501 nt, Mus musculus
gcagccuuguccacugaccgcaaaaaacaaaacucacaaggucuagauauguaucaaaacuggcuugcuuaucacucucuauguagccugggcuggccuuaaaccugguccugccucugccuccugagugguauuacaggcgaguaccaccacccugaacuuacauuucuauuuauuuauucauuuacuuaucuaucuaucuaucuaucuaucuaucuaucuauuuacucgggggaaggaaagcaucuaugcacaacuuucaggaguugguucucuccuacugugugggucccggggagugaacucagguggccaggcuugcuucuuuauccacuaagccaucucauuuauucuugaacguuuacaugagaaacuagccauaccauucauaaagaugauuagagagagagagucauguuaagcacauggacucugaacucuggggcccuggguaaacuucugcaguuggugccucaguuucuucaucuguccaauggguauagugaaaacagacaccaccacccccagugcaguugggguaagaaaauucugcucugguggcaaggauggggcacccacugagauugcucaccaaggaucauggagcagcguugggcagguuccuggccagugagcagcgugaaguguucuggguaguagaauuccagggcuuccaggaaggccucgaagccccucuugccccggcagcguaaaaugucuaugaggcgcccugaggguaaagguugugacaggggucaggaugaggucuucccccagugccccugcucuccaccccgacaaugcuccagggccuacguuccccagauuuuugggcugugacacacaccggggccugucccaacacaucagggagcaaagcucagucugcccuggcuaggaacaccagacccuccccagagcaccugcacuggagcagguccccagcaaccccuacacacacacacacacacacacacacacacacacacacacacacacacacacacacacguuacgcaugcccgggggcaucggaugccugcguuucccaggcaaaaugcucucauugacuuaaguucccugauacuuuuagucccucugacaguccugguacaaagacgcccagugggagaggagccucggagaacugagcccggauuugagcucuugagaaaaacugauucuuuaagggauacacaaaugggacagagagaaccagagaggucaaagagcacaguaaagaucccacaggggucgccaucggcaccggcaaccacauccagcugucugcucuggagcgggccuaggaagggagaggaaaccccuggcggcgggcucaccgguacgguuagcgcggcacgggaaacgguaggugcugagcaccuccuccucguccuguucguccaggacgcggcacuggcgcagauacggcgugagcuuggccggauucagggcgcgcgucagucggugccggacgcccucgauccgcucccacagcgcguccucuucggccuccgaccccgaacccgccccagccuccucgucagccucgcccgcguccgcccggcccugcauggccgcguccuccgagccugcgggcgacaagcacggugggcacggagccgcggucaccgcaccugggcgucgcccgcgggucccggcgcugucgggcuccgucuucccgggaucccaagcugcucugccugcacccucccggguccccgagaggucacgcccgcguccucccgggcgucccgucggcguccuuucacguccccacgcugcugucccgcccguguccuccccgcacucaccacgggcgcugcagcugcccugagcucccggcucugugcucggccgacggcuccggaggcgcgacggggcggugccuucggggucauuggcuccgcccccagcccggcggccucccgggccacccaacauugcccgcgacccgcugcgcuccggucguccucccggccgcucugcgggccagccgcgccuccccaccccccacccccgcuuccuguuucccgccggcucuccgggccaguccuggcgggguccgcacggcccucccacaccugcccggcccccgacggggcggagccgccacgcgcgcgcccacaccccgcgcgccaccgccagggccacugccgccgcugcugcucaccuugucccccaccaugagcacaacaccagccugcacccucuacaagcccgacucccggugcagcuggccacccggaacccugaacgcgacaaguguccgcuccacuagccacacacgcccugaagucaacaggucacaccaacuuagcgagcucugggcucggaccucauauacagagccccaucauucccacuuaaacucgcaugguagguauauucacucugcugaaagucacauaauacauaucugucuuucaggaaauaucugcaaagugugggacagggccucagaagcuagcagaacuuucacacguguccauguucuggga

SEQ ID NO: 10750 - RNA, 2501 nt, Mus musculus
ucccagaacauggacacgugugaaaguucugcuagcuucugaggcccugucccacacuuugcagauauuuccugaaagacagauauguauuaugugacuuucagcagagugaauauaccuaccaugcgaguuuaagugggaaugauggggcucuguauaugagguccgagcccagagcucgcuaaguuggugugaccuguugacuucagggcguguguggcuaguggagcggacacuugucgcguucaggguuccggguggccagcugcaccgggagucgggcuuguagagggugcaggcugguguugugcucauggugggggacaaggugagcagcagcggcggcaguggcccuggcgguggcgcgcggggugugggcgcgcgcguggcggcuccgccccgucgggggccgggcaggugugggagggccgugcggaccccgccaggacuggcccggagagccggcgggaaacaggaagcgggggugggggguggggaggcgcggcuggcccgcagagcggccgggaggacgaccggagcgcagcgggucgcgggcaauguuggguggcccgggaggccgccgggcugggggcggagccaaugaccccgaaggcaccgccccgucgcgccuccggagccgucggccgagcacagagccgggagcucagggcagcugcagcgcccguggugagugcggggaggacacgggcgggacagcagcguggggacgugaaaggacgccgacgggacgcccgggaggacgcgggcgugaccucucggggacccgggagggugcaggcagagcagcuugggaucccgggaagacggagcccgacagcgccgggacccgcgggcgacgcccaggugcggugaccgcggcuccgugcccaccgugcuugucgcccgcaggcucggaggacgcggccaugcagggccgggcggacgcgggcgaggcugacgaggaggcuggggcggguucggggucggaggccgaagaggacgcgcugugggagcggaucgagggcguccggcaccgacugacgcgcgcccugaauccggccaagcucacgccguaucugcgccagugccgcguccuggacgaacaggacgaggaggaggugcucagcaccuaccguuucccgugccgcgcuaaccguaccggugagcccgccgccagggguuuccucucccuuccuaggcccgcuccagagcagacagcuggaugugguugccggugccgauggcgaccccugugggaucuuuacugugcucuuugaccucucugguucucucugucccauuuguguaucccuuaaagaaucaguuuuucucaagagcucaaauccgggcucaguucuccgaggcuccucucccacugggcgucuuuguaccaggacugucagagggacuaaaaguaucagggaacuuaagucaaugagagcauuuugccugggaaacgcaggcauccgaugcccccgggcaugcguaacguguguguguguguguguguguguguguguguguguguguguguguguguguguguguagggguugcuggggaccugcuccagugcaggugcucuggggagggucugguguuccuagccagggcagacugagcuuugcucccugauguguugggacaggccccggugugugucacagcccaaaaaucuggggaacguaggcccuggagcauugucgggguggagagcaggggcacugggggaagaccucauccugaccccugucacaaccuuuacccucagggcgccucauagacauuuuacgcugccggggcaagaggggcuucgaggccuuccuggaagcccuggaauucuacuacccagaacacuucacgcugcucacuggccaggaaccugcccaacgcugcuccaugauccuuggugagcaaucucagugggugccccauccuugccaccagagcagaauuuucuuaccccaacugcacugggggugguggugucuguuuucacuauacccauuggacagaugaagaaacugaggcaccaacugcagaaguuuacccagggccccagaguucagaguccaugugcuuaacaugacucucucucucuaaucaucuuuaugaaugguauggcuaguuucucauguaaacguucaagaauaaaugagauggcuuaguggauaaagaagcaagccuggccaccugaguucacuccccgggacccacacaguaggagagaaccaacuccugaaaguugugcauagaugcuuuccuucccccgaguaaauagauagauagauagauagauagauagauagauaaguaaaugaauaaauaaauagaaauguaaguucaggguggugguacucgccuguaauaccacucaggaggcagaggcaggaccagguuuaaggccagcccaggcuacauagagagugauaagcaagccaguuuugauacauaucuagaccuugugaguuuuguuuuuugcggucaguggacaaggcugc

SEQ ID NO: 10751 - RNA, 2501 nt, Mus musculus
cccuuguagucaauacugaagcccagaaaggggacucagagucagccucucuccccaccggaaaccaucaacaagguuaucucagagcuagcucagguuaucucagaguuuaacaggugauggcuccuuucagcaccacuucccgggaguuccaaccugggaggucuuccgcggcugaaagccugcuuccaccacccagggcccaacagagcuaugaaagucaggacuugaagugagugccaggcccugacugugguuucuggggaugagaggaacacuuggugccuacgcaggaccagagagggaggggcucggcuugggccagcagcggcuguguaagcugccccgccugucggcguggggacgugagaagcgcugcuuccuggcuccugucccgcgccuggccgccccgccacgucaccgcgcggccaagggugcgcgcggcgggagcgcgccagcaaggaggcgcggcaccggccuggggcaccgcgaggagcagggacggggacguggcagcgccccgcgcaacagaaaguucccugggaaguucugcgcgacacggcgcgggagcggcgggcgggaccaugaacguguuccgaauccucggggaccugagccaccuccuggcuaugaucuugcuccuggugaagaucuggagguccaagagcugcgccggugagcggcgcccggggcggggcgggaccggaccauggugaggacuuaggcucagagggaagccgggcgcgcgcgcuuccaaaaacuucagcgaaguuuuucgacaucagaggauccgggagauuaugagggagcguggcuucugucuccaugaagagcccuaccucacgcuucucgcccuauccuuaacugggcagcuggcaguaucacggcugcugggcgaggaguggagggggaccuuccccugggaggagaccauauuugaagucgccuuagucgucgagucuucauucucuccugccuuuuauuuccccagagagagccuuuuccugccagcuggugauaucagccuggcccagggauguggagcuggcucugaguggaaggcguuggaggggcucgcgauuugucuacaggucuagcggccuugcugggaugggaaauaucuggaggcuggguugaugauuucaguccccggguuaauaagaagcugcccauugucuuucagccaucuccguuccuagcguucccugccugucccaggcaugcaauugagugugagcucagacucuaccagagcuggggaggcagagagcagcugagggcuacguggacagagaggaugggcaggguaugugcucaagguacaggguacgguguugagaacacccgugcaaauacguagaagccacagggcauagggcauguccugggaaggacacaggaggaagaggaauccagaagguaggauggacuaauggugaaaggcuuuuuccggucacauucgggauccaggaugaaggaaaccaucgaagaaguaggagcagaggcagaggcucagcaggucucuugagacuccggaaauggagguugagagcauuuugagaugucaccugggaggcugaucaggagagggacuugguugaguauggaucagacacauuuuggauccaguggcucuggacugaauuagacguuaccggggguuuguaguagucaguugccugagagaucgucucucacggcccuucugcuugcugggccugugacuuugcuuuagagguccgggguaggauugggggagugcuuguuaccuccucccucauccugugagggacacugugcccugauaccccaaugcccugccuuagggagcugaccuacugagagaccagcagaaagcgacaggaggagcaaaucaguaugcguugcuguaggcgaaagaaaaauggcagcuggugccagccccaaaugccagagacacacuggccacugucccacuguccugcugaguuguguagccuggggcuucuguuucccuaucagucagagggacucacucacggugucucucuucuccugggcuucugguagggauaguguuuauguguuuauguguggagccacuauggguagaacccugagccuacaagguuaagaggacuggaggauauaguggccagguaucccccaugaagcugcugccuagacuguccuaauagggcaggugccucuuuggcaagggcuuggugaaggggcaacacagccagccccaccuggucuaggucgccuccccaucugugucacccccuauaggaguuccuuuauggccucgucugucucccugcuaggcucuacucagguccuaggucuuggucacauggcuccaaucacaugugcgggggaugggggggaggggaaacaggacuacuagugaggaaugugaggcccacacucgccugcagccgguaucugggcccaguguucuucagagugggagagaccuuaggagucuccuccaucauuaaaaaugucacucugacugg

SEQ ID NO: 10752 - RNA, 2501 nt, Mus musculus
ccagucagagugacauuuuuaaugauggaggagacuccuaaggucucucccacucugaagaacacugggcccagauaccggcugcaggcgagugugggccucacauuccucacuaguaguccuguuuccccucccccccaucccccgcacaugugauuggagccaugugaccaagaccuaggaccugaguagagccuagcagggagacagacgaggccauaaaggaacuccuauagggggugacacagauggggaggcgaccuagaccagguggggcuggcuguguugccccuucaccaagcccuugccaaagaggcaccugcccuauuaggacagucuaggcagcagcuucaugggggauaccuggccacuauauccuccaguccucuuaaccuuguaggcucaggguucuacccauaguggcuccacacauaaacacauaaacacuaucccuaccagaagcccaggagaagagagacaccgugagugagucccucugacugauagggaaacagaagccccaggcuacacaacucagcaggacagugggacaguggccagugugucucuggcauuuggggcuggcaccagcugccauuuuucuuucgccuacagcaacgcauacugauuugcuccuccugucgcuuucugcuggucucucaguaggucagcucccuaaggcagggcauugggguaucagggcacagugucccucacaggaugagggaggagguaacaagcacucccccaauccuaccccggaccucuaaagcaaagucacaggcccagcaagcagaagggccgugagagacgaucucucaggcaacugacuacuacaaacccccgguaacgucuaauucaguccagagccacuggauccaaaaugugucugauccauacucaaccaagucccucuccugaucagccucccaggugacaucucaaaaugcucucaaccuccauuuccggagucucaagagaccugcugagccucugccucugcuccuacuucuucgaugguuuccuucauccuggaucccgaaugugaccggaaaaagccuuucaccauuaguccauccuaccuucuggauuccucuuccuccuguguccuucccaggacaugcccuaugcccuguggcuucuacguauuugcacggguguucucaacaccguacccuguaccuugagcacauacccugcccauccucucuguccacguagcccucagcugcucucugccuccccagcucugguagagucugagcucacacucaauugcaugccugggacaggcagggaacgcuaggaacggagauggcugaaagacaaugggcagcuucuuauuaacccggggacugaaaucaucaacccagccuccagauauuucccaucccagcaaggccgcuagaccuguagacaaaucgcgagccccuccaacgccuuccacucagagccagcuccacaucccugggccaggcugauaucaccagcuggcaggaaaaggcucucucuggggaaauaaaaggcaggagagaaugaagacucgacgacuaaggcgacuucaaauauggucuccucccaggggaaggucccccuccacuccucgcccagcagccgugauacugccagcugcccaguuaaggauagggcgagaagcgugagguagggcucuucauggagacagaagccacgcucccucauaaucucccggauccucugaugucgaaaaacuucgcugaaguuuuuggaagcgcgcgcgcccggcuucccucugagccuaaguccucaccaugguccggucccgccccgccccgggcgccgcucaccggcgcagcucuuggaccuccagaucuucaccaggagcaagaucauagccaggagguggcucagguccccgaggauucggaacacguucauggucccgcccgccgcucccgcgccgugucgcgcagaacuucccagggaacuuucuguugcgcggggcgcugccacguccccgucccugcuccucgcggugccccaggccggugccgcgccuccuugcuggcgcgcucccgccgcgcgcacccuuggccgcgcggugacguggcggggcggccaggcgcgggacaggagccaggaagcagcgcuucucacguccccacgccgacaggcggggcagcuuacacagccgcugcuggcccaagccgagccccucccucucugguccugcguaggcaccaaguguuccucucauccccagaaaccacagucagggccuggcacucacuucaaguccugacuuucauagcucuguugggcccugggugguggaagcaggcuuucagccgcggaagaccucccagguuggaacucccgggaaguggugcugaaaggagccaucaccuguuaaacucugagauaaccugagcuagcucugagauaaccuuguugaugguuuccgguggggagagaggcugacucugaguccccuuucugggcuucaguauugacuacaaggg

SEQ ID NO: 10753 - RNA, 2501 nt, Mus musculus
ccccagcauugagaacaguaccccuggcuuuugccacgugguccagcuucuuuaaagcaagcauugcucccccacccacccccuuugcuuuugcaaagaccuggauggccaugcaagauaagcgguagccccugugagcucagaauucagcccugggagacagcgcaaaggcaggcuccuccgcaugggauggcuugagccuagcugcuggcucugcaggcagucaggaguaggagccgcagccgggaccgaagagguuaacaugcaucugccuccgaauguuaaugugucuaggugaugucagugggagcugggaaggagggaguggggcgagcaguugggcucagaggcagcagaggcugccaggcgguagaggaagacccuuuucuggacugcggggcucaagcuccggacaaggcgguggagggcgcuggaggcugccgcagccugcguggguggacgggcgcuccacuccagggagcaggcgaccugcaccggcugcauggaucugcaagccucguugcuguccacuggccccaaugccagcaacaucuccgauggccaggauaauuucacauuggcgggugagucgaguuggaguccucccuccuccgggauggguguggaaaaugggaagguuucaccucccaagccaaacugccugggaaacuuuaucuuacaguucuuggugauaagaucugcagucggcuuugccugaagaggaagaggagaggaggggacaccagcuaggacagaaggggcagggaggaauagagauggggcagaggcacauuuagaaacaacaaggguuggugacaagacgugaggcaggcuugaggggaaagcuugcugaugagucccaaauaugcuuugcaggggggggggggggggaaucaaggcuggagaagcaagcaagcaagacagcaagacagcgggcggguaguaugugggagccagcagaagcgcuuugauucaccgcuauccugggcucaauccucuggccucgcacuggggaaauggggucugagugguccuugcugucuucuggcaaaggcugcugggagcaaaagacuucacagggcgugagaggauuaacuuuucuggugaauuaagcuucuugacauuugcagaacgucaaugccuuaaaauucuagcucugaaggagaagggaaugaaggggaaagagggaagguugguguggagaaauucccaagcuucugggguguaacacagcuccagucccuacccuauugggaaagcccagacucaggagacaugguccaaggaaaucccugacagaaaaccgggagagggcagggcuguggagccugaaacacaccccacacccauggugacagucacuucucacauaugccuaggaaccuaucugaaaccuuuggccaucucucucugaaaagaugaggcugcaaauacacacacacacacacacacacacacacacacacacacacacacacacacacacacacacacaaauguccuucaagccuuuuugacaagguuuucugguggaucccggggauaugaaguuguucucagcagauaucugggagucuugacuccuggcccucugaguaaauggaugaagcgaagaagaaugggguccucugaguaacagguggaucuagaaaauccuauaggagucaccagggcacgguggaggaggguaagguacagaacuaacaauagcccgagaaggggaaacagcaggagaugauuccagagacguagugaccccaagcugcaagggaaagcaugaggggccagcaggaaggccgacauggcagguugucagcuucuagaucggaaggcgggucacacuugcucuuucuauccucagggccaccuccucgcacaaggagugucuccuacaucaacaucaucaugccuucaguguuugguaccaucugucuccugggcauugugggaaacuccacagucauuuuugccguggugaagaaauccaagcugcacuggugcagcaacgucccugacaucuucaucaucaaccucucugugguggaucugcuuuuccugcugggcaugccuuucaugauccaccagcucauggguaauggugucuggcacuuuggggaaaccaugugcacccucaucacagccauggacgccaacagucaguucaccagcaccuacauccugacugcuauggccauugaccgcuacuuggccaccguccaucccaucuccuccaccaaguuccggaagcccuccauggccacccuggugaucugccuccugugggcucucucguucauuagcaucacuccuguguggcucuaugccaggcuuauccccuucccagggggugcugugggcuguggcauccgccuaccaaacccagauacugaucuuuacugguucacucuguaucaguuuuuccuggccuucgcccuuccguuuguggucaucacugcugcguacgugaaaauacuacagcgcaugacgucuucgguggcccc

SEQ ID NO: 10754 - RNA, 2501 nt, Mus musculus
ggggccaccgaagacgucaugcgcuguaguauuuucacguacgcagcagugaugaccacaaacggaagggcgaaggccaggaaaaacugauacagagugaaccaguaaagaucaguaucuggguuugguaggcggaugccacagcccacagcacccccugggaaggggauaagccuggcauagagccacacaggagugaugcuaaugaacgagagagcccacaggaggcagaucaccaggguggccauggagggcuuccggaacuugguggaggagaugggauggacgguggccaaguagcggucaauggccauagcagucaggauguaggugcuggugaacugacuguuggcguccauggcugugaugagggugcacaugguuuccccaaagugccagacaccauuacccaugagcugguggaucaugaaaggcaugcccagcaggaaaagcagauccaccacagagagguugaugaugaagaugucagggacguugcugcaccagugcagcuuggauuucuucaccacggcaaaaaugacuguggaguuucccacaaugcccaggagacagaugguaccaaacacugaaggcaugaugauguugauguaggagacacuccuugugcgaggagguggcccugaggauagaaagagcaagugugacccgccuuccgaucuagaagcugacaaccugccaugucggccuuccugcuggccccucaugcuuucccuugcagcuuggggucacuacgucucuggaaucaucuccugcuguuuccccuucucgggcuauuguuaguucuguaccuuacccuccuccaccgugcccuggugacuccuauaggauuuucuagauccaccuguuacucagaggaccccauucuucuucgcuucauccauuuacucagagggccaggagucaagacucccagauaucugcugagaacaacuucauauccccgggauccaccagaaaaccuugucaaaaaggcuugaaggacauuuguguguguguguguguguguguguguguguguguguguguguguguguguguguguguguguauuugcagccucaucuuuucagagagagauggccaaagguuucagauagguuccuaggcauaugugagaagugacugucaccaugggugugggguguguuucaggcuccacagcccugcccucucccgguuuucugucagggauuuccuuggaccaugucuccugagucugggcuuucccaauaggguagggacuggagcuguguuacaccccagaagcuugggaauuucuccacaccaaccuucccucuuuccccuucauucccuucuccuucagagcuagaauuuuaaggcauugacguucugcaaaugucaagaagcuuaauucaccagaaaaguuaauccucucacgcccugugaagucuuuugcucccagcagccuuugccagaagacagcaaggaccacucagaccccauuuccccagugcgaggccagaggauugagcccaggauagcggugaaucaaagcgcuucugcuggcucccacauacuacccgcccgcugucuugcugucuugcuugcuugcuucuccagccuugauuccccccccccccccccugcaaagcauauuugggacucaucagcaagcuuuccccucaagccugccucacgucuugucaccaacccuuguuguuucuaaaugugccucugccccaucucuauuccucccugccccuucuguccuagcugguguccccuccucuccucuuccucuucaggcaaagccgacugcagaucuuaucaccaagaacuguaagauaaaguuucccaggcaguuuggcuugggaggugaaaccuucccauuuuccacacccaucccggaggagggaggacuccaacucgacucacccgccaaugugaaauuauccuggccaucggagauguugcuggcauuggggccaguggacagcaacgaggcuugcagauccaugcagccggugcaggucgccugcucccuggaguggagcgcccguccacccacgcaggcugcggcagccuccagcgcccuccaccgccuuguccggagcuugagccccgcaguccagaaaagggucuuccucuaccgccuggcagccucugcugccucugagcccaacugcucgccccacucccuccuucccagcucccacugacaucaccuagacacauuaacauucggaggcagaugcauguuaaccucuucggucccggcugcggcuccuacuccugacugccugcagagccagcagcuaggcucaagccaucccaugcggaggagccugccuuugcgcugucucccagggcugaauucugagcucacaggggcuaccgcuuaucuugcauggccauccaggucuuugcaaaagcaaagggggugggugggggagcaaugcuugcuuuaaagaagcuggaccacguggcaaaagccagggguacuguucucaaugcugggg

SEQ ID NO: 10755 - RNA, 2501 nt, Mus musculus
aaaaaaaagucucacuauccccaccccuaaccccacugugcagccugccucuccacucucuuagauggggcaacccuugucugccaucuuucuugccucagaccagguucacguuuugaguguucucuuacacacagcgcucuacccacuccgggcuucccugcccgcguugcccuucacggaaaacgccccuuuauucuuuuccucucuucuccauuugccuuuccauuggcccucaccugucccaaaucuuccauuauaucuccaugaugcccuagcacccgugcgaaccaacuuucuguuuucucuauuaacauccauaagcuuuaaggucaaggagguuuggucauccucaguucuguguucucaggguugaucaacuagcaaugcaucaaagacuuuuuggguggguaagagaggcucagggaaguucaggguuauaggguucagcaccuaggcugggagcugggucuggaacccaguucucuugauucggagcucagucagcaaccgcgccugggcagaaccgcggcgauccagcgcaauaucccaaucaccgcgugacucacgcacgcgcacggucgccggcagcugccaccagccuccugcgcccuggaccugguaaggggcuagggauaggcucuaaggagacagacaaggacugggauacaggcaccuuacccggccgagcauccccagcuccggcacccgcucccucgugcuggcgcgggagcugcgggaaggggaggggcccucggcgaggcuggccugcgcgcgggucacguggugccgguggcagcggcggcaucggugcgcgcgggcaggggcggcgcggcgccgagcgagcggaggcgaggucccgggcgggcgcggggcgcaggggcggcgcggccggguggcgggucgggcggguaggcgguacggcgccgaggggcgaggcccggcugcaggggccgcuuggcccagggagagcccgcgcccggcucagccuugcagccccgcgcccugagcaucucccggaggacccgagacaaaggaggauucauguccaaagguagggcugucgccugggcgcuuggcaucggccuggaggaggcugcggccccaagcccuaccaaagggaggguuugcugugcugaggaccccacgugcagugugacauaugcauggacgcacgcacacccgguggcacacacuuggaagcauagucucgggcaaaagcccacagagaagcuuggggagguauggagacccagaugcuuagggaaagccuccgcuggggcacagcagggcacgcacacacacgcacagcaugaacuccgagcucgagcucggguaccagaccaccuacaaccaguaagagaccugugcgcugacacauuagucaguccccuccccccacacagagaccaagcacagagacaggcaccagcugguggucuccaagggaacuauuggccuccugacuagaaugggggaaggggagugucccagggcccuuugcuucuuuuaauggagaaggauuuguuucuuucuuuucuuuuucuuuuuucuuuuuuuggagcugcccagggcuggagcugggaugaacuggaauuggcucuaugaugggugugggaucuuaaaggcugcugguuaucagggaauggaugauuccucagcuuaggugggaagggagagcccuagccauaagcuaaggggacaggcacuaucccugaaagaucuccuucuccuauugccaccuuuccaacagaggggugggguuucugguccagacaaagacagagccauucauuuucccauaguagaaagcacuauauccuugcuugccuuagggauggagucugcuguccggagggaccagagcugagucagguggacugucucucuuucuggagcucugguguggcagguaccuagcagggagugcugcagacagaugcacccuuuucugggugagcugggagcuuaggaggggguccccaaggaccaucuagcugcuuucugccaugagcacagcuaugggcucuuucucuauucuuggggagcccccuuccaaucucagaugcagaggacagaggagguuucaauagguguaccuaccuugacuguggcgcacauaacagcuauuuguugguugggggugggguccaggugcucuggggaaggagagaggugucugcagggacaccugccuggugggacuaugauccguccaccauccuuuauccauccauccauccauccauccauccauccauccauuguugagagucuaugauaugccaggugcguuggggacagagaacaagaaggcauggcuccuuccucgaagagggcuaggaacuugcacauauucaccgacggggcauuuacaugcaugguuuucacaguaggccaagcaagcaaggcagguacaucccccuaucuucugagaaaaaaaaccaaaaccaaaaccaaaacccuaggcugggauucaugccugugucagcugcccaucc

SEQ ID NO: 10756 - RNA, 2501 nt, Mus musculus
ggaugggcagcugacacaggcaugaaucccagccuaggguuuugguuuugguuuugguuuuuuuucucagaagauagggggauguaccugccuugcuugcuuggccuacugugaaaaccaugcauguaaaugccccgucggugaauaugugcaaguuccuagcccucuucgaggaaggagccaugccuucuuguucucuguccccaacgcaccuggcauaucauagacucucaacaauggauggauggauggauggauggauggauggauggauaaaggaugguggacggaucauagucccaccaggcaggugucccugcagacaccucucuccuuccccagagcaccuggaccccacccccaaccaacaaauagcuguuaugugcgccacagucaagguagguacaccuauugaaaccuccucuguccucugcaucugagauuggaagggggcuccccaagaauagagaaagagcccauagcugugcucauggcagaaagcagcuagaugguccuuggggacccccuccuaagcucccagcucacccagaaaagggugcaucugucugcagcacucccugcuagguaccugccacaccagagcuccagaaagagagacaguccaccugacucagcucuggucccuccggacagcagacuccaucccuaaggcaagcaaggauauagugcuuucuacuaugggaaaaugaauggcucugucuuugucuggaccagaaaccccaccccucuguuggaaagguggcaauaggagaaggagaucuuucagggauagugccuguccccuuagcuuauggcuagggcucucccuucccaccuaagcugaggaaucauccauucccugauaaccagcagccuuuaagaucccacacccaucauagagccaauuccaguucaucccagcuccagcccugggcagcuccaaaaaaagaaaaaagaaaaagaaaagaaagaaacaaauccuucuccauuaaaagaagcaaagggcccugggacacuccccuucccccauucuagucaggaggccaauaguucccuuggagaccaccagcuggugccugucucugugcuuggucucuguguggggggaggggacugacuaaugugucagcgcacaggucucuuacugguuguagguggucugguacccgagcucgagcucggaguucaugcugugcgugugugugcgugcccugcugugccccagcggaggcuuucccuaagcaucugggucuccauaccuccccaagcuucucugugggcuuuugcccgagacuaugcuuccaagugugugccaccgggugugcgugcguccaugcauaugucacacugcacgugggguccucagcacagcaaacccucccuuugguagggcuuggggccgcagccuccuccaggccgaugccaagcgcccaggcgacagcccuaccuuuggacaugaauccuccuuugucucggguccuccgggagaugcucagggcgcggggcugcaaggcugagccgggcgcgggcucucccugggccaagcggccccugcagccgggccucgccccucggcgccguaccgccuacccgcccgacccgccacccggccgcgccgccccugcgccccgcgcccgcccgggaccucgccuccgcucgcucggcgccgcgccgccccugcccgcgcgcaccgaugccgccgcugccaccggcaccacgugacccgcgcgcaggccagccucgccgagggccccuccccuucccgcagcucccgcgccagcacgagggagcgggugccggagcuggggaugcucggccggguaaggugccuguaucccaguccuugucugucuccuuagagccuaucccuagccccuuaccagguccagggcgcaggaggcugguggcagcugccggcgaccgugcgcgugcgugagucacgcggugauugggauauugcgcuggaucgccgcgguucugcccaggcgcgguugcugacugagcuccgaaucaagagaacuggguuccagacccagcucccagccuaggugcugaacccuauaacccugaacuucccugagccucucuuacccacccaaaaagucuuugaugcauugcuaguugaucaacccugagaacacagaacugaggaugaccaaaccuccuugaccuuaaagcuuauggauguuaauagagaaaacagaaaguugguucgcacgggugcuagggcaucauggagauauaauggaagauuugggacaggugagggccaauggaaaggcaaauggagaagagaggaaaagaauaaaggggcguuuuccgugaagggcaacgcgggcagggaagcccggaguggguagagcgcuguguguaagagaacacucaaaacgugaaccuggucugaggcaagaaagauggcagacaaggguugccccaucuaagagaguggagaggcaggcugcacagugggguuagggguggggauagugagacuuuuuuuu

SEQ ID NO: 10757 - RNA, 2501 nt, Mus musculus
accaaccgugacccugacacuggauucucgagguuccuuaucaguucgccaucaacacucagcccuuccagguuucccugggcaagcaccacccuuauaaagugaggucugcacuggugagugaccaccccuuugggacucaagcuugaugcccuacccucggagguucaaauugggauccaagcccauuagaugcacuuauccccacgcaucccucugugccuccuuaaguggaaaaggccccacuccaucagccacuaggcuagaauccccagguccauccccuagcaggcucucaagggaaacuugcaggggauguuugcuguuuggugguaaagacugugcuuagcaagccacaagcccuggauucuaucauucccaggagagagagagagagagagagagagagagagagagagagagagagagagaauaacaaguugggcuugguggcacacaucuguaauacuagucugaggcugagccacauaggaaaacagucucaaaacaaacaaacaaacacaacaaaauggagcaaggaauuuaugaaacugaauucgucuacaaggucgucuacaaggccccccagcccagauguccacauacaaucuucuguaauccuccuuuuaaggaggacugaaugacaucuuuaaaaucuccgccaauccgucggccaccagacaaccugcagcaaagcaccggggagaguggcucuaguguccuugcaccauucccagucacugcggguggguugcguuuuuuccccaugcuggccuaagcuacuccucuuucaacccugagggcggcugagcaggguguacacuccaucggaaagucaaaggcccuugcucaacugccuaaucgcaggaagucccugccagggccccucugggcuucucccauagagaaacauguguauguacuuggguucacuguauuggacgaagaauaugaccagaaaccaguccuguccaggugugccagcgccaucccgacggcagcaccagcaacagaccucccccagggucccgcggaugcuccgggaugggggguggggggcuguggacguccgcucuuccccucccccuccagcaccuccagaggcuuugucaucccaguuccaggaguaucugggcucucagcacccagacgguuccccgccagaggccgcggaguacuuagaccgcccggcacccgggcucugcgucucggauuccccgcgccucgguaucccgggcgccucuccccgugccccaggucuccucccuccgaguuccgccccaucccagccugcccggagcgcucgggcuacgcaggccgggguggaugcagcgccggccccaccagcccgggauggccacacuuaccggcacccggcgcggagggcccgggcuccgggcuccgccaccagcguagcagagcccgcgcgggcuccaggcugacggcacagcgucgccguuucacccacagcacggagugcagcggcuccgccgcccccauugcccccaucgccgccggcgcggccucguccgccgggcgcggggcgcgcggacaccggggggggcgcgggaccguuagcggccccugcagucugcccggcggugacgcggggaggcgggagcgggaggcggcgcugcgucacccgguacgcagagaggguggcggggacccgggaggaggcgaccagggugaggacaggagaagcuagacuuggggccagagaagaaucagaaacagaggagucuagggagccuaggaugaggagcagaaaaggccuaggaaggaacgggagggaggggucagaggaggggacugagggaccuggcuguggggagggcggucggagcggccgggugcccugaaagacacuagucugucgcucuggcugccccuggguccugcugggucugcacgagcgacgggguagggagggcugcaaagggacgggcggagucccagcagcgcagaaauguugcccgggcgguccugggcaggcgauaggaggccguggaacugcuggugugcgcccaggagcgauuugaccuugggcauccgucucuuuuuaggucuuggucuccuggcggcuagcaagaguccugcagguuagucccaguaggcaaaggaaggcuaggauggagaggacagggguuaccuuccaggggaguggaagcuucauguguggaugguugugggucuacagccaccagagagacgggagaaggcgucuucuuaucagucaccugacuguacccucccaaacaggccuagggaaccggaguugcugcucuugaugcagcuuaacaugggacaagcugaacauauccaccucagggaggucuuccuggacuccgucucccccagccaaagcaucccaagacacagcagggcaaaauucagcacugcacucauugcauaucuacccaucuuugugaaaauuccaugggcaugugggcuugucccuuacugggucuccagugucuaaaauggucucugugcauaau

SEQ ID NO: 10758 - RNA, 2501 nt, Mus musculus
auuaugcacagagaccauuuuagacacuggagacccaguaagggacaagcccacaugcccauggaauuuucacaaagauggguagauaugcaaugagugcagugcugaauuuugcccugcugugucuugggaugcuuuggcugggggagacggaguccaggaagaccucccugagguggauauguucagcuugucccauguuaagcugcaucaagagcagcaacuccgguucccuaggccuguuugggaggguacagucaggugacugauaagaagacgccuucucccgucucucugguggcuguagacccacaaccauccacacaugaagcuuccacuccccuggaagguaaccccuguccucuccauccuagccuuccuuugccuacugggacuaaccugcaggacucuugcuagccgccaggagaccaagaccuaaaaagagacggaugcccaaggucaaaucgcuccugggcgcacaccagcaguuccacggccuccuaucgccugcccaggaccgcccgggcaacauuucugcgcugcugggacuccgcccgucccuuugcagcccucccuaccccgucgcucgugcagacccagcaggacccaggggcagccagagcgacagacuagugucuuucagggcacccggccgcuccgaccgcccuccccacagccaggucccucaguccccuccucugaccccucccucccguuccuuccuaggccuuuucugcuccucauccuaggcucccuagacuccucuguuucugauucuucucuggccccaagucuagcuucuccuguccucacccuggucgccuccucccggguccccgccacccucucugcguaccgggugacgcagcgccgccucccgcucccgccuccccgcgucaccgccgggcagacugcaggggccgcuaacggucccgcgccccccccgguguccgcgcgccccgcgcccggcggacgaggccgcgccggcggcgaugggggcaaugggggcggcggagccgcugcacuccgugcugugggugaaacggcgacgcugugccgucagccuggagcccgcgcgggcucugcuacgcugguggcggagcccggagcccgggcccuccgcgccgggugccgguaaguguggccaucccgggcugguggggccggcgcugcauccaccccggccugcguagcccgagcgcuccgggcaggcugggauggggcggaacucggagggaggagaccuggggcacggggagaggcgcccgggauaccgaggcgcggggaauccgagacgcagagcccgggugccgggcggucuaaguacuccgcggccucuggcggggaaccgucugggugcugagagcccagauacuccuggaacugggaugacaaagccucuggaggugcuggagggggaggggaagagcggacguccacagccccccaccccccaucccggagcauccgcgggacccugggggaggucuguugcuggugcugccgucgggauggcgcuggcacaccuggacaggacugguuucuggucauauucuucguccaauacagugaacccaaguacauacacauguuucucuaugggagaagcccagaggggcccuggcagggacuuccugcgauuaggcaguugagcaagggccuuugacuuuccgauggaguguacacccugcucagccgcccucaggguugaaagaggaguagcuuaggccagcauggggaaaaaacgcaacccacccgcagugacugggaauggugcaaggacacuagagccacucuccccggugcuuugcugcagguugucugguggccgacggauuggcggagauuuuaaagaugucauucaguccuccuuaaaaggaggauuacagaagauuguauguggacaucugggcuggggggccuuguagacgaccuuguagacgaauucaguuucauaaauuccuugcuccauuuuguuguguuuguuuguuuguuuugagacuguuuuccuauguggcucagccucagacuaguauuacagaugugugccaccaagcccaacuuguuauucucucucucucucucucucucucucucucucucucucucucucucucuccugggaaugauagaauccagggcuuguggcuugcuaagcacagucuuuaccaccaaacagcaaacauccccugcaaguuucccuugagagccugcuaggggauggaccuggggauucuagccuaguggcugauggaguggggccuuuuccacuuaaggaggcacagagggaugcguggggauaagugcaucuaaugggcuuggaucccaauuugaaccuccgaggguagggcaucaagcuugagucccaaagggguggucacucaccagugcagaccucacuuuauaaggguggugcuugcccagggaaaccuggaagggcugaguguugauggcgaacugauaaggaaccucgagaauccagugucagggucacgguuggu

SEQ ID NO: 10759 - RNA, 2501 nt, Mus musculus
caccucuuuacccuucuauccuucaccuggagagccucgaaagagcaaaugagagcacgcuuucuuugugggcggggccuaggccacguggacugagcggugguccuaaggcuuuucaccagguucugaucccucugccucaagacccggagcagcugcgaagccacugaaggagcccuggcuacaguaccuuuacacagccugcuccccuggugauuccuguuccuucucucccucgauucucuucgucucaggaugcacccuucccuugcaguggugaauggagacaggguaccacccauucccaccaggugagggaagauggggaaggggcauggugguuugggaugcucacggaacuagagaguuguagaagaaagguggcuuuccuaugauaagcagaaugucuaaguaacuucugggguggagguggguggggaguggccacuagaacagcaggauccucuuacuugacugccucuguacaaucaaguuacaagaaguuggcaucccauggccugccucagcagggugacugaacaaacccagggucacggaucagcggagacagaccuaggucucccuugggaaaucuggcuuuucccugguaacuccuagaugguccagccccgagacaacuccaucugagucaauguccaaguccccugcaaaguaucugcuucaccuuccucccugcccccuccaaguccucccuggcucuccuucccucuaauuuauuguauuauuuuuuuaaaauguauuuucguguaaccuuauccuccuccacuugcugagucccugaacaucccagacacaacaugucccaucaucucuuccucuguccgacuccuuggguauguaugggugauggaguggguguauccugucucuacucacuguggagggcugggguacagccugagaagcaagaauaaggagcgagugucggcagaacaagccuacccaucucagugguggguuuacaggcugcagacauggggcgagaucccaugaccaacucacucugggcccuguaaagcaggacuguuugccucuauaggguugcaguagcaguaccgaggcuucggaugacagcaccggauccaagaugugagacucagcccccauucccgguguggggcacauaccaguguccacacccuugaucagcccgucaacaagggcuaucuacagccguucuccaaucccaggugccuggaugcugcccacgaucgagacugcaaucucuggucuccaagcccuaccuauauucugagauccuuuguuggguaaacugggguaggguguagacaagagaguagguguccgcuuaggcucaagccgcugagcuucuaggaaucuggaggcgcggguaugauccacaggaaaauuuuggugucuuccaaauuagaaaggucuccucaccccgcuggggguccccuuuucaaauacuuagucugaggggaacguuagacccugcagcuacuuagaccuugcccgaaauaacccggauggcugacuguuccauuuagcggccccagagacuugcucucccgccagcugugacgccgcaauauucagucuuuuggggaaaaacuaggaaagggaucggagaugggggggggggagagggcauuagaagacccccccuaccugccagcgaguggaaucuaguaggaaaguuuccuccguguccccucccccccauucauucaucggaagcgugcagaccgggggcggaggcagggcgaggccccuccccacgccgggaaccccacgucgcgcuggagggucgcacacgcuuucccgcccagcucccaccagguccuugccggccccuaccagacugagccguaggcgccggagcccaccgggcguaggcccugcagccgcugcggcaccucccauacuguuuuguucagcucuugccgguagaaucccgcgcgcggacccgacauauccacagaagcagcuggagcgagcgccccggauccccgcgcgcagcacccggcccgcgccccacgcccagcaccgcugagcaaagcggggugggggcuggggggcggcggcgcagcagggcgggacggcggggcggggccgaggcccggcggauuuccccagccuggagaccggagggcggggaaacggggguggggugggguggguggagguugaggguucccggagacagacgcacagcuuccugccccucggagaccgugacaaaggaaaaagccugcuucccucccaugggggugacgaugaaacuucuugcuuguacuccuccaccuucaucuucugcauauuaccuacccccucugcccuuccccgggucccaggccaguccccuuccucagaaaugaagggaaauugucaaaagugagcuugagcacguggugauaauacuuucagaacaacaacaaaaaacauuagugguggggggagggggaaguaaaggcucuagguuaaaaaaccagcgccacggcgccaacucagggcac

SEQ ID NO: 10760 - RNA, 2501 nt, Mus musculus
gugcccugaguuggcgccguggcgcugguuuuuuaaccuagagccuuuacuucccccuccccccaccacuaauguuuuuuguuguuguucugaaaguauuaucaccacgugcucaagcucacuuuugacaauuucccuucauuucugaggaaggggacuggccugggacccggggaagggcagaggggguagguaauaugcagaagaugaagguggaggaguacaagcaagaaguuucaucgucacccccaugggagggaagcaggcuuuuuccuuugucacggucuccgaggggcaggaagcugugcgucugucuccgggaacccucaaccuccacccaccccaccccacccccguuuccccgcccuccggucuccaggcuggggaaauccgccgggccucggccccgccccgccgucccgcccugcugcgccgccgccccccagcccccaccccgcuuugcucagcggugcugggcguggggcgcgggccgggugcugcgcgcggggauccggggcgcucgcuccagcugcuucuguggauaugucggguccgcgcgcgggauucuaccggcaagagcugaacaaaacaguaugggaggugccgcagcggcugcagggccuacgcccggugggcuccggcgccuacggcucagucugguaggggccggcaaggaccuggugggagcugggcgggaaagcgugugcgacccuccagcgcgacgugggguucccggcguggggaggggccucgcccugccuccgcccccggucugcacgcuuccgaugaaugaaugggggggaggggacacggaggaaacuuuccuacuagauuccacucgcuggcagguagggggggucuucuaaugcccucucccccccccccaucuccgaucccuuuccuaguuuuuccccaaaagacugaauauugcggcgucacagcuggcgggagagcaagucucuggggccgcuaaauggaacagucagccauccggguuauuucgggcaaggucuaaguagcugcagggucuaacguuccccucagacuaaguauuugaaaaggggacccccagcggggugaggagaccuuucuaauuuggaagacaccaaaauuuuccuguggaucauacccgcgccuccagauuccuagaagcucagcggcuugagccuaagcggacaccuacucucuugucuacacccuaccccaguuuacccaacaaaggaucucagaauauagguagggcuuggagaccagagauugcagucucgaucgugggcagcauccaggcaccugggauuggagaacggcuguagauagcccuuguugacgggcugaucaaggguguggacacugguaugugccccacaccgggaaugggggcugagucucacaucuuggauccggugcugucauccgaagccucgguacugcuacugcaacccuauagaggcaaacaguccugcuuuacagggcccagagugaguuggucaugggaucucgccccaugucugcagccuguaaacccaccacugagauggguaggcuuguucugccgacacucgcuccuuauucuugcuucucaggcuguaccccagcccuccacagugaguagagacaggauacacccacuccaucacccauacauacccaaggagucggacagaggaagagaugaugggacauguugugucugggauguucagggacucagcaaguggaggaggauaagguuacacgaaaauacauuuuaaaaaaauaauacaauaaauuagagggaaggagagccagggaggacuuggagggggcagggaggaaggugaagcagauacuuugcaggggacuuggacauugacucagauggaguugucucggggcuggaccaucuaggaguuaccagggaaaagccagauuucccaagggagaccuaggucugucuccgcugauccgugacccuggguuuguucagucacccugcugaggcaggccaugggaugccaacuucuuguaacuugauuguacagaggcagucaaguaagaggauccugcuguucuaguggccacuccccacccaccuccaccccagaaguuacuuagacauucugcuuaucauaggaaagccaccuuucuucuacaacucucuaguuccgugagcaucccaaaccaccaugccccuuccccaucuucccucaccuggugggaaugggugguacccugucuccauucaccacugcaagggaagggugcauccugagacgaagagaaucgagggagagaaggaacaggaaucaccaggggagcaggcuguguaaagguacuguagccagggcuccuucaguggcuucgcagcugcuccgggucuugaggcagagggaucagaaccuggugaaaagccuuaggaccaccgcucaguccacguggccuaggccccgcccacaaagaaagcgugcucucauuugcucuuucgaggcucuccaggugaaggauagaaggguaaagaggug

SEQ ID NO: 10761 - RNA, 2501 nt, Mus musculus
ucgugcagcauacaggaucccaucagcaggaaccagcuuugcacucuggccgacaaugcagcagccgacuuccucaaggaugugcagcaucugcucagacaccuucauuaacuucuagggacggacccacccacuggcccugaccacugacccaacagaaguucaaaacauggccagcgagagucaguaugguucugauggcuaaccuaccaaggaucccgauuaguuaugacagacacauuaaugcguaccagcuaaucaguggcuucucccuguucccaaguaacgaucccgaucaaaguucucucgaugacuccaggccuauuuacaaccaaugaccuuuugaauagucaauguucucucucauuagugacccagauaaauaaccuguccauugaucauccugugauucgggccagugacucccucaacccagaucauugaucaguuaguggcccaccuguaccugcucugggcucugggugacaccgaacccaggaaucgauuccagcuuauccagugugcccccugugugucccagacugcggccgcugaucauuggcaccugguggagagggaugcugacugcccccacgcaggcccuuaaccucauuuuaccuauccucuacuaagaaccuauccuauccucauaugaaauuacuuuuaaaaaagcaguuauauuuuagagucuuuuuuuuuuuuuuuuuuuuuuuuuuugguuuuucgagacaggguuucucuguguaggucuggcuguccuggaacucacuuuguagaccaggcuggccuagaacucagaaauccgccugccucugccucccaagugcuaggauuaaaggcgugcgccaccacgcccggcuauuuuagagucuuuuaaacaguuaaugagggugcccaauugguggaaaggaagauaaacuguacuuggugggagcaguuugucaguaggucaggaguuggcacacacucaucuggggcccaagucugaaggacaggaagaggaaggccccgcucuuucuuuguggggccugcuagcucuuaaaggguccucuuggguacagaggcaacucuacuccaugguggaauuuguguauugagcgaugggacugcccuggauuuugucuuugagagcuuugagccaggcuggaggguuggagguuccugugagcgggucagaggucuguagaggacguggucacuaaccuuacagccgcaugcagccagggcaggugccagaaccaggcuaaccuugucacccacaccuccuguggaguguuugucaacaagcugcuggugccaggcuuugggccacuccaguugcugcccagacucugcaagggcccgagucagcacagaugucucuucuagguucauucccugcagccgaauggccauuagcauggccccuaaguauggauacaaugagcgagguguucacgcagucugaguuuucuggggccgugaugguggugggguacuguggaucccugaggugcguauggggcagcuggaagggguguuggggucuaguuaccacacaccaauuuguguguccugugcucuuccaucuaucaccgcgugcacgaaguuucugauaucugcuucucucagaugcccuccaucucgcuucaggcggaucagcucaggcagcugccugggcuccccaccuccucccccugaggccgagggagguggugucccuggagcugccauugcuccagucuguaagggauauugagacaccacuggaacuccccaccuccaccccauccaggucuuugaauccauggucacuuguccaaaccuugcucuuacagggucucuggcacucaccagucucauguuuuucucuauccagcacugucccauucccaaccccaucuggcuuccauuucucgaccucacaaaucacuccccccaccccgcacucccccgcccacgucuaguaccuauucaauucaggggccuuuaccaguuuucuggaucuggcucgguuccagccuguuaucccucaguccugcguggacuuagguacagaggagacaguucaccguccaggauuacgguuaggaauaguggaaaaauagggcugucccaguaggcggcacuugucaagguaaggccaaucaccacuuaagcucuuccccaccugcuaucuggcuaauuggcauugccaggaccuuuaagggucggguuacagcgcuccggaccggaguucgcucugcccaguucccuggggucuugguaucuaugggucccgagcacugcuuguccugugcgacagaucucuaggcaagcgacagaucucuagguucagauaccacugagacaaucaaugcucgaacucaccucguccucuccucccccaccccuccuugcccgcuucggagaaagaaagagagacacacagcacugacuuagaaagcuuuaaguaaacaacccagagccugugcgcgcgugcuugcaggcaucagucguccacgugguacuguaucaugggg

SEQ ID NO: 10762 - RNA, 2501 nt, Mus musculus
ccccaugauacaguaccacguggacgacugaugccugcaagcacgcgcgcacaggcucuggguuguuuacuuaaagcuuucuaagucagugcugugugucucucuuucuuucuccgaagcgggcaaggaggggugggggaggagaggacgaggugaguucgagcauugauugucucagugguaucugaaccuagagaucugucgcuugccuagagaucugucgcacaggacaagcagugcucgggacccauagauaccaagaccccagggaacugggcagagcgaacuccgguccggagcgcuguaacccgacccuuaaagguccuggcaaugccaauuagccagauagcagguggggaagagcuuaaguggugauuggccuuaccuugacaagugccgccuacugggacagcccuauuuuuccacuauuccuaaccguaauccuggacggugaacugucuccucuguaccuaaguccacgcaggacugagggauaacaggcuggaaccgagccagauccagaaaacugguaaaggccccugaauugaauagguacuagacgugggcgggggagugcgggguggggggagugauuugugaggucgagaaauggaagccagaugggguugggaaugggacagugcuggauagagaaaaacaugagacuggugagugccagagacccuguaagagcaagguuuggacaagugaccauggauucaaagaccuggaugggguggagguggggaguuccaguggugucucaauaucccuuacagacuggagcaauggcagcuccagggacaccaccucccucggccucagggggaggagguggggagcccaggcagcugccugagcugauccgccugaagcgagauggagggcaucugagagaagcagauaucagaaacuucgugcacgcggugauagauggaagagcacaggacacacaaauuggugugugguaacuagaccccaacaccccuuccagcugccccauacgcaccucagggauccacaguaccccaccaccaucacggccccagaaaacucagacugcgugaacaccucgcucauuguauccauacuuaggggccaugcuaauggccauucggcugcagggaaugaaccuagaagagacaucugugcugacucgggcccuugcagagucugggcagcaacuggaguggcccaaagccuggcaccagcagcuuguugacaaacacuccacaggaggugugggugacaagguuagccugguucuggcaccugcccuggcugcaugcggcuguaagguuagugaccacguccucuacagaccucugacccgcucacaggaaccuccaacccuccagccuggcucaaagcucucaaagacaaaauccagggcagucccaucgcucaauacacaaauuccaccauggaguagaguugccucuguacccaagaggacccuuuaagagcuagcaggccccacaaagaaagagcggggccuuccucuuccuguccuucagacuugggccccagaugagugugugccaacuccugaccuacugacaaacugcucccaccaaguacaguuuaucuuccuuuccaccaauugggcacccucauuaacuguuuaaaagacucuaaaauagccgggcgugguggcgcacgccuuuaauccuagcacuugggaggcagaggcaggcggauuucugaguucuaggccagccuggucuacaaagugaguuccaggacagccagaccuacacagagaaacccugucucgaaaaaccaaaaaaaaaaaaaaaaaaaaaaaaaaagacucuaaaauauaacugcuuuuuuaaaaguaauuucauaugaggauaggauagguucuuaguagaggauagguaaaaugagguuaagggccugcgugggggcagucagcaucccucuccaccaggugccaaugaucagcggccgcagucugggacacacagggggcacacuggauaagcuggaaucgauuccuggguucggugucacccagagcccagagcagguacaggugggccacuaacugaucaaugaucuggguugagggagucacuggcccgaaucacaggaugaucaauggacagguuauuuaucugggucacuaaugagagagaacauugacuauucaaaaggucauugguuguaaauaggccuggagucaucgagagaacuuugaucgggaucguuacuugggaacagggagaagccacugauuagcugguacgcauuaaugugucugucauaacuaaucgggauccuugguagguuagccaucagaaccauacugacucucgcuggccauguuuugaacuucuguugggucaguggucagggccaguggguggguccgucccuagaaguuaaugaaggugucugagcagaugcugcacauccuugaggaagucggcugcugcauugucggccagagugcaaagcugguuccugcugaugggauccuguaugcugcacga

SEQ ID NO: 10763 - RNA, 2501 nt, Mus musculus
cgccguguccuucaggggcuccagaaacacgacucuuuuaccugccuuccgaucgucagcagaggcaucgccaguggggccaggacugagaauggacgagugggcacugcuuuggcucagcguguuuuucugucucuuggcuuugcauuugcaugggcacggcgucagguacagauacaguagcacuagaacuauacuggccacgcaggcagccagggugguaaaggccguguuaaacgccucgugggcgugggaucuguuuauggugaaauugcucacguugaucaugauauccaccgucucguuuaacagccgcugccuguucauugcgauacaagaauauaccccggcguccucaaagccaggguucucuaugaccagacuuccguuguaaaacacacgaaaguuccccaugucuuuaucuggcuccagcagccuguuaucgggaccgacccagaugaaaucaguauuuccauugccagucuugcugucacaguggacgaucgcccucuccccaaccugagccucguggauaaagccaagugcguggaaggagccguugauaacgcuguaagaacaguucagaaagcucuccuggagcagcugcagcuggugggagugccuggagucagaccacaggcgacagguauagucauucuuaaaauccaucacggagcuaaagugccuacgguaccaaaagaucagcaacgaguacagagaacagucacauacaaauggguucccgugaagguagaugccucucagcugucuccccggcacuaaguuuauauggugcaucgguauggaagggauucgauuauaggaaacaucuaaaaaugucagaucagccagcuugaaccucccaguauacaaauccauagggaacugugugagaaaguucccacucagauagaguuucugcaagugggaaagccccccgaacgcugcgggguccagauaggaaaugugguuguuguacagcagcaguacuuccagagccuucagcucuuggaauguggcacucuuuaccgacuucagccuauuggaugauaaguccagacacuuuaaauuugggguuguggagaaacugcccguggagaugcuggugauguuguuguggcgaagaauuaaggugcucagcuugacaaacgacaccgggauccagucggcauccaacaguccgauucuguuauagcucagauccagucuuuuaaucagucugaaaagguucccgggcaccuuagauagguuuuuguuggugcagcugacaaugucgguggcacagaugcaagcaguggggcacauuccugaggcgcuggggcucaccaucacugcgaucaccaacagacacagcagcucucugcaacccgguuugacagcucuaggcagggugggcaguguguggaaccuuaacgacauuauggucgccucugagucucuugccagucgcuucucaucagcucagucucccaccaaucugguaacaacauuuaaaacgggagaaaaguacaaguuaacugccacuaguuaacccguuagaguuauuccguaauugcuuucauuccaauuaacuuuugaaauggguuccaucuccaacagggguggcuuuuuaauaaagaaccuguuauaugcauuuuuccuagauuacuccaacucagugagauuuccagguaccuucucucaaugcgacagucucagcaugagaaacucaggcuuuuuuguguguuuuuguuucuaaaggaugcauucugccuuaacucccuccaccgacacacacaaaaacacacaaucgcaucccauaaacaauugaacggaaauacuuagccagccgucggucuagccgaccacucacagcgcugggaagccgcagcggcucggagaggccgccgacggcggugcgcucggaagguccgcgcguccgccugccgguuugcgccccgcgcgcucgcaccuucccuccagcucccggugggcggcagccucucaacuuuggcgaguuucgaggcagcggcgcgggcuccccggcucucucgcucggcugcagguaccgccggagcucggccgcgccgggagcggggugggcggcgggggaagccggcccgccgguggcgcucgcaggcugcagggcccgggcucccgcgcccgccgcccgccuuuuaucccgugcgcccggggucgggagcgggcgggaggcggguccccgcguccucgcuccucgggcgccgcggcgggcggagcaggggagggggggcgcagccaaucgcagaggcggccccgugcgggcuccgcgccgccucucggccgggugggaccgcagcgaggccugcgacucugcacccccaggccccgcgccccucgccccgcgcccgcgggggagccgcccagcccgguagggagccgcccagggugccggggugccgcgcgccggagcccgcgggcgguggcccgcagguggcaccccaccccgaucucggagccuggcuuuaggggcuggggcgagg

SEQ ID NO: 10764 - RNA, 2501 nt, Mus musculus
ccucgccccagccccuaaagccaggcuccgagaucgggguggggugccaccugcgggccaccgcccgcgggcuccggcgcgcggcaccccggcacccugggcggcucccuaccgggcugggcggcucccccgcgggcgcggggcgaggggcgcggggccugggggugcagagucgcaggccucgcugcggucccacccggccgagaggcggcgcggagcccgcacggggccgccucugcgauuggcugcgcccccccuccccugcuccgcccgccgcggcgcccgaggagcgaggacgcggggacccgccucccgcccgcucccgaccccgggcgcacgggauaaaaggcgggcggcgggcgcgggagcccgggcccugcagccugcgagcgccaccggcgggccggcuucccccgccgcccaccccgcucccggcgcggccgagcuccggcgguaccugcagccgagcgagagagccggggagcccgcgccgcugccucgaaacucgccaaaguugagaggcugccgcccaccgggagcuggagggaaggugcgagcgcgcggggcgcaaaccggcaggcggacgcgcggaccuuccgagcgcaccgccgucggcggccucuccgagccgcugcggcuucccagcgcugugaguggucggcuagaccgacggcuggcuaaguauuuccguucaauuguuuaugggaugcgauuguguguuuuugugugugucgguggagggaguuaaggcagaaugcauccuuuagaaacaaaaacacacaaaaaagccugaguuucucaugcugagacugucgcauugagagaagguaccuggaaaucucacugaguuggaguaaucuaggaaaaaugcauauaacagguucuuuauuaaaaagccaccccuguuggagauggaacccauuucaaaaguuaauuggaaugaaagcaauuacggaauaacucuaacggguuaacuaguggcaguuaacuuguacuuuucucccguuuuaaauguuguuaccagauuggugggagacugagcugaugagaagcgacuggcaagagacucagaggcgaccauaaugucguuaagguuccacacacugcccacccugccuagagcugucaaaccggguugcagagagcugcugugucuguuggugaucgcagugauggugagccccagcgccucaggaaugugccccacugcuugcaucugugccaccgacauugucagcugcaccaacaaaaaccuaucuaaggugcccgggaaccuuuucagacugauuaaaagacuggaucugagcuauaacagaaucggacuguuggaugccgacuggaucccggugucguuugucaagcugagcaccuuaauucuucgccacaacaacaucaccagcaucuccacgggcaguuucuccacaaccccaaauuuaaagugucuggacuuaucauccaauaggcugaagucgguaaagagugccacauuccaagagcugaaggcucuggaaguacugcugcuguacaacaaccacauuuccuaucuggaccccgcagcguucggggggcuuucccacuugcagaaacucuaucugagugggaacuuucucacacaguucccuauggauuuguauacugggagguucaagcuggcugaucugacauuuuuagauguuuccuauaaucgaaucccuuccauaccgaugcaccauauaaacuuagugccggggagacagcugagaggcaucuaccuucacgggaacccauuuguaugugacuguucucuguacucguugcugaucuuuugguaccguaggcacuuuagcuccgugauggauuuuaagaaugacuauaccugucgccuguggucugacuccaggcacucccaccagcugcagcugcuccaggagagcuuucugaacuguucuuacagcguuaucaacggcuccuuccacgcacuuggcuuuauccacgaggcucagguuggggagagggcgaucguccacugugacagcaagacuggcaauggaaauacugauuucaucugggucggucccgauaacaggcugcuggagccagauaaagacauggggaacuuucguguguuuuacaacggaagucuggucauagagaacccuggcuuugaggacgccgggguauauucuuguaucgcaaugaacaggcagcggcuguuaaacgagacgguggauaucaugaucaacgugagcaauuucaccauaaacagaucccacgcccacgaggcguuuaacacggccuuuaccacccuggcugccugcguggccaguauaguucuagugcuacuguaucuguaccugacgccgugcccaugcaaaugcaaagccaagagacagaaaaacacgcugagccaaagcagugcccacucguccauucucaguccuggccccacuggcgaugccucugcugacgaucggaaggcagguaaaagagucguguuucuggagccccugaaggacacggcg

SEQ ID NO: 10765 - RNA, 2501 nt, Mus musculus
caacauuuaaaacgggagaaaaguacaaguuaacugccacuaguuaacccguuagaguuauuccguaauugcuuucauuccaauuaacuuuugaaauggguuccaucuccaacagggguggcuuuuuaauaaagaaccuguuauaugcauuuuuccuagauuacuccaacucagugagauuuccagguaccuucucucaaugcgacagucucagcaugagaaacucaggcuuuuuuguguguuuuuguuucuaaaggaugcauucugccuuaacucccuccaccgacacacacaaaaacacacaaucgcaucccauaaacaauugaacggaaauacuuagccagccgucggucuagccgaccacucacagcgcugggaagccgcagcggcucggagaggccgccgacggcggugcgcucggaagguccgcgcguccgccugccgguuugcgccccgcgcgcucgcaccuucccuccagcucccggugggcggcagccucucaacuuuggcgaguuucgaggcagcggcgcgggcuccccggcucucucgcucggcugcagguaccgccggagcucggccgcgccgggagcggggugggcggcgggggaagccggcccgccgguggcgcucgcaggcugcagggcccgggcucccgcgcccgccgcccgccuuuuaucccgugcgcccggggucgggagcgggcgggaggcggguccccgcguccucgcuccucgggcgccgcggcgggcggagcaggggagggggggcgcagccaaucgcagaggcggccccgugcgggcuccgcgccgccucucggccgggugggaccgcagcgaggccugcgacucugcacccccaggccccgcgccccucgccccgcgcccgcgggggagccgcccagcccgguagggagccgcccagggugccggggugccgcgcgccggagcccgcgggcgguggcccgcagguggcaccccaccccgaucucggagccuggcuuuaggggcuggggcgaggggccuggcgggcgcugugcaccgggugcuugcugggguccccgcccggguuuggaggaggaggaggaggacaggagcgagggccgcggcgcguucccucgggcaccaccggggcuuugcggggggagggggugcggaggcgccgcggggacgccccccgguucccugggaaaguucgagcccuuuuccuaacucggagacggcggcccgaggcaccgggcccagcucuagaagcaaaggggcaggaaagaaggcuuccgguuggaaugcacagauaagggcauuagccuuuaaaaaaaauaaacaaaaaaaacaaaaacaaaaaaaauccagagucgcgcuggcggcuucaggacuaggauuaauucgguagggguggcuacgcagaaggacuuguccccuagaggcccuacagccaccagggcuccaguagacugagcuagcauucucggaaggcacaagcugaacaaggccaugugaaaaugagggagagagcuugaagcuggugggcuuuucgauuacaaauccauucuuguuuaaaggcuuaaacgaugggauuugacugagccaagugauccauuuggccguuguguacggauuaaaagaaauaaauuacugucccuaaaaaaccaugcuagccacaguagaagggcuuagggagccaaugaaagguagacaaaauuggggagacagugagggcagagcacaugaauacaacuuuaaaaaccaaaaugauccccccccccccccacggcauccuuaaauuuaucggaaaacuuccugagugaguuuuuggcauggaucugauggaccuguguguugcguuaauguggacugguuccgggagagcucagcgauucaggguuuucaagggagggcaacuugguuccuguuaguuucacuuucacuaaagauugacuuuuaaaaccacaagcauccagccuagugugcuccaggggugcauucuucauuuccccagagaaauagguuuaagauuccuaucagaccacacgcacacccccaacccccgggcuucccccaagaaaaccucggguuuaaggcucaaagucacaaagcugagcggucaccuggaaauggagucagguaaucaaaggaauguuauuuaaaugaccaguaagugacuggguuuugcaguccuaaauggaaggaaauugggaagcugguuaacccgugcuuaucacaaaaugaucuaaaaugggugguuuuuuuuuuuuuuaagaaguggagaguggaaguuaugcuauaccugcaggcaacucucagaaguaucuugccaucaccccacagcauaaaccagcuguacacaaacucgcagggggcaggucuauauaagaccagcucucuggacucccaugcaugucaaaggcaagagaggcaugaaagguguguguuuacuagccuggagacaagaaagcugacuucaguaauagcaaaagguauggccuuacuuugcggaagguaaug

SEQ ID NO: 10766 - RNA, 2501 nt, Mus musculus
cauuaccuuccgcaaaguaaggccauaccuuuugcuauuacugaagucagcuuucuugucuccaggcuaguaaacacacaccuuucaugccucucuugccuuugacaugcaugggaguccagagagcuggucuuauauagaccugcccccugcgaguuuguguacagcugguuuaugcuguggggugauggcaagauacuucugagaguugccugcagguauagcauaacuuccacucuccacuucuuaaaaaaaaaaaaaaccacccauuuuagaucauuuugugauaagcacggguuaaccagcuucccaauuuccuuccauuuaggacugcaaaacccagucacuuacuggucauuuaaauaacauuccuuugauuaccugacuccauuuccaggugaccgcucagcuuugugacuuugagccuuaaacccgagguuuucuugggggaagcccggggguugggggugugcguguggucugauaggaaucuuaaaccuauuucucuggggaaaugaagaaugcaccccuggagcacacuaggcuggaugcuugugguuuuaaaagucaaucuuuagugaaagugaaacuaacaggaaccaaguugcccucccuugaaaacccugaaucgcugagcucucccggaaccaguccacauuaacgcaacacacagguccaucagauccaugccaaaaacucacucaggaaguuuuccgauaaauuuaaggaugccguggggggggggggggaucauuuugguuuuuaaaguuguauucaugugcucugcccucacugucuccccaauuuugucuaccuuucauuggcucccuaagcccuucuacuguggcuagcaugguuuuuuagggacaguaauuuauuucuuuuaauccguacacaacggccaaauggaucacuuggcucagucaaaucccaucguuuaagccuuuaaacaagaauggauuuguaaucgaaaagcccaccagcuucaagcucucucccucauuuucacauggccuuguucagcuugugccuuccgagaaugcuagcucagucuacuggagcccugguggcuguagggccucuaggggacaaguccuucugcguagccaccccuaccgaauuaauccuaguccugaagccgccagcgcgacucuggauuuuuuuuguuuuuguuuuuuuuguuuauuuuuuuuaaaggcuaaugcccuuaucugugcauuccaaccggaagccuucuuuccugccccuuugcuucuagagcugggcccggugccucgggccgccgucuccgaguuaggaaaagggcucgaacuuucccagggaaccggggggcguccccgcggcgccuccgcacccccuccccccgcaaagccccgguggugcccgagggaacgcgccgcggcccucgcuccuguccuccuccuccuccuccaaacccgggcggggaccccagcaagcacccggugcacagcgcccgccaggccccucgccccagccccuaaagccaggcuccgagaucgggguggggugccaccugcgggccaccgcccgcgggcuccggcgcgcggcaccccggcacccugggcggcucccuaccgggcugggcggcucccccgcgggcgcggggcgaggggcgcggggccugggggugcagagucgcaggccucgcugcggucccacccggccgagaggcggcgcggagcccgcacggggccgccucugcgauuggcugcgcccccccuccccugcuccgcccgccgcggcgcccgaggagcgaggacgcggggacccgccucccgcccgcucccgaccccgggcgcacgggauaaaaggcgggcggcgggcgcgggagcccgggcccugcagccugcgagcgccaccggcgggccggcuucccccgccgcccaccccgcucccggcgcggccgagcuccggcgguaccugcagccgagcgagagagccggggagcccgcgccgcugccucgaaacucgccaaaguugagaggcugccgcccaccgggagcuggagggaaggugcgagcgcgcggggcgcaaaccggcaggcggacgcgcggaccuuccgagcgcaccgccgucggcggccucuccgagccgcugcggcuucccagcgcugugaguggucggcuagaccgacggcuggcuaaguauuuccguucaauuguuuaugggaugcgauuguguguuuuugugugugucgguggagggaguuaaggcagaaugcauccuuuagaaacaaaaacacacaaaaaagccugaguuucucaugcugagacugucgcauugagagaagguaccuggaaaucucacugaguuggaguaaucuaggaaaaaugcauauaacagguucuuuauuaaaaagccaccccuguuggagauggaacccauuucaaaaguuaauuggaaugaaagcaauuacggaauaacucuaacggguuaacuaguggcaguuaacuuguacuuuucucccguuuuaaauguug

SEQ ID NO: 10767 - RNA, 2501 nt, Mus musculus
gacuucucggucuaccuauuuagacccuaggccuuccucuacugaaagccuaggauuugcacaucuacaaucugugcuuacggcagagggccagggggucucuaggggcuucccaggggauucagucccuccaagagaucaguucagaggugggcgggggagggagacuaauagaucauguuauaaauaaguagagcccaacgcaccagggccgcuagaguauacgcagacuuaugacugugccuggagaagagugggggucggcuaagcugccccacuuucuuccuuucucuccuuucccuucucuaucuuggucaggaagcaaaucacaguugaccaggaguacugacuggggauuccuacuuuuugcaguuugaagcaaugucccuguuguccucccugugucccucacacaagguagaaaaggcuacgggucaccuauuucugcucaaggggucucuaguauccaaaacaaaggcagacacuuucacuccuacugucuccuguucuggcugcacacacuauucucuccagucuucagcuagagaaggaauagagauggcccccaaauauaaaaacccuuaguuuacagaguugacgguccuggguccagacaacugcucucugccccucagaaguccacucuuccucccuagccuggggagagcauuccuugcauuuucugcucccucggccuucugauuucuccugcaugccugccuuacgggacaagauggguaccugacaagguagaaauggaaccagugccugguaacuccacaguacugggaugugccucuaguucuuaagaauaggaagaggugaggauuuaccacaaagccacugucucuucguggccaucuccuggaaucaucccuugcccaucagccuuugcugacauuccccccccccccaccuccugugucaugaagaagauggcuuuccucggggcaucgaggcagaccugaacucuguccaagggaacauuugcaaugcccagaaaaugccugcccaacugcuugccuaggcucuggccccucuuaccgcugcugggcccagacaggaggcugacucauucaccacaaagaggaggaggaggagaaggaggaggaggaagaggaggaggagcagaaggaggaggaacagcaggaggaggaggguugcucagacucagagagccaaggcucccagagcccaggcagauucagccucagguaggggauagucauaguggagacaguggacuuggagaucacacgcagauccuaccuagauucgccucuugcauccaagucccuucacucuccaaacagaaacuaguccuuaaaaccccuuucucaauuuccacgcucacccucgagucccucuggacaucuguggacaggcucuccugaaagagaaaccuagcacacuggucucaaagcaccggcgguuuuagaaaggcaagcacaaaaggaaaaaacuccauauaaaagauuccacuccacuaucacuggugaucacacauggcuccgcgaaguaauaaacaggcucuacacacuccaccuccagagaccuuagcaccaucgacagccaaucacucccuucuuacuccuccacuccaagucaaagcgcccgucccaggaaagaaacaaacgcuucuuguuguccagcgcugagcacccuccuagcuaaggacucccacgcugagccgccugagcaucgcggagguggcuguccccucgccagccucguacgaacuucagcuuucucagacuugggugcccucucagagucccaaccucauggcaccacagcccggaucucagucgccaacuuugcuuuccgagucuuggacucuagcgcuugcacccgaacgcugagaccucuagaucccagacgccugccccgggucuaaccacucacccagaacccccuucccccugcaccccgauccgcaccuggucuggcgguggacacacagcucggcgcuucccgugcuuagggcucggcagcagcuuuuugacaagcagagacugcucagcaccuggccccgcccccgcaaggccccgcccccggaccgcccugccccucaaccacgcccacuaaguucaguccucugaagcccugaaacuuucuugacuuggaaucaaccacugcacugucgccuuggaggcccugccuugugaggggcuccaggaccgccagccacagugcagcacaggcgucugccuuccguggaacaguauuugaugaugucgugugugcaaauccacguuucugccugugaugauccgugauguagccaccacccaccccugccgccgugguucuacccaaucugcuguaaacgccucccccaggugugucacccguaccugaguugacccgggaccccgacgcccgcggcgcgcugcagggagccguucucugcgcgcgccggauggggaaccucaggugaguuucuccugcagggcgcucagccggacucuacugguuaggauuagcccaagaaaaccaga

SEQ ID NO: 10768 - RNA, 2501 nt, Mus musculus
ucugguuuucuugggcuaauccuaaccaguagaguccggcugagcgcccugcaggagaaacucaccugagguuccccauccggcgcgcgcagagaacggcucccugcagcgcgccgcgggcgucggggucccgggucaacucagguacgggugacacaccugggggaggcguuuacagcagauuggguagaaccacggcggcaggggugggugguggcuacaucacggaucaucacaggcagaaacguggauuugcacacacgacaucaucaaauacuguuccacggaaggcagacgccugugcugcacuguggcuggcgguccuggagccccucacaaggcagggccuccaaggcgacagugcagugguugauuccaagucaagaaaguuucagggcuucagaggacugaacuuagugggcgugguugaggggcagggcgguccgggggcggggccuugcgggggcggggccaggugcugagcagucucugcuugucaaaaagcugcugccgagcccuaagcacgggaagcgccgagcuguguguccaccgccagaccaggugcggaucggggugcagggggaaggggguucugggugagugguuagacccggggcaggcgucugggaucuagaggucucagcguucgggugcaagcgcuagaguccaagacucggaaagcaaaguuggcgacugagauccgggcuguggugccaugagguugggacucugagagggcacccaagucugagaaagcugaaguucguacgaggcuggcgaggggacagccaccuccgcgaugcucaggcggcucagcgugggaguccuuagcuaggagggugcucagcgcuggacaacaagaagcguuuguuucuuuccugggacgggcgcuuugacuuggaguggaggaguaagaagggagugauuggcugucgauggugcuaaggucucuggagguggaguguguagagccuguuuauuacuucgcggagccaugugugaucaccagugauaguggaguggaaucuuuuauauggaguuuuuuccuuuugugcuugccuuucuaaaaccgccggugcuuugagaccagugugcuagguuucucuuucaggagagccuguccacagauguccagagggacucgagggugagcguggaaauugagaaagggguuuuaaggacuaguuucuguuuggagagugaagggacuuggaugcaagaggcgaaucuagguaggaucugcgugugaucuccaaguccacugucuccacuaugacuauccccuaccugaggcugaaucugccugggcucugggagccuuggcucucugagucugagcaacccuccuccuccugcuguuccuccuccuucugcuccuccuccucuuccuccuccuccuucuccuccuccuccucuuuguggugaaugagucagccuccugucugggcccagcagcgguaagaggggccagagccuaggcaagcaguugggcaggcauuuucugggcauugcaaauguucccuuggacagaguucaggucugccucgaugccccgaggaaagccaucuucuucaugacacaggagguggggggggggggaaugucagcaaaggcugaugggcaagggaugauuccaggagauggccacgaagagacaguggcuuugugguaaauccucaccucuuccuauucuuaagaacuagaggcacaucccaguacuguggaguuaccaggcacugguuccauuucuaccuugucagguacccaucuugucccguaaggcaggcaugcaggagaaaucagaaggccgagggagcagaaaaugcaaggaaugcucuccccaggcuagggaggaagaguggacuucugaggggcagagagcaguugucuggacccaggaccgucaacucuguaaacuaaggguuuuuauauuugggggccaucucuauuccuucucuagcugaagacuggagagaauagugugugcagccagaacaggagacaguaggagugaaagugucugccuuuguuuuggauacuagagaccccuugagcagaaauaggugacccguagccuuuucuaccuugugugagggacacagggaggacaacagggacauugcuucaaacugcaaaaaguaggaauccccagucaguacuccuggucaacugugauuugcuuccugaccaagauagagaagggaaaggagagaaaggaagaaaguggggcagcuuagccgacccccacucuucuccaggcacagucauaagucugcguauacucuagcggcccuggugcguugggcucuacuuauuuauaacaugaucuauuagucucccucccccgcccaccucugaacugaucucuuggagggacugaauccccugggaagccccuagagacccccuggcccucugccguaagcacagauuguagaugugcaaauccuaggcuuucaguagaggaaggccuagggucuaaauagguagaccgagaaguc

SEQ ID NO: 10769 - RNA, 2501 nt, Mus musculus
ggagggugcaggggaggggaaucuguuguuauggaguuuucauucucggaauuuaaguacuuagcuucauaauuuucauacccccccaaccuggguagaaacagcugggucccauaagagacuguaucucacccugagcuuucuggagggagggaaaauuguuuuuuguuuuuuuuuuuuuuuuuuuuuuuuuuuuuuuuuuuuuuuugcugcagaagggagaagcagaucggucgcgccucccuccgccuuccucugcaccuccaagccuggugcugccagcucgccugggauuauuaacaaucgcuacccaguccugugggccgcuggaggauggaccuggcucucccaugguccuccaaggaaggaaugcggagagcgggugaaaagccccccccccccccccaggcagacggucucucuccggcuugggggugggggucgugcagcaaacugcuuucucaugcuguccuauuaaacauugcagccacaugcucuuugcagcuucucugaggcuacugcagcaucccugccccgcccgucagcccauacaacagagcuucacugcagcuucggaacccuguucucuuucuuccucacuuccucguugccauggagacacacgucauuuacgugccgugcgucgccuuggaaacgggggagcauccgcggcgccgccgggagacccgccccugccucuccagccgcacucgcgggcacugcugguggauggcuggggggagucccgagacugacgcgcugcggguccccgucucgaccccgagcccucugcgagcgccucugugaccugugagcacucuuugucggugauugccgggagggcggcggggacauagguaccacacuggaggcgagcgggcaagccacuuuugcccccuggguaagcccgaagauccuggucccgggacccuagacaggucuucgauccauagacucuucucagcccuccuugaucccgcccguguccucugccuggggccgcucucuucacguaggcuccccgccccucuagggagccuaggugucccugggcuccaccccgucccucccgggaccucucccccuccacacccuucccccacccuggaggcccgcuggacacgacccagagcugccaccgcccgcuucugccacucaauggaggacagucugcuggagaucaugaccaaggacggcggcgacaugccagcgccucuggagguguccacggugcccgccgugggggacgugaucucuggggaguauaacggcgguaugaaggaacugauggagcaccugaaggcccagcugcaggcccuguuugaggacgugagggccaugcgaggggcacuggacgagcaggccucgcacauccagguucugucggacgacgugugcgccaaccagcgggcuauagucuccaugugccagauuaugaccacugcgccccgccagggaggcuugggcguggccggcggcaaggggagcuucccaaguguuccccaugaaccagagacaccuucgccugggaucgaggacagcggcuugcugggucgugauccugaugaagacgaggacgaagaggagaaagagacaccuaaccccgccacacccaccagucacugcgagcucucugagagccccggucuccuuggggaggaugggccacuuguggagccccccgaccuuccugacauuacccugcugcagcuggagggcgaggccucucugugagggagaccccaccagggaaccaacuacccgcgcuggcuuuggguuuccaagugcuuaacccgaggggacugaacagugcggugcaguguucuucacuucaaacgugguccuuauaggucagggagagagacucccucacagaaggauuuguagagucaaggacuuuggaagcaucgcgaauuccacccaagcaggcaucauagcaaacugcagaaaggugagguucccagaaaggacgugcccaucucuggacucucaucuaucccuuuaccuugcccccuuccccucuuccuaggaaacaggaggaccauugaauuauguaaauaaaauucugcuuuuucuauucugaaaaaggagucaucuaggacuuuggcaaauaaucucuauuuaccuagaaauuaaggaguugggguauucuguucuggcaacaggaaauuuacccuuuuccccaaacccaagauauucagugcucugcggaaaccucucccccuuacagaucgcucugcaacugcugauggguaaaggaagcuugaggagggaacugcggcccuaggagucaggguacucggguucccagggccccuaggcugggaggagcuggcucugaugugcaugaagacacaagagcucaagcucuggcacugagcaugcagagccgagccugccccgucgcugacuucaccugggauugcuuggccacucaccugggccuagagaacaaagugcucaggucgcaggcagagacuuaggacugcucagcaacuguc

SEQ ID NO: 10770 - RNA, 2501 nt, Mus musculus
gacaguugcugagcaguccuaagucucugccugcgaccugagcacuuuguucucuaggcccaggugaguggccaagcaaucccaggugaagucagcgacggggcaggcucggcucugcaugcucagugccagagcuugagcucuugugucuucaugcacaucagagccagcuccucccagccuaggggcccugggaacccgaguacccugacuccuagggccgcaguucccuccucaagcuuccuuuacccaucagcaguugcagagcgaucuguaagggggagagguuuccgcagagcacugaauaucuuggguuuggggaaaaggguaaauuuccuguugccagaacagaauaccccaacuccuuaauuucuagguaaauagagauuauuugccaaaguccuagaugacuccuuuuucagaauagaaaaagcagaauuuuauuuacauaauucaaugguccuccuguuuccuaggaagaggggaagggggcaagguaaagggauagaugagaguccagagaugggcacguccuuucugggaaccucaccuuucugcaguuugcuaugaugccugcuuggguggaauucgcgaugcuuccaaaguccuugacucuacaaauccuucugugagggagucucucucccugaccuauaaggaccacguuugaagugaagaacacugcaccgcacuguucaguccccucggguuaagcacuuggaaacccaaagccagcgcggguaguugguucccugguggggucucccucacagagaggccucgcccuccagcugcagcaggguaaugucaggaaggucggggggcuccacaaguggcccauccuccccaaggagaccggggcucucagagagcucgcagugacugguggguguggcgggguuaggugucucuuucuccucuucguccucgucuucaucaggaucacgacccagcaagccgcuguccucgaucccaggcgaaggugucucugguucauggggaacacuugggaagcuccccuugccgccggccacgcccaagccucccuggcggggcgcaguggucauaaucuggcacauggagacuauagcccgcugguuggcgcacacgucguccgacagaaccuggaugugcgaggccugcucguccagugccccucgcauggcccucacguccucaaacagggccugcagcugggccuucaggugcuccaucaguuccuucauaccgccguuauacuccccagagaucacgucccccacggcgggcaccguggacaccuccagaggcgcuggcaugucgccgccguccuuggucaugaucuccagcagacuguccuccauugaguggcagaagcgggcgguggcagcucugggucguguccagcgggccuccagggugggggaaggguguggagggggagaggucccgggagggacgggguggagcccagggacaccuaggcucccuagaggggcggggagccuacgugaagagagcggccccaggcagaggacacgggcgggaucaaggagggcugagaagagucuauggaucgaagaccugucuagggucccgggaccaggaucuucgggcuuacccagggggcaaaaguggcuugcccgcucgccuccagugugguaccuauguccccgccgcccucccggcaaucaccgacaaagagugcucacaggucacagaggcgcucgcagagggcucggggucgagacggggacccgcagcgcgucagucucgggacuccccccagccauccaccagcagugcccgcgagugcggcuggagaggcaggggcgggucucccggcggcgccgcggaugcucccccguuuccaaggcgacgcacggcacguaaaugacgugugucuccauggcaacgaggaagugaggaagaaagagaacaggguuccgaagcugcagugaagcucuguuguaugggcugacgggcggggcagggaugcugcaguagccucagagaagcugcaaagagcauguggcugcaauguuuaauaggacagcaugagaaagcaguuugcugcacgacccccacccccaagccggagagagaccgucugccuggggggggggggggggcuuuucacccgcucuccgcauuccuuccuuggaggaccaugggagagccagguccauccuccagcggcccacaggacuggguagcgauuguuaauaaucccaggcgagcuggcagcaccaggcuuggaggugcagaggaaggcggagggaggcgcgaccgaucugcuucucccuucugcagcaaaaaaaaaaaaaaaaaaaaaaaaaaaaaaaaaaaaaaaacaaaaaacaauuuucccucccuccagaaagcucagggugagauacagucucuuaugggacccagcuguuucuacccagguuggggggguaugaaaauuaugaagcuaaguacuuaaauuccgagaaugaaaacuccauaacaacagauuccccuccccugcacccucc

SEQ ID NO: 10771 - RNA, 2501 nt, Mus musculus
ucuaucguuuucuguuuucccauuccuuauccccggucuucccagaccuuacaguuggagaagcagcacaggauccuucacagaagcuggguggcacaucuaccacacaugcaggagaaccuuggugcucuccagcuuccccagaaacucgggcugagcacguagaaaauauccuuuuuggcaaagcauggauuuuucuuuucuuucucacauggcuggcacuuacucuuuaaggaugucugagacagacgguuaaaaagaggggcugggguagagaaagugggaagggcucagaagcaaagcugagcucuaaagggcuugggagcggagaguagggaaagcauugcuuucuacauuuccaaaagauagacagggcaucuccaacucaccccagcccagggagaaaugauaagaacuagacccccaugugcucaacuggacacuaacccaguguggacaugcccuacauuuacugccccccccccaaaaaaaagcaucgaugaugcaucgcuucaucaucgucucuaagccgcagccucugaguugcggcaagcagacagcuucggcuugagaugcaggagagugauauucccuccaaagccggcggggcgggaggguggcucucugccccgccacagcugccuccagcagcacccuccuaccucauuuaacuuugcucuggagaacuagagagagagggagagaggagggagaggaagggagaggagagagacagagacagaggagacgucugguacucccggggaguucucagggcucccuucaccucaccauccagaggugaacuagaccagagacccaaguggcacccaggcuuguucacugccuuccaggauccucuaaaaucaucaaagccccaaccaaagaauuuuuuacauucuuuccuucgcuuuccuggcaagcaccuaucuucaaagguggauucccagcccccccccccuuaaaaaagcagcaacugcggcuagccaauggugguaggauggggcauuuggggguacacucuuaccugaggugucccagagacuaagcuccacucucuguuccucugucuccaaacaggcuguguaauucucaaacacgguaggcacauaggucugcgaggagacaggaaacacucacaccccggcagcagcaugcccucagaaccccacaccaagcguuggcuacacaugcgccgagaaacaccaaagugucagauggcgagaagccagaggagggggagccauuggggacuguagagguauuggccuucgcuccccagccugggacaaacccccuacauccuagcuagucugagacacauacauucgcauuuuccucacaucucuaaaugugugucccauuuuucagagccacaagccaguuuuaaccucugucuucugcccucuaguccuuuggcacaggugaacaggcaaaacagcagaagccugcgcggggggggggggggggguuggggagggcacccucacagagccuuauaggaggggcaggcagguacugcgucaagaaugaagcccaagcucucgggagccuccaggucucagggaugaaggcaagugggaggggauaugauggguaaagaggugaggaggagccgaccgggcggcagaagugggucaggucucuagggaagcaagacagggcaguccuccagccagaaggcaaggcaggguggggcggccugcgggugguggagagcgcugucccggacaggugggggaucgaccccgggacggcagggaagcucaccucgggauagcagucuuucgcuagcaccuguaacaucgccgucuucccacacugcacgucucccaccaggacgagcuuacaccugaccaccacuggcugcggugcccgucucuccuucauggcugcagccucggagggacguggacucggguucagggaggaggaggucgcgccucaaguguccgcacuagcacacuagcgcggguucccugccugccugccuccgacugaggcggaggcucguaaggcuccgcuauaagucucagacugauccaaucacaagaggaggcggacucuguccaggccaaucccuaaggugggauccccugcugcagccaauaguaggagacuccgagucagcgcccucuuccucccuucccuuucuguuaaagcugcacgguggcuuccucuuggaaggggauucccacgcuuuuuguguugcuguuaggaggucaggaggggacuggaaguaaaacuuagugaucucugagugucuaugaguuagugucaagacccacaaagagcuauagaaucaggcugucugucccaggaagacagcaggaccugccuaaacuauggacagguggguggcaucucucgggggagagggugacuccuuaauuuuauauaguuccuauucacacugguuccacuucugggaucuccuaauagaagucucugcugccccucuuuuacagcccgacucccuuccucaggaaucgccuucccca

SEQ ID NO: 10772 - RNA, 2501 nt, Mus musculus
uggggaaggcgauuccugaggaagggagucgggcuguaaaagaggggcagcagagacuucuauuaggagaucccagaaguggaaccagugugaauaggaacuauauaaaauuaaggagucacccucucccccgagagaugccacccaccuguccauaguuuaggcagguccugcugucuuccugggacagacagccugauucuauagcucuuugugggucuugacacuaacucauagacacucagagaucacuaaguuuuacuuccaguccccuccugaccuccuaacagcaacacaaaaagcgugggaauccccuuccaagaggaagccaccgugcagcuuuaacagaaagggaagggaggaagagggcgcugacucggagucuccuacuauuggcugcagcaggggaucccaccuuagggauuggccuggacagaguccgccuccucuugugauuggaucagucugagacuuauagcggagccuuacgagccuccgccucagucggaggcaggcaggcagggaacccgcgcuagugugcuagugcggacacuugaggcgcgaccuccuccucccugaacccgaguccacgucccuccgaggcugcagccaugaaggagagacgggcaccgcagccagugguggucagguguaagcucguccuggugggagacgugcagugugggaagacggcgauguuacaggugcuagcgaaagacugcuaucccgaggugagcuucccugccgucccggggucgaucccccaccuguccgggacagcgcucuccaccacccgcaggccgccccacccugccuugccuucuggcuggaggacugcccugucuugcuucccuagagaccugacccacuucugccgcccggucggcuccuccucaccucuuuacccaucauauccccucccacuugccuucaucccugagaccuggaggcucccgagagcuugggcuucauucuugacgcaguaccugccugccccuccuauaaggcucugugagggugcccuccccaacccccccccccccccccgcgcaggcuucugcuguuuugccuguucaccugugccaaaggacuagagggcagaagacagagguuaaaacuggcuuguggcucugaaaaaugggacacacauuuagagaugugaggaaaaugcgaauguaugugucucagacuagcuaggauguaggggguuugucccaggcuggggagcgaaggccaauaccucuacaguccccaauggcucccccuccucuggcuucucgccaucugacacuuugguguuucucggcgcauguguagccaacgcuuggugugggguucugagggcaugcugcugccggggugugaguguuuccugucuccucgcagaccuaugugccuaccguguuugagaauuacacagccuguuuggagacagaggaacagagaguggagcuuagucucugggacaccucagguaagaguguacccccaaaugccccauccuaccaccauuggcuagccgcaguugcugcuuuuuuaagggggggggggcugggaauccaccuuugaagauaggugcuugccaggaaagcgaaggaaagaauguaaaaaauucuuugguuggggcuuugaugauuuuagaggauccuggaaggcagugaacaagccugggugccacuugggucucuggucuaguucaccucuggauggugaggugaagggagcccugagaacuccccgggaguaccagacgucuccucugucucugucucucuccucucccuuccucucccuccucucucccucucucucuaguucuccagagcaaaguuaaaugagguaggagggugcugcuggaggcagcuguggcggggcagagagccacccucccgccccgccggcuuuggagggaauaucacucuccugcaucucaagccgaagcugucugcuugccgcaacucagaggcugcggcuuagagacgaugaugaagcgaugcaucaucgaugcuuuuuuuuggggggggggcaguaaauguagggcauguccacacuggguuaguguccaguugagcacaugggggucuaguucuuaucauuucucccugggcuggggugaguuggagaugcccugucuaucuuuuggaaauguagaaagcaaugcuuucccuacucuccgcucccaagcccuuuagagcucagcuuugcuucugagcccuucccacuuucucuaccccagccccucuuuuuaaccgucugucucagacauccuuaaagaguaagugccagccaugugagaaagaaaagaaaaauccaugcuuugccaaaaaggauauuuucuacgugcucagcccgaguuucuggggaagcuggagagcaccaagguucuccugcaugugugguagaugugccacccagcuucugugaaggauccugugcugcuucuccaacuguaaggucugggaagaccggggauaaggaaugggaaaacagaaaacgauaga

SEQ ID NO: 10773 - RNA, 2501 nt, Mus musculus
cacugccaccagcucgguuugcucagccuaccccuacaccccacgcccgggaaucccugaccacagcuccacccaugcucugucuccuucuuuuccuucucuguccagccgucgggguuccugggugaggaagugucuccacggagucgcuggcuagaaccacaacuuucauccugccauucagaauagggaagagaagagaccacagcguaggggggacagaggagacggacuucgagaggacagccccaccggcgcgugugggggaggcaauccaggcugcaaacagguuguccccagcgcauugucuccgcgcccccuggcggaugcugguccccgacgggcuccggacgcgcagaagagugaggccggcgcgcgugggaggccaucccaaggggaggggucggcggccagugcagaccuggaggcgggggccaccaggcagggggcgggggugagccccgacgguuagccugucagcucuuugcucagaccggcaagagccacagcuucgcucgccacucauugucuguggcccugaccagugcgcccuggugcuuuuagugccgcccgggcccggaggggcagccucuucucacugcagucagcgccgcaacuauaagaggccuauaagaggcggugccucccgcaguggcugcuucagcccagcagccaggacagcgaaccaugcugccugcggcccgccuccagacuuauuagagccagccugggaacucgcaucacugcccucaccgcuguguccagucccaccgucgcggacagcaaccacagucgucagaaccgcagcacagaaccagcaaggccaggcaggccauggggcucugggcgcugcugcccagcuggguuucuacuacguugcuacuggcacugaccgcucugcccgcagcccuggcugccaacaguaguggccgauggugguaagugagcuaguacgggguccgccacuuguccuggggcaaagagccaggcacgggccuuacccagcucccacgcuguggggaucaccaaccuacagaccccccucgugcauugugacuucacauccagggugcucacaccuagaacuagcucugcugaagugggggcacaucauuggcaugcagaagcccagauacaccaggcucagagaccauucccauuuaauacgaccccguuucugcugagcaacaggucccaaccucgcuguggugggugcucaggugucccuuaggucuugaaccaaaaaaaaaaaaaaaaaaaaaaaaaaaaccagauauuagcuuugaggugagggaguggaauuccuaaguuuuucaaggugggcaaggcugcaggugggguuucuccucgggggcugacuugaagaaaggaagagcuaagguagccaugccuuuucuguccacucacuagacucuggagcucagggccaggcaaggauagggugguacagccuguaugguuaggaugcagguccccuccccuggacugaacccuuaugcaucccgccaggggcaucgugaacauagccuccuccacgaaccuguugacggauuccaagagucugcagcuggugcucgagcccagucugcagcugcugagccgcaagcagcggcgacugauccgacagaacccggggauccugcacagcgugaguggagggcuccagagcgcugugcgagagugcaaauggcaauuccgaaaccgccgcuggaacugccccacugcuccggggccccaccucuucggcaagaucgucaaccgaggugggugcccaggaaagcgacgcuuccgggauuaagggaaaagcagggucaucuccagggcauaggcgggcgaaggcagggaagacaucccaggguuauaugugaucaaacugagaaucgccuggugccggcaguuaccguaggucagcaccagauucuuucuagccuugcguugugagcaugaucuuuaacguugcugagccacuggcccacagaaagggaauuccggaucgugggcgcugggcgacagcuguuuuucccuagccuuccucaaagguaccugggaagcugaucucugagggcuagcuaggguugugcuucgcacccagcaaaguuugcacugccaauacuaguagcgaucuuggcuaugcagauuuguucuacuugggaaucuccccuuggagcugcucugcuaaggcucuggagucucaguaaagcuuagagaggagggcauuccaugcuucgcacacaugacuccaaggauguuggacuguaggguaccaagucuuccaaacagggugcugaguuggccccacgccuucucucaacugaugcggggucgcuucacccacaggcugccgagaaacagcguucaucuucgcaaucaccuccgccggggucacacauuccguggcgcgcuccugcuccgaaggcuccaucgaguccugcaccugcgacuaccggcggcgcggcccugggggccccgacuggcacugggggggcugcagugacaacauc

SEQ ID NO: 10774 - RNA, 2501 nt, Mus musculus
gauguugucacugcagcccccccagugccagucggggcccccagggccgcgccgccgguagucgcaggugcaggacucgauggagccuucggagcaggagcgcgccacggaaugugugaccccggcggaggugauugcgaagaugaacgcuguuucucggcagccugugggugaagcgaccccgcaucaguugagagaaggcguggggccaacucagcacccuguuuggaagacuugguacccuacaguccaacauccuuggagucaugugugcgaagcauggaaugcccuccucucuaagcuuuacugagacuccagagccuuagcagagcagcuccaaggggagauucccaaguagaacaaaucugcauagccaagaucgcuacuaguauuggcagugcaaacuuugcugggugcgaagcacaacccuagcuagcccucagagaucagcuucccagguaccuuugaggaaggcuagggaaaaacagcugucgcccagcgcccacgauccggaauucccuuucugugggccaguggcucagcaacguuaaagaucaugcucacaacgcaaggcuagaaagaaucuggugcugaccuacgguaacugccggcaccaggcgauucucaguuugaucacauauaacccugggaugucuucccugccuucgcccgccuaugcccuggagaugacccugcuuuucccuuaaucccggaagcgucgcuuuccugggcacccaccucgguugacgaucuugccgaagagguggggccccggagcaguggggcaguuccagcggcgguuucggaauugccauuugcacucucgcacagcgcucuggagcccuccacucacgcugugcaggauccccggguucugucggaucagucgccgcugcuugcggcucagcagcugcagacugggcucgagcaccagcugcagacucuuggaauccgucaacagguucguggaggaggcuauguucacgaugccccuggcgggaugcauaaggguucaguccaggggaggggaccugcauccuaaccauacaggcuguaccacccuauccuugccuggcccugagcuccagagucuagugaguggacagaaaaggcauggcuaccuuagcucuuccuuucuucaagucagcccccgaggagaaaccccaccugcagccuugcccaccuugaaaaacuuaggaauuccacucccucaccucaaagcuaauaucugguuuuuuuuuuuuuuuuuuuuuuuuuuuugguucaagaccuaagggacaccugagcacccaccacagcgagguugggaccuguugcucagcagaaacggggucguauuaaaugggaauggucucugagccugguguaucugggcuucugcaugccaaugaugugcccccacuucagcagagcuaguucuaggugugagcacccuggaugugaagucacaaugcacgaggggggucuguagguuggugauccccacagcgugggagcuggguaaggcccgugccuggcucuuugccccaggacaaguggcggaccccguacuagcucacuuaccaccaucggccacuacuguuggcagccagggcugcgggcagagcggucagugccaguagcaacguaguagaaacccagcugggcagcagcgcccagagccccauggccugccuggccuugcugguucugugcugcgguucugacgacugugguugcuguccgcgacggugggacuggacacagcggugagggcagugaugcgaguucccaggcuggcucuaauaagucuggaggcgggccgcaggcagcaugguucgcuguccuggcugcugggcugaagcagccacugcgggaggcaccgccucuuauaggccucuuauaguugcggcgcugacugcagugagaagaggcugccccuccgggcccgggcggcacuaaaagcaccagggcgcacuggucagggccacagacaaugaguggcgagcgaagcuguggcucuugccggucugagcaaagagcugacaggcuaaccgucggggcucacccccgcccccugccugguggcccccgccuccaggucugcacuggccgccgaccccuccccuugggauggccucccacgcgcgccggccucacucuucugcgcguccggagcccgucggggaccagcauccgccagggggcgcggagacaaugcgcuggggacaaccuguuugcagccuggauugccucccccacacgcgccgguggggcuguccucucgaaguccgucuccucuguccccccuacgcuguggucucuucucuucccuauucugaauggcaggaugaaaguugugguucuagccagcgacuccguggagacacuuccucacccaggaaccccgacggcuggacagagaaggaaaagaaggagacagagcauggguggagcuguggucagggauucccgggcgugggguguagggguaggcugagcaaaccgagcugguggcagug

SEQ ID NO: 10775 - RNA, 2501 nt, Mus musculus
aaugucccagggccaaggugaggaagggaagggccuucccaguuuacuggaaagaggauggcuucaucacugggacaagaggggauucuuggcucggaguaauugguucucaccuuccaucccagcaaucaggagguagaggcaggaggauuucuaugagugcuaccuagcaaauuuuagaucugucagggcuauguagugucucaauagauaaguaaggaaagaagagagagagagagagagagagagagagagagagagagagagagagagagagagaaaaggaagggagaggaaagaaauucuuucuccccuguacagguuuuccuaaccacauaaccuggaaaacuaugcaguuagucagaggaaauccguacaccacacacacacacacacacacacacacuacccugccugccccuugcacacacaauuaggugguguaauggaaaguagauaggacugagaaccaggaguccugaaccugcucucagcaaugcuacaauuuggcugugaggcuuugauuaaguugcuuuuccucuccugcagcccagcucucagauauaaaaugagggguggggugggauggagaaacacgucuucugaguuuccugucagacacucuacagcacuggccauaggggcucugggcccuucccuuccaagccauggcccacugagucggcuugguucagugccccucuguagcauguaccccagaaugcuagcugauauucaaagcagaguccucaagcuaaggugaguuuagauggcccagaaacccuugauucucaggugugucugucuguucugaggacuguuuuuuggucacccccaccccaaagucuguuguuuagacccuaguauaggcuaccuuucccgugccaaggacaauggccaccccauccccagguagauggucuggucugguaaccugacucuugcccaucucuuuuccagcccccuucuuuuggcucacagagcuuuuggacaucaggccaagagccaggcuaaguguaaagccuuaugcagucuaccuaucauagccagcuccuggcccccagcucaccccagcccuuccugccuggcucggugacugacccccgguccacgccucagccauuucccgucucgccugccgccauccuccuuuccccgcccucgcuccagccucucccagauucacucucacugggcaguuccuccucccccuccccaucgcagacucucuccccauuuggauaccuccgaaccacuauccagccaccagguuauuugcuuuccugaagggugugaugaaggagaucucacuuuauuuuauuuuaguuuagggucucuggggaugaaggaacaguucauccuccaggguuguuguaggaaaauugaggagcugguggugugguagagcagguggggagaaacucuccuuaccucugucaucaggcggucugcgccgcuguucuccucauccuugaagauuaugucgggguuguaguuggguacgaggucccggaagcgcuccgacccccuuguuacccuccccuccgcuggcccacucgcgcccaggguccgcucgggcauacugggcacaaacugcuuguauagcagaggcacaaguugcuugcgcacauaacgccgccggccaaccgguccucggcccggcccgcagcucugggcagauagugccaagagugccaagcagcacaggggcaacagacuggccggcagagccaugggugccguggacuugggucggaagggagcguucuuguccucacuggcucuccugucaauugggcaucuccgcaggagcuaaagagcaccgcagauagagaaggucccagaguaccuggagcgcuguggcucugaacacuuggcagccgcuaacucugccuacaugcccuggggaaccuggaaccuacuacugauagacuaccauuuacagagcaggugggucgagggugagugccagcccagccagucucugcugcccggcucccgugcucccagaaacgcccugacuccgccuuaaguggucccgggccccgccccccgcccuucucucagggcugucccgcccccucccacccgggcgggggaucuagcagucacaacuggacaccacuguuccauuacuccacugaagugugucccauccuggaaaccaugcaggcaccugcuuaggaaaucccugaagcuuuagaguccuggcugccuggauaagcauccuucuaccuccgagucuaaauuaggcaccaaacuaucuuccugggcacuagucuuugcuuuccuaaagucuacccuggcacgccaugcccucugcuguccuccgggaagucugaguuccaaggccauccaagcccuuugggcaagccaucaaagccucccaucuccgugcuccuccucaagucuccccgauuucucucaacacucauccauaaccaagcagagaucccagaggaucauuuuccuuggugguuuuauaucuucuugggaacaga

SEQ ID NO: 10776 - RNA, 2501 nt, Mus musculus
ucuguucccaagaagauauaaaaccaccaaggaaaaugauccucugggaucucugcuugguuauggaugaguguugagagaaaucggggagacuugaggaggagcacggagaugggaggcuuugauggcuugcccaaagggcuuggauggccuuggaacucagacuucccggaggacagcagagggcauggcgugccaggguagacuuuaggaaagcaaagacuagugcccaggaagauaguuuggugccuaauuuagacucggagguagaaggaugcuuauccaggcagccaggacucuaaagcuucagggauuuccuaagcaggugccugcaugguuuccaggaugggacacacuucaguggaguaauggaacagugguguccaguugugacugcuagaucccccgcccgggugggagggggcgggacagcccugagagaagggcggggggcggggcccgggaccacuuaaggcggagucagggcguuucugggagcacgggagccgggcagcagagacuggcugggcuggcacucacccucgacccaccugcucuguaaaugguagucuaucaguaguagguuccagguuccccagggcauguaggcagaguuagcggcugccaaguguucagagccacagcgcuccagguacucugggaccuucucuaucugcggugcucuuuagcuccugcggagaugcccaauugacaggagagccagugaggacaagaacgcucccuuccgacccaaguccacggcacccauggcucugccggccagucuguugccccugugcugcuuggcacucuuggcacuaucugcccagagcugcgggccgggccgaggaccgguuggccggcggcguuaugugcgcaagcaacuugugccucugcuauacaagcaguuugugcccaguaugcccgagcggacccugggcgcgagugggccagcggaggggaggguaacaagggggucggagcgcuuccgggaccucguacccaacuacaaccccgacauaaucuucaaggaugaggagaacagcggcgcagaccgccugaugacagagguaaggagaguuucuccccaccugcucuaccacaccaccagcuccucaauuuuccuacaacaacccuggaggaugaacuguuccuucauccccagagacccuaaacuaaaauaaaauaaagugagaucuccuucaucacacccuucaggaaagcaaauaaccugguggcuggauagugguucggagguauccaaauggggagagagucugcgauggggagggggaggaggaacugcccagugagagugaaucugggagaggcuggagcgagggcggggaaaggaggauggcggcaggcgagacgggaaauggcugaggcguggaccgggggucagucaccgagccaggcaggaagggcuggggugagcugggggccaggagcuggcuaugauagguagacugcauaaggcuuuacacuuagccuggcucuuggccugauguccaaaagcucugugagccaaaagaagggggcuggaaaagagaugggcaagagucagguuaccagaccagaccaucuaccuggggaugggguggccauuguccuuggcacgggaaagguagccuauacuagggucuaaacaacagacuuuggggugggggugaccaaaaaacaguccucagaacagacagacacaccugagaaucaaggguuucugggccaucuaaacucaccuuagcuugaggacucugcuuugaauaucagcuagcauucugggguacaugcuacagaggggcacugaaccaagccgacucagugggccauggcuuggaagggaagggcccagagccccuauggccagugcuguagagugucugacaggaaacucagaagacguguuucuccaucccaccccaccccucauuuuauaucugagagcugggcugcaggagaggaaaagcaacuuaaucaaagccucacagccaaauuguagcauugcugagagcagguucaggacuccugguucucaguccuaucuacuuuccauuacaccaccuaauugugugugcaaggggcaggcaggguagugugugugugugugugugugugugugguguacggauuuccucugacuaacugcauaguuuuccagguuaugugguuaggaaaaccuguacaggggagaaagaauuucuuuccucucccuuccuuuucucucucucucucucucucucucucucucucucucucucucucucucucucucuucuuuccuuacuuaucuauugagacacuacauagcccugacagaucuaaaauuugcuagguagcacucauagaaauccuccugccucuaccuccugauugcugggauggaaggugagaaccaauuacuccgagccaagaauccccucuugucccagugaugaagccauccucuuuccaguaaacugggaaggcccuucccuuccucaccuuggcccugggacauu

SEQ ID NO: 10777 - RNA, 2501 nt, Mus musculus
gagcaggcuggcacuguacucccgauccaacgcccccgcuccugccgggcuggaccggggagaggcccacgaucgccgaaccgcccccgccacgggcggauaaggagcuaagaggcgcuguccucagagacucucaucacucugacccguccgugggugagaccgaccgggucaagaugcuccggucgcgcgagcccaaggaggagaaaaggggaaggcugccggccggccccggacgccgguaaaggccggccggagagggacuuccagagcucggugcgagaggagagccgggaccgcgcucagccgccaggagagcccagcacgcacgucgaccaggagggcgcgggagcagcgcugagcgcacgaugcgcgcgacccagaccgccgggccagucuacacugccgcgugggucacguggcccgggcggguccgccgcugugcggccggggggccgggggugcgcggggcggggggcugcgagcgcgcgcccgccaggcucgcucccugcgcgcugcgcuggccucugggcgcgggagccgcccccggcccccccgcgcucugcccgccgcggggcgcgcgcccucuauauagcgcgccccugcccgguccgcgccaggccgccugccacggagugggcaccgcacgucgcgcagagccccgcagacagacgcccgccgcugccagcgccgccccgacggccgccccgcgacgcagccgcugccaccgggcccccaaggccaccaugaagaaggagguguguucaguugccuucuucaaggccguguucgcagaguuccuggccacccucaucuucgucuucuuuggccugggcucggcacucaaguggcccucggcgcugcccaccauucugcagaucuccauagccuuuggccuggccauagguaccuuggcccaagcccugggaccugugagugguggccacaucaauccggccauuacucuggcccucuuaauaggcaaccagaucucucugcuccgagccaucuucuacguggcagcccagcuggugggugccauugcuggagcaggcauccuguacugguuggcgccaggcaaugcccgggguaaccuggccgucaaugcggugaguguccaccagacuguggagggaugggcagggacccuggggacauuucagaccagaccuuccaugcuccuccaucuugagaauggguacaaccaaaacaccagggcauaacuuagccaguaagagcaggcugaccaaccuccuggccaaccucagugcucccggguccuggcuucucuucacauucucccucaucuaccccucccucuccuaugcugcauucccuggccuaacuccccagggccgccaaaacaucccuuccaucucuaaucucaccugugacuucuuucuugugaccccccuuggugguguaguuuuaagggacccaccaaggagccauggauagugauggauggaggucuggagcaaccgugaucucccugggcuuccaguuuacuacccaugacauggaggugaucagagcacagccagugcccuggggauuacacuuagaagccaugaugugaugcacccccagugcuggcucccccuuuuguaaccccugcuccugccccccugcugucucuccaucuuugcagcccuagauucagcccccugucccaugugaacugggcucauuaaucaaacacagaggaggauuuucucggccauugucaagcugugagucagacacacuggagagacggguuugaaguuggcaccggcagcgggucaggcauggauaggaggccaggggcuguuugcaguaggcaaacugggcagcugcccacaggagggaggguaaaugccagcucaugggggcuggggauugggcagagccguugacacgauggcacccaggaaaacuugcugacacccuacccucuggcuacaggccugagcuucaagcuugcgcacacugaagugcaguuucuccaacaaaucgccugucuggaucaugcaggggacuugacuuccaagagcucaggcucuagguguccuugaagaccagaaccuuacuugucuagccugucaccgagccugaaggcugcuagcaggguccuaacccagcucuuccuugcagcucagcaacaacacaacaccaggcaaggccguggugguggaguuaaucuugacuuuccagcuggcccucugcaucuucuccuccacggacucccgccgcaccagcccggugggcuccccagccuuauccauuggcuugucggucacacugggccaucuugugggggugaguagugcuggcacaaaccggggugucauggagaugaacaguggaaccccagaaugccagcuccuccagauagauaagacccgauagaguuuaagaucuggucuuggguaucuaagcuguagccuuacuggacucuagguuugauguugcccauccccccccaagacccuccauggacugagaagcugaguaagugg

SEQ ID NO: 10778 - RNA, 2501 nt, Mus musculus
ccacuuacucagcuucucaguccauggagggucuuggggggggaugggcaacaucaaaccuagaguccaguaaggcuacagcuuagauacccaagaccagaucuuaaacucuaucgggucuuaucuaucuggaggagcuggcauucugggguuccacuguucaucuccaugacaccccgguuugugccagcacuacucacccccacaagauggcccagugugaccgacaagccaauggauaaggcuggggagcccaccgggcuggugcggcgggaguccguggaggagaagaugcagagggccagcuggaaagucaagauuaacuccaccaccacggccuugccugguguuguguuguugcugagcugcaaggaagagcuggguuaggacccugcuagcagccuucaggcucggugacaggcuagacaaguaagguucuggucuucaaggacaccuagagccugagcucuuggaagucaaguccccugcaugauccagacaggcgauuuguuggagaaacugcacuucagugugcgcaagcuugaagcucaggccuguagccagaggguagggugucagcaaguuuuccugggugccaucgugucaacggcucugcccaauccccagcccccaugagcuggcauuuacccucccuccugugggcagcugcccaguuugccuacugcaaacagccccuggccuccuauccaugccugacccgcugccggugccaacuucaaacccgucucuccagugugucugacucacagcuugacaauggccgagaaaauccuccucuguguuugauuaaugagcccaguucacaugggacagggggcugaaucuagggcugcaaagauggagagacagcaggggggcaggagcagggguuacaaaagggggagccagcacugggggugcaucacaucauggcuucuaaguguaauccccagggcacuggcugugcucugaucaccuccaugucauggguaguaaacuggaagcccagggagaucacgguugcuccagaccuccauccaucacuauccauggcuccuuggugggucccuuaaaacuacaccaccaaggggggucacaagaaagaagucacaggugagauuagagauggaagggauguuuuggcggcccuggggaguuaggccagggaaugcagcauaggagagggagggguagaugagggagaaugugaagagaagccaggacccgggagcacugagguuggccaggagguuggucagccugcucuuacuggcuaaguuaugcccugguguuuugguuguacccauucucaagauggaggagcauggaaggucuggucugaaauguccccagggucccugcccaucccuccacagucugguggacacucaccgcauugacggccagguuaccccgggcauugccuggcgccaaccaguacaggaugccugcuccagcaauggcacccaccagcugggcugccacguagaagauggcucggagcagagagaucugguugccuauuaagagggccagaguaauggccggauugauguggccaccacucacaggucccagggcuugggccaagguaccuauggccaggccaaaggcuauggagaucugcagaauggugggcagcgccgagggccacuugagugccgagcccaggccaaagaagacgaagaugaggguggccaggaacucugcgaacacggccuugaagaaggcaacugaacacaccuccuucuucaugguggccuugggggcccgguggcagcggcugcgucgcggggcggccgucggggcggcgcuggcagcggcgggcgucugucugcggggcucugcgcgacgugcggugcccacuccguggcaggcggccuggcgcggaccgggcaggggcgcgcuauauagagggcgcgcgccccgcggcgggcagagcgcgggggggccgggggcggcucccgcgcccagaggccagcgcagcgcgcagggagcgagccuggcgggcgcgcgcucgcagccccccgccccgcgcacccccggccccccggccgcacagcggcggacccgcccgggccacgugacccacgcggcaguguagacuggcccggcggucugggucgcgcgcaucgugcgcucagcgcugcucccgcgcccuccuggucgacgugcgugcugggcucuccuggcggcugagcgcggucccggcucuccucucgcaccgagcucuggaagucccucuccggccggccuuuaccggcguccggggccggccggcagccuuccccuuuucuccuccuugggcucgcgcgaccggagcaucuugacccggucggucucacccacggacgggucagagugaugagagucucugaggacagcgccucuuagcuccuuauccgcccguggcgggggcgguucggcgaucgugggccucuccccgguccagcccggcaggagcgggggcguuggaucgggaguacagugccagccugcuc

SEQ ID NO: 10779 - RNA, 2501 nt, Mus musculus
uuauggggcacagaauacaccccaccauuuaagaagaagagacuaggcaauuagcacacaggcaccccugcagcaggccuuggauguggguuucuccaugaucuugcuggucucuaagcugacauuagggaucugacuuccacuccccaaguccccaagucccaggcuagacuucuuuuggcagccagucccgggagguuccagcucagugcccaguguuccuccuuacuggccuggcccccuccugucaggugagccccgagcuggaacagacacgugagcacucugaaccucccacccccagacacgcacaaugccaucagcuggcuccccaugaaucugagcagcuuguuucuaaggccagcagugugcugggggcaccuuagcuggcuggggaagcugccacagaaagggaggccaggagagcuggggaggggucaagagaccugagggaacagaacgaaucagggagaagaggcagcagaccugaaggcaagcaggugacaagacauggagccagggcuguguagcagggcuuaccuucugguuggcgggcuuuggaccgccaucagcaaggcgcuuuuugcugaguuccuggccacggggcuguacguuuucuuuggugugggcucuguucugcccuggccuguggcgcuucccucugugcuccagaucgccaucaccuucaaucuggccacagccacagccgugcagaucuccuggaagaccagcggggcccacgccaacccugcugugacccuggccuaccucgugggaucccauaucucucugccucgggcuauggccuauaucgcugcgcagcuggcuggggccacagcuggggcugcucuucuuuacgggguaacuccaggagguauucgagagacccuuggggucaacgugguaggugcaaagaggcccagucauguggcagaugauagggcaccugagggagucagauggucacggugggaggccagacaggaggaaacaauguagcuauucugagcugccccggguuccucucccauuuaagcauucaccuaggccagacagaaauggcaacauggugugauaaacagaugggacaccgagacaauacgaaggggagggaaucaggggcagcuaagagcugucagcgaggagccaagcugggcuugagagggagagggagagggagagggagagggagagggagagggagagggagagggagagggagaggagagagagagaaggagagggagagggagagggagagggagagggagagggagagggagagggagagggagagggagagcccuaccuaacuggccuuguacucucucuguguauccugcugguuucucuguuuccgaggccugcuucacuccucucaucaucuuugcuccaucugcuuccaccucuacccgcagccccuccauucuucccucaagcuuuuucaucacuccuuaacuucugaggcaccguugaaccgcgggccucacucaaugggagagugggagacgugucaggcacuugcacggggagcaggcauccggaugcaaugcgagccggcugcacagaccccacagaccuccuuaggguccugcaucagcccucagccggggagaguaggaaggacuagggagucucacuguccugugcucagagcccaaguccacuccagugcaauccucucugcuaagguccacaacagcacaucaacuggccaggcgguggccguggagcugguucugacgcugcagcuggugcucugugucuuugcuuccauggauggccggcagaccuuggcguccccagcugccaugauuggaaccucuguggcacugggccaccucauugggguaagagacaaaggaggacaccaugcaugugcacauacgggaacucucccugaagaacccuaaggcccuaaaggcuacaggaccauaaaaggccaggaaauguucucccuaagccccuccucucuuguggcugaaggaaugcccucuaauauucugagcuaggacaguggggaaacguccuccuccaggcugccucaaacccucauucuuugcccuaccagaucuacuucacuggcuguuccaugaacccagcccgcuccuucggcccugccgucauuguugggaaguucgcaguccauugggugagguccuccacugguagccuugagggugugugguggugggguuaggcagaaggaauagagauagcagguuuugcuauuaggaaauccauauagaguugaauaaaccagcuccugcccucccaggcuauuuaaaccacccaggagugcagcuuucccuacauucaaaaagccaaggugagugucccggcuugcauugacuuucagcuccaauauccugcaguauccagggacucacacaaaaugggccagggcagaaacugcagccuuggcccagguuuccuguuccggccguuuccuucuucgccuucuccagcuggaccaaauuucaaacuugaauaaagaaaag

SEQ ID NO: 10780 - RNA, 2501 nt, Mus musculus
cuuuucuuuauucaaguuugaaauuugguccagcuggagaaggcgaagaaggaaacggccggaacaggaaaccugggccaaggcugcaguuucugcccuggcccauuuugugugagucccuggauacugcaggauauuggagcugaaagucaaugcaagccgggacacucaccuuggcuuuuugaauguagggaaagcugcacuccugggugguuuaaauagccugggagggcaggagcugguuuauucaacucuauauggauuuccuaauagcaaaaccugcuaucucuauuccuucugccuaaccccaccaccacacacccucaaggcuaccaguggaggaccucacccaauggacugcgaacuucccaacaaugacggcagggccgaaggagcgggcuggguucauggaacagccagugaaguagaucugguagggcaaagaaugaggguuugaggcagccuggaggaggacguuuccccacuguccuagcucagaauauuagagggcauuccuucagccacaagagaggaggggcuuagggagaacauuuccuggccuuuuaugguccuguagccuuuagggccuuaggguucuucagggagaguucccguaugugcacaugcaugguguccuccuuugucucuuaccccaaugagguggcccagugccacagagguuccaaucauggcagcuggggacgccaaggucugccggccauccauggaagcaaagacacagagcaccagcugcagcgucagaaccagcuccacggccaccgccuggccaguugaugugcuguuguggaccuuagcagagaggauugcacuggaguggacuugggcucugagcacaggacagugagacucccuaguccuuccuacucuccccggcugagggcugaugcaggacccuaaggaggucuguggggucugugcagccggcucgcauugcauccggaugccugcuccccgugcaagugccugacacgucucccacucucccauugagugaggcccgcgguucaacggugccucagaaguuaaggagugaugaaaaagcuugagggaagaauggaggggcugcggguagagguggaagcagauggagcaaagaugaugagaggagugaagcaggccucggaaacagagaaaccagcaggauacacagagagaguacaaggccaguuagguagggcucucccucucccucucccucucccucucccucucccucucccucucccucucccucucccucuccuucucucucucuccucucccucucccucucccucucccucucccucucccucucccucucccucucccucucccucucaagcccagcuuggcuccucgcugacagcucuuagcugccccugauucccuccccuucguauugucucggugucccaucuguuuaucacaccauguugccauuucugucuggccuaggugaaugcuuaaaugggagaggaacccggggcagcucagaauagcuacauuguuuccuccugucuggccucccaccgugaccaucugacucccucaggugcccuaucaucugccacaugacugggccucuuugcaccuaccacguugaccccaagggucucucgaauaccuccuggaguuaccccguaaagaagagcagccccagcuguggccccagccagcugcgcagcgauauaggccauagcccgaggcagagagauaugggaucccacgagguaggccagggucacagcaggguuggcgugggccccgcuggucuuccaggagaucugcacggcuguggcuguggccagauugaaggugauggcgaucuggagcacagagggaagcgccacaggccagggcagaacagagcccacaccaaagaaaacguacagccccguggccaggaacucagcaaaaagcgccuugcugauggcgguccaaagcccgccaaccagaagguaagcccugcuacacagcccuggcuccaugucuugucaccugcuugccuucaggucugcugccucuucucccugauucguucuguucccucaggucucuugaccccuccccagcucuccuggccucccuuucuguggcagcuuccccagccagcuaaggugcccccagcacacugcuggccuuagaaacaagcugcucagauucauggggagccagcugauggcauugugcgugucugggggugggagguucagagugcucacgugucuguuccagcucggggcucaccugacaggagggggccaggccaguaaggaggaacacugggcacugagcuggaaccucccgggacuggcugccaaaagaagucuagccugggacuuggggacuuggggaguggaagucagaucccuaaugucagcuuagagaccagcaagaucauggagaaacccacauccaaggccugcugcaggggugccugugugcuaauugccuagucucuucuucuuaaauggugggguguauucugugccccauaa

SEQ ID NO: 10781 - RNA, 2501 nt, Mus musculus
augugccaucagaggaagcagcagcagcaagaagcaggagcuucgauccgaaggagacaacguggggagggggacgcugggggcagacacccuccuuccugcgcgcacacgugcgcgugcacacacacacaccccauagucacacacgcacacacacgcgcacacacacacaagccacagggccucgcaagcagagagcggagccggcuccgggauccgaacgaggcagcucugcugagagcggcgggaggaggcgagccagcggggggagcccucgguuccgcucccgggccgggggccccccgcgcacaccggcccagagacacccucgcagacacucguaggcgcgcacgcgcacccuuuccccuccuccuccccucccgccgccucccggccggacgauggaucccugcagaucccggggcugagagcaccgcgcagcgccagcgcgccgagccccgggcggaccaagccgagcgagcaagcgcgcgcgggcggcggaccgagcugagccgagcuggccgagcgggccgcucccugcagggcucuacgcgggugccgcggcagccggcggcucgggcuccgggccaugagccccuccgccgcgcggcgcugagcccacggaccgccucgcgccccaggaccugcagcggcggccggcuuuccccagcccccucagguggguuuccgaccccgcugccuugggccccgggcuuccuggugccccaaagccgagacucuccuccacuguagcuuucuccagcuucuggggaggcucggcggauggggagggggcggggggccgagccgggaauaugacugcgacgagaagcuggacuggagggggugcguucggggcggggauaacuggcugucauagggaaccgcgccccccccccccauuccuacauccaccucaggcagccuaccauccucucccaaacacacacacacacacacacacacacacacacacacacauacacacacagccugcgccuaugccugugcuuguuugagaacuggagacacagaaggugaggauacaggcagggccccuccccagaugugcccaccuccggagagguggcccugguuuagcuccugaggugacagccuguuccuggggauacccuugaucaagagaagagccccugaccccugguucagcccauuauggggaguuugaucuuggcugggguagauauuccugucccagagugaccucacaucuggagggaacucccaugccugccugugggugcaucagggacuucccuccuucacucuaguggcuguaucuggggucccccauagucugggaagcuugcagaccauucucucgacccgagcugaccccccccuccaagccucuauguuuuaaugacugucaucuuggauggucccucguucaagccaccuuuggagccugcaugucagggaagucuucccuuggacaagcagugaccuccgguuaaggauuuugaauggacauaauuggaggggcccuauaugcgccuucaucucaggacaaugacagagucuugucuccucuuuccucccucuaggauccccuuggcaagcauggaacugaagaccgaggaggaggaggugggugguguccagccggugagcauccaggcuuuugccagcagcuccacgcugcacggucuugcccacaucuucuccuaugagcggcugucucugaagcgggcacugugggcccuguguuuccuggguucgcuggccguccugcugugugugugcacugagcgugugcaguacuacuucugcuaccaccacgucaccaagcucgacgagguggcugccucccagcucaccuucccugccgucacucucugcaaccucaaugaguuucgcuuuagccaagucuccaagaaugaccuguaccaugcuggggaacugcuggcccugcucaacaacaggugggcagcucccauccaccccuccgcaugacuuguggaguaacaccguccuuagcccaccaaaagucaaacagcucugcccucuagcauuccuuuaaaccugccgcucaaggcggaggggcugagaucaugccaguaccaguuaccuacacacaaucucugauuccagcuuaggucaaaacagcucuguccccacccagccugagcuaggagauguuagcucuuuccccagagagcaucaccuaccuccugguacuauccuccuugccucacuuagggaaugggacggaccaccuuuuuuuuuuuuuuuuuuuuuuuuccuuuuuuuuuuugagacaggguuucucuguauagcccuggcuguccuggaacucacuuuguagaccaggcuugccucaaacucagaaaucugcugccucugccucccgaaugcugggauuaaaggcgugcgccacuaccccuggcuaggacggaccaccuuuuaagggucaagacuguaccauccaaggcuccugcccuacagagccuuugucuucuuguauuccaugugucagg

SEQ ID NO: 10782 - RNA, 2501 nt, Mus musculus
ccugacacauggaauacaagaagacaaaggcucuguagggcaggagccuuggaugguacagucuugacccuuaaaaggugguccguccuagccagggguaguggcgcacgccuuuaaucccagcauucgggaggcagaggcagcagauuucugaguuugaggcaagccuggucuacaaagugaguuccaggacagccagggcuauacagagaaacccugucucaaaaaaaaaaaggaaaaaaaaaaaaaaaaaaaaaaaaggugguccgucccauucccuaagugaggcaaggaggauaguaccaggagguaggugaugcucucuggggaaagagcuaacaucuccuagcucaggcuggguggggacagagcuguuuugaccuaagcuggaaucagagauuguguguagguaacugguacuggcaugaucucagccccuccgccuugagcggcagguuuaaaggaaugcuagagggcagagcuguuugacuuuuggugggcuaaggacgguguuacuccacaagucaugcggagggguggaugggagcugcccaccuguuguugagcagggccagcaguuccccagcaugguacaggucauucuuggagacuuggcuaaagcgaaacucauugagguugcagagagugacggcagggaaggugagcugggaggcagccaccucgucgagcuuggugacguggugguagcagaaguaguacugcacacgcucagugcacacacacagcaggacggccagcgaacccaggaaacacagggcccacagugcccgcuucagagacagccgcucauaggagaagaugugggcaagaccgugcagcguggagcugcuggcaaaagccuggaugcucaccggcuggacaccacccaccuccuccuccucggucuucaguuccaugcuugccaaggggauccuagagggaggaaagaggagacaagacucugucauuguccugagaugaaggcgcauauagggccccuccaauuauguccauucaaaauccuuaaccggaggucacugcuuguccaagggaagacuucccugacaugcaggcuccaaagguggcuugaacgagggaccauccaagaugacagucauuaaaacauagaggcuuggaggggggggucagcucgggucgagagaauggucugcaagcuucccagacuaugggggaccccagauacagccacuagagugaaggagggaagucccugaugcacccacaggcaggcaugggaguucccuccagaugugaggucacucugggacaggaauaucuaccccagccaagaucaaacuccccauaaugggcugaaccaggggucaggggcucuucucuugaucaaggguauccccaggaacaggcugucaccucaggagcuaaaccagggccaccucuccggaggugggcacaucuggggaggggcccugccuguauccucaccuucugugucuccaguucucaaacaagcacaggcauaggcgcaggcuguguguguauguguguguguguguguguguguguguguguguguguguuugggagaggaugguaggcugccugagguggauguaggaauggggggggggggcgcgguucccuaugacagccaguuauccccgccccgaacgcacccccuccaguccagcuucucgucgcagucauauucccggcucggccccccgcccccuccccauccgccgagccuccccagaagcuggagaaagcuacaguggaggagagucucggcuuuggggcaccaggaagcccggggcccaaggcagcggggucggaaacccaccugagggggcuggggaaagccggccgccgcugcagguccuggggcgcgaggcgguccgugggcucagcgccgcgcggcggaggggcucauggcccggagcccgagccgccggcugccgcggcacccgcguagagcccugcagggagcggcccgcucggccagcucggcucagcucgguccgccgcccgcgcgcgcuugcucgcucggcuugguccgcccggggcucggcgcgcuggcgcugcgcggugcucucagccccgggaucugcagggauccaucguccggccgggaggcggcgggaggggaggaggaggggaaagggugcgcgugcgcgccuacgagugucugcgagggugucucugggccggugugcgcggggggcccccggcccgggagcggaaccgagggcuccccccgcuggcucgccuccucccgccgcucucagcagagcugccucguucggaucccggagccggcuccgcucucugcuugcgaggcccuguggcuugugugugugugcgcgugugugugcgugugugacuauggggugugugugugugcacgcgcacgugugcgcgcaggaaggagggugucugcccccagcgucccccuccccacguugucuccuucggaucgaagcuccugcuucuugcugcugcugcuuccucugauggcacau

SEQ ID NO: 10783 - RNA, 2501 nt, Mus musculus
ggaaagcauagauuuucacccagucccagccuguacugccgaucaggaagaggaagaguguccugucuuccccaucccgagcccucugcccaacuccccagccgcaggucccagccucacaagguuccaugccccaaauucuaaagcuccccaucugguaguugugccccgcccccaucccgugguuggggucccagcccggcuagacaaaaaggacacggcugaacagaaaagacaagguggccuuucccucuauucuggccaccccugaccugagggagaggaacaacuaacugucaagccuugaggugcacagaccagacugacucagaacggaccuaucuagguuucuuuagcccgaggcugagcguugauggccagcacuguggacaacggaagggaacaaaaguauuaagggugaagggcuggaauuuggaggcaaaaagauuuaagccaacuggagaauccaaagggcggagccaacucuggagcagacacucccagcccaaacucagcuuucuuagcgcuguuccuuaggagugagcacagguaaguuggcugcuaccucacgcgggucccucccugaagcccucacgaaucuagauuucugccucugggugcaggcuacccucuccuggccuagagcgacgcuuccgcagcuagcucagucccuacguuccuacccaggacgcacgggaccccaaugccuggguucgaagccugucccuucguggcagggaggggcugggguggucgcacucggucugcagcccucuagagccgagcccugcugcugggaggcguacugggcaauaggaaacgaguuauuaggagggagugguggagccgggccaggcaggaagaagcuagaauaagaaacauuuugcuccagccccuucccaguccccggaggccgccgcgccagccgcgcagaucgagaccuuucccggccccacaggccggcucuggacgugagaccccggccgccuccggcaaggagaggcgggggucgagucgcccuguccaaaggugagucggagugccgcugggccgggcagggagaccugucccuggucucagggggacccuucuuuauguggaucucaaagaccucucagacggcgcguggcagggucaguuuuagccgggcaagacagucagcaguccccugguuguggacacacaccucccugcuaccccgaccugagcguggaagggggcgggucgagcacggauggggaaucaaaaaacuuuuuuugcuagguauccugaggccuuuagcuucucuucccugccgagauuaacucuucuacccuuaucuauaaagguaaaacgggacugaaagauucuucccuccugagcuccagggugcucuguugacauaggagcgacuucccuugcggaaccuccucauagagaccacuuaaccuggcaccccaauccuuaucucuauagggucacagaauuccccugccguggguguccuugacauuccccuuuagggacuccuggcccucccccaggcugagauccaggcagucagucagcccugcagagaacagcucugcuuucuuaggucuuccuuugaaggacacauuccccugcucacgagcaacuucuggaugaguucggcccccucucugacccuccagggucagucugucuagggggucugucuagggucuuuccucucuggauccucaccacucuagcuggccccccaccugucuucacaauuauccuucuuuguugugggugguuuugcucacacagccuaucagaugggagauaacugugcccagcuuguggaagagaggucagcuucaggcuuuggaugacucugagaagggugucagucaaugacaucaggagacaccaugguugggagguuuuuuguuuguguuuguuuguuuguuuguuuuugauacagagcuggccucagauuuucaguccaccugauucagcuuuagucucuuuccugcccugccucaggaggcuucugagugcugggauacaggucagugccggcacaucuggcugccgagggcuugcuccgugccacuugccacacaguugaguaacucucgugggucucaccugggaaaugguacucuucuuaugccaaucuccaagcugugagacguagcugccacagaccacccuagcuagguaugggggucccugggauguggguucucgaggcuagguagguaaggauuuggcggugacaaacagaaacaaacacagaggccaggaacaauacucaauacugccaggaacaugccuguuccuggacugugaaugucccaugauucuuaccuccucgccaucuuaacucgaugugucucuguggaggagucugcagcacucugacgagguccucuccuuaccugagaaaguauuuuuuuuuuuuuuagaaaaaggauagagaaagcuuaccugccucgagccccacauugaaccccagcuuccacggaccaccccagucgggugcuugcuca

SEQ ID NO: 10784 - RNA, 2501 nt, Mus musculus
ugagcaagcacccgacuggggugguccguggaagcugggguucaauguggggcucgaggcagguaagcuuucucuauccuuuuucuaaaaaaaaaaaaaauacuuucucagguaaggagaggaccucgucagagugcugcagacuccuccacagagacacaucgaguuaagauggcgaggagguaagaaucaugggacauucacaguccaggaacaggcauguuccuggcaguauugaguauuguuccuggccucuguguuuguuucuguuugucaccgccaaauccuuaccuaccuagccucgagaacccacaucccagggacccccauaccuagcuaggguggucuguggcagcuacgucucacagcuuggagauuggcauaagaagaguaccauuucccaggugagacccacgagaguuacucaacuguguggcaaguggcacggagcaagcccucggcagccagaugugccggcacugaccuguaucccagcacucagaagccuccugaggcagggcaggaaagagacuaaagcugaaucagguggacugaaaaucugaggccagcucuguaucaaaaacaaacaaacaaacaaacacaaacaaaaaaccucccaaccauggugucuccugaugucauugacugacacccuucucagagucauccaaagccugaagcugaccucucuuccacaagcugggcacaguuaucucccaucugauaggcugugugagcaaaaccacccacaacaaagaaggauaauugugaagacagguggggggccagcuagaguggugaggauccagagaggaaagacccuagacagacccccuagacagacugacccuggagggucagagagggggccgaacucauccagaaguugcucgugagcaggggaauguguccuucaaaggaagaccuaagaaagcagagcuguucucugcagggcugacugacugccuggaucucagccugggggagggccaggagucccuaaaggggaaugucaaggacacccacggcaggggaauucugugacccuauagagauaaggauuggggugccagguuaaguggucucuaugaggagguuccgcaagggaagucgcuccuaugucaacagagcacccuggagcucaggagggaagaaucuuucagucccguuuuaccuuuauagauaaggguagaagaguuaaucucggcagggaagagaagcuaaaggccucaggauaccuagcaaaaaaaguuuuuugauuccccauccgugcucgacccgcccccuuccacgcucaggucgggguagcagggagguguguguccacaaccaggggacugcugacugucuugcccggcuaaaacugacccugccacgcgccgucugagaggucuuugagauccacauaaagaagggucccccugagaccagggacaggucucccugcccggcccagcggcacuccgacucaccuuuggacagggcgacucgacccccgccucuccuugccggaggcggccggggucucacguccagagccggccuguggggccgggaaaggucucgaucugcgcggcuggcgcggcggccuccggggacugggaaggggcuggagcaaaauguuucuuauucuagcuucuuccugccuggcccggcuccaccacucccuccuaauaacucguuuccuauugcccaguacgccucccagcagcagggcucggcucuagagggcugcagaccgagugcgaccaccccagccccucccugccacgaagggacaggcuucgaacccaggcauuggggucccgugcguccuggguaggaacguagggacugagcuagcugcggaagcgucgcucuaggccaggagaggguagccugcacccagaggcagaaaucuagauucgugagggcuucagggagggacccgcgugagguagcagccaacuuaccugugcucacuccuaaggaacagcgcuaagaaagcugaguuugggcugggagugucugcuccagaguuggcuccgcccuuuggauucuccaguuggcuuaaaucuuuuugccuccaaauuccagcccuucacccuuaauacuuuuguucccuuccguuguccacagugcuggccaucaacgcucagccucgggcuaaagaaaccuagauagguccguucugagucagucuggucugugcaccucaaggcuugacaguuaguuguuccucucccucaggucagggguggccagaauagagggaaaggccaccuugucuuuucuguucagccguguccuuuuugucuagccgggcugggaccccaaccacgggaugggggcggggcacaacuaccagauggggagcuuuagaauuuggggcauggaaccuugugaggcugggaccugcggcuggggaguugggcagagggcucgggauggggaagacaggacacucuuccucuuccugaucggcaguacaggcugggacugggugaaaaucuaugcuuucc

SEQ ID NO: 10785 - RNA, 2501 nt, Mus musculus
augccacaaaaucuucacccuagugaaccccucuucugucuguguaaauggaguuuguuuguuuguuuguuuguuuguuuguuuucgagauaagguuucucuguguagcccuggcuguccuggaacucacucuguagcccaggcuggccucgaacucagaaauucgccugccucugccucccaagugcugggauaaaggcgugcgccaccacgcccggaauaaacggauauuuaaaacgccauuuuuugcccugaaaacagacacucaggggcuaacaccaccugcuauccuuugugcaccccuuaguuauccacucccugugucggugaggauggcagguaugcugagggcgugugcagaaguggagaagggcugcgaccuguuaggucacaggaaucccgauccuggcgcccccggcuccgguggcuggggcguggccugcugggggaggucccuaccuccucccgcggcgauauaacaacaggucgaggacugccacccuccgcggcggaacuccuguucuggucucucgcuucgcucuccucuccagacaagaugagcuucacaacucgcuccaccaccuucuccaccaacuaccggucccugggcucugugcgaacucccagccagcggguccggccugccagcagcgcagccagcgucuaugcaggugcugggggcuccgggucccggauauccgugucccgcucugucugggguggcucugugggguccgcaggccuggcgggaauggguggaauccagaccgagaaggagaccaugcaagaccugaacgaucgccuggccagcuaccuagacaaggugaagagccuggaaacugagaacaggagacuggagagcaaaauccgggaacaucuggagaagaaggggccccagggcgucagagacuggggccacuacuucaagaucaucgaagaccugagggcucagguaaggggccuaaggggggaggggcaguagcuccgggcuguucugucuauccagugugcccacacccccaaacuugaauagagugugggcuguugacucccuccacucuuuccacauucaccacauccccccacacacacucuaugggacggaguuaggaauacucuggacucucacccacaaccuguaggaauuccaagcguagugguuacacacgcgagccggcuucccccaagcaguguagugggaagagaacaggauuggaaaaaaaauaaaauaaaaaggugugugugggggaaucauaaaaugaacucagacacucacuucuuuuccaguaggaacaguuagaggguuaagcggauguggcuaaggcugagucaucuaggaguaaacaggagcuuaccuguaggaggggccagcgggacaaguggggggggggggcgcgucccaggacggggggggggggggggguuagcaggugcaccuggagaagaugccaggagaggaucagagaaaucuuguuggaagcugcucuuuuguaagcaauccagauagugcaggcccuggcagaggggcaaggaauccaggaagggagaggaggcucaggugggaagggaagacagaaauacacgccucugacuguuccugggacugggauggauucacugaaacacaagacguguuuucucaucccccacuucuccacacacacacacacacacacacacacacacacacccucaugugacccggaacucucaaagcgacucucuccacuuuaauccacccagaucuuugcgaauucuguggacaaugcccgcaucgucuugcagaucgacaaugcccgccuugccgccgaugacuuuagagucaaguaaguccggggcugcagcuggagcuaagaauggccuacucccagaacuguauuagaguaggguuccuuccuuuccgaaguuuauucagguuaggguucauugacuacugaguuagcucuucaucugugcagcccaguuuaagcaaacgcuccaaggccaagaaucgugcuaagggaaugacuccgugacuguuuauggugggcacggggcuagucuauggagguggcacugguugagaagguucaggcccucugaucaccuccacuccuucagguaugagacagaacuagccaugcgccagucuguggagagcgacauccauggacuccgcaaggugguagaugacaccaacaucacaaggcugcagcuggagacagaaaucgaggcacucaaggaagaacuucuguucaugaagaagaaucaugaagagguaagccgggccacugaccaggccuaggagcuaagggccaagacuaggcgggccaggcugcccccaaagcagccuagcauggaagcagaagccccggcuguuagccuguuuugauuaagagcagagccauuggcucacacauguucuauggcucaccuaaguuacacuauugagagucaagauaacauuaagccaguuaaggccuggcuugugcaucacuaccuccuggaaagcugagacagga

SEQ ID NO: 10786 - RNA, 2501 nt, Mus musculus
uccugucucagcuuuccaggagguagugaugcacaagccaggccuuaacuggcuuaauguuaucuugacucucaauaguguaacuuaggugagccauagaacaugugugagccaauggcucugcucuuaaucaaaacaggcuaacagccggggcuucugcuuccaugcuaggcugcuuugggggcagccuggcccgccuagucuuggcccuuagcuccuaggccuggucaguggcccggcuuaccucuucaugauucuucuucaugaacagaaguucuuccuugagugccucgauuucugucuccagcugcagccuugugauguuggugucaucuaccaccuugcggaguccauggaugucgcucuccacagacuggcgcauggcuaguucugucucauaccugaaggaguggaggugaucagagggccugaaccuucucaaccagugccaccuccauagacuagccccgugcccaccauaaacagucacggagucauucccuuagcacgauucuuggccuuggagcguuugcuuaaacugggcugcacagaugaagagcuaacucaguagucaaugaacccuaaccugaauaaacuucggaaaggaaggaacccuacucuaauacaguucugggaguaggccauucuuagcuccagcugcagccccggacuuacuugacucuaaagucaucggcggcaaggcgggcauugucgaucugcaagacgaugcgggcauuguccacagaauucgcaaagaucuggguggauuaaaguggagagagucgcuuugagaguuccgggucacaugaggguguguguguguguguguguguguguguguguguggagaagugggggaugagaaaacacgucuuguguuucagugaauccaucccagucccaggaacagucagaggcguguauuucugucuucccuucccaccugagccuccucucccuuccuggauuccuugccccucugccagggccugcacuaucuggauugcuuacaaaagagcagcuuccaacaagauuucucugauccucuccuggcaucuucuccaggugcaccugcuaacccccccccccccccccguccugggacgcgccccccccccccacuugucccgcuggccccuccuacagguaagcuccuguuuacuccuagaugacucagccuuagccacauccgcuuaacccucuaacuguuccuacuggaaaagaagugagugucugaguucauuuuaugauucccccacacacaccuuuuuauuuuauuuuuuuuccaauccuguucucuucccacuacacugcuugggggaagccggcucgcguguguaaccacuacgcuuggaauuccuacagguugugggugagaguccagaguauuccuaacuccgucccauagaguguguguggggggauguggugaauguggaaagaguggagggagucaacagcccacacucuauucaaguuugggggugugggcacacuggauagacagaacagcccggagcuacugccccuccccccuuaggccccuuaccugagcccucaggucuucgaugaucuugaaguaguggccccagucucugacgcccuggggccccuucuucuccagauguucccggauuuugcucuccagucuccuguucucaguuuccaggcucuucaccuugucuagguagcuggccaggcgaucguucaggucuugcauggucuccuucucggucuggauuccacccauucccgccaggccugcggaccccacagagccaccccagacagagcgggacacggauauccgggacccggagcccccagcaccugcauagacgcuggcugcgcugcuggcaggccggacccgcuggcugggaguucgcacagagcccagggaccgguaguugguggagaaggugguggagcgaguugugaagcucaucuugucuggagaggagagcgaagcgagagaccagaacaggaguuccgccgcggaggguggcaguccucgaccuguuguuauaucgccgcgggaggagguagggaccucccccagcaggccacgccccagccaccggagccgggggcgccaggaucgggauuccugugaccuaacaggucgcagcccuucuccacuucugcacacgcccucagcauaccugccauccucaccgacacagggaguggauaacuaaggggugcacaaaggauagcaggugguguuagccccugagugucuguuuucagggcaaaaaauggcguuuuaaauauccguuuauuccgggcgugguggcgcacgccuuuaucccagcacuugggaggcagaggcaggcgaauuucugaguucgaggccagccugggcuacagagugaguuccaggacagccagggcuacacagagaaaccuuaucucgaaaacaaacaaacaaacaaacaaacaaacaaacuccauuuacacagacagaagagggguucacuagggugaagauuuuguggcau

SEQ ID NO: 10787 - RNA, 2501 nt, Mus musculus
cagcuuuuccuauuauugucucuaaggcuaggucuugcguuuuuaugguuuuguuuuucacagacacaggccaggagucuuuauuuuaccuuccccguuugcuuuaccaacucucucugggucuguuucuuacccuccgugggagcuucugcccauaugccugacaucuuuccuagcguuuauacacaucucuuucacgaugcacagucccuccgacccccaaucuccacccccauacuaucccuucucgggucaccuuuaucaccgucccccaccccaauauucucacacuaucuacagguuccucaucuuccugcacauacacucaugcuaacuggauuucacgguucaccuucucuguccuccccuuuacuccucccuacuccacaaucccuuuagccagauguacagcucccaaauuccgggcgagauucccaggaacaaagcaagaaaaaaacaucagaacaauuugggaaguaaacagcggcggagaagaagggagggaaaagccggguggacccagguggguggcccuccaguccacccaguuaagggacugccuuuuuccccucccccuucaccuggcuuuuaaggggccgggcccagaccucugcuucuuaaagaggagcccgcagcagcagcugcacuggacucucuggaaggaguguacagggcaaaaacucugaccaugaccugggaugggcugcccacgcagccgcugcucaugcugcuaaugcuguuguucgcugcgggcucaggguccgccuuagcggggugccccggcugcggcgcugggaugcagacugguugucgcgggggcugcguggaggaggaagacgcgggaucgccugcagacggcuguacagaagccggaggcugucucaggagagagggacaaccgugcggggucuacagcccuaagugcgccccaggacugcagugccaaccccgagagaacgaagaggcgccuuugcgggcgcugcuaaucggccagggccgcugucaacgcgccagagggccgucgggugaguccaugucuccccccucccuccccgcuucccaccugccuaccugagauaggagaagcaagucucuccugguaggaaucuggacagaugcagguugggcagccucuucaagccucugggaccggcccauugguucuuccugggccuugaguggaacgugaaguggaaacgucaggggacagcuauaaggcugauaggggcaccuuagaauaagcaagagagaugucugaauucuccucugcucucccuuucccuuaucuauuuucuccaaagggaaagagacguauguaggcggaggauggaggauuugaguuucagcuuuccucuauaccccgcagggucaacgccauggcucuccaggcucacacuggagacaggaccuagauuccuuauggaggaggaggaaagggaaucucaaacucuaguuccacacacuaagaaaugucuccugcuccuccuucagugccacugugaacggcagugggcaucgggagcaucggcaccgggggaguaaacacagugggcagcgggcaccggggguagcaggcacugcagacggugggcacgggggcaguggacaccggggcagugagcaggcccuagagggccuggggagggcugaagaagugggaagagaaggaaucugccaaaucagacuuaugauuuaaaccugguaggaauuggaugcccuccagccccacccuaucccagggaugaacacagaagacugagucauugggugggugggacuagagugagucagcaccccaaagaugggggugaagagcaacgggagauggaagauagcaagucccugguuuuuccauagaaagggaugagaaaugaauuuggaucauuuggcagugcaggccugccauuccagugcuuagggguggaggcgggaaggucagucagugucagccuuggcuacauaaucucaggccagccuacacacacacacacaccauacacacagaggcacacacauacacacacaugcacacacaugcacacaugaauauauacacaagaauacaugcaugcaugcacauacacacauacacgcaugcacgcacaugcauacaugaguccccccacaugugcauuggcacauacgcaugcacauacauauauacacacaugagcacacacaagcacacacauacacacaggaacacacacgagcacacuggagugagggguugaagcuccaguuucuagugucagagcucaggguucuagggcuccucugagaagguguguuuugguuggagaaggcaguuugaagcaucaucccaguuuggcauuaaauggggggagugagggacaaggucugaggaagauaugguacccagacagacaacagcguugacacugcagagggaacggaguaagaacaugugugagcuuaucuuuuggcauguugcgucagcucagccuuuuccuagcuauggcuuacuugcguccugagcu

SEQ ID NO: 10788 - RNA, 2501 nt, Mus musculus
agcucaggacgcaaguaagccauagcuaggaaaaggcugagcugacgcaacaugccaaaagauaagcucacacauguucuuacuccguucccucugcagugucaacgcuguugucugucuggguaccauaucuuccucagaccuugucccucacuccccccauuuaaugccaaacugggaugaugcuucaaacugccuucuccaaccaaaacacaccuucucagaggagcccuagaacccugagcucugacacuagaaacuggagcuucaaccccucacuccagugugcucguguguguuccuguguguaugugugugcuugugugugcucauguguguauauauguaugugcaugcguaugugccaaugcacauguggggggacucauguaugcaugugcgugcaugcguguauguguguaugugcaugcaugcauguauucuuguguauauauucaugugugcaugugugugcauguguguguaugugugugccucuguguguaugguguguguguguguguaggcuggccugagauuauguagccaaggcugacacugacugaccuucccgccuccaccccuaagcacuggaauggcaggccugcacugccaaaugauccaaauucauuucucaucccuuucuauggaaaaaccagggacuugcuaucuuccaucucccguugcucuucacccccaucuuuggggugcugacucacucuagucccacccacccaaugacucagucuucuguguucaucccugggauaggguggggcuggagggcauccaauuccuaccagguuuaaaucauaagucugauuuggcagauuccuucucuucccacuucuucagcccuccccaggcccucuagggccugcucacugccccgguguccacugcccccgugcccaccgucugcagugccugcuacccccggugcccgcugcccacuguguuuacucccccggugccgaugcucccgaugcccacugccguucacaguggcacugaaggaggagcaggagacauuucuuaguguguggaacuagaguuugagauucccuuuccuccuccuccauaaggaaucuagguccugucuccagugugagccuggagagccauggcguugacccugcgggguauagaggaaagcugaaacucaaauccuccauccuccgccuacauacgucucuuucccuuuggagaaaauagauaagggaaagggagagcagaggagaauucagacaucucucuugcuuauucuaaggugccccuaucagccuuauagcuguccccugacguuuccacuucacguuccacucaaggcccaggaagaaccaaugggccggucccagaggcuugaagaggcugcccaaccugcaucuguccagauuccuaccaggagagacuugcuucuccuaucucagguaggcaggugggaagcggggagggaggggggagacauggacucacccgacggcccucuggcgcguugacagcggcccuggccgauuagcagcgcccgcaaaggcgccucuucguucucucgggguuggcacugcaguccuggggcgcacuuagggcuguagaccccgcacgguugucccucucuccugagacagccuccggcuucuguacagccgucugcaggcgaucccgcgucuuccuccuccacgcagcccccgcgacaaccagucugcaucccagcgccgcagccggggcaccccgcuaaggcggacccugagcccgcagcgaacaacagcauuagcagcaugagcagcggcugcgugggcagcccaucccaggucauggucagaguuuuugcccuguacacuccuuccagagaguccagugcagcugcugcugcgggcuccucuuuaagaagcagaggucugggcccggccccuuaaaagccaggugaagggggaggggaaaaaggcagucccuuaacuggguggacuggagggccacccaccuggguccacccggcuuuucccucccuucuucuccgccgcuguuuacuucccaaauuguucugauguuuuuuucuugcuuuguuccugggaaucucgcccggaauuugggagcuguacaucuggcuaaagggauuguggaguagggaggaguaaaggggaggacagagaaggugaaccgugaaauccaguuagcaugaguguaugugcaggaagaugaggaaccuguagauagugugagaauauuggggugggggacggugauaaaggugacccgagaagggauaguauggggguggagauugggggucggagggacugugcaucgugaaagagauguguauaaacgcuaggaaagaugucaggcauaugggcagaagcucccacggaggguaagaaacagacccagagagaguugguaaagcaaacggggaagguaaaauaaagacuccuggccugugucugugaaaaacaaaaccauaaaaacgcaagaccuagccuuagagacaauaauaggaaaagcug

SEQ ID NO: 10789 - RNA, 2501 nt, Mus musculus
ucuuuuaccccccgccccccagcuugucauaaggaggggaccaagaccccgaaacggaaaacccuucuccuucccccaauccuaggggggaaaagaacagcaguuaaaaaaaaauacaauuacccccucccagccaccgcccccgcccaucccaccgcccaccccaccccaacccucucucucucuccuccuuuucucgcucuguggaauggagaggaggggagugacgagagaaaaacgaauacaaaucugcaauugauuuucauaauguuucugcgguguuugcaaaccaaucgccugaacguccccgaucuuaccuaagagagaaccccuccuacgucugcgaagugcuccgaacugauauaugacaauaucuacuuuggaucacgugcucggggagagagacuaagacggauaacgcgucaucucgccuucccaaaauuuccccccucgcuagaucggguccaaaaccuccagccggaggaggcaggagaagagaacgauguuuaacucggucaaccugggcaacuucugcucgccuucgcgcaaggagaggggcgcugacuucggcgaacgagggagcugcaccuccaaccucuaucugcccaguugcacuuacuacgugccugaguucuccaccgucucuuccuuccuaccccaggcucccucucgucagauuucuuaucccuacucagcccaagugcccccgguccgggaggucuccuacggccuggaaccguccgggaaguggcaccaucggaacagcuacucgucuuguuaugcggcggccgacgagcuuaugcaccgggagugccugccuccuuccacagucacugagauccucaugaaaaaugaaggcuccuacggcggccaccaccaccccagcgccccgcacgcggcccccgccggcuucuacuccucagucaacaagaacagcgucuugccccaagcuuucgaccgcuucuucgacaacgccuacugcggugggggagaugcgcccgccgagccccccugcuccggcaagggcgaggccaagggggagccugaggcgccccccgccucgggacuugcgucccgggcagaggccggugcugaggccgaggccgaggaggagaacacgaaucccagcucguccgguucuucccacucggcgaccaaggagccggccaagggagccgcccccaguagguagcagcggccgggaacccgagggcagcgagggagggagcggagagggagggcuggaguagugggggggggcaggggagcgcggacagccucguguuuugggucagucugauuuuauguggaguuuuauaagcauucaaaggauuuuauuauaaccuacaaagcccucucucccaacgacucgacuuuuuacgauggagaagggguggggagggagggaaaggggcucuuuggaaaagccgggugagccccccuccuccguuaucucccucggucugugaaauuuuuaaaagugccaccauugcgggcgauauuaacuuugaucgugaacuuagaggagcguuuaagaaaggauggggagucggacugcugggggguugggagggaggggagggguggagggggaaaggggagggcgagggacagacugggagaaauccagagaaggggagagguaaggaacagaagcgacgcggcagaacuggaguccagggaagcucuccaaggccgcuccucuucuuuuuaaaacgacuuuuaaaaauguucaaauuacguguucgcgggucuuugagaagaaaccggggcaagccgggguuuggcgguggcaggagaguggggaaagaaucagagauucccuugcucugcaggggaagguagcgguggcucuccaggguccgaggccucucucuggguaggcccagccugacuguacgcaagccuggggcaggcaagcggcugggugucccagggcgccagggcaccacaggaggcucguagguguccugcuaccucuacgggcuaguuugcucccgauuccucacugcucucuccugaucucacuccuucgcgccgauucuccgcgguucccuccgauuucuggaggaagggauccuggauuugcagaagcauuaggagggcggcuuggaaagggcaagggcagcgaccaggagcagacagagcaccccagggaaagcacguggcucaggcaggcuuuccuccacccucagaccuugucagcuagggcucuggccugaggggcagggggaacuagguucucagugaaccuggcggugggaucaaggcuugccccagcgcagcggauacggaagaggagccgccggccuagagggagggcugcccggcagcgggacugggagcuguguagcugagcuuucagcgacuggguuggcuggggucucccggggucucacgugucucuuuccccucuccucgcacuugcccuuccccucccuccagacgccccccgcacccgcaagaagcgcugcccuuauucgaaauuccagauccgggaa

SEQ ID NO: 10790 - RNA, 2501 nt, Mus musculus
uucccggaucuggaauuucgaauaagggcagcgcuucuugcgggugcggggggcgucuggagggaggggaagggcaagugcgaggagaggggaaagagacacgugagaccccgggagaccccagccaacccagucgcugaaagcucagcuacacagcucccagucccgcugccgggcagcccucccucuaggccggcggcuccucuuccguauccgcugcgcuggggcaagccuugaucccaccgccagguucacugagaaccuaguucccccugccccucaggccagagcccuagcugacaaggucugaggguggaggaaagccugccugagccacgugcuuucccuggggugcucugucugcuccuggucgcugcccuugcccuuuccaagccgcccuccuaaugcuucugcaaauccaggaucccuuccuccagaaaucggagggaaccgcggagaaucggcgcgaaggagugagaucaggagagagcagugaggaaucgggagcaaacuagcccguagagguagcaggacaccuacgagccuccuguggugcccuggcgcccugggacacccagccgcuugccugccccaggcuugcguacagucaggcugggccuacccagagagaggccucggacccuggagagccaccgcuaccuuccccugcagagcaagggaaucucugauucuuuccccacucuccugccaccgccaaaccccggcuugccccgguuucuucucaaagacccgcgaacacguaauuugaacauuuuuaaaagucguuuuaaaaagaagaggagcggccuuggagagcuucccuggacuccaguucugccgcgucgcuucuguuccuuaccucuccccuucucuggauuucucccagucugucccucgcccuccccuuucccccuccaccccuccccucccucccaaccccccagcaguccgacuccccauccuuucuuaaacgcuccucuaaguucacgaucaaaguuaauaucgcccgcaaugguggcacuuuuaaaaauuucacagaccgagggagauaacggaggaggggggcucacccggcuuuuccaaagagccccuuucccucccuccccaccccuucuccaucguaaaaagucgagucguugggagagagggcuuuguagguuauaauaaaauccuuugaaugcuuauaaaacuccacauaaaaucagacugacccaaaacacgaggcuguccgcgcuccccugcccccccccacuacuccagcccucccucuccgcucccucccucgcugcccucggguucccggccgcugcuaccuacugggggcggcucccuuggccggcuccuuggucgccgagugggaagaaccggacgagcugggauucguguucuccuccucggccucggccucagcaccggccucugcccgggacgcaagucccgaggcggggggcgccucaggcucccccuuggccucgcccuugccggagcaggggggcucggcgggcgcaucucccccaccgcaguaggcguugucgaagaagcggucgaaagcuuggggcaagacgcuguucuuguugacugaggaguagaagccggcgggggccgcgugcggggcgcugggguggugguggccgccguaggagccuucauuuuucaugaggaucucagugacuguggaaggaggcaggcacucccggugcauaagcucgucggccgccgcauaacaagacgaguagcuguuccgauggugccacuucccggacgguuccaggccguaggagaccucccggaccgggggcacuugggcugaguagggauaagaaaucugacgagagggagccugggguaggaaggaagagacgguggagaacucaggcacguaguaagugcaacugggcagauagagguuggaggugcagcucccucguucgccgaagucagcgccccucuccuugcgcgaaggcgagcagaaguugcccagguugaccgaguuaaacaucguucucuucuccugccuccuccggcuggagguuuuggacccgaucuagcgaggggggaaauuuugggaaggcgagaugacgcguuauccgucuuagucucucuccccgagcacgugauccaaaguagauauugucauauaucaguucggagcacuucgcagacguaggagggguucucucuuagguaagaucggggacguucaggcgauugguuugcaaacaccgcagaaacauuaugaaaaucaauugcagauuuguauucguuuuucucucgucacuccccuccucuccauuccacagagcgagaaaaggaggagagagagagaggguugggguggggugggcggugggaugggcgggggcgguggcugggaggggguaauuguauuuuuuuuuaacugcuguucuuuuccccccuaggauugggggaaggagaaggguuuuccguuucggggucuugguccccuccuuaugacaagcuggggggcgggggguaaaaga

SEQ ID NO: 10791 - RNA, 2501 nt, Mus musculus
cccaagguaccaagucuuccgggccucugcuuaagguucuggcgggagagaagguagggagaucggcgcccaccaggccuggaaaggaggccucgggauguucaaccuguguaugauuucagucucacacucauguuguggucugucugcauugggagacgccgcuugccugucugucugagacuucccaaacccgggcacuccuuccaaaggcucagaaaaauucgucgucggaauguguacuuucauucauuggauucucugaaacucggcagggcuggcuacgacaacccagguugggagggagcauucuuccucuuuucuggauguguaguccuuuggcuccuuggucacaggcugaguuuuccgguucuagguucgcgggucgcccugauguuugaagcuagacagcuccagucgguuagggagggcggggagggacccgcggcuguggcuccuuaauuguacuucgagcccuuauugucucuccuuucgccaccuccgcuuccucagucugggcuccaaagucacugcaaauuuccuugcgauacauacaucacacaaaagaucagguaacaacgcgcucagagccauugaaucagagcacagggcaacccugguucuggggaggcuaccucuccagucacuccccaggcuggaaaaacagacuguguugggggagccggaaauaaccccguuugcugcggagcggcagggcgggggcgccggcgcaaaggcaggccgggcaggccauggcguugagagggccacguucacaggcccuggggguuucacgcuugcggagcuugggggccuggcucuuggugugguggcagggaucccagauacccaccuuggguggggguagcacgcaguucuccucgcagcaagcaggagaacucaguuucugcuuccagcucaggccuuagcuaggaggaguuguguguggguguguuuuucccaacaaagagggaucaggagagauggggggggaacuagaagggaaccagggaggggggcggggaaggcgagagggcagcggagggacgaaaugagcccauuucagggggagaaggaaaaugaaagcaaacggaguagggccuccucgguucagggagggugcugaggagcagagagcgggcucucugccugcggcggccgggauggcccgcugggggcacagaagaaagccuguuuuaaauuuaauccgaacuugacgguguggauugaaccggagggaauuuaaaucauuaaaagggagacacgcgguagggggagggaggaggaugacucuaaccuaucuguuugucuguccuucccacagugcuagcuuggcuguuuucucaguugcccagguuugaggugauagagguuugcccaucccccuucaggggacuccucuccugugcccacuggaaucuguuggggguguaaggugaauacagaauagucagcuagaacugggcuuucuuccucccuuuccagcagugacucccaguuuccucaagucucucagguugccccauugaugcuaagaacaauugaaaggaguuggguaaaugagagaaagucuuagaauaaaauaggagauucagugggaguaacugaauccccaagaugagaccuugcuucuucgcauccaugucuuugcccuccauaucuacaagccuagauuuagggaaaacuugaaaguccacuucacaguccugaccugcuagcuuuuaaaugugaaacaugagagucacaaccuauaugaaggaccugggccuaguguccucuggacucccagucucuuaucagaccccuuccuuuaggcuaccucuuucuaggaggcauaauagaaugggacauugguaaggaggggccugugggcaaggccugcuuucugguccacagcugugcugacuucugaguggggagggucuagaguucuugcuuccaaaaggaaggaaaggcaacagucucucuccugcuuccugggggauuugaggacagcaggaaucccuguaugguaccccugacuacccagcugccacagccucugcaggguaggcaagcugggagugcaggcugcccaggaguugaaaagaaggcaguguucaaaaggagaaggggagaagagacucucauuacagucaagaugccuauaagaagagcuuuuccaaauagaagaggguccuuaaggacuucuguuucagaacguugagguaaaggcagacaggcccuguuguauagugaagaugcagagaaagagcaggcaugauguuuccuuccucuucuauuucuuccucuuucacuagaauguagcucagcccccagcagccagagugacugcuaggcuaauaucagauucggugucccagaggccuaguauacccaccggagcaggucucccagaggggauggaaaggaggccucuuacuccuuuguguccagacagaaguggccgccgcgccggagcggucccgcggcaaagcaccggacugcacaaugccauggcu

SEQ ID NO: 10792 - RNA, 2501 nt, Mus musculus
agccauggcauugugcaguccggugcuuugccgcgggaccgcuccggcgcggcggccacuucugucuggacacaaaggaguaagaggccuccuuuccauccccucugggagaccugcuccgguggguauacuaggccucugggacaccgaaucugauauuagccuagcagucacucuggcugcugggggcugagcuacauucuagugaaagaggaagaaauagaagaggaaggaaacaucaugccugcucuuucucugcaucuucacuauacaacagggccugucugccuuuaccucaacguucugaaacagaaguccuuaaggacccucuucuauuuggaaaagcucuucuuauaggcaucuugacuguaaugagagucucuucuccccuucuccuuuugaacacugccuucuuuucaacuccugggcagccugcacucccagcuugccuacccugcagaggcuguggcagcuggguagucagggguaccauacagggauuccugcuguccucaaaucccccaggaagcaggagagagacuguugccuuuccuuccuuuuggaagcaagaacucuagacccuccccacucagaagucagcacagcuguggaccagaaagcaggccuugcccacaggccccuccuuaccaaugucccauucuauuaugccuccuagaaagagguagccuaaaggaaggggucugauaagagacugggaguccagaggacacuaggcccagguccuucauauagguugugacucucauguuucacauuuaaaagcuagcaggucaggacugugaaguggacuuucaaguuuucccuaaaucuaggcuuguagauauggagggcaaagacauggaugcgaagaagcaaggucucaucuuggggauucaguuacucccacugaaucuccuauuuuauucuaagacuuucucucauuuacccaacuccuuucaauuguucuuagcaucaauggggcaaccugagagacuugaggaaacugggagucacugcuggaaagggaggaagaaagcccaguucuagcugacuauucuguauucaccuuacacccccaacagauuccagugggcacaggagaggaguccccugaagggggaugggcaaaccucuaucaccucaaaccugggcaacugagaaaacagccaagcuagcacugugggaaggacagacaaacagauagguuagagucauccuccucccucccccuaccgcgugucucccuuuuaaugauuuaaauucccuccgguucaauccacaccgucaaguucggauuaaauuuaaaacaggcuuucuucugugcccccagcgggccaucccggccgccgcaggcagagagcccgcucucugcuccucagcacccucccugaaccgaggaggcccuacuccguuugcuuucauuuuccuucucccccugaaaugggcucauuucgucccuccgcugcccucucgccuuccccgccccccucccugguucccuucuaguuccccccccaucucuccugaucccucuuuguugggaaaaacacacccacacacaacuccuccuagcuaaggccugagcuggaagcagaaacugaguucuccugcuugcugcgaggagaacugcgugcuacccccacccaagguggguaucugggaucccugccaccacaccaagagccaggcccccaagcuccgcaagcgugaaacccccagggccugugaacguggcccucucaacgccauggccugcccggccugccuuugcgccggcgcccccgcccugccgcuccgcagcaaacgggguuauuuccggcucccccaacacagucuguuuuuccagccuggggagugacuggagagguagccuccccagaaccaggguugcccugugcucugauucaauggcucugagcgcguuguuaccugaucuuuugugugauguauguaucgcaaggaaauuugcagugacuuuggagcccagacugaggaagcggagguggcgaaaggagagacaauaagggcucgaaguacaauuaaggagccacagccgcgggucccuccccgcccucccuaaccgacuggagcugucuagcuucaaacaucagggcgacccgcgaaccuagaaccggaaaacucagccugugaccaaggagccaaaggacuacacauccagaaaagaggaagaaugcucccucccaaccuggguugucguagccagcccugccgaguuucagagaauccaaugaaugaaaguacacauuccgacgacgaauuuuucugagccuuuggaaggagugcccggguuugggaagucucagacagacaggcaagcggcgucucccaaugcagacagaccacaacaugagugugagacugaaaucauacacagguugaacaucccgaggccuccuuuccaggccuggugggcgccgaucucccuaccuucucucccgccagaaccuuaagcagaggcccggaagacuugguaccuuggg

SEQ ID NO: 10793 - RNA, 2501 nt, Mus musculus
aaccucagagaacucaucuuuuggauugcaggcucagcccugacuuacuaacucucaccuccuggggguccucuaccuguugagguaaccugaguugaccugauggcucagguaucucucaaaaaggaaagaaaagggggaacaccuucaaacuagagugcacaccuuggaaaagcuggccuuguccauuagcuagggcuggcucaccacccccuacacacaccacacccccauuccucgccucuccucccucccucuccuccagguccccccccccagcccugaacccccucucccccagucucucucucucucucucucucucucucucucucucucucucccucucccucucccucucucucucucucucucucucucucucucucucucuugcucgcucgcucgcucgcucgcucgccugucuucaugucguggauugaugaacgcgaaucgcguguaagcgccgccaccgccgggagucugaggaauucgccugggcuguuagaggaaagagcuaagugagagcgcgcgcucuaccuaccgacagugagcagagagcugcagccgcccgagcccgcagccggcaccgcgcccccaccugcccagcccccagcccagcaguccagcccgggggagccggccagcuugggguucggucccggggggaggggaguuucggggauacccggcgggggagcgugauccaaggggagggggccgcggguuuucauguacccagcaugagcuccuacuucgucaacccccuguuuuccaaauacaaaggcggcgagucccuggaaccggccuauuacgacugccgguucccucagagcgugggcagaagccaugcgcugguguacgggcccggcggcuccgcgcccgguuuccagcacgccucgcaccacguccaagacuucuuccaccacggcaccuccggcaucuccaacucgggcuaccagcagaacccaugcucgcugagcugccacggagacgccuccaaauucuauggcuacgaggcgcuccccagacagucccuuuauggggcucagcaagaggcgagcguggugcaauaucccgacuguaaauccuccgccaacacuaacaguagcgaaggacaaggccacuuaaaucagaacucgucucccagccucauguuuccauggaugagaccccacggugagaagccuuuucucuuucccccuuggucucccgcgcuccggggucuuccccccucccucgccuccuuuuugucugcccuagcucgcuuuccuuccuggcuuugggggucucucccacuccacucccgugccuggguggguuccugggagauugaaaggcuuggcuggggguggagcguggggugccugagacauugugcuuguuggggugaaggugggggaaaggugacuugugggugcaaaggguuaaaaaucguuuucucuauuccuucugucucuccuucuucccaucuguaaagccaaaguuggggagauggcuggcaaggacacccuaaguaaacugagguuaucagucuuugggguugguagccaguuuucccaaagacauuucccaacgccagccaucccaagacagugaccagacuguugggugaaaaggagacccuuugcuaucucccccuagucagggagaggggcaagaccuccccucucccaaggacaagcauucugccucucuaggauugucacuucuuccccucagagaagcagccugaaggccacuaccccaacuuuucuguacuuccuccaauugaagagaagacugaaagcccgagaagaggaaaaugauugcucaaaaggagagaggggucauaccaaguaggggccucugagauccaggguacucgagucaggcuacccgccaaucaagaacuauggagucucuuggaaagcuguuuaggucaugagccccuccaaggguggcccuucauggcccaauuucgaaguacagggggaagagauaacgacaaguuccggcagggauggcccuugauuuauuuuuggucuccaguuagcaaucaggcagagcagugauacauuccagaagaucaauuauuuuucuuauuggaaaagcauuagucagagaucggcaaggagggggcaauuggcacagcccccucuccuuuaaccccagcccuuuuccuuucuuuuggaaacagauuauuucccuaggccgccucacuaaaugccauucugcacuuguaaacaaagcugcaagggcuaagcuguaggccugagggacccugauggcuuccuuguccaccucaagcccuuacuuuucagacaaccacgucccagcccccaccgucacccaccucccaaggugaaggaagucaaaccaaaacagcuauggaaacuuuuccugcccuugcuugccuucugcagucggccuuaucggcaggagggagggagaacugggaauagcagagagggaaguuuguggggcuguguuggggggcggagcccccacccagacauaac

SEQ ID NO: 10794 - RNA, 2501 nt, Mus musculus
guuaugucugggugggggcuccgccccccaacacagccccacaaacuucccucucugcuauucccaguucucccucccuccugccgauaaggccgacugcagaaggcaagcaagggcaggaaaaguuuccauagcuguuuugguuugacuuccuucaccuugggaggugggugacggugggggcugggacgugguugucugaaaaguaagggcuugagguggacaaggaagccaucagggucccucaggccuacagcuuagcccuugcagcuuuguuuacaagugcagaauggcauuuagugaggcggccuagggaaauaaucuguuuccaaaagaaaggaaaagggcugggguuaaaggagagggggcugugccaauugcccccuccuugccgaucucugacuaaugcuuuuccaauaagaaaaauaauugaucuucuggaauguaucacugcucugccugauugcuaacuggagaccaaaaauaaaucaagggccaucccugccggaacuugucguuaucucuucccccuguacuucgaaauugggccaugaagggccacccuuggaggggcucaugaccuaaacagcuuuccaagagacuccauaguucuugauuggcggguagccugacucgaguacccuggaucucagaggccccuacuugguaugaccccucucuccuuuugagcaaucauuuuccucuucucgggcuuucagucuucucuucaauuggaggaaguacagaaaaguugggguaguggccuucaggcugcuucucugaggggaagaagugacaauccuagagaggcagaaugcuuguccuugggagaggggaggucuugccccucucccugacuagggggagauagcaaagggucuccuuuucacccaacagucuggucacugucuugggauggcuggcguugggaaaugucuuugggaaaacuggcuaccaaccccaaagacugauaaccucaguuuacuuaggguguccuugccagccaucuccccaacuuuggcuuuacagaugggaagaaggagagacagaaggaauagagaaaacgauuuuuaacccuuugcacccacaagucaccuuucccccaccuucaccccaacaagcacaaugucucaggcaccccacgcuccacccccagccaagccuuucaaucucccaggaacccacccaggcacgggaguggagugggagagacccccaaagccaggaaggaaagcgagcuagggcagacaaaaaggaggcgagggaggggggaagaccccggagcgcgggagaccaagggggaaagagaaaaggcuucucaccguggggucucauccauggaaacaugaggcugggagacgaguucugauuuaaguggccuuguccuucgcuacuguuaguguuggcggaggauuuacagucgggauauugcaccacgcucgccucuugcugagccccauaaagggacugucuggggagcgccucguagccauagaauuuggaggcgucuccguggcagcucagcgagcauggguucugcugguagcccgaguuggagaugccggaggugccgugguggaagaagucuuggacguggugcgaggcgugcuggaaaccgggcgcggagccgccgggcccguacaccagcgcauggcuucugcccacgcucugagggaaccggcagucguaauaggccgguuccagggacucgccgccuuuguauuuggaaaacaggggguugacgaaguaggagcucaugcuggguacaugaaaacccgcggcccccuccccuuggaucacgcucccccgccggguauccccgaaacuccccuccccccgggaccgaaccccaagcuggccggcucccccgggcuggacugcugggcugggggcugggcaggugggggcgcggugccggcugcgggcucgggcggcugcagcucucugcucacugucgguagguagagcgcgcgcucucacuuagcucuuuccucuaacagcccaggcgaauuccucagacucccggcgguggcggcgcuuacacgcgauucgcguucaucaauccacgacaugaagacaggcgagcgagcgagcgagcgagcgagcaagagagagagagagagagagagagagagagagagagagggagagggagagggagagagagagagagagagagagagagagagagagagagagacugggggagaggggguucagggcuggggggggggaccuggaggagagggagggaggagaggcgaggaaugggggugugguguguguaggggguggugagccagcccuagcuaauggacaaggccagcuuuuccaaggugugcacucuaguuugaagguguucccccuuuucuuuccuuuuugagagauaccugagccaucaggucaacucagguuaccucaacagguagaggacccccaggaggugagaguuaguaagucagggcugagccugcaauccaaaagaugaguucucugagguu

SEQ ID NO: 10795 - RNA, 2501 nt, Mus musculus
ccugggcauaaacaagaaacacuggcaaacuggcccuccuggugguuagugccuauggugaagauaagacaaaggagagaacgggaucuagaugucauuaccuguaaggaggguguguguguguguguguguguguguguguguguguguggcugcuaaauaaauaugcucuguauuuacaauuaaauucucccuuggggcagagugagcuugagagggggccucucuugaugguggggcggcaccuccccgcccugcucugcccucccccucccuauuggcucccuccccagcuucccacacaaacacccuugcccagauugcaggccaaccucagcuucugcauuugagggacagagaaggcuccaggcugugugaccggcucucucugauucuccauucuuguggggguggaggugguaaagauccaaaaccccuuggaggaaaaacagguucugcacuuucuggccaccccuagugccucccugggcugugggccggguaucuaucugcccaauaccuugcaggggacccacaccucuuacaaggucucuccccauuuccugcagcccacugagguaucuccuggugggaaugaguggagucacggggaagacagggugaagguguggcuucacagccuugaguagcuaacucugccaggucucuaggccaggugucucccagaauaaggcuuucugggaggaggcgggagaagcccaaugcauacucccauuggccuuccacauucucuucccuugggucucuccuguaaccugcauggauccauccuacugaaccccuuacauuauuugaaagugacauuccagggagagguggucagccuccaugucuagguuuuggaauuucucucugauucggaaugcucaagcagaggcggcuagaggcgucuuuugugccucucauugugguaagagcacagcauuuaugauguaaaccauuuguaauucuacaagcacauggccugaaaugaaccagcaauguugagugacgcccacuacuaucuauacucaaaacguuccaucauccgcaauuaaaucuguaccuguuaaauaguccaaaaucccagccaucuccaucgccuggcaaugaucaccacccacucuggauugccuuugaacuuguagguucuagaugccucauaguagugggacccuccugaacugaaccuagaugcuucaguccuucuccaagcuuggcaugcacacucaguuauaccuccuuuucccguggaaucaugggugccaucccuucuucccuuuaaagcccacagaucugccacaguagucaagagcaggcaggggggccauccuuggagcuuaccccccaggcugggacaccguuaagaacccaaggaagcugcccccucgccgcuguggggcgccacggagcccagacccggaggagugcgcggcccucagggacccgaggaccagguccugucugauugguacugcuugggaaucagacgcugaguacaacaggcaacaagugggcuacucuggaguucagagcuuugggccagcgaugguggagaggggauccgcccugacucuuucccagacuuuucccgcccacuuggacgcaaaagguggcgaaugccacccagggguggcaggguggccuuggggggcaccaaagggaaggucugcgccacagaaaucuggagaaggagcaacgggacugccgcacgaaccgcaccccaacccuuccccgucaagcacggauccccuggccugucccgauuccuaaagagggcacacugcucccugucauuccggaaccccgacgucaccgcagucccuugucgcgcccccaacucaccgggcacgggcgucuggacacaguggcgggcugcgcguggggcgaggcgccggcuguuuugaagcuuggggcugggacugcgcggcguccuccgcccuccgggcugccgagccuccucccugccgcccucucccuagcccgccucccugcccgcccgugaugucaggagccgccgauccagggggcgggaccacgggaggccgggcgccccccccccccccaccuccccuugcugggccguccagcagcacucuguaaaguucgagggagcuggaagucuccugcugggaucaucgcugcccuucucaucucugccgccccucuucuccugacugcagggucaggacccugagauuuccacuucuuuccgagcagcccucucugucucuuacuaauuuagcugguuguuaaucucuccugccucaguuuccuaugauagaaaaggaaggcguggcgggaccuuguccugaggccuaaaggccacacucggugccuccuggagaggcugaguugauaugagccaagccauaacugaaaaaucaauuccuuccccgaaguaagaccaccauaaggaccagucuuaagauuccuucaagccuggccaggccugagaaguuugauauagaggauccaaguugugaucucaauugggcauu

SEQ ID NO: 10796 - RNA, 2501 nt, Mus musculus
aaugcccaauugagaucacaacuuggauccucuauaucaaacuucucaggccuggccaggcuugaaggaaucuuaagacugguccuuaugguggucuuacuucggggaaggaauugauuuuucaguuauggcuuggcucauaucaacucagccucuccaggaggcaccgaguguggccuuuaggccucaggacaaggucccgccacgccuuccuuuucuaucauaggaaacugaggcaggagagauuaacaaccagcuaaauuaguaagagacagagagggcugcucggaaagaaguggaaaucucaggguccugacccugcagucaggagaagaggggcggcagagaugagaagggcagcgaugaucccagcaggagacuuccagcucccucgaacuuuacagagugcugcuggacggcccagcaaggggagguggggggggggggggcgcccggccucccguggucccgcccccuggaucggcggcuccugacaucacgggcgggcagggaggcgggcuagggagagggcggcagggaggaggcucggcagcccggagggcggaggacgccgcgcagucccagccccaagcuucaaaacagccggcgccucgccccacgcgcagcccgccacuguguccagacgcccgugcccggugaguugggggcgcgacaagggacugcggugacgucgggguuccggaaugacagggagcagugugcccucuuuaggaaucgggacaggccaggggauccgugcuugacggggaaggguuggggugcgguucgugcggcagucccguugcuccuucuccagauuucuguggcgcagaccuucccuuuggugccccccaaggccacccugccaccccuggguggcauucgccaccuuuugcguccaagugggcgggaaaagucugggaaagagucagggcggauccccucuccaccaucgcuggcccaaagcucugaacuccagaguagcccacuuguugccuguuguacucagcgucugauucccaagcaguaccaaucagacaggaccugguccucgggucccugagggccgcgcacuccuccgggucugggcuccguggcgccccacagcggcgagggggcagcuuccuuggguucuuaacggugucccagccugggggguaagcuccaaggauggccccccugccugcucuugacuacuguggcagaucugugggcuuuaaagggaagaagggauggcacccaugauuccacgggaaaaggagguauaacugagugugcaugccaagcuuggagaaggacugaagcaucuagguucaguucaggagggucccacuacuaugaggcaucuagaaccuacaaguucaaaggcaauccagaguggguggugaucauugccaggcgauggagauggcugggauuuuggacuauuuaacagguacagauuuaauugcggaugauggaacguuuugaguauagauaguagugggcgucacucaacauugcugguucauuucaggccaugugcuuguagaauuacaaaugguuuacaucauaaaugcugugcucuuaccacaaugagaggcacaaaagacgccucuagccgccucugcuugagcauuccgaaucagagagaaauuccaaaaccuagacauggaggcugaccaccucucccuggaaugucacuuucaaauaauguaagggguucaguaggauggauccaugcagguuacaggagagacccaagggaagagaauguggaaggccaaugggaguaugcauugggcuucucccgccuccucccagaaagccuuauucugggagacaccuggccuagagaccuggcagaguuagcuacucaaggcugugaagccacaccuucacccugucuuccccgugacuccacucauucccaccaggagauaccucagugggcugcaggaaauggggagagaccuuguaagagguguggguccccugcaagguauugggcagauagauacccggcccacagcccagggaggcacuagggguggccagaaagugcagaaccuguuuuuccuccaagggguuuuggaucuuuaccaccuccacccccacaagaauggagaaucagagagagccggucacacagccuggagccuucucugucccucaaaugcagaagcugagguuggccugcaaucugggcaaggguguuugugugggaagcuggggagggagccaauagggagggggagggcagagcagggcggggaggugccgccccaccaucaagagaggcccccucucaagcucacucugccccaagggagaauuuaauuguaaauacagagcauauuuauuuagcagccacacacacacacacacacacacacacacacacacacacccuccuuacagguaaugacaucuagaucccguucucuccuuugucuuaucuucaccauaggcacuaaccaccaggagggccaguuugccaguguuucuuguuuaugcccagg

SEQ ID NO: 10797 - RNA, 2501 nt, Mus musculus
gggggcaacacaguacucagugucaggggcugucccuguaggaucccaucacagaaauaccagagaccaggcacggauacucaggagcggccaucuucccagucauaaaccacaacuagccuggaaguuugguccccaucacuguggguggagauguauaugauguccgacccuccccccuccccccagcaucccgaagacuucaagaaaagucagucuguauaccccacucccaacccaggacguuuggccaaagcauacgcucuaggaaucuuuguuucuuuuaaaaaaaaacuuucauaauaaaguuuauuaccuaaacuggcuguaaaaauauaaaauaggauauucugcacagcagaaaaaugaagccagagacccuccccgaccccugguuugugcaaagauacugggaauauguaaacauggagagguaggaguggaauucagguccuggccccagacacaagcugcuacaaccaggggggacccggagggagcaccaggaggggagcacccccaccccugagaggugggaugaggucuccagccagaagugggaggcaucucacccuccacaaccacucccuccgacccaggcggggagggcucccacgugguuccagaaaaauaauaauaauuaauaauaagaaauaauaaggcgcccccacuuaaugcugcggcacagcggcagccggucagaucuggaaggggaaggaacucagguagucacggaguaccggguuaagagggaugcgcgccagguucucgcgacccacggcggccacgaugcgcuggcgacacagcuccugcagcggccgcacgcggcgcuggcgcagcggggcccccaacaugcggcgcggcgccgccacguagugcuccagcagcucgaaaaggcagucgaaggucucgcggcugccguccaaguggaagcggccggccuggaagugcacgcggaugcucguggggcccgaagccaucuucacgcugagcgcgaagaagcaguuccguuggcgacugucgcgcaccaagaaggugcccacgggcucggcacgcagccgcucgugcgccccgugcacgcucagggguccccaauagaagccgcaggcguccaggagcgcgcugguccgcgugaugcgccgguaaucggagugggagcggaaggugcggaagugagugucgccaggggcuggggcugggaccgccgggcagggccggggacgcacgggggccgcuggcgaggacgaagacgaggacgaggagggcucugaccgccgucggggcucugcugccggggagaucgcauugucggcugccaccugguugcgugcuaccauccuacucgaggggccagcuggaggggugggccauagcguccggggcugcgcugaugggggagacagaggcagugagccgggcguccggguggcacaggccggccaacagaccccaaggagcgagagcggcacgcagaauccgcccggagcuugagccucggugggcucaucugcgaaguaggccguuccuguaugcggaacccuuccagacuggcgguggagcccugccuccccgcgcgcguggagaagggggcguggagaggggcccgacucccggccguccccgcugguggcuagucgccucgcggcugccgccuacuggccacgccggggacuggaacccgggcggaggaucagggcucagggccggagaggaggggcugacggcgccccgcucgagcgaggggccuccugggggagccggggcgggggugggggggcgccagaggcguggcauccucgacccugccauacagucugcgagguuaguccugccgggcucugcucccaucaccucccauccccucccgccugcucccucgcagcugccuuggcucaccuggcggcaggacgcggggagccgcggcugggggcuccggggcggcugucgcgcaugcuccggggcugggagccgugccgcugccacggccgcaguucucucugcugcugcccgccccugcaucaggcucuuaaaccaggcaggccccgcccacagguccagcccacccccgcuuucgguuucucuuuccggcaagucuuucggguucucucuagacuccugaggcucucccuggagacgguuccucuaacuugguuucgccucgcaccuucccacauugggaccucugggguuccggcuccaaccggaaucuuguguuccgugccuggggugcuuaggacuuggugcccgcucuuuugcucuaccuucgccccaaaucgcagcccgccgugugggaugcuagcgcggggcugacacgccuccuccccuccgggugucugcauucuucugguuagggcuccgccucgccuggacccugugcuccccaagcagcuccucccugccaggguccuuccugcccaggacccgaaggccuuggcaaucucgacccuucuuggaacccggcuagcuaguccuagagaccuguggggccgccgcccuccucc

SEQ ID NO: 10798 - RNA, 2501 nt, Mus musculus
ggaggagggcggcggccccacaggucucuaggacuagcuagccggguuccaagaagggucgagauugccaaggccuucggguccugggcaggaaggacccuggcagggaggagcugcuuggggagcacaggguccaggcgaggcggagcccuaaccagaagaaugcagacacccggaggggaggaggcgugucagccccgcgcuagcaucccacacggcgggcugcgauuuggggcgaagguagagcaaaagagcgggcaccaaguccuaagcaccccaggcacggaacacaagauuccgguuggagccggaaccccagaggucccaaugugggaaggugcgaggcgaaaccaaguuagaggaaccgucuccagggagagccucaggagucuagagagaacccgaaagacuugccggaaagagaaaccgaaagcgggggugggcuggaccugugggcggggccugccugguuuaagagccugaugcaggggcgggcagcagcagagagaacugcggccguggcagcggcacggcucccagccccggagcaugcgcgacagccgccccggagcccccagccgcggcuccccgcguccugccgccaggugagccaaggcagcugcgagggagcaggcgggaggggaugggaggugaugggagcagagcccggcaggacuaaccucgcagacuguauggcagggucgaggaugccacgccucuggcgcccccccacccccgccccggcucccccaggaggccccucgcucgagcggggcgccgucagccccuccucuccggcccugagcccugauccuccgcccggguuccaguccccggcguggccaguaggcggcagccgcgaggcgacuagccaccagcggggacggccgggagucgggccccucuccacgcccccuucuccacgcgcgcggggaggcagggcuccaccgccagucuggaaggguuccgcauacaggaacggccuacuucgcagaugagcccaccgaggcucaagcuccgggcggauucugcgugccgcucucgcuccuuggggucuguuggccggccugugccacccggacgcccggcucacugccucugucucccccaucagcgcagccccggacgcuauggcccaccccuccagcuggccccucgaguaggaugguagcacgcaaccagguggcagccgacaaugcgaucuccccggcagcagagccccgacggcggucagagcccuccucguccucgucuucguccucgccagcggcccccgugcguccccggcccugcccggcggucccagccccagccccuggcgacacucacuuccgcaccuuccgcucccacuccgauuaccggcgcaucacgcggaccagcgcgcuccuggacgccugcggcuucuauuggggaccccugagcgugcacggggcgcacgagcggcugcgugccgagcccgugggcaccuucuuggugcgcgacagucgccaacggaacugcuucuucgcgcucagcgugaagauggcuucgggccccacgagcauccgcgugcacuuccaggccggccgcuuccacuuggacggcagccgcgagaccuucgacugccuuuucgagcugcuggagcacuacguggcggcgccgcgccgcauguugggggccccgcugcgccagcgccgcgugcggccgcugcaggagcugugucgccagcgcaucguggccgccgugggucgcgagaaccuggcgcgcaucccucuuaacccgguacuccgugacuaccugaguuccuuccccuuccagaucugaccggcugccgcugugccgcagcauuaagugggggcgccuuauuauuucuuauuauuaauuauuauuauuuuucuggaaccacgugggagcccuccccgccugggucggagggagugguuguggagggugagaugccucccacuucuggcuggagaccucaucccaccucucaggggugggggugcuccccuccuggugcucccuccggguccccccugguuguagcagcuugugucuggggccaggaccugaauuccacuccuaccucuccauguuuacauauucccaguaucuuugcacaaaccaggggucggggagggucucuggcuucauuuuucugcugugcagaauauccuauuuuauauuuuuacagccaguuuagguaauaaacuuuauuaugaaaguuuuuuuuuaaaagaaacaaagauuccuagagcguaugcuuuggccaaacguccuggguugggagugggguauacagacugacuuuucuugaagucuucgggaugcuggggggaggggggagggucggacaucauauacaucuccacccacagugauggggaccaaacuuccaggcuaguugugguuuaugacugggaagauggccgcuccugaguauccgugccuggucucugguauuucugugaugggauccuacagggacagccccugacacugaguacuguguugccccc

SEQ ID NO: 10799 - RNA, 2501 nt, Mus musculus
gguggauagaugaaaggauaaugauggaauugaaggggaaaaaaggaaggaagaaaagaagagaaaagaaaagaugagaaaaggaaagaaaaucauucgucucugccuguaaucuccgggcgguguaucacacucuuaccgcugugcgccucaguuuccccucugucguuggguugacccucgaagaaagaggacgccaggcgcaggcccaguacugccggcacccaauaagcgcucaaggaagccuggccucccgccuucucugccccagcuccgggagccgccagcugagaaacacuacccacccccuugcuuacacucccucugcccauugugcgccuccgggcccagagcgcacgugacuccacccagcccgcuccgcuccgccccgccgucccagcgcgaucuccaguuggucgcaccagagcgccccgcccccaaucagggcggagcccaagcaccucgcccccugcugaucgggcucuggcgucuggcgagggcuccgcggccgacccggcuggcgcgcaggcggagccggggcggcggggcugcugcuggcuaauugcacaggacugcgggccgcgacauggucagcagggaugggcagagcaggcggguagggggaagggacgcgccggauggaucggggugcggcgcuggcgggucggcgcggcagaugccgcgcgcgggcgggggcucuuuguccuccgccgcgggauugggacaaaggagguagcggggggcggaggcugcuuggcugggcaucugccccucuccgugacccacgguucuauguccugcgcggauccuccgggcugcccggaacacucacuccgcauugacgggguuccuggcagcgccccagcguggucaagaugggaucgaggggaacgggggcccagggaaaaucuggcgcucguuucauugguggggagacugaggcugagccgcagcguuuggucccaggucgggucggcagugauugcgcggcgugggcuugaaugggucucugggaccccccccccagggaaaaaaacuggggucaggcggacuugauuugucuucagcugucguuuccuccucagcugucgcccccugaacaggccccuacuucccuagcgccucgccuugcuccuucgauagagugggagagacgcggcgucgccuggcaccgcgccugcacaccgcccgcgcucagcacgcgggagcugcugggacgcuugucauuaguguccaguccucucgacccaggucaccuagacuaucuccuaaggaggggucaaacacagacucauugugcucagcuuucaggagaaagaagacaggucagacauaugacguuuuagaaucagguuugaaaucgguuauuuaggaucggggcuuccuggguaucugcaccuccacuuuuuaaacugugugaccuuggggaccgaguuaacuucucuaagcuacagauuauuugucaaguaggaagagcagucauucgguucuaggauuguuuugaugcagaaguuuuggagagauccacaugagauguuggagcucaaaaguguggcaucaaggaacuuuucagcaucgacuauuauaucaccgccagaguuguauggccagaugggacccugacgagugggggcagaauucaggcuuggacuaugagauugcagcucaccucgggcaguucccaaacuucuuagucuuaguuuccuuuccuggcauaagaacugggaguaggguggcaucuggagcagauuucucuucuggaggaggaaggggaggggagaggacaaugggcacagccaugauagauguucccuuuucuuuccuguugcuguugguccuccaucuaagcucuuggauggcagaagcccucggugauggugccuuugggguuugaccaagcagaacccugagcaggaaauacuucuggucugggguccccugaagaggacacuuggaagguggccuugcuggaggauggagcagugcaggaagccccuggauguuaguuggcccugaaagcagggcaguauuucucacugccuuggaggcccugggagguggaagcuuuggauggaguggcagaguggugcccagcugaguacaauagcacuggugaugugcccaguuaagugaugaguaggcagaggauguccccagagaagaggcuauuugugacauggguccaggccaggcuuugugcccugagguacaagaaguuacagagaaaaaggcaagacauuaagaacagccugcuguggauaagaguggugagaaccuggccugccuuguugccuucuggguggggugaaagguuagcuuugggaucccaugaagagguagggauaacagacgccuuuccaaggaagaccuaaaggagagugugaauuuuaggagaccucugcccagaggucaccacacuguaugucauuuugagaccaguguguucuaggaccaguuacccauuggucugggccuugagaaaccaggcccagcaauucuca

SEQ ID NO: 10800 - RNA, 2501 nt, Mus musculus
ugagaauugcugggccugguuucucaaggcccagaccaauggguaacugguccuagaacacacuggucucaaaaugacauacaguguggugaccucugggcagaggucuccuaaaauucacacucuccuuuaggucuuccuuggaaaggcgucuguuaucccuaccucuucaugggaucccaaagcuaaccuuucaccccacccagaaggcaacaaggcaggccagguucucaccacucuuauccacagcaggcuguucuuaaugucuugccuuuuucucuguaacuucuuguaccucagggcacaaagccuggccuggacccaugucacaaauagccucuucucuggggacauccucugccuacucaucacuuaacugggcacaucaccagugcuauuguacucagcugggcaccacucugccacuccauccaaagcuuccaccucccagggccuccaaggcagugagaaauacugcccugcuuucagggccaacuaacauccaggggcuuccugcacugcuccauccuccagcaaggccaccuuccaaguguccucuucaggggaccccagaccagaaguauuuccugcucaggguucugcuuggucaaaccccaaaggcaccaucaccgagggcuucugccauccaagagcuuagauggaggaccaacagcaacaggaaagaaaagggaacaucuaucauggcugugcccauuguccucuccccuccccuuccuccuccagaagagaaaucugcuccagaugccacccuacucccaguucuuaugccaggaaaggaaacuaagacuaagaaguuugggaacugcccgaggugagcugcaaucucauaguccaagccugaauucugcccccacucgucagggucccaucuggccauacaacucuggcggugauauaauagucgaugcugaaaaguuccuugaugccacacuuuugagcuccaacaucucauguggaucucuccaaaacuucugcaucaaaacaauccuagaaccgaaugacugcucuuccuacuugacaaauaaucuguagcuuagagaaguuaacucgguccccaaggucacacaguuuaaaaaguggaggugcagauacccaggaagccccgauccuaaauaaccgauuucaaaccugauucuaaaacgucauaugucugaccugucuucuuucuccugaaagcugagcacaaugagucuguguuugaccccuccuuaggagauagucuaggugaccugggucgagaggacuggacacuaaugacaagcgucccagcagcucccgcgugcugagcgcgggcggugugcaggcgcggugccaggcgacgccgcgucucucccacucuaucgaaggagcaaggcgaggcgcuagggaaguaggggccuguucagggggcgacagcugaggaggaaacgacagcugaagacaaaucaaguccgccugaccccaguuuuuuucccuggggggggggucccagagacccauucaagcccacgccgcgcaaucacugccgacccgaccugggaccaaacgcugcggcucagccucagucuccccaccaaugaaacgagcgccagauuuucccugggcccccguuccccucgaucccaucuugaccacgcuggggcgcugccaggaaccccgucaaugcggagugaguguuccgggcagcccggaggauccgcgcaggacauagaaccgugggucacggagaggggcagaugcccagccaagcagccuccgccccccgcuaccuccuuugucccaaucccgcggcggaggacaaagagcccccgcccgcgcgcggcaucugccgcgccgacccgccagcgccgcaccccgauccauccggcgcgucccuucccccuacccgccugcucugcccaucccugcugaccaugucgcggcccgcaguccugugcaauuagccagcagcagccccgccgccccggcuccgccugcgcgccagccgggucggccgcggagcccucgccagacgccagagcccgaucagcagggggcgaggugcuugggcuccgcccugauugggggcggggcgcucuggugcgaccaacuggagaucgcgcugggacggcggggcggagcggagcgggcuggguggagucacgugcgcucugggcccggaggcgcacaaugggcagagggaguguaagcaaggggguggguaguguuucucagcuggcggcucccggagcuggggcagagaaggcgggaggccaggcuuccuugagcgcuuauugggugccggcaguacugggccugcgccuggcguccucuuucuucgagggucaacccaacgacagaggggaaacugaggcgcacagcgguaagagugugauacaccgcccggagauuacaggcagagacgaaugauuuucuuuccuuuucucaucuuuucuuuucucuucuuuucuuccuuccuuuuuuccccuucaauuccaucauuauccuuucaucuauccacc

SEQ ID NO: 10801 - RNA, 2501 nt, Mus musculus
uuaacuuucuggcacgccgcccuagaccugcuguggcagcugcggggagccuuuaccuuccuuucccaaaagccagagccuacagcugcuugugugcaauaaccccccuccagacgcaacuuccaaauauagacucucuggccacuaggggcugcgcggucccaguccggagggccgcccuuccuucccgcccucgccuugccaggcacugcccacaucuggaagccaagucgccguaggucaccuagcggaaacacguuuccccagugcucaagaaccgagauuuccuuucuugaaaacauuuaauguauuuugagccuccacugaaaugccaugagcagcccauuuugaaccagaaaaauuuagucugacaacagagucuuccucuauucacagcuguuccagaaggaggagcugaaaucugaaccucuuggcugugauugguuacuucuagaaaaagcaacggagaaggcgccuccccgcccagaggagcucagucgggcagggagccgggugacuucagaggcgccugccugucccccgccgcaccugagccaccgcgaugcuauaggaccgccgccuggaccguuauccgcccgcgcccgcccgcagccaccaugccgcgcuccuuccuggucaagaaacauuucaacgccuccaagaagcccaacuacagcgaacuggacacacacacagguaaaaaucgccucuguaaaucugugcgcgaguaaaccgcgguucuauugcuugacucagagaacacaccgggccgcuuuccuuuuaaugcugugccaaaacuguccuugcagucucuugauuacuuagguuaaguuuuaauucaaaaccuuugagaucuuugcugacaaggaaagcuuccuuccggucgggcaguauaguucucugagccuguguguacgcaaaaggagugcacggacgugaucgcacccuuccccucgccugagcagcaaucuccugaagccaagcacuugggaaagcagcuggauucgugcaugccauuacccgccacaggcacgguacagcuagaacagcccacgcauaaaaugaaaagcaacuuuauaaaaaguuuuaauauagugucuaguucuucguucuaaauugggacagcaaggcuaguccagaaugaagguuagucagggcaacugucagccugcacgaggacaguaagcccaggugaagggaagacuuuauguguguccugugaguaaggcugucuucacuagagagucuccuauggagucuccugcauguuguuauggucucucucagacuguguacauauauuuuaaaaauauuuugccuuaauuuuuucuuuccuuccuuuucuuucuuccaguuauuauuuccccauaucucuaugaaaguuacccuauaccugucauaccaaaaccagagauccucaccucgggagcauacagcccuauuacuguauggacaucgucggcagcuccacuccacucuccuuuacccaguggccuuucuccucuuacuggauacuccucauccuuggggcguguaagucccccgccuuccucugacacuucauccaaggaucacagugguucagaaagucccauuagugacgaagaggagagacugcagcccaagcuuucagacccccaugccaucgaagcugagaaguuucagugcaauuuaugcaauaagaccuauucuacguucucugggcuggccaaacacaagcagcugcacugugaugcccagucuaggaaaucguucagcugcaaguacugugacaaggaauaugugagccugggugcccugaagaugcacauucgaacccacacauugccuugugucugcaagaucuguggcaaggcuuucuccagacccuggcugcuucaaggacacauuagaacucacacugguaagagaaauguagaaaaccaugccucucagcucaaacaguggugugacagagcugucugcggggugucuuaagggacugacaggggguguuuuucauaaggugaaccacugauagcugcuuucugcucuaaagcuuguuagaacagcaagugcuccuuuccagccucugcuccagggauuguaaacagcauuuagacuuuggaaagcacaugcaggagauuuggucucaaagaucaguuagaaagcaagauugagguauuugguguguguucugcagaacugauagucaguaaauacaaaugucuggcuccuaguguugauuugauaaacaggcagaggggguuccuauaguuuuuuuggcuauacuuuuugcuaugaauucugccaacucuugacuaauuuaguaaaugaggcuaaauuggaucuggccgugugcuuguuuguuucauuuucuuguugcugauuuuuaaaaaaagcccaaagcaugaaaucauaugcaggaagucauggaauuuauccagucuuagucaucauacagaaagaggagacauacuggaaauggagggagcugcucaucauugcugcaccuguugaag

SEQ ID NO: 10802 - RNA, 2501 nt, Mus musculus
cuucaacaggugcagcaaugaugagcagcucccuccauuuccaguaugucuccucuuucuguaugaugacuaagacuggauaaauuccaugacuuccugcauaugauuucaugcuuugggcuuuuuuuaaaaaucagcaacaagaaaaugaaacaaacaagcacacggccagauccaauuuagccucauuuacuaaauuagucaagaguuggcagaauucauagcaaaaaguauagccaaaaaaacuauaggaacccccucugccuguuuaucaaaucaacacuaggagccagacauuuguauuuacugacuaucaguucugcagaacacacaccaaauaccucaaucuugcuuucuaacugaucuuugagaccaaaucuccugcaugugcuuuccaaagucuaaaugcuguuuacaaucccuggagcagaggcuggaaaggagcacuugcuguucuaacaagcuuuagagcagaaagcagcuaucagugguucaccuuaugaaaaacacccccugucagucccuuaagacaccccgcagacagcucugucacaccacuguuugagcugagaggcaugguuuucuacauuucucuuaccagugugaguucuaauguguccuugaagcagccagggucuggagaaagccuugccacagaucuugcagacacaaggcaauguguggguucgaaugugcaucuucagggcacccaggcucacauauuccuugucacaguacuugcagcugaacgauuuccuagacugggcaucacagugcagcugcuuguguuuggccagcccagagaacguagaauaggucuuauugcauaaauugcacugaaacuucucagcuucgauggcaugggggucugaaagcuugggcugcagucucuccucuucgucacuaaugggacuuucugaaccacugugauccuuggaugaagugucagaggaaggcgggggacuuacacgccccaaggaugaggaguauccaguaagaggagaaaggccacuggguaaaggagaguggaguggagcugccgacgauguccauacaguaauagggcuguaugcucccgaggugaggaucucugguuuugguaugacagguauaggguaacuuucauagagauauggggaaauaauaacuggaagaaagaaaaggaaggaaagaaaaaauuaaggcaaaauauuuuuaaaauauauguacacagucugagagagaccauaacaacaugcaggagacuccauaggagacucucuagugaagacagccuuacucacaggacacacauaaagucuucccuucaccugggcuuacuguccucgugcaggcugacaguugcccugacuaaccuucauucuggacuagccuugcugucccaauuuagaacgaagaacuagacacuauauuaaaacuuuuuauaaaguugcuuuucauuuuaugcgugggcuguucuagcuguaccgugccuguggcggguaauggcaugcacgaauccagcugcuuucccaagugcuuggcuucaggagauugcugcucaggcgaggggaagggugcgaucacguccgugcacuccuuuugcguacacacaggcucagagaacuauacugcccgaccggaaggaagcuuuccuugucagcaaagaucucaaagguuuugaauuaaaacuuaaccuaaguaaucaagagacugcaaggacaguuuuggcacagcauuaaaaggaaagcggcccgguguguucucugagucaagcaauagaaccgcgguuuacucgcgcacagauuuacagaggcgauuuuuaccuguguguguguccaguucgcuguaguugggcuucuuggaggcguugaaauguuucuugaccaggaaggagcgcggcaugguggcugcgggcgggcgcgggcggauaacgguccaggcggcgguccuauagcaucgcgguggcucaggugcggcgggggacaggcaggcgccucugaagucacccggcucccugcccgacugagcuccucugggcggggaggcgccuucuccguugcuuuuucuagaaguaaccaaucacagccaagagguucagauuucagcuccuccuucuggaacagcugugaauagaggaagacucuguugucagacuaaauuuuucugguucaaaaugggcugcucauggcauuucaguggaggcucaaaauacauuaaauguuuucaagaaaggaaaucucgguucuugagcacuggggaaacguguuuccgcuaggugaccuacggcgacuuggcuuccagaugugggcagugccuggcaaggcgagggcgggaaggaagggcggcccuccggacugggaccgcgcagccccuaguggccagagagucuauauuuggaaguugcgucuggagggggguuauugcacacaagcagcuguaggcucuggcuuuugggaaaggaagguaaaggcuccccgcagcugccacagcaggucuagggcggcgugccagaaaguuaa

SEQ ID NO: 10803 - RNA, 2501 nt, Mus musculus
uuccaggacagccagggcuacacagagaaacccugucucgaaaaaaaaaaaaaaagaagaaguggcagggcgcucugacuccuggucugcacggaguucaggaagucauccucuccuguagucagggaagagugugacugaccucaggacuggccuugaguaccagguaggcgucuggcauagccaguaaccuguuuucuuucugguugguagcauuucuggggaccaccaacuggcugaggcccagggacagagacgucugcuccagcuaaaagguuaguugugauguacguggccaguuggcacuguguaagcuaagaugagccucagccccacaagccagagaacuuggcgaggucccuggcacucccacuuccucaaagcuaugagacaggaguguucuccuuaugugacuaggcauaaguuccaaguggggaggggacuggcucagcauccggagccaaaacaagaauagaacugggagcugggccugaagcaguucaggcuuugggcucucugcaucaacacagccagcaugccuaugauuucugugcugggcaaaauguuucuguggcagcgcgaagggccuggaggacgauggacuugucagacaagucgcagaggugagagcagagaucauggaugugaucugggaagcgaugggaaacugagcaaaaaggaacaccagguguggagaggaaacucucucugguuuagauauugggaagcagacugaaagggagagacucggguuggggccauuagguaaugacuuacaagggugaaacuuagaaaaaucauggguuuguugggagugauagcccaguugagauuggugagaggaaagaauccuggggagaaggagagugagagggggccagugcuggugggcaaauuucaugcacuuuucaaggguugagaugcgggcggagaggucagggguuacucauauuuggguaugaguaacguaaguucugauggcaaaauaguuguagaggaagguguccuuagggaugccacagucaguugugggauaggggguuucaggagaguuaugugcgugaacucagauugucugcgagaugggggagggguaauaaaaaaugacacggcagcacggugaaaauggcagucuugguagaagugggaaugcagaugaacaccguucccucccgacuccucaguggcuucggacccugccugggcuguggaguggaucgaacucccucgaggucucucucuguccucccugggaucugcucgaacucuccgaggcuggagucgguccccccguccuucuuccguggacagccaggacuugccagaggugcugcgccuuuucugugcauguuuggcggcgggggguggggguggggguggcguucacauugaggguucgugugaccccuccccguuccugccucaccauccugcuucgggcucuuuuuuccugcuagcggaggcgcuauccggcaggccgcccccgcgccggucugcucugcucggcguggugccagcgggcuggcuugcuagcgccuucggugcugacgucagcgcaucccaggccguaucccgggagacccuguugcauggugauggguugccagggagauauacaccuuuuucuuugggccagggccgcagcugcgcggagcgucgcugggcauggauggccccggcugggggaagagaggggagggagggagagccggccaggaaacacccgccagguuccccuucccacaggccuggccagaggcuaucggcgccaaucuggaggcccugucagucagguacugaaggagagggacggaggaugggccugaggucaaggggcagguggaggccgcuugugccaauuggaaccaaccauaauggaggagaauuagguaaugcugggaagggggugugugcuucaguuauauucagcauaggaaaacauuugcuggggcuuaucaagggaccguuaagucagguacaggauggaguuaggaguccauauggauuuaacucugacccugccaucuccugcuuccuccggaguacaaggcagucaguacagaacaugggaggggccgugcgugagaauugagggugugaaaaaaaauaaaaauauggguugaagcauuauuacuaagagacacuuguggccuugaguuacagggagcguuguguaagauucuuuuugaaccuuuugauggccuucuuggucuaaaaagcugguuccuuucccuugaggcaggcaggauggugaaagaauuuggugguauuggcagaaaugagugcuggacuucgagaaaggccaggaaaaggcagaagcuuccuuguggcaaaguccuuaagugccugaauaacagaggaagagccugaaaagagacguucuuucuuuuaaaaauuaaaaacauauaucuuuaauuaauuauauguguggguaugcccauugagccuggagguguuugaccuccuggagcuagauuaacaacagcgaccugauguggaug

SEQ ID NO: 10804 - RNA, 2501 nt, Mus musculus
cauccacaucaggucgcuguuguuaaucuagcuccaggaggucaaacaccuccaggcucaaugggcauacccacacauauaauuaauuaaagauauauguuuuuaauuuuuaaaagaaagaacgucucuuuucaggcucuuccucuguuauucaggcacuuaaggacuuugccacaaggaagcuucugccuuuuccuggccuuucucgaaguccagcacucauuucugccaauaccaccaaauucuuucaccauccugccugccucaagggaaaggaaccagcuuuuuagaccaagaaggccaucaaaagguucaaaaagaaucuuacacaacgcucccuguaacucaaggccacaagugucucuuaguaauaaugcuucaacccauauuuuuauuuuuuuucacacccucaauucucacgcacggccccucccauguucuguacugacugccuuguacuccggaggaagcaggagauggcagggucagaguuaaauccauauggacuccuaacuccauccuguaccugacuuaacggucccuugauaagccccagcaaauguuuuccuaugcugaauauaacugaagcacacacccccuucccagcauuaccuaauucuccuccauuaugguugguuccaauuggcacaagcggccuccaccugccccuugaccucaggcccauccuccgucccucuccuucaguaccugacugacagggccuccagauuggcgccgauagccucuggccaggccugugggaaggggaaccuggcggguguuuccuggccggcucucccucccuccccucucuucccccagccggggccauccaugcccagcgacgcuccgcgcagcugcggcccuggcccaaagaaaaagguguauaucucccuggcaacccaucaccaugcaacagggucucccgggauacggccugggaugcgcugacgucagcaccgaaggcgcuagcaagccagcccgcuggcaccacgccgagcagagcagaccggcgcgggggcggccugccggauagcgccuccgcuagcaggaaaaaagagcccgaagcaggauggugaggcaggaacggggaggggucacacgaacccucaaugugaacgccacccccacccccaccccccgccgccaaacaugcacagaaaaggcgcagcaccucuggcaaguccuggcuguccacggaagaaggacggggggaccgacuccagccucggagaguucgagcagaucccagggaggacagagagagaccucgagggaguucgauccacuccacagcccaggcaggguccgaagccacugaggagucgggagggaacgguguucaucugcauucccacuucuaccaagacugccauuuucaccgugcugccgugucauuuuuuauuaccccucccccaucucgcagacaaucugaguucacgcacauaacucuccugaaacccccuaucccacaacugacuguggcaucccuaaggacaccuuccucuacaacuauuuugccaucagaacuuacguuacucauacccaaauaugaguaaccccugaccucuccgcccgcaucucaacccuugaaaagugcaugaaauuugcccaccagcacuggcccccucucacucuccuucuccccaggauucuuuccucucaccaaucucaacugggcuaucacucccaacaaacccaugauuuuucuaaguuucacccuuguaagucauuaccuaauggccccaacccgagucucucccuuucagucugcuucccaauaucuaaaccagagagaguuuccucuccacaccugguguuccuuuuugcucaguuucccaucgcuucccagaucacauccaugaucucugcucucaccucugcgacuugucugacaaguccaucguccuccaggcccuucgcgcugccacagaaacauuuugcccagcacagaaaucauaggcaugcuggcuguguugaugcagagagcccaaagccugaacugcuucaggcccagcucccaguucuauucuuguuuuggcuccggaugcugagccaguccccuccccacuuggaacuuaugccuagucacauaaggagaacacuccugucucauagcuuugaggaagugggagugccagggaccucgccaaguucucuggcuuguggggcugaggcucaucuuagcuuacacagugccaacuggccacguacaucacaacuaaccuuuuagcuggagcagacgucucugucccugggccucagccaguuggugguccccagaaaugcuaccaaccagaaagaaaacagguuacuggcuaugccagacgccuaccugguacucaaggccaguccugaggucagucacacucuucccugacuacaggagaggaugacuuccugaacuccgugcagaccaggagucagagcgcccugccacuucuucuuuuuuuuuuuuuuucgagacaggguuucucuguguagcccuggcuguccuggaa

SEQ ID NO: 10805 - RNA, 2501 nt, Mus musculus
aaagacaaguccucauccuccagcggcccaucucguucaagagugccacaggcccgaggcucagccucugcccuucacuagccugagccucuggucuugggguggacaccaccuccagggguggucgcaaggagcgugugugggggugucgaggcccgccucuccucucccucuuugcgcccccuaguuccucccuucccccuacccacuccgcuccccccuccuccagucccucccuccuccccugccgggucccagccugucccccucccccacucgcgauccggccgcugcugcugggccggaccccccgggcucagccgggcuccuuguggagccgccgccgcgccccguuugcugaagaggaggccccgggcccggacgccuggcgcgggcauaaaacgggccagagccggcgccuagggcacuaaaguggaguacggcccgggucagcgccccuccgcccgcucucucccgccccgcccggccgggagccgaccaggcgacugugagacgagccccucgccacugccccccuccuggccccggcccccuccugccggcccgccuccgguccggcccuacucccucuccugcucccuccucccgcccgccuccccagcugucugcuccgcgucaugccgagccucccggccccgccggccccgcggcugcuccucgggcugcugcugcucggcucgcggccggccaguggcacuggcccugagcccccagcacugcccauccguuccgagaaggagccgcugccuguccggggagcggcagguaggugggcuccagggggaggugcgggaggggagucugacuccuggcaagucuacauccacagggagagggccccgggcgcagguggcuucgcgcagcgggagggugggaggggaaagcagaggcggcgaggugcacggugccaagggaccaugggccuggcgggcagagcccggagcaggcauuacggcacgagcaaccggacagcggccgccagccaagcccguccccgcaggcugcuccuucggcgggaaggucuaugccuuggacgagacguggcacccggaccugggggagccuuuuggggugaugcgcugcgugcugugcgccugugaagcggugaguggauaacgcagcugccugcccuacucuagaggguagcggaacgcugguguccuaaguaguagacucggagaugcucaggggaaggcugguccgcaaaucggaggaaaccgcuuucaagucugcgguguugacaguuauugaucgcccacaaugugacuggcuuuuagccaacuuccccccucccguuacaguauugcuagauaaaugacauuauuaguucuacuuugcagacagggacgccgaggcucagagaaguuaagaaacuuuggacgggccauguaacuuguaaauagcagaauugacugucugcagcccuggggucugaugguuucauucccuuaauuuuccuauguucucugccaucagccucagugggcucgccgugggagggguccuggcagggucagcugcaagaacaucaaaccucagugccccacccuggccugcaggcagccgcgccagcugccaggacacugcugccagaccugcccgcagggugaggcccgcugugcccggaguuaggaggguggaaggcucuacacuagguccuguacgacuugcaucgcggaggaggacugguccuccugguaccuuucugaagccagccgucuuauuccuuaccccggaugcagagcgcagcaaucuagauccacagcccgcuggccuggucuucgaguauccaagggauccagagcaucgcaguuacagugaucgaggggaacccggcguuggggagcggacccgugcugauggccacacagguaggcugggguggaggugggccugaugaaguuugagucccgcggcaaggcuugacagugcucaggccaucuucucuucucgaagacuuuguggcgcugcugacaggaccgaggucgcaggcgguagcucgugcucgagucucuuugcugcgcucaaguuuacgcuucucugucuccuaccagcggugagaccgggaaaagggcaaggacuaggaguaguaaagggggcaauaaagaggagccuguaggcuauagauccagucucacuggaccucucuucacaggcuggaccgucccagcaggguucguuucacagaucccacaggcaacauccuguuugaacacccugcaacccccacccaggauggccuggugagaugaugccauuuaagagugcuuauccaaaaucggcacuugcugagagcaugcuuugcauugccuccuuugguucucacaacagcccagugggagaaaggcccugacauuaugaugcccauuuuacagaggagggaacugaggcucagaauagcagaaugugauuuguucaaggucauuuggcuaguaagugguaagccaggacuuaaaaucaaggcucauggguccuucuua

SEQ ID NO: 10806 - RNA, 2501 nt, Mus musculus
uaagaaggacccaugagccuugauuuuaaguccuggcuuaccacuuacuagccaaaugaccuugaacaaaucacauucugcuauucugagccucaguucccuccucuguaaaaugggcaucauaaugucagggccuuucucccacugggcuguugugagaaccaaaggaggcaaugcaaagcaugcucucagcaagugccgauuuuggauaagcacucuuaaauggcaucaucucaccaggccauccuggguggggguugcaggguguucaaacaggauguugccugugggaucugugaaacgaacccugcugggacgguccagccugugaagagagguccagugagacuggaucuauagccuacaggcuccucuuuauugcccccuuuacuacuccuaguccuugcccuuuucccggucucaccgcugguaggagacagagaagcguaaacuugagcgcagcaaagagacucgagcacgagcuaccgccugcgaccucgguccugucagcagcgccacaaagucuucgagaagagaagauggccugagcacugucaagccuugccgcgggacucaaacuucaucaggcccaccuccaccccagccuaccuguguggccaucagcacggguccgcuccccaacgccggguuccccucgaucacuguaacugcgaugcucuggaucccuuggauacucgaagaccaggccagcgggcuguggaucuagauugcugcgcucugcauccgggguaaggaauaagacggcuggcuucagaaagguaccaggaggaccaguccuccuccgcgaugcaagucguacaggaccuaguguagagccuuccacccuccuaacuccgggcacagcgggccucacccugcgggcaggucuggcagcaguguccuggcagcuggcgcggcugccugcaggccaggguggggcacugagguuugauguucuugcagcugacccugccaggaccccucccacggcgagcccacugaggcugauggcagagaacauaggaaaauuaagggaaugaaaccaucagaccccagggcugcagacagucaauucugcuauuuacaaguuacauggcccguccaaaguuucuuaacuucucugagccucggcgucccugucugcaaaguagaacuaauaaugucauuuaucuagcaauacuguaacgggaggggggaaguuggcuaaaagccagucacauugugggcgaucaauaacugucaacaccgcagacuugaaagcgguuuccuccgauuugcggaccagccuuccccugagcaucuccgagucuacuacuuaggacaccagcguuccgcuacccucuagaguagggcaggcagcugcguuauccacucaccgcuucacaggcgcacagcacgcagcgcaucaccccaaaaggcucccccagguccgggugccacgucucguccaaggcauagaccuucccgccgaaggagcagccugcggggacgggcuuggcuggcggccgcuguccgguugcucgugccguaaugccugcuccgggcucugcccgccaggcccauggucccuuggcaccgugcaccucgccgccucugcuuuccccucccacccucccgcugcgcgaagccaccugcgcccggggcccucucccuguggauguagacuugccaggagucagacuccccucccgcaccucccccuggagcccaccuaccugccgcuccccggacaggcagcggcuccuucucggaacggaugggcagugcugggggcucagggccagugccacuggccggccgcgagccgagcagcagcagcccgaggagcagccgcggggccggcggggccgggaggcucggcaugacgcggagcagacagcuggggaggcgggcgggaggagggagcaggagagggaguagggccggaccggaggcgggccggcaggagggggccggggccaggaggggggcaguggcgaggggcucgucucacagucgccuggucggcucccggccgggcggggcgggagagagcgggcggaggggcgcugacccgggccguacuccacuuuagugcccuaggcgccggcucuggcccguuuuaugcccgcgccaggcguccgggcccggggccuccucuucagcaaacggggcgcggcggcggcuccacaaggagcccggcugagcccgggggguccggcccagcagcagcggccggaucgcgagugggggagggggacaggcugggacccggcaggggaggagggagggacuggaggaggggggagcggaguggguagggggaagggaggaacuagggggcgcaaagagggagaggagaggcgggccucgacacccccacacacgcuccuugcgaccaccccuggaggugguguccaccccaagaccagaggcucaggcuagugaagggcagaggcugagccucgggccuguggcacucuugaacgagaugggccgcuggaggaugaggacuugucuuu

SEQ ID NO: 10807 - RNA, 2501 nt, Mus musculus
cagggguggucgcaaggagcgugugugggggugucgaggcccgccucuccucucccucuuugcgcccccuaguuccucccuucccccuacccacuccgcuccccccuccuccagucccucccuccuccccugccgggucccagccugucccccucccccacucgcgauccggccgcugcugcugggccggaccccccgggcucagccgggcuccuuguggagccgccgccgcgccccguuugcugaagaggaggccccgggcccggacgccuggcgcgggcauaaaacgggccagagccggcgccuagggcacuaaaguggaguacggcccgggucagcgccccuccgcccgcucucucccgccccgcccggccgggagccgaccaggcgacugugagacgagccccucgccacugccccccuccuggccccggcccccuccugccggcccgccuccgguccggcccuacucccucuccugcucccuccucccgcccgccuccccagcugucugcuccgcgucaugccgagccucccggccccgccggccccgcggcugcuccucgggcugcugcugcucggcucgcggccggccaguggcacuggcccugagcccccagcacugcccauccguuccgagaaggagccgcugccuguccggggagcggcagguaggugggcuccagggggaggugcgggaggggagucugacuccuggcaagucuacauccacagggagagggccccgggcgcagguggcuucgcgcagcgggagggugggaggggaaagcagaggcggcgaggugcacggugccaagggaccaugggccuggcgggcagagcccggagcaggcauuacggcacgagcaaccggacagcggccgccagccaagcccguccccgcaggcugcuccuucggcgggaaggucuaugccuuggacgagacguggcacccggaccugggggagccuuuuggggugaugcgcugcgugcugugcgccugugaagcggugaguggauaacgcagcugccugcccuacucuagaggguagcggaacgcugguguccuaaguaguagacucggagaugcucaggggaaggcugguccgcaaaucggaggaaaccgcuuucaagucugcgguguugacaguuauugaucgcccacaaugugacuggcuuuuagccaacuuccccccucccguuacaguauugcuagauaaaugacauuauuaguucuacuuugcagacagggacgccgaggcucagagaaguuaagaaacuuuggacgggccauguaacuuguaaauagcagaauugacugucugcagcccuggggucugaugguuucauucccuuaauuuuccuauguucucugccaucagccucagugggcucgccgugggagggguccuggcagggucagcugcaagaacaucaaaccucagugccccacccuggccugcaggcagccgcgccagcugccaggacacugcugccagaccugcccgcagggugaggcccgcugugcccggaguuaggaggguggaaggcucuacacuagguccuguacgacuugcaucgcggaggaggacugguccuccugguaccuuucugaagccagccgucuuauuccuuaccccggaugcagagcgcagcaaucuagauccacagcccgcuggccuggucuucgaguauccaagggauccagagcaucgcaguuacagugaucgaggggaacccggcguuggggagcggacccgugcugauggccacacagguaggcugggguggaggugggccugaugaaguuugagucccgcggcaaggcuugacagugcucaggccaucuucucuucucgaagacuuuguggcgcugcugacaggaccgaggucgcaggcgguagcucgugcucgagucucuuugcugcgcucaaguuuacgcuucucugucuccuaccagcggugagaccgggaaaagggcaaggacuaggaguaguaaagggggcaauaaagaggagccuguaggcuauagauccagucucacuggaccucucuucacaggcuggaccgucccagcaggguucguuucacagaucccacaggcaacauccuguuugaacacccugcaacccccacccaggauggccuggugagaugaugccauuuaagagugcuuauccaaaaucggcacuugcugagagcaugcuuugcauugccuccuuugguucucacaacagcccagugggagaaaggcccugacauuaugaugcccauuuuacagaggagggaacugaggcucagaauagcagaaugugauuuguucaaggucauuuggcuaguaagugguaagccaggacuuaaaaucaaggcucauggguccuucuuaagagggucuggggucucccuuccaugcuccuuccucauuagaccugggucuuuuagguggcuuguccugcauaauuacaguaggcauucuucccucuucucucaaggucuguggg

SEQ ID NO: 10808 - RNA, 2501 nt, Mus musculus
cccacagaccuugagagaagagggaagaaugccuacuguaauuaugcaggacaagccaccuaaaagacccaggucuaaugaggaaggagcauggaagggagaccccagacccucuuaagaaggacccaugagccuugauuuuaaguccuggcuuaccacuuacuagccaaaugaccuugaacaaaucacauucugcuauucugagccucaguucccuccucuguaaaaugggcaucauaaugucagggccuuucucccacugggcuguugugagaaccaaaggaggcaaugcaaagcaugcucucagcaagugccgauuuuggauaagcacucuuaaauggcaucaucucaccaggccauccuggguggggguugcaggguguucaaacaggauguugccugugggaucugugaaacgaacccugcugggacgguccagccugugaagagagguccagugagacuggaucuauagccuacaggcuccucuuuauugcccccuuuacuacuccuaguccuugcccuuuucccggucucaccgcugguaggagacagagaagcguaaacuugagcgcagcaaagagacucgagcacgagcuaccgccugcgaccucgguccugucagcagcgccacaaagucuucgagaagagaagauggccugagcacugucaagccuugccgcgggacucaaacuucaucaggcccaccuccaccccagccuaccuguguggccaucagcacggguccgcuccccaacgccggguuccccucgaucacuguaacugcgaugcucuggaucccuuggauacucgaagaccaggccagcgggcuguggaucuagauugcugcgcucugcauccgggguaaggaauaagacggcuggcuucagaaagguaccaggaggaccaguccuccuccgcgaugcaagucguacaggaccuaguguagagccuuccacccuccuaacuccgggcacagcgggccucacccugcgggcaggucuggcagcaguguccuggcagcuggcgcggcugccugcaggccaggguggggcacugagguuugauguucuugcagcugacccugccaggaccccucccacggcgagcccacugaggcugauggcagagaacauaggaaaauuaagggaaugaaaccaucagaccccagggcugcagacagucaauucugcuauuuacaaguuacauggcccguccaaaguuucuuaacuucucugagccucggcgucccugucugcaaaguagaacuaauaaugucauuuaucuagcaauacuguaacgggaggggggaaguuggcuaaaagccagucacauugugggcgaucaauaacugucaacaccgcagacuugaaagcgguuuccuccgauuugcggaccagccuuccccugagcaucuccgagucuacuacuuaggacaccagcguuccgcuacccucuagaguagggcaggcagcugcguuauccacucaccgcuucacaggcgcacagcacgcagcgcaucaccccaaaaggcucccccagguccgggugccacgucucguccaaggcauagaccuucccgccgaaggagcagccugcggggacgggcuuggcuggcggccgcuguccgguugcucgugccguaaugccugcuccgggcucugcccgccaggcccauggucccuuggcaccgugcaccucgccgccucugcuuuccccucccacccucccgcugcgcgaagccaccugcgcccggggcccucucccuguggauguagacuugccaggagucagacuccccucccgcaccucccccuggagcccaccuaccugccgcuccccggacaggcagcggcuccuucucggaacggaugggcagugcugggggcucagggccagugccacuggccggccgcgagccgagcagcagcagcccgaggagcagccgcggggccggcggggccgggaggcucggcaugacgcggagcagacagcuggggaggcgggcgggaggagggagcaggagagggaguagggccggaccggaggcgggccggcaggagggggccggggccaggaggggggcaguggcgaggggcucgucucacagucgccuggucggcucccggccgggcggggcgggagagagcgggcggaggggcgcugacccgggccguacuccacuuuagugcccuaggcgccggcucuggcccguuuuaugcccgcgccaggcguccgggcccggggccuccucuucagcaaacggggcgcggcggcggcuccacaaggagcccggcugagcccgggggguccggcccagcagcagcggccggaucgcgagugggggagggggacaggcugggacccggcaggggaggagggagggacuggaggaggggggagcggaguggguagggggaagggaggaacuagggggcgcaaagagggagaggagaggcgggccucgacacccccacacacgcuccuugcgaccaccccug

SEQ ID NO: 10809 - RNA, 2501 nt, Mus musculus
ugaacaagagaagcauauuaaauaaucaccaaaggaaacaauaaacccagauaauccccuguuuucuaauacgacacuaaggaaauggccucaggaaacaauacacaguuccuccuucccgaggaaaaacgaagucauguaaacuuccacaaacauaugaguuuaucucauccauucagaguuaugaccagaccagcuucauacuuuugcugucuuguuaucugagaaggcugaguaggaucacccauaaauaugacaucacuauccuaaacacaauguaacaacuacucuagggacugaguaugcgagucacauuggguuuggggucuuggaguuccuugcagacuacauaagcccuaagaggagggucccaaaggaucccauucaauggagugaaggauuuauauuucccuuuaaaaagaauagucaguaugcugagauaauucuuuagcuuugagcuucacuuugccagacauaaaggcauuauuaacuggguguaagaaggaaagacuucaacagcuugugaauccagaucaacaugaguuuuguuuacucccggagucugcagcuuugcagccaucagagacuaugaaaaugagccaccaagggggugacuaaggugacaaaugccacgaaacguuaagggaaaauaaaguaaagugucuuucccucccaaggcuuacucucaaaaucguagcuuacucugagucccacuugaaucuaaccuacacacuugaguguguggaacucaaagagaacagcagaguuggaguugcuaacaggcuuaagguagucaacucaugccaggagaggcuccuuccucaacccaucuuuauacuucagcuaucaggacugaggcugucucagauugcaagugacucgcagccacacccaaaggaucaaggacccgagaaaagcaaggauucuggugauuugcuggcacucaguuuccuucuguaaauaacgacauaugaugaacuauuugaacccaaggcugcggaagcagaaucaguuucagauugugacaaagaaaugucugauaagucaaauuuucuuuacacucccugggaccaagcugcagauaccaugguguugacuuaguaucucaaaagcugaaaugcagauaauaguaaguggacaguaaacuuuguaagaggccgaugguaacuaucaacugguuggaagaauaagaaagggguucuguguagaaguggaugaaugugagaacauggaaaguugggaaagugagauguauuaaaaggcaaaaaacccacgugcuuguugaaggcagagcaaaucaaaugauauuaaguucaucugguaucuauuauaauucauaaucacugucuuaugugguuaugaggaguauaaagaccuuuauuuguuuucauacucuccguagguaguaugacuacucuguagguagauggagggguggguagaacaauggguggcgcgugaaugaauggaugaaugaaagaacgaacaaucgaacgaacuagugcccuccagggcuuuaccagauaaaggaacccagaugcaccuauacaagugacccucauacuagacugucgguggaugaaagcagaaaguguuuucccgaauaugggacaagcuauuaacugacacaggguuguugaaagaaggugggccagcauggaagaaaggaauucugauucccauccaugagcaauucccagaagcuuugaaggaaggggauggggggcgucagccucuggggagcccacugauuugacugcuacuaaccuggucuccgccucacuggccucuugcggccgcugcagaagcgcacuuugcugaacaccccgaggacgugccucucacacagggagcgcccgucuuugcuggggcuggagcggcgcuuggaggccgacacccggucgcuguuggacucccucgccugccgcuucugccggaucaaggagcuggcuaucgccgcagccauagcugcucagcgcgggcccgaggccccgggcuccacugcgcccucggguuccugcuccgccgggaugagggcaggaccucgggggccuggaggaauaggacaggcgcggggaggcagugcuaauauuugaggagguugcaguaucgaaaaccuggagcccacaagguuagucagagucugggcaguggcaacaaaacgugugaaaauccggauguaaacuuccccaaccacuggcggcgggggcggggcggucccaggccuucuugcgaaguagacguuugcaccccaaacuugcaccccaaagcgauccacguccaaagggcaguagggaguuuggucacacugcguucaggguaccaaguggaaaggggggaaaagauguccaaaauaacaagcugugccccgguuggagaggcgcaagcguuguaagguguccaaaguauaccuacacauauauacauagaaacccguuuacaaggcagagucuggaccgaggcuagaagcgagcccccagcuuaaaaauauauauaguaaa

SEQ ID NO: 10810 - RNA, 2501 nt, Mus musculus
uuuacuauauauauuuuuaagcugggggcucgcuucuagccucgguccagacucugccuuguaaacggguuucuauguauauauguguagguauacuuuggacaccuuacaacgcuugcgccucuccaaccggggcacagcuuguuauuuuggacaucuuuuccccccuuuccacuugguacccugaacgcagugugaccaaacucccuacugcccuuuggacguggaucgcuuuggggugcaaguuuggggugcaaacgucuacuucgcaagaaggccugggaccgccccgcccccgccgccagugguuggggaaguuuacauccggauuuucacacguuuuguugccacugcccagacucugacuaaccuugugggcuccagguuuucgauacugcaaccuccucaaauauuagcacugccuccccgcgccuguccuauuccuccaggcccccgagguccugcccucaucccggcggagcaggaacccgagggcgcaguggagcccggggccucgggcccgcgcugagcagcuauggcugcggcgauagccagcuccuugauccggcagaagcggcaggcgagggaguccaacagcgaccgggugucggccuccaagcgccgcuccagccccagcaaagacgggcgcucccugugugagaggcacguccucgggguguucagcaaagugcgcuucugcagcggccgcaagaggccagugaggcggagaccagguuaguagcagucaaaucagugggcuccccagaggcugacgccccccauccccuuccuucaaagcuucugggaauugcucauggaugggaaucagaauuccuuucuuccaugcuggcccaccuucuuucaacaacccugugucaguuaauagcuugucccauauucgggaaaacacuuucugcuuucauccaccgacagucuaguaugagggucacuuguauaggugcaucuggguuccuuuaucugguaaagcccuggagggcacuaguucguucgauuguucguucuuucauucauccauucauucacgcgccacccauuguucuacccaccccuccaucuaccuacagaguagucauacuaccuacggagaguaugaaaacaaauaaaggucuuuauacuccucauaaccacauaagacagugauuaugaauuauaauagauaccagaugaacuuaauaucauuugauuugcucugccuucaacaagcacguggguuuuuugccuuuuaauacaucucacuuucccaacuuuccauguucucacauucauccacuucuacacagaaccccuuucuuauucuuccaaccaguugauaguuaccaucggccucuuacaaaguuuacuguccacuuacuauuaucugcauuucagcuuuugagauacuaagucaacaccaugguaucugcagcuuggucccagggaguguaaagaaaauuugacuuaucagacauuucuuugucacaaucugaaacugauucugcuuccgcagccuuggguucaaauaguucaucauaugucguuauuuacagaaggaaacugagugccagcaaaucaccagaauccuugcuuuucucggguccuugauccuuuggguguggcugcgagucacuugcaaucugagacagccucaguccugauagcugaaguauaaagauggguugaggaaggagccucuccuggcaugaguugacuaccuuaagccuguuagcaacuccaacucugcuguucucuuugaguuccacacacucaaguguguagguuagauucaagugggacucagaguaagcuacgauuuugagaguaagccuugggagggaaagacacuuuacuuuauuuucccuuaacguuucguggcauuugucaccuuagucacccccuugguggcucauuuucauagucucugauggcugcaaagcugcagacuccgggaguaaacaaaacucauguugaucuggauucacaagcuguugaagucuuuccuucuuacacccaguuaauaaugccuuuaugucuggcaaagugaagcucaaagcuaaagaauuaucucagcauacugacuauucuuuuuaaagggaaauauaaauccuucacuccauugaaugggauccuuugggacccuccucuuagggcuuauguagucugcaaggaacuccaagaccccaaacccaaugugacucgcauacucagucccuagaguaguuguuacauuguguuuaggauagugaugucauauuuaugggugauccuacucagccuucucagauaacaagacagcaaaaguaugaagcuggucuggucauaacucugaauggaugagauaaacucauauguuuguggaaguuuacaugacuucguuuuuccucgggaaggaggaacuguguauuguuuccugaggccauuuccuuagugucguauuagaaaacaggggauuaucuggguuuauuguuuccuuuggugauuauuuaauaugcuucucuuguuca

SEQ ID NO: 10811 - RNA, 2501 nt, Mus musculus
cuuucauaagaagccagagucucuuuugaaacucagucuacagagaccacuucucaguggagcaccuuaggucugagagggaaaugguauggucucuguuuagccccgugcuccacagccgaggcaggcacuggaaccugcagcuucagggguucuucugaagucuggaggcagggaggcaaauugucaucuguaaucacagccuuggcguguucgcuggcaggacaagcccugggcagugcgucucccaucucucucucucaucucugcacaucuggaucuacuuccacuucaggcuucacauccuccauugacagagcuaaucuggguaguguccccaagccccgggaggaaccuuccuauacuugcuguggggucuucucagagcucuuccuggccacgacccucucaacaugccuucccugucacaguuguugcugagcccagcagcugacucaugaccacaggcaaauugaacugucugguccugaaucuacuccagauguucaggcgaugcagaaaaagagaccugcuuaaggaauuuccaagucacagagcagggacacccacacauccgagagcugccugcaauggguagugccagcuagaaaucccuggcaggcaaugcucagcaccuugaguucuuguguuaucucagcagucacggucugcccuaggguagugcauuuggcccuaaagguagagccgcucagguuggagggucccgaaggcucuccuuuuccacagcucacuccucuucauuuugggcagagacacagauaaggggugagauuaaaacccacccaguuugugcgugguaguauaugccuuuaauccuagcacuugggaaguaggguaagaggaucucugugaguuuggggccagccuggucuacauagugggacccugucuuaaaaccaaacaaaacaaacucaccuagucagcugugguuauagcuaaguaguagacugcuuguuuagcaugcuugagauccugaguuugauccucagcaccaaaauacauacaaauaaacauacauacauacauacauacauacauacauacauacauacauaccgacaccugauuuuuuuucuugguuuuucgagacaggguuucucuguauagcccuggcuguccuggaacucacuuuguagaccaggcuggccuugaacucagaaaucugccugccucugccuccuaaaugcugggauuaaaggcgugcgccaccacgaccagcgagacaccugauucuuaucacaaaccuaccuccagcaucucccucccaaaggcaucagcccuggacccugugacacaucuagaugaucagaaugggaucaucuaagcuacacacagaguuagaaccuggacacuuaaaacuucaacuggguuccaaauuggcacuccugacuagagacugcauauccgccugaguccagcaguauaaauguaacacuguaaaucuaccacaaguagagggccgauuucucccaggcagaaaccuugugaguucaccauccuggacagaucuauaugcagaguccccuuuaaguggcuaccucuguaggcucaauggaaaugauacagguuccaacagccagaaccuuagagaaacuccugcccuuguggaucuggucucccggaguagguaaaccgggugcuucaguuaacuuucaaccaauuuccugcaggucaaaagcucuccccgcugcacuccaggcucacuucacagaccauaaagucaaggaaagcgaaacagggcaucaagauucacagcuagacacuaggaccggcucacccagcuccugcgcgggcuggaccaguccagguccucagagcaucccaggcacgcgccagcccugcuccuuguagagucucgggauccuaucgucaaccgggauguggggcgcggccgggauggggggugggcgggcacccacuuaccagcagcuccacgaggcugccgggucaauaagaaggaggcggcgaggagaggaggcggaggaccggaccggcucaagacugcagcaugagugagggccuucuggguccucccugucauuuaaacagccccucgugagucaccgcacggggcagugucggccugcggggcggggcaaccucugggagcaucaucagggaauuguguucaaguugaaggggcguucaucgacugcacuugaaaauaaguuucuucuuugccucuccuuccccaucuccuucggacucgcuguguccagugugacacuggaaagggguuuucugccaccgcaguaggacugaguaacugggacccagcucuugccuuaggcaccaguucagguugugauugaagucgggcuuucugugaccuuuuaguccacucucugcuuccuucuccaucccccuuccuuuucucccccagccccgaauucuaaaauuuguauauagaaauaacuccaauuuuagagaaaauaugcaagaacauuauaaggcacacucgaaugugucauccaauucag

SEQ ID NO: 10812 - RNA, 2501 nt, Mus musculus
cugaauuggaugacacauucgagugugccuuauaauguucuugcauauuuucucuaaaauuggaguuauuucuauauacaaauuuuagaauucggggcugggggagaaaaggaagggggauggagaaggaagcagagaguggacuaaaaggucacagaaagcccgacuucaaucacaaccugaacuggugccuaaggcaagagcugggucccaguuacucaguccuacugcgguggcagaaaaccccuuuccagugucacacuggacacagcgaguccgaaggagauggggaaggagaggcaaagaagaaacuuauuuucaagugcagucgaugaacgccccuucaacuugaacacaauucccugaugaugcucccagagguugccccgccccgcaggccgacacugccccgugcggugacucacgaggggcuguuuaaaugacagggaggacccagaaggcccucacucaugcugcagucuugagccgguccgguccuccgccuccucuccucgccgccuccuucuuauugacccggcagccucguggagcugcugguaagugggugcccgcccaccccccaucccggccgcgccccacaucccgguugacgauaggaucccgagacucuacaaggagcagggcuggcgcgugccugggaugcucugaggaccuggacugguccagcccgcgcaggagcugggugagccgguccuagugucuagcugugaaucuugaugcccuguuucgcuuuccuugacuuuauggucugugaagugagccuggagugcagcggggagagcuuuugaccugcaggaaauugguugaaaguuaacugaagcacccgguuuaccuacuccgggagaccagauccacaagggcaggaguuucucuaagguucuggcuguuggaaccuguaucauuuccauugagccuacagagguagccacuuaaaggggacucugcauauagaucuguccaggauggugaacucacaagguuucugccugggagaaaucggcccucuacuugugguagauuuacaguguuacauuuauacugcuggacucaggcggauaugcagucucuagucaggagugccaauuuggaacccaguugaaguuuuaaguguccagguucuaacucuguguguagcuuagaugaucccauucugaucaucuagaugugucacaggguccagggcugaugccuuugggagggagaugcuggagguagguuugugauaagaaucaggugucucgcuggucgugguggcgcacgccuuuaaucccagcauuuaggaggcagaggcaggcagauuucugaguucaaggccagccuggucuacaaagugaguuccaggacagccagggcuauacagagaaacccugucucgaaaaaccaagaaaaaaaaucaggugucgguauguauguauguauguauguauguauguauguauguauguauguuuauuuguauguauuuuggugcugaggaucaaacucaggaucucaagcaugcuaaacaagcagucuacuacuuagcuauaaccacagcugacuaggugaguuuguuuuguuugguuuuaagacagggucccacuauguagaccaggcuggccccaaacucacagagauccucuuacccuacuucccaagugcuaggauuaaaggcauauacuaccacgcacaaacuggguggguuuuaaucucaccccuuaucugugucucugcccaaaaugaagaggagugagcuguggaaaaggagagccuucgggacccuccaaccugagcggcucuaccuuuagggccaaaugcacuacccuagggcagaccgugacugcugagauaacacaagaacucaaggugcugagcauugccugccagggauuucuagcuggcacuacccauugcaggcagcucucggaugugugggugucccugcucugugacuuggaaauuccuuaagcaggucucuuuuucugcaucgccugaacaucuggaguagauucaggaccagacaguucaauuugccuguggucaugagucagcugcugggcucagcaacaacugugacagggaaggcauguugagagggucguggccaggaagagcucugagaagaccccacagcaaguauaggaagguuccucccggggcuuggggacacuacccagauuagcucugucaauggaggaugugaagccugaaguggaaguagauccagaugugcagagaugagagagagagaugggagacgcacugcccagggcuuguccugccagcgaacacgccaaggcugugauuacagaugacaauuugccucccugccuccagacuucagaagaaccccugaagcugcagguuccagugccugccucggcuguggagcacggggcuaaacagagaccauaccauuucccucucagaccuaaggugcuccacugagaaguggucucuguagacugaguuucaaaagagacucuggcuucuuaugaaag

SEQ ID NO: 10813 - RNA, 2501 nt, Mus musculus
cucccuugggacuggaauuacaggcaguuguagauucacguggguguugggaauugaacccugguccucugcaagagcaagaagcacuccuaaccucucuacugccaacagccuguuagucacaggcccacagcuucaugcagaggccuucaugaguuucacccauuucugauuuacucgaugccacccagaccacucuggaaacuuaagaugucugugcugacauuugaaugauuaaauauuggagguuguuaggagguacgggguauguuuuucaugugaagacauucuuuggagggggcagagguagacugcaaaugauccaauauuaguggcuaaaauucauguaguucaaaccuaacucucggugcaaucuuauucagagguggggcucuugggaagugugaggucaacagaacacacuguggaugagauuaacauccacacaaaagaagaccaagaaaggcaggguuuucauccauucugcuggguggggauacacugagcagauaccacccaugaggaagaggggccacacuagauacuaaaucugccagcacuuggacuuuggguuucuccaccuuuagaaccguagacaguccacuuccaucacuuguaauguacccacucugaaguauuuuguugcagcagccuaaguggacuaagacaggcgagaaagaaaagguaguuuagguaaaaauaacuguaggcuuuuuuuuuaaaggcacgacacaccuuaaagugaaugggagauaucaccuggagucagagaguaguaggaguggugggaacagggcagccugucuccaggaaaaaagauagggcagaggagagaacucaggacagcucaggccccaagggcuaggagagaggaagaguuagcaaaguuaguggcaaagccaugguccuuccugaaugauggccauuauggaacuggcauacacucuccauuccuuagugcaaagugcucuauuuuccucaggauggauuuuagacuaagucucaagaagcuauauuuaaggcuaccuauuuaaaaagaaauacuauagaaagagacaaggaacaaagagguaaugggcuuuaccagucaagagugacagaagacugcagugguccccaugcaaagcuguucuuggccugauuaacaaucuacagucaccaugacuguguagccagaagggacaauuucugggaaaagcuugucuccaacaucccucuuccuaucacuuuaugccuuccauaagcagauguuuaaaauauauauauuuagaaaaauggcuaaaagcaguuuauugcugcuugauacaaacugguuuuaacagagguuaaaaacucucuuuuuagauagcaaucuccaucgcugagauugugguaaaaguaaaggccaaagauaagacaauauuccaaccaggacuguguugcuacacacagaaaaacagucacuccccacaagguguacauggccucucucucuggaaauacagggugaacugagaacagagaagcuaucuuuuacccuucaaguucaugugaccacgugagaacaaccccaugcauggguccuacuaagaucacugaaaauacagaacuuucuggaguguccauuuaaacuugcagugugugugcuggauugcguucuuauauacaucuaaucuacccuacuauccuccaugauccuuuaaaaugaaaacuguuaaaauccucacaccugacagcaaaaaaccaauccucuauuuuagauccuuuggaauagcaagaacaaaccucagcauucuggacggcaaaccugaaggaauauauauacauauguaggucucaacagaaccaguggggucagcaucuggaaacuguaagcuuaccugucacagccuucaucgaggucuugacaaucacacaaacaggcagccacgugguucuuuuccccauuucgaucuauguauucgcaacagcacaggggcuccaauucagguucuucgguuuucuuuuuuuugacuggcuucauauugcccuuuaguguacggauuuguaccugucaccaugaggcauaagaagcucacagaagguaaagguggcaagaacucaacucacauccuguaaacacauccuugcuucucauuaacgccaacgccugagcaauaaaaaaaugaaaaggggggaaggguccugcuuucaucaggcuuuucgggcuccgcguggccugacaggaggguuccuugacuucuggggcucugagcaccuuccccuccccuucccagcuaggcuagcaacaucugggcaccagccguucccauggcgacagccgaccacgcggcccgggacagcagagcuagggcggcccaguucaccugagggugccggcucaaagggccgggcuguccccaccccaaggcugcgcgccguggaaacucacccucgcaggugcaggcagcgacgcccuggcgcugcaaccacccaccggcccggggaugccaggagccccagcagccccgaggucgcccguc

SEQ ID NO: 10814 - RNA, 2501 nt, Mus musculus
gacgggcgaccucggggcugcuggggcuccuggcauccccgggccggugggugguugcagcgccagggcgucgcugccugcaccugcgagggugaguuuccacggcgcgcagccuugggguggggacagcccggcccuuugagccggcacccucaggugaacugggccgcccuagcucugcugucccgggccgcguggucggcugucgccaugggaacggcuggugcccagauguugcuagccuagcugggaaggggaggggaaggugcucagagccccagaagucaaggaacccuccugucaggccacgcggagcccgaaaagccugaugaaagcaggacccuuccccccuuuucauuuuuuuauugcucaggcguuggcguuaaugagaagcaaggauguguuuacaggaugugaguugaguucuugccaccuuuaccuucugugagcuucuuaugccucauggugacagguacaaauccguacacuaaagggcaauaugaagccagucaaaaaaaagaaaaccgaagaaccugaauuggagccccugugcuguugcgaauacauagaucgaaauggggaaaagaaccacguggcugccuguuugugugauugucaagaccucgaugaaggcugugacagguaagcuuacaguuuccagaugcugaccccacugguucuguugagaccuacauauguauauauauuccuucagguuugccguccagaaugcugagguuuguucuugcuauuccaaaggaucuaaaauagaggauugguuuuuugcugucaggugugaggauuuuaacaguuuucauuuuaaaggaucauggaggauaguaggguagauuagauguauauaagaacgcaauccagcacacacacugcaaguuuaaauggacacuccagaaaguucuguauuuucagugaucuuaguaggacccaugcaugggguuguucucacguggucacaugaacuugaaggguaaaagauagcuucucuguucucaguucacccuguauuuccagagagagaggccauguacaccuuguggggagugacuguuuuucuguguguagcaacacaguccugguuggaauauugucuuaucuuuggccuuuacuuuuaccacaaucucagcgauggagauugcuaucuaaaaagagaguuuuuaaccucuguuaaaaccaguuuguaucaagcagcaauaaacugcuuuuagccauuuuucuaaauauauauauuuuaaacaucugcuuauggaaggcauaaagugauaggaagagggauguuggagacaagcuuuucccagaaauugucccuucuggcuacacagucauggugacuguagauuguuaaucaggccaagaacagcuuugcauggggaccacugcagucuucugucacucuugacugguaaagcccauuaccucuuuguuccuugucucuuucuauaguauuucuuuuuaaauagguagccuuaaauauagcuucuugagacuuagucuaaaauccauccugaggaaaauagagcacuuugcacuaaggaauggagaguguaugccaguuccauaauggccaucauucaggaaggaccauggcuuugccacuaacuuugcuaacucuuccucucuccuagcccuuggggccugagcuguccugaguucucuccucugcccuaucuuuuuuccuggagacaggcugcccuguucccaccacuccuacuacucucugacuccaggugauaucucccauucacuuuaaggugugucgugccuuuaaaaaaaaagccuacaguuauuuuuaccuaaacuaccuuuucuuucucgccugucuuaguccacuuaggcugcugcaacaaaauacuucagaguggguacauuacaagugauggaaguggacugucuacgguucuaaagguggagaaacccaaaguccaagugcuggcagauuuaguaucuaguguggccccucuuccucaugggugguaucugcucaguguauccccacccagcagaauggaugaaaacccugccuuucuuggucuucuuuuguguggauguuaaucucauccacaguguguucuguugaccucacacuucccaagagccccaccucugaauaagauugcaccgagaguuagguuugaacuacaugaauuuuagccacuaauauuggaucauuugcagucuaccucugcccccuccaaagaaugucuucacaugaaaaacauaccccguaccuccuaacaaccuccaauauuuaaucauucaaaugucagcacagacaucuuaaguuuccagaguggucuggguggcaucgaguaaaucagaaaugggugaaacucaugaaggccucugcaugaagcugugggccugugacuaacaggcuguuggcaguagagagguuaggagugcuucuugcucuugcagaggaccaggguucaauucccaacacccacgugaaucuacaacugccuguaauuccagucccaagggag

SEQ ID NO: 10815 - RNA, 2501 nt, Mus musculus
aacacuaaauucuuaagacucuucgaagaccuguuuuaaccagucugaggugacuuacagauucugaagccacuuguggguuaaaaaaaaaaaaaaaauucagaggggcuaaaaguucaaugaccuuguaaauuaagagcuaaaaaaaauuaaauaaauaaaaacucauacuagugugauagccuagccaauccccacaaaauugcaggaaaacacucgcccggaaauugcuuuuugggaaaauuccuaugagguagaggggaaagaggaggacgacgaggaagggcuauuagcaaaugcuuagauggugaagaggguacaaaugaagagaaauaaaaccagcugccacgcaaacaacuuccaggcaucucuggauaaaaaggaaaacaagccuugugcugcaugcuggagaguuggaugaauggggaagacuuguuauacaccuagugguggguggauuucacaggcugcagccuccacacagcuuuucuuugcugcacugcagaggcgccaucuucuccgucuuaaucuucacccuauucaauccuuuuaucugcaccccuuuuuuuuuuuuuuuaaaaaaaaaaggaacccugaggacccuccccagcauccugugucccccccagggugacuaagcuagaguucccaaaucugccccauaggaggccgcaccuuaaucagacaaacgccuccuuugaugcccuggagccucagccuccccaccaccaggcacugcccuucccagacgcacgccucacucccggcucgcucucucucucucucucucucucucucucucucucucucucucucucucucucucucucucucucaggacuuugcagucccucacaggauugccaguaggugguggugaugcgggggugggagaccgcggggcccuagcagcaccucuaggcccucgggggcagacgcgcagcucggggaaaggaacggcgguggcgcaccaacuaccagggcuccgccaccgcgcccuggacggcgagggcggggugucgcggcuuuuguucccggggaccuucucagacucagggagaaacuggaggugcacugaagaguccuggacguccagguugagggacggugccggguggccgcacuuuccgaucccucccaucacuuggaacuuacacaaaagggagacacgaaaaugcacaaaguuugcaaaaggaaggcggcggugcgcgaccccgcaccgacucgggagagggucgcugcgcaggcagccgccgcccgcggccgccaggagcaaagcccagcuucgcagucaagacaggcgggggugggaagggagugugagccaggcgcuccccagcauccagagcugcccccauuccaacccaggaccccaaggaaggggaagggcggcgauuuccucgcagggcacugaauccugagacgcuacgcuuucgguuuuccacacgugucccuucccccucgaacugggugucucucgcaucccggaguccagcucucaacgcagggaggagucagggucugcguucaggcucguccccucgccuuccagcccuaggcuggcacggauauggggaccccagcgcccuaacccauucccucuucaucgcucgggcagcgcguccccgggcaggguugggccagagccgccgaagcgcagggcgcccgcaggcgggggcggcgaggagcggucuacccgugacagccccccacgucucgagauucaagcuccucgguggggaggaucgcguccucccggcgcccgccuccccagucucguucccaaggcgcggcacccaccuccagagcccgaaccguccaggcggccagcaggagcagugccaagcugggcagcaucgugauccugcgugggccaccgagugcuccgugugcgaguggaagauccgccgcgcccuggcuguguccgcgccgccgccgccgucuccgguggccccgcgcucgcucugcucccggugcucucgccucccgccgccgaggaaacugacagagcuggagcgaggcggcggggcucgcagccggcagagucagcugaucccgcccacccggcucgccacccgacagagaccccuagcggagccucggggagcugcgcccgagcgcagcgggaggcgacccagagcccacaggugcggcgucuugggcuaaggggagccgcgcucccgauggggucugggaaccaaguuggggagugaucugggucagggagaggaccccgcaaucgggagaaggugaaccguaggacguuaagguuccagggaagucgggagcgcucucggcucguccccgcgcgagcuugagucacccgaccccgcaggccucucccaaaugugguugaggagcuaaggcugcgaugcgugcauuuuuauccgcaguucguucucucuauuuggagagguggagcgaggccgagaacauuagcaaaagaaacaggauuuuuuuuuuuucuauuuucuuuuucuuuugguaggaggucacccuuc

SEQ ID NO: 10816 - RNA, 2501 nt, Mus musculus
gaagggugaccuccuaccaaaagaaaaagaaaauagaaaaaaaaaaaauccuguuucuuuugcuaauguucucggccucgcuccaccucuccaaauagagagaacgaacugcggauaaaaaugcacgcaucgcagccuuagcuccucaaccacauuugggagaggccugcggggucgggugacucaagcucgcgcggggacgagccgagagcgcucccgacuucccuggaaccuuaacguccuacgguucaccuucucccgauugcgggguccucucccugacccagaucacuccccaacuugguucccagaccccaucgggagcgcggcuccccuuagcccaagacgccgcaccugugggcucugggucgccucccgcugcgcucgggcgcagcuccccgaggcuccgcuaggggucucugucggguggcgagccgggugggcgggaucagcugacucugccggcugcgagccccgccgccucgcuccagcucugucaguuuccucggcggcgggaggcgagagcaccgggagcagagcgagcgcggggccaccggagacggcggcggcggcgcggacacagccagggcgcggcggaucuuccacucgcacacggagcacucgguggcccacgcaggaucacgaugcugcccagcuuggcacugcuccugcuggccgccuggacgguucgggcucuggaggugggugccgcgccuugggaacgagacuggggaggcgggcgccgggaggacgcgauccuccccaccgaggagcuugaaucucgagacguggggggcugucacggguagaccgcuccucgccgcccccgccugcgggcgcccugcgcuucggcggcucuggcccaacccugcccggggacgcgcugcccgagcgaugaagagggaauggguuagggcgcugggguccccauauccgugccagccuagggcuggaaggcgaggggacgagccugaacgcagacccugacuccucccugcguugagagcuggacuccgggaugcgagagacacccaguucgagggggaagggacacguguggaaaaccgaaagcguagcgucucaggauucagugcccugcgaggaaaucgccgcccuuccccuuccuugggguccuggguuggaaugggggcagcucuggaugcuggggagcgccuggcucacacucccuucccacccccgccugucuugacugcgaagcugggcuuugcuccuggcggccgcgggcggcggcugccugcgcagcgacccucucccgagucggugcggggucgcgcaccgccgccuuccuuuugcaaacuuugugcauuuucgugucucccuuuuguguaaguuccaagugaugggagggaucggaaagugcggccacccggcaccgucccucaaccuggacguccaggacucuucagugcaccuccaguuucucccugagucugagaagguccccgggaacaaaagccgcgacaccccgcccucgccguccagggcgcgguggcggagcccugguaguuggugcgccaccgccguuccuuuccccgagcugcgcgucugcccccgagggccuagaggugcugcuagggccccgcggucucccacccccgcaucaccaccaccuacuggcaauccugugagggacugcaaaguccugagagagagagagagagagagagagagagagagagagagagagagagagagagagagagagagagcgagccgggagugaggcgugcgucugggaagggcagugccuggugguggggaggcugaggcuccagggcaucaaaggaggcguuugucugauuaaggugcggccuccuauggggcagauuugggaacucuagcuuagucacccugggggggacacaggaugcuggggaggguccucaggguuccuuuuuuuuuuaaaaaaaaaaaaaaaggggugcagauaaaaggauugaauagggugaagauuaagacggagaagauggcgccucugcagugcagcaaagaaaagcuguguggaggcugcagccugugaaauccacccaccacuagguguauaacaagucuuccccauucauccaacucuccagcaugcagcacaaggcuuguuuuccuuuuuauccagagaugccuggaaguuguuugcguggcagcugguuuuauuucucuucauuuguacccucuucaccaucuaagcauuugcuaauagcccuuccucgucguccuccucuuuccccucuaccucauaggaauuuucccaaaaagcaauuuccgggcgaguguuuuccugcaauuuuguggggauuggcuaggcuaucacacuaguaugaguuuuuauuuauuuaauuuuuuuuagcucuuaauuuacaaggucauugaacuuuuagccccucugaauuuuuuuuuuuuuuuuaacccacaaguggcuucagaaucuguaagucaccucagacugguuaaaacaggucuucgaagagucuuaagaauuuaguguu

SEQ ID NO: 10817 - RNA, 2501 nt, Mus musculus
aauggccuuuuucgggcugcugagacucagcggucagagaaaucguaaaguaggauaugaauaccagcuccuagggacaagucggaaaagagggagaaaucuagaaaagggcaaaaagaaauuugaaugauuaaaaagaacuaacuggcugguagggacugaacacggcagagucaggcgaauguguagcagggaggaucaguccaggcuaacauuccucagcgcuggggaguccaaccucugccgggagagggagugcgagcaacgaggccgagguaggaggcgcguggaggcggggcgagccaagcaaagaccucccaagcagguucugcagaggggcccaacggagccaccagccaucggggucagcuuuucaaaugggggaaggggacagacggaaggccacagaaaugagaucaccacugccguugcccaggcuccugaacgcacauccaggucaccauggcuccucuacuccgcccuccuuugagcgcuacgugcucacacggacugacguuacaaaacucagcgcgaaacuacaaccuaguuaaagugaacucauacauucacuaaaggcauuaaagggauggagagagauucuucaguguaaggagucggguuauuggcuucgcggaggaaacgcuuagcccuuaucuacaggaccuccgauucuuucucucuuucucaaauuauuaacuauucgggcaaauaaguguucuagcagaguauggucacacuuuuuuugggggggggagcgggaaggucacgacccagaacuucaauucacugcaagucugagucauucgcauuuagaggcgaucuggagugugaccccaagucacgccucguaaagacugagagaugggggucacucuuauaccugauggcuuucccgcguccugaggcguggggucccgcacaggccacugguuccggguguucuggcucucgggucgcgagucgcugguuggcagggucucgucguccaugacgccgcacuuggcgccgccacugccccgccgccuucgccucaggauguggaacugcggccgugcggaugacuccuccucgggcacggcaggggccaggcgcucgguggccacuccaggcgcuggcugaaugaagaacuccucuccuuguagguagaaggcaccacgcacaccuucacagaggcugagggcugcggcagagccgggaucaccguucaccgugccagaguagaagcagugagccagguccccggugggguccagauguugugccucggacccgggacugcgccccacagucugcagggugaagccaggcgccaagaaaccgcuguccggcugcaacuucagauguagcugcuggccaaaggcguccagacgaaggcguguggugguggaaucguggcccggggcgcgcuccagcgagggcaggaccagcuccucaucuuccuccguggggcgcccgugugcgccccgcgcacauagcagcauuguuauggaagcgaggagcagcaacagcaugugugcggacagagagccccgagaucucgcugcccgcuggacgucccccaugucggagcagggcuucugcuugcgugaccccaaagggacuuuuggcugcauggcaccgcacccugcaccgcagagaacucuuggucuggauagacguuuagacgcguagagcuucgcuggccugcuccugaugcuuaaaauucacgaucacuuugaugggaaaguucgugcagagcuagcacccgaagcuccgggucacuuagaaagauucugcacuggcgcgcgggaauuuuuucauuccagcaccgaguugguggcuccgcacugcuggcugcugcaggaccuagaagcgcccccggagcuggggaacaaguccagaauaggagccuggacucuucguccuccgccuuggccccgauuugacucgaucugagcaaggaucugcucucuccgccgggcugugcgcucuggccuugcgauagcaccuagcucggagcugcuuucuagcgagugcaaggaccaggcagccccggccgccccuuuauagccacauaggagccccuccuucccccaacacugcgacaccgcccccugagcucagucggugcuaaaccgagcucugcgccucggggccugaagggggagggggcagccuccgcccuggccucacgccacagcucgucacucuggggguguaagacgccgaaacagcgcugggaccagcacuuuguacagcgcuggcugcucuggggaaaagagugaaccuuuaacuucaucucucggcugcugauucccggaccacccugcuuccugucgcccuuccugugccccggcugggcugcaguuuccaagaaagagggucgaauugaaaagauuccucaacauuccuuuucuccccuagucagagccucuucugccccaaagugggcuauuagcuacagcugccuuuucuuaaaaagcacccuacuuuuccgucucgucuacguuuccaugggcacc

SEQ ID NO: 10818 - RNA, 2501 nt, Mus musculus
ggugcccauggaaacguagacgagacggaaaaguagggugcuuuuuaagaaaaggcagcuguagcuaauagcccacuuuggggcagaagaggcucugacuaggggagaaaaggaauguugaggaaucuuuucaauucgacccucuuucuuggaaacugcagcccagccggggcacaggaagggcgacaggaagcagggugguccgggaaucagcagccgagagaugaaguuaaagguucacucuuuuccccagagcagccagcgcuguacaaagugcuggucccagcgcuguuucggcgucuuacacccccagagugacgagcuguggcgugaggccagggcggaggcugcccccucccccuucaggccccgaggcgcagagcucgguuuagcaccgacugagcucagggggcggugucgcaguguugggggaaggaggggcuccuauguggcuauaaaggggcggccggggcugccugguccuugcacucgcuagaaagcagcuccgagcuaggugcuaucgcaaggccagagcgcacagcccggcggagagagcagauccuugcucagaucgagucaaaucggggccaaggcggaggacgaagaguccaggcuccuauucuggacuuguuccccagcuccgggggcgcuucuagguccugcagcagccagcagugcggagccaccaacucggugcuggaaugaaaaaauucccgcgcgccagugcagaaucuuucuaagugacccggagcuucgggugcuagcucugcacgaacuuucccaucaaagugaucgugaauuuuaagcaucaggagcaggccagcgaagcucuacgcgucuaaacgucuauccagaccaagaguucucugcggugcagggugcggugccaugcagccaaaagucccuuuggggucacgcaagcagaagcccugcuccgacaugggggacguccagcgggcagcgagaucucggggcucucuguccgcacacaugcuguugcugcuccucgcuuccauaacaaugcugcuaugugcgcggggcgcacacgggcgccccacggaggaagaugaggagcugguccugcccucgcuggagcgcgccccgggccacgauuccaccaccacacgccuucgucuggacgccuuuggccagcagcuacaucugaaguugcagccggacagcgguuucuuggcgccuggcuucacccugcagacuguggggcgcagucccggguccgaggcacaacaucuggaccccaccggggaccuggcucacugcuucuacucuggcacggugaacggugaucccggcucugccgcagcccucagccucugugaaggugugcguggugccuucuaccuacaaggagaggaguucuucauucagccagcgccuggaguggccaccgagcgccuggccccugccgugcccgaggaggagucauccgcacggccgcaguuccacauccugaggcgaaggcggcggggcaguggcggcgccaagugcggcgucauggacgacgagacccugccaaccagcgacucgcgacccgagagccagaacacccggaaccaguggccugugcgggaccccacgccucaggacgcgggaaagccaucagguauaagagugacccccaucucucagucuuuacgaggcgugacuuggggucacacuccagaucgccucuaaaugcgaaugacucagacuugcagugaauugaaguucugggucgugaccuucccgcucccccccccaaaaaaagugugaccauacucugcuagaacacuuauuugcccgaauaguuaauaauuugagaaagagagaaagaaucggagguccuguagauaagggcuaagcguuuccuccgcgaagccaauaacccgacuccuuacacugaagaaucucucuccaucccuuuaaugccuuuagugaauguaugaguucacuuuaacuagguuguaguuucgcgcugaguuuuguaacgucaguccgugugagcacguagcgcucaaaggagggcggaguagaggagccauggugaccuggaugugcguucaggagccugggcaacggcaguggugaucucauuucuguggccuuccgucuguccccuucccccauuugaaaagcugaccccgauggcugguggcuccguugggccccucugcagaaccugcuugggaggucuuugcuuggcucgccccgccuccacgcgccuccuaccucggccucguugcucgcacucccucucccggcagagguuggacuccccagcgcugaggaauguuagccuggacugauccucccugcuacacauucgccugacucugccguguucagucccuaccagccaguuaguucuuuuuaaucauucaaauuucuuuuugcccuuuucuagauuucucccucuuuuccgacuugucccuaggagcugguauucauauccuacuuuacgauuucucugaccgcugagucucagcagcccgaaaaaggccauu

SEQ ID NO: 10819 - RNA, 2501 nt, Mus musculus
gcgcggggaaggaaggaggggcuacgagggauuugaaagugcucaagcugcggaguggagcucgcuucuguccccgccgcccgcgagcggauuaaauuucugcaaauucaaacugaauggggcuuucuucugcugccuuccagagggcgccugcagcccgccgcgcgcuccucuccggcgggagcggccccggggagcaccgcugaggacccggcgggccagagggcggcggcgcccgggcuugggggacuccgccaccggacugugccccucucggaccagcagccgcuguucccucucacagccgaucggggcaccagacgggaccgcgggcgcgaucugggcgaucgauccucggaggacgaacuucucgggggcggguccccggucgcccggucgccagcuauugucugcgcgcggcgcuagcacagaggcgcggggggcgugagcacagagacccgggccgggcggggccggguccagggcggcggcaggaggagccagggcagccccgggagccggaggaggagcggcugcgagcgcgggagccgagcgagcgcgaugccggcagcggcgggggacgggcucuugggcgagccggcggcaccggggggcgauggaggcgcggaggacacgaccaggccggcggcggccugcgagggaaguuuccugcccgccugggugagcggcgugucccgcgagcggcuccgggacuuccagcaccacaagcgcgugggcaacuaccucaucggcagcaggaagcugggagagggcuccuucgccaaggugcgcgaggggcugcacgugcugacgggagaaaaggugagcuggggugcgcgggccuggcgggaggacccgggagcacugucccgcgagcacucagccuggcucuccaacccaguguggcuagacgcacgcucaggcucuccuagugggccaccgggcaccuacugauggaugaugguggugaugggcucacguucguggggugggguacccgggcagauagauguacccgcgaagcuaccccgcaccgucuuucuguuuuguuuuggaagggugccgccuggcggacgccagggaagggaggggagagguggcgguggaggguccugcgguaggggcauggaucagugcagaggcgggaacuagauccaggcugggguucagcuuugccuguggaaugugcggcggcgggagagcaaggcagccagucugagguugcuuagaguuucaucccuccugggcucaggcgaggacguggaggggaguuggggcccuguaagcuccccucuccccccgugugggcuggggcaacuguuggaguaacgauccugcuuuuggcaggugcagaacuacacaggcccuggacucuagaaguuugcagauaccuuuucaucuuucuagaagacaguaaaggaaaggggccccucccccacacccggagggacucuacuucgaccuaauuagaagugagagagugaacucuugccaggccgggugcgggcagaucucagguguuaacuuagauuugugaaaagaaacccaagaagcugacuuacuuuugaggcuggguggccucaggcagggaauugcucugggcugccaaacugguaucuuuguagggacccaauacucuaaucacccaggcuggggguuguccgcgcgggcggaggaggggaacucagccgguccuagcagcaaauagcccaagggccaagcccucgggccugcugcucuggguuuccuugcccagccuagggguuugugacagugaugaacugugagaagucuggugacaggccagggccaccacacuagucauuuucuagccucuggauaccuuugauuuccucuugguuucuguuguccuggaaaccccuacauuugagcacuggguuccaucacccuuugacuuuaucuucuuuuucuguagccauuccaaguggggugccccuuuauacuggguaagcaggguuagaccgagcagucauuuucaagugucucuugcccgaauuuccaagcaaaaaaaaaaaaaaaaaaaaaaaaaacacccacaaaaaacaaaaaaacaaaaacaaaaacaaaaaacaaacaaacaaaaaaaacccagcauucaguaugaacucacauuagcucuucaaaggagaaacucuuuagacccguccuaguuguucucaguggaguaagggaauauuuauuuacuuuuuggugcgcagugggcugucugccggacacacaucagugaugcagacugauuucagggagcucauuucuguucuggcagggagaggcgaaggacuuugcucucaaaaucuagaggauuuagucuggcuaugcacaucaccucucuaaagagaucagaacuucuuagagcuuuuugccauguugggcuggaccucagcuccucacuagggcaguuuugccccaugggauaauacuuuuguccuuggcugcacugccugggguauucaggguucagcccugauucaguucuggac

SEQ ID NO: 10820 - RNA, 2501 nt, Mus musculus
guccagaacugaaucagggcugaacccugaauaccccaggcagugcagccaaggacaaaaguauuaucccauggggcaaaacugcccuagugaggagcugagguccagcccaacauggcaaaaagcucuaagaaguucugaucucuuuagagaggugaugugcauagccagacuaaauccucuagauuuugagagcaaaguccuucgccucucccugccagaacagaaaugagcucccugaaaucagucugcaucacugauguguguccggcagacagcccacugcgcaccaaaaaguaaauaaauauucccuuacuccacugagaacaacuaggacgggucuaaagaguuucuccuuugaagagcuaaugugaguucauacugaaugcuggguuuuuuuuguuuguuuguuuuuuguuuuuguuuuuguuuuuuuguuuuuuguggguguuuuuuuuuuuuuuuuuuuuuuuuuugcuuggaaauucgggcaagagacacuugaaaaugacugcucggucuaacccugcuuacccaguauaaaggggcaccccacuuggaauggcuacagaaaaagaagauaaagucaaagggugauggaacccagugcucaaauguagggguuuccaggacaacagaaaccaagaggaaaucaaagguauccagaggcuagaaaaugacuagugugguggcccuggccugucaccagacuucucacaguucaucacugucacaaaccccuaggcugggcaaggaaacccagagcagcaggcccgagggcuuggcccuugggcuauuugcugcuaggaccggcugaguuccccuccuccgcccgcgcggacaacccccagccugggugauuagaguauugggucccuacaaagauaccaguuuggcagcccagagcaauucccugccugaggccacccagccucaaaaguaagucagcuucuuggguuucuuuucacaaaucuaaguuaacaccugagaucugcccgcacccggccuggcaagaguucacucucucacuucuaauuaggucgaaguagagucccuccgggugugggggaggggccccuuuccuuuacugucuucuagaaagaugaaaagguaucugcaaacuucuagaguccagggccuguguaguucugcaccugccaaaagcaggaucguuacuccaacaguugccccagcccacacggggggagaggggagcuuacagggccccaacuccccuccacguccucgccugagcccaggagggaugaaacucuaagcaaccucagacuggcugccuugcucucccgccgccgcacauuccacaggcaaagcugaaccccagccuggaucuaguucccgccucugcacugauccaugccccuaccgcaggacccuccaccgccaccucuccccucccuucccuggcguccgccaggcggcacccuuccaaaacaaaacagaaagacggugcgggguagcuucgcggguacaucuaucugcccggguaccccaccccacgaacgugagcccaucaccaccaucauccaucaguaggugcccgguggcccacuaggagagccugagcgugcgucuagccacacuggguuggagagccaggcugagugcucgcgggacagugcucccggguccucccgccaggcccgcgcaccccagcucaccuuuucucccgucagcacgugcagccccucgcgcaccuuggcgaaggagcccucucccagcuuccugcugccgaugagguaguugcccacgcgcuuguggugcuggaagucccggagccgcucgcgggacacgccgcucacccaggcgggcaggaaacuucccucgcaggccgccgccggccuggucguguccuccgcgccuccaucgccccccggugccgccggcucgcccaagagcccgucccccgccgcugccggcaucgcgcucgcucggcucccgcgcucgcagccgcuccuccuccggcucccggggcugcccuggcuccuccugccgccgcccuggacccggccccgcccggcccgggucucugugcucacgccccccgcgccucugugcuagcgccgcgcgcagacaauagcuggcgaccgggcgaccggggacccgcccccgagaaguucguccuccgaggaucgaucgcccagaucgcgcccgcggucccgucuggugccccgaucggcugugagagggaacagcggcugcugguccgagaggggcacaguccgguggcggagucccccaagcccgggcgccgccgcccucuggcccgccggguccucagcggugcuccccggggccgcucccgccggagaggagcgcgcggcgggcugcaggcgcccucuggaaggcagcagaagaaagccccauucaguuugaauuugcagaaauuuaauccgcucgcgggcggcggggacagaagcgagcuccacuccgcagcuugagcacuuucaaaucccucguagccccuccuuccuuccccgcgc

SEQ ID NO: 10821 - RNA, 2501 nt, Mus musculus
guuuuaacgacugaacugcgcacucugggaugguuacguuucauguuaugaauauuagacugcauuuuuauaacagccaaccucucacuuuggagcccagauuggccuccucuccuuccugcuucaguaguucccagcgaugggauuacuggcugaucacauuuuacaaggacaaauguaacuauaaaaagggauggcaauagagcucgagagauaaagggaggcaaaagccauuuuagccugaccagcugaacuagaauucggaaggaacaauguuuugcccuaaagcucccucccuugcccucccagggcgggcgcuguggcacccgcgcaggcgccccacgauaacccucucuggcaacucuggcuguaccucugcucaggcgaccaaugaacacucgccuguggccaagcucacgccuccauuggcugcaccccgccaaccgcgguccucgcagguucccaagccggguuuaaaggugucaggcgcgcacggccccucacugucauccgccggcacgcagguccgcggggagggcgaucugccgaccggcccaccccugggcguuagugaagggcgccccgggucgccccacagcccccgccccagauguacuaugcgauuucccaggcgcgugugaacgcggcucccgcgaccauguugcggccacagcggccuggagacgugcagcucggggccucgcuguaugagcugguggguuacaggcagccaccuaucuccucauccucauccucauccucuuccaccgcaucccuucuccccaagccugcgcgcgagaaggccgaagcuccgcucgcugaaccucggggaccugcgccagaguccgggggcgcccgggccgacgccaaagaggaacagcagcagcagcagcugcggcgcaagaucaacagccgcgagcggaagcgcaugcaggaccugaacuuggccauggacgcgcugcgcgaaguuauccuacccuacucggcagcgcacugccagggcgcgccgggccgcaagcucuccaagauugccacgcugcugcucgcccgcaacuacauccugcugcuggguagcucgcugcaggagcugcgccgcgcgcucggcgacggugcgggacccgccgccccgcgccugcuccucgcuggccugccucuucuggcugccgcgccgggcucugugcugcuggcacccggugccgugggaccccccgaaacgcugcgccccaccaaguaccugucucuagcgcucgacgagccaccgugcggccaguucucucucccagcugguggcgcggguagcccuggccucugcuccugugcggugugcaaguucccgcaucugguccccgccggccugggcuuggcagcggugcaggcccaguucuccaagugagggcuggcugggcccggggcggagcgcgaccucagccaaucuucccgcgcccccgcguccuggaucuaggcagagcuggccccagaaaggaggacauuuccagacuucucucccagacgacagacuguagggcgccuucuuccccgcccccacucccuggcaauuaaaauaacccaagcggguguuccaaggagcgauguaguugcuugggauucuagaugaaucccaccuguuuagagccagaagucuucgcauccccaccacaacucacccacuggcaggggugacaacccccaccaccgcgggcuauucucguauccgugagcaucgcggagucggggaggacgguagccggccggugcgguauaaggggguugcccugggugcagcgaaaggcugcccccagcuugguuuccuggcaugcuuccgcucccuggccuaagagcugcuccccaacagugucuacccagaggggcguccuuuccuuguccagggccugagcgcacaggcucccuugcucucuccagccaaaccaugcggaucuaggaggucuagaaagcccaggccaccgguacaaacaucaaggguguuacggaugggccgcucuggaaagcccaggguuuccgagcuggauguuacgcgggugcgcucgguuaccgcgcucggugguuggggaugcgaaguggagagguuccucuccacucccaguucuguuuuucaggcucgcccagguguuuuguugcaguuuaugcuccuuaaaaccuaaaacccuuacuuagucuccacuucccuaaagguagcuuaaccaacguuugagcuugcuugaaaacaaaauuccaaccacguuccaugccaucgguguucggacuuacuaaaauagguagcaaggcacgucguagcgcaggcuuauaaaauucggucauuaacguucucauuaaaguaagcggaguugggcgaggaucccaaaccgccuacccgccgcgcugcaggcgggaaggcgcuggcacuucacaggcugguccuuaaccacagcagugcggcugaagaacuccguggacgcgugcgcgcgugggugccgcgucuuggcuugugacuagcguuaggaaau

SEQ ID NO: 10822 - RNA, 2501 nt, Mus musculus
auuuccuaacgcuagucacaagccaagacgcggcacccacgcgcgcacgcguccacggaguucuucagccgcacugcugugguuaaggaccagccugugaagugccagcgccuucccgccugcagcgcggcggguaggcgguuugggauccucgcccaacuccgcuuacuuuaaugagaacguuaaugaccgaauuuuauaagccugcgcuacgacgugccuugcuaccuauuuuaguaaguccgaacaccgauggcauggaacgugguuggaauuuuguuuucaagcaagcucaaacguugguuaagcuaccuuuagggaaguggagacuaaguaaggguuuuagguuuuaaggagcauaaacugcaacaaaacaccugggcgagccugaaaaacagaacugggaguggagaggaaccucuccacuucgcauccccaaccaccgagcgcgguaaccgagcgcacccgcguaacauccagcucggaaacccugggcuuuccagagcggcccauccguaacacccuugauguuuguaccgguggccugggcuuucuagaccuccuagauccgcaugguuuggcuggagagagcaagggagccugugcgcucaggcccuggacaaggaaaggacgccccucuggguagacacuguuggggagcagcucuuaggccagggagcggaagcaugccaggaaaccaagcugggggcagccuuucgcugcacccagggcaacccccuuauaccgcaccggccggcuaccguccuccccgacuccgcgaugcucacggauacgagaauagcccgcggugguggggguugucaccccugccagugggugaguugugguggggaugcgaagacuucuggcucuaaacaggugggauucaucuagaaucccaagcaacuacaucgcuccuuggaacacccgcuuggguuauuuuaauugccagggagugggggcggggaagaaggcgcccuacagucugucgucugggagagaagucuggaaauguccuccuuucuggggccagcucugccuagauccaggacgcgggggcgcgggaagauuggcugaggucgcgcuccgccccgggcccagccagcccucacuuggagaacugggccugcaccgcugccaagcccaggccggcggggaccagaugcgggaacuugcacaccgcacaggagcagaggccagggcuacccgcgccaccagcugggagagagaacuggccgcacgguggcucgucgagcgcuagagacagguacuugguggggcgcagcguuucggggggucccacggcaccgggugccagcagcacagagcccggcgcggcagccagaagaggcaggccagcgaggagcaggcgcggggcggcgggucccgcaccgucgccgagcgcgcggcgcagcuccugcagcgagcuacccagcagcaggauguaguugcgggcgagcagcagcguggcaaucuuggagagcuugcggcccggcgcgcccuggcagugcgcugccgaguaggguaggauaacuucgcgcagcgcguccauggccaaguucagguccugcaugcgcuuccgcucgcggcuguugaucuugcgccgcagcugcugcugcugcuguuccucuuuggcgucggcccgggcgcccccggacucuggcgcagguccccgagguucagcgagcggagcuucggccuucucgcgcgcaggcuuggggagaagggaugcgguggaagaggaugaggaugaggaugaggagauagguggcugccuguaacccaccagcucauacagcgaggccccgagcugcacgucuccaggccgcuguggccgcaacauggucgcgggagccgcguucacacgcgccugggaaaucgcauaguacaucuggggcgggggcuguggggcgacccggggcgcccuucacuaacgcccaggggugggccggucggcagaucgcccuccccgcggaccugcgugccggcggaugacagugaggggccgugcgcgccugacaccuuuaaacccggcuugggaaccugcgaggaccgcgguuggcggggugcagccaauggaggcgugagcuuggccacaggcgaguguucauuggucgccugagcagagguacagccagaguugccagagaggguuaucguggggcgccugcgcgggugccacagcgcccgcccugggagggcaagggagggagcuuuagggcaaaacauuguuccuuccgaauucuaguucagcuggucaggcuaaaauggcuuuugccucccuuuaucucucgagcucuauugccaucccuuuuuauaguuacauuuguccuuguaaaaugugaucagccaguaaucccaucgcugggaacuacugaagcaggaaggagaggaggccaaucugggcuccaaagugagagguuggcuguuauaaaaaugcagucuaauauucauaacaugaaacguaaccaucccagagugcgcaguucagucguuaaaac

SEQ ID NO: 10823 - RNA, 2501 nt, Mus musculus
ggcacaagacacagaggcuuacccacuuucccaugugcucacccugggccagagcuauucauugugcacggggagcagucuuuuaagucuagcuguuuguugcucccuuucagugaaacaggugcccgguaaaucccuuugacuuguaggugcauugucuucuaacuguugaauggcuagcuuauuggaucuuucaguguugugguuauguuuucauguauaaacagccagcuucccuuguuuguacaacacauggcauugcaggcagucacuugauaaaacagaacaugucauauauuuccuauguugcuauuguauaacaaaaccuugccuauucauagacaacaauggcuuuaauguguaaauaacucccaaggagugguaucuugggauacaaugcgggggguggggggggaccuagguagcgccuaaaagccccacccgguacuggcggcuuucucugcuauuccagauuggcuccaaauuccucuccggagucaucugaaaggauucucugucuaacgugcaggacuccaccagugacuuggugcuaccaguucccuugagaccuagcucucugcuucugauggacuaauccuucacuucucgagccaugggagaacgagagaggagagacuugggguacugggugccagcucccgccccugcgaaugucgggcacuuugucuccagcguucagcagucugcgauagccgcagccccuagcagcccgggacuuggcaagcccuugccagcgugcgcuccuccuccugccgcccggcccagcccggcgcgucucggaggugcgauccaggcgacauccagauucaccagcaguggggcggcugcuggcgugaccgaaggacccagcucggagcacacggagggagcucccgggguugccgaagcgagggaggggcgggaggcgccuucgcuugaaggaacugggagggagcgggagaugcugcggcugcuagcaggugggugugcggggagcgcgcggcgaucagcaacggauggggaggugccgggggucgccagaccaguggggcggcuccgcgcgcggcgacugagacccgccccacccgccccucuccuuccaggacacugaugcuccgcuugcucggcagagucaugucauuccugccuaugccgccgccgccgccaccaccaccgccgcccccccgaacuccggggggccccgcugcgcgccagcuaucccggagacccugugcgccgcccgcgccuucaccgcccgcugccuccgccgccggcggcgagaaaaagaggaggccgcccgagaugcugcucuccagcuccuggcccuccgccaccuugaagaggcccccgguacggcgcggccccggccuggguucgggcaccccacagccggcuaccuccgcacgcgucccgccccagcccucuccgggccguggggggaccucgaccacgugcuccgcgccccggcgggucgccugcagccacaucccagcgggauccaccgccucggggaccucugcgggggcgggggcugggcccgacgacgccacgcgcuucuccuugaaccucaccccagaagccauccuggucauccagaggcgccaccuggagaagcaguugcuggcgcgaccccgcaggcccuuccccacacccucugccgacccgcggcucccacugguacccuguccccggaccagggcuucgacccugcggagggguggccccaccaguguccccaacgcgccucuggcuguggcugucagcagccgcccuccccgugccucgcugcugccaggaggucugcaggccacucugcccagcccgugccccuccagccugcgcccagugcuuaaggugucgcugcucaaugagaagcacaaguacgaugaugaggaguacgaggaggagguggaggugguggacgagggccucgugcgcaagugcaccgaguggcugcguggggucgagucggcggcagcugcgaggggccgcacagggcaucuggacucgcugccacaccugagcacccugugaggcuaggugggccugugggacccagccuggcuugaagcccacggccgccuccugggcuccuugcacaccugggcucuugugaaccagguaggccagcaagggacaggacuauugccugguaccuuccccaggugugcuuauucaugagugacccacaggcuuuucuaacgccucaccacccaccuccugugcaauuaggucagcgugggacacaacagacucgccugacucuagcagcuguccccugcuccuccugcuccccgcccucccuaaugugggggucgggggaggaccugugaaaugccuucuaaccucucacccuaacuaaguauuggacccagagguccucugccccagguggcauuccacuuccuggggacucugcaagccuguggccaccgaggguggggugaucuucuguugcagaacuaggacauggugcuaucuauguauaggauuuguuuccu

SEQ ID NO: 10824 - RNA, 2501 nt, Mus musculus
aggaaacaaauccuauacauagauagcaccauguccuaguucugcaacagaagaucaccccacccucgguggccacaggcuugcagaguccccaggaaguggaaugccaccuggggcagaggaccucuggguccaauacuuaguuagggugagagguuagaaggcauuucacagguccucccccgacccccacauuagggagggcggggagcaggaggagcaggggacagcugcuagagucaggcgagucuguugugucccacgcugaccuaauugcacaggagguggguggugaggcguuagaaaagccugugggucacucaugaauaagcacaccuggggaagguaccaggcaauaguccugucccuugcuggccuaccugguucacaagagcccaggugugcaaggagcccaggaggcggccgugggcuucaagccaggcugggucccacaggcccaccuagccucacagggugcucagguguggcagcgaguccagaugcccugugcggccccucgcagcugccgccgacucgaccccacgcagccacucggugcacuugcgcacgaggcccucguccaccaccuccaccuccuccucguacuccucaucaucguacuugugcuucucauugagcagcgacaccuuaagcacugggcgcaggcuggaggggcacgggcugggcagaguggccugcagaccuccuggcagcagcgaggcacggggagggcggcugcugacagccacagccagaggcgcguuggggacacugguggggccaccccuccgcagggucgaagcccugguccggggacaggguaccagugggagccgcgggucggcagaggguguggggaagggccugcggggucgcgccagcaacugcuucuccagguggcgccucuggaugaccaggauggcuucuggggugagguucaaggagaagcgcguggcgucgucgggcccagcccccgcccccgcagagguccccgaggcgguggaucccgcugggauguggcugcaggcgacccgccggggcgcggagcacguggucgagguccccccacggcccggagagggcuggggcgggacgcgugcggagguagccggcuguggggugcccgaacccaggccggggccgcgccguaccgggggccucuucaagguggcggagggccaggagcuggagagcagcaucucgggcggccuccucuuuuucucgccgccggcggcggaggcagcgggcggugaaggcgcgggcggcgcacagggucuccgggauagcuggcgcgcagcggggccccccggaguucgggggggcggcgguggugguggcggcggcggcggcauaggcaggaaugacaugacucugccgagcaagcggagcaucaguguccuggaaggagaggggcggguggggcgggucucagucgccgcgcgcggagccgccccacuggucuggcgacccccggcaccuccccauccguugcugaucgccgcgcgcuccccgcacacccaccugcuagcagccgcagcaucucccgcucccucccaguuccuucaagcgaaggcgccucccgccccucccucgcuucggcaaccccgggagcucccuccgugugcuccgagcuggguccuucggucacgccagcagccgccccacugcuggugaaucuggaugucgccuggaucgcaccuccgagacgcgccgggcugggccgggcggcaggaggaggagcgcacgcuggcaagggcuugccaagucccgggcugcuaggggcugcggcuaucgcagacugcugaacgcuggagacaaagugcccgacauucgcaggggcgggagcuggcacccaguaccccaagucucuccucucucguucucccauggcucgagaagugaaggauuaguccaucagaagcagagagcuaggucucaagggaacugguagcaccaagucacugguggaguccugcacguuagacagagaauccuuucagaugacuccggagaggaauuuggagccaaucuggaauagcagagaaagccgccaguaccggguggggcuuuuaggcgcuaccuagguccccccccaccccccgcauuguaucccaagauaccacuccuugggaguuauuuacacauuaaagccauuguugucuaugaauaggcaagguuuuguuauacaauagcaacauaggaaauauaugacauguucuguuuuaucaagugacugccugcaaugccauguguuguacaaacaagggaagcuggcuguuuauacaugaaaacauaaccacaacacugaaagauccaauaagcuagccauucaacaguuagaagacaaugcaccuacaagucaaagggauuuaccgggcaccuguuucacugaaagggagcaacaaacagcuagacuuaaaagacugcuccccgugcacaaugaauagcucuggcccagggugagcacaugggaaaguggguaagccucugugucuugugcc

SEQ ID NO: 10825 - RNA, 2501 nt, Mus musculus
cacaggauccauguucaaugcccagcauccacguggagccucacagccaucuguaacuucaguuucaggggaaucuggugccuucuucaaggacaccguaagguaugugguaaacagacauaaauucgaacaaaauacucacacacauagaauaaaaaaauauucucuuaauuuuuucgaagaaauuaaccuacuauagcuagagaguuggccuuuggaggggggggggaucaauucuuagcagccacgcaggcugcucacaaccuguaacuccagcuccaaggacucugagacccuuuucuggccucugcauggcagacacaauggacacgcaugugcgcacacacacuuuaaaaauaaugguguaaaaaaaaaaagugaauucuaaggcaaaggccgcaggucuguaguagaguacuugcuuagcaugccugggcccuagguuggauccccuguaccaacgccuucaaaagaaacaaauuccaguuaucuagcaagaccgugacuuccacagcacuagaccagcuguguuaauucuuggucacagcagcccuaaauccaaaauuuucuguucuaaauguuccccccugggccuacuauuguuuaaggggcacccuuccuccauaucaugaaguuaccggggcagcaaucuaucuuugggcagcuaauuggucuauaagccgcagugcagcagugucucccuccaaauacucuccaaaaugagaaauagaauucuggucagcucauucuuacacuaacaaguccuacaaauuauuaacuccaggugagagaacaaaacucucugauacaaaggacuaaagagccuggacuaccauuagaaacaucaaguuuggcucagccccgucucauucugagucacuuuugaaagucaaggguaaagcuggcuucaagauucucuucccgcuuccuucuuaucaaaguuuuuaaaacaagaaaagauuugguuucccuucacccuaaagagcccagaggaggccugucuccaaacuaaugguauuggaaguucccuaggcccacaagucuguguccaacaccaacaaacuucgacaggacuggaaauuauacaaccuuggaucccagagcagaagacuccacuagaauaaucuacucuggagacaaugacaucaugugagcaaccacacaggaagcuaacugagagacgugaaggguaaagucuugaaagccuacagagaugaccaccucucaacccuugucaaaagaagaaaaagcuucaaccacugacaaauggcuacuuuaaauaaggaaaacugagaguugccacagaaggggucaaucugcaguugaaaccaccacuacccaacuccaagagcaucgcguggguucgcacucccuggagacugcacacuagaggggacgccuccgaagccccacggcuggaacuucaauggaaacgugcagcgggacaaaagcccagccuuagcucugcccccugcaacuuccgacggacacaccgggccccgggagucgcacaaagccgcccgacuuaugacagccacaaguggccgggcacggggggcuccgggggccagugccacggcggcgcguccuccugcgccgccgcggccaccacgcgggcaacuuucccgcgggggcggggcggggcggaggucugcguguccucggggcuccgcgcccgccacgcaagacacccaccugcacagggcguccaagucgacggccugggccugcgcggagcccgcggccgccaggagcagcagcagcaggagcggcggcaggagcgcgacgcgcggcccggagggcaccggucccagcugaacggcccgcaucgcguguggcguggggcucacggcggcuggccguuuggagccgcgccugggacacggucgcgccaccacagcggagucgaagcugcaacgggagcuggagggagaaagaggagagagaacuggagccaggggggagugcgacgaggaggcgcuccguggccguccccggagcgucacgugaccugagucggcccgcccccgccccgccuccugcucacgugacguccucguucaggugcucuccgcccagucccgggucacaugagcaucgcacgcgcgcgggacaggaaguguugcgggccgggcacgagcgccagguaccuacucgaggccugacaaccccaggguugcucacgcgcggcgaggggugacgccucagagccagaccucaguuuccccguccagcacccagguugcgucugcgcuugagcgcuuccuaacucucucuucuucaaccgagaccaguacgguggccgagauggaguuagguggaaaagcccagguugauguuuaguguugcaaguggaugcaggguuaagaggucagucuuucuagaaucccgcgugggaguuuccgacucaugccccggagagccucacagcagcucuguggaaaugugacuucccaagcagggcuuucuacagcaaguuaggugacugguggacuaauaug

SEQ ID NO: 10826 - RNA, 2501 nt, Mus musculus
cauauuaguccaccagucaccuaacuugcuguagaaagcccugcuugggaagucacauuuccacagagcugcugugaggcucuccggggcaugagucggaaacucccacgcgggauucuagaaagacugaccucuuaacccugcauccacuugcaacacuaaacaucaaccugggcuuuuccaccuaacuccaucucggccaccguacuggucucgguugaagaagagagaguuaggaagcgcucaagcgcagacgcaaccugggugcuggacggggaaacugaggucuggcucugaggcgucaccccucgccgcgcgugagcaacccugggguugucaggccucgaguagguaccuggcgcucgugcccggcccgcaacacuuccugucccgcgcgcgugcgaugcucaugugacccgggacugggcggagagcaccugaacgaggacgucacgugagcaggaggcggggcgggggcgggccgacucaggucacgugacgcuccggggacggccacggagcgccuccucgucgcacuccccccuggcuccaguucucucuccucuuucucccuccagcucccguugcagcuucgacuccgcugugguggcgcgaccgugucccaggcgcggcuccaaacggccagccgccgugagccccacgccacacgcgaugcgggccguucagcugggaccggugcccuccgggccgcgcgucgcgcuccugccgccgcuccugcugcugcugcuccuggcggccgcgggcuccgcgcaggcccaggccgucgacuuggacgcccugugcaggugggugucuugcguggcgggcgcggagccccgaggacacgcagaccuccgccccgccccgcccccgcgggaaaguugcccgcgugguggccgcggcggcgcaggaggacgcgccgccguggcacuggcccccggagccccccgugcccggccacuuguggcugucauaagucgggcggcuuugugcgacucccggggcccgguguguccgucggaaguugcagggggcagagcuaaggcugggcuuuugucccgcugcacguuuccauugaaguuccagccguggggcuucggaggcguccccucuagugugcagucuccagggagugcgaacccacgcgaugcucuuggaguuggguaguggugguuucaacugcagauugaccccuucuguggcaacucucaguuuuccuuauuuaaaguagccauuugucagugguugaagcuuuuucuucuuuugacaaggguugagagguggucaucucuguaggcuuucaagacuuuacccuucacgucucucaguuagcuuccugugugguugcucacaugaugucauugucuccagaguagauuauucuaguggagucuucugcucugggauccaagguuguauaauuuccaguccugucgaaguuuguugguguuggacacagacuugugggccuagggaacuuccaauaccauuaguuuggagacaggccuccucugggcucuuuagggugaagggaaaccaaaucuuuucuuguuuuaaaaacuuugauaagaaggaagcgggaagagaaucuugaagccagcuuuacccuugacuuucaaaagugacucagaaugagacggggcugagccaaacuugauguuucuaaugguaguccaggcucuuuaguccuuuguaucagagaguuuuguucucucaccuggaguuaauaauuuguaggacuuguuaguguaagaaugagcugaccagaauucuauuucucauuuuggagaguauuuggagggagacacugcugcacugcggcuuauagaccaauuagcugcccaaagauagauugcugccccgguaacuucaugauauggaggaagggugccccuuaaacaauaguaggcccaggggggaacauuuagaacagaaaauuuuggauuuagggcugcugugaccaagaauuaacacagcuggucuagugcuguggaagucacggucuugcuagauaacuggaauuuguuucuuuugaaggcguugguacaggggauccaaccuagggcccaggcaugcuaagcaaguacucuacuacagaccugcggccuuugccuuagaauucacuuuuuuuuuuuacaccauuauuuuuaaagugugugugcgcacaugcguguccauugugucugccaugcagaggccagaaaagggucucagaguccuuggagcuggaguuacagguugugagcagccugcguggcugcuaagaauugauccccccccccuccaaaggccaacucucuagcuauaguagguuaauuucuucgaaaaaauuaagagaauauuuuuuuauucuaugugugugaguauuuuguucgaauuuaugucuguuuaccacauaccuuacgguguccuugaagaaggcaccagauuccccugaaacugaaguuacagauggcugugaggcuccacguggaugcugggcauugaacauggauccugug

SEQ ID NO: 10827 - RNA, 2501 nt, Mus musculus
gaguaccggaggucugugcggccgcuacugugaagguccugagaccauucuucucccacagugaggugccucuguguggucaggcggcugaugagucuuucuggguuuucugagagagaagaugcucagguugguaaugauaacaccuagacgcuaggaaccgagagagugguauggaugcugucaagccaaggacccuucuucucugaacuccaggugcagagugaagguaagaggccugggcugaguggguaaacuguguaucaauggggagaaugcauaguuuaggggcuuggagucuuaccuguugcgaggucaucgggagagucuguauggagggcuucaaugaucagagagaagguacccuagggaaaggggagaagaugcuugauaaccggaaguguggaggaggaggaaggggaggaggaggaguugggagacuaggagugggaggaggaggagcuggaggaggaggagaggcauuaaagagaaccaaguacagaggcucucagaucucuguguugugccaaugaaggucaacuccuaucacuuuccuuaauuagaagaauuuuaaagaguguccccccccacacacacaccguguguggguuugguuuuuuaaaaacauguuaauacaggaaauuguauuuuaaaaaggggggagaguacuugauggagcaagguggggugcaggaagaggagagggcagcugucauuuguuuucuggggguggaaccucgaggauggagagcagccccagcacugguagcaacccaaccaaggccuaagagcuaggggacaagaacucucccaacuuuggggguaggggagggaagcauucgaccuuucagguaaguaggaggugugugagaaaugcccagggcuugcaaaagccucugggguuccacacccccuccucaacugccagucaguucccaguaagaagucaagaccucaggcgugucuuugugggauuccccaacccuuaucaguggcccuugccuucuucccacugccaaccaccaaccagccaccccuaccccuccagacccagccgagugcgcgcaggugcccacucacuggccaggugaagccgaaggggaaucggaugggguugcugaaggcggggucgaugccugcgccaucaggcaggcugaaggagucgacacccagcacuggcgugacagcacugccguaggugcaggguggcuccggugacacgcuggccugguagugcuugaggcauacgcgaaagaagguccugcaggcgcaaggcgggccagagcccccgcggcagcaguugcgguuccccagcagccccuucuuguugacgaacuccugcagcuucagcucaaauacgccggagcuccagaccugcgcggggaaggggcgugaggucgcgccggcggcggagggacccgggggcgcgcgggcccuugcuaggacgcagaggccgagcgcaccucagcgcccauccggagcugcccgcugccgggcagcucucggggucgucgcugccggagucacuuggggauggacagcugaucggcugguccgacuccccucccuccaccgcgcagcagccccgcccggcccccuaccuggcacagcagggcagagaccacggcaagggcuagcgcgcuccgacggcccaugguaccgcuggacgcccuugcucuccuagaguauccucuuuucuuucuucuucaaagacccagggaugccaggaaagucuauaugacccgaggaguacuggcggaaaggcgucucucggcuccaggugugcuaucagggccaggucgcuucaggagggugcggugccuucagcuagguccccggcaagagcucuacgaggcacugagaaaggacaacuuucgguuuccucuucgucuggcuuucaguccacggagaggugagugucuccugcuuucugguuuugucuuaagcuucuucgcggagggaaagaggagaaaggagauaagacacagagggaagagagcccagauguucagcuuaauucccaagagagcuugcaguggcuuccuucgcaggccuauuaggaagcggcggucuggaaaucccaccggugaggcgauaauccggggccccgaggggcgcggugggaacggugguggcaaggacugcggcgcgcgcccugguuucccggcccggcgucacucggcagccgcugccgcucccagaguguucuagaccgguaucucuugcacuaucgccaagccucgcgucuuccucaagaauucagccaaugccaugcgagaacacacaccgaggaccggaggccgaagcgugggaggcuccgugccgcaccggugcucucccgugaccugcccuggucagacaggguaaccgcgggugcacgccggaggaucuggcccgggcuggcgccugccacccuuaaauccugccggccgcucgcauaacuaaugagaugcaaaugagcagccccccaaucuggcgagagcugucacaaaggagccacu

SEQ ID NO: 10828 - RNA, 2501 nt, Mus musculus
aguggcuccuuugugacagcucucgccagauuggggggcugcucauuugcaucucauuaguuaugcgagcggccggcaggauuuaaggguggcaggcgccagcccgggccagauccuccggcgugcacccgcgguuacccugucugaccagggcaggucacgggagagcaccggugcggcacggagccucccacgcuucggccuccgguccucgguguguguucucgcauggcauuggcugaauucuugaggaagacgcgaggcuuggcgauagugcaagagauaccggucuagaacacucugggagcggcagcggcugccgagugacgccgggccgggaaaccagggcgcgcgccgcaguccuugccaccaccguucccaccgcgccccucggggccccggauuaucgccucaccggugggauuuccagaccgccgcuuccuaauaggccugcgaaggaagccacugcaagcucucuugggaauuaagcugaacaucugggcucucuucccucugugucuuaucuccuuucuccucuuucccuccgcgaagaagcuuaagacaaaaccagaaagcaggagacacucaccucuccguggacugaaagccagacgaagaggaaaccgaaaguuguccuuucucagugccucguagagcucuugccggggaccuagcugaaggcaccgcacccuccugaagcgaccuggcccugauagcacaccuggagccgagagacgccuuuccgccaguacuccucgggucauauagacuuuccuggcaucccugggucuuugaagaagaaagaaaagaggauacucuaggagagcaagggcguccagcgguaccaugggccgucggagcgcgcuagcccuugccguggucucugcccugcugugccagguagggggccgggcggggcugcugcgcgguggagggaggggagucggaccagccgaucagcuguccauccccaagugacuccggcagcgacgaccccgagagcugcccggcagcgggcagcuccggaugggcgcugaggugcgcucggccucugcguccuagcaagggcccgcgcgcccccgggucccuccgccgccggcgcgaccucacgccccuuccccgcgcaggucuggagcuccggcguauuugagcugaagcugcaggaguucgucaacaagaaggggcugcuggggaaccgcaacugcugccgcgggggcucuggcccgccuugcgccugcaggaccuucuuucgcguaugccucaagcacuaccaggccagcgugucaccggagccacccugcaccuacggcagugcugucacgccagugcugggugucgacuccuucagccugccugauggcgcaggcaucgaccccgccuucagcaaccccauccgauuccccuucggcuucaccuggccagugagugggcaccugcgcgcacucggcugggucuggagggguagggguggcugguuggugguuggcagugggaagaaggcaagggccacugauaaggguuggggaaucccacaaagacacgccugaggucuugacuucuuacugggaacugacuggcaguugaggaggggguguggaaccccagaggcuuuugcaagcccugggcauuucucacacaccuccuacuuaccugaaaggucgaaugcuucccuccccuacccccaaaguugggagaguucuuguccccuagcucuuaggccuugguuggguugcuaccagugcuggggcugcucuccauccucgagguuccacccccagaaaacaaaugacagcugcccucuccucuuccugcaccccaccuugcuccaucaaguacucuccccccuuuuuaaaauacaauuuccuguauuaacauguuuuuaaaaaaccaaacccacacacgguguguguguggggggggacacucuuuaaaauucuucuaauuaaggaaagugauaggaguugaccuucauuggcacaacacagagaucugagagccucuguacuugguucucuuuaaugccucuccuccuccuccagcuccuccuccucccacuccuagucucccaacuccuccuccuccccuuccuccuccuccacacuuccgguuaucaagcaucuucuccccuuucccuaggguaccuucucucugaucauugaagcccuccauacagacucucccgaugaccucgcaacagguaagacuccaagccccuaaacuaugcauucuccccauugauacacaguuuacccacucagcccaggccucuuaccuucacucugcaccuggaguucagagaagaaggguccuuggcuugacagcauccauaccacucucucgguuccuagcgucuagguguuaucauuaccaaccugagcaucuucucucucagaaaacccagaaagacucaucagccgccugaccacacagaggcaccucacugugggagaagaauggucucaggaccuucacaguagcggccgcacagaccuccgguacuc

SEQ ID NO: 10829 - RNA, 2501 nt, Mus musculus
gcaccaacaccaggaagcccagcagggcuagcccuagaagggagggagaguuauauaucagacacaaucagcauaaaaggagaaucauauccacaaagguaccaacuggagccaggaaaauagcuuagucgguaaaagcuguuaagccugacaaccuuaacuugauccugaacuccacaugguaggagagaaccaauucucacaaauugucuucuaaccuccacauuccugggcagaaguacaccugcccacccacucauacacuaugaguauguuuaaaaauaaaaaaacuaaaguggccugacuaugaaaaacaaacgaaagucagagcaaggcagaguucagugcugcugccugcccacacagagcaggucuugcgggcuacaaacuuucagaaggguuacugucugucaggaucacugcagaucuaggaagcagagacaauaagcccuacuuugcaggugcaaaaacuagcuuggaguaaucugucccagcugagcccagcgaguaggcaaaggagagaggaugaugaaccagggcagaccaauuccuggcuaaagccacaguuccucccugccacacaggaggccagaccaggucugucuugucugucugucuguccguccugcagaaaucuggagaagcaugaccucagccugaguucugauuaggacaggagggacauaccagccucaggguuacuuaacauugucaaauguccaggcagauggaggcuuugggucuuuuuguuuuccauaaagaaagccaggaaaggccagaaugaggggaaaggacuggaagaagccuauccugucuccacuggggcgcuuucagcucuguucuuuccagugcuggccuuucuuggacauuccucccuuccccacaaccaguuggcauugccuuaauagaggacaaaugcaggcaucagccccacucuuggugggggucugacuagacaauagcgcucuuccucuagagaaaagcccaagucuaaaccuagcuggcucuaguucccucucccagcuggggcggcucaaggacaggccagggcugugucagcagagcucuaggggcccgcaagaaguguguuggggggcggggugggggaaagcggagccccacgguacugcuauggucguggggacucaaggcuaucgcgaggaagggcuugggucaggcaggggcagucuucucuccaauuccuccuagccagugaacgcccaucuccaggaugagcgcuggagggggagggugcccaaggcgcaggauuaucaaggggauaccaggauucuuaccccuagagcucagccggauuaagcuggcucucacucugcuccccuguccugcuuuggggcacuacugggaaagcaggagcuggcaacgaagcuugggacaauggcagcuuugucaccgcggcgccugacccaaccagagcagggacaguccaggacuugagcuuggggggcugcugugcucacaggcaaggcggccgcgagugcaagaagcgugaaucggggcgcggcucaccuaccguguguguagauguugcccagcucguuguguagguagaaaaggcugcgcagacagcccgagccgcugcuggccggccgguagccgguuaauacgaacuuauugaacugcaggugcggcggcgagcuagcccaguccaggagacgaggcccggucaggaaugccauggccucacgcacugcggccgaccggcgacccucugcgccugggcuuccuucucaguggagcugcagcgcugggaagcucaucccgauucaccuccggcuauccgguggcccugcccgggucagcaaggaggucccggcccccuucccucacgcgcugcgcacgcgcgaguucgacgcccccgcaagggagagaaagcuggcaaccccaggucggagcucagugcauucagcuccaccguagcagagcggcggagggagagcuccgguuggccgcaacggcagccaggcgucucgccgcagcccggaggacgggcgcggccggacgccggaggggacagcaggcuccaccccggcuccucgcccccgccacccugccuguguuucgcgcgcuggauuccugacguucuuguugcagggaccaaugggcucugcggacggagaugcuccgccccgagaccgcccaugccuucucuuuuuaacauaugcgguuccagccuucuuugcguggaguggcuguuggcuugcgacgcgaguuucugugucgggcuccuccacuggaguggccuagcaccuugggucuaccaacauuaucacaccccagcuuucuuaaugaccuucagguugccgcaccuuugggcaccuaccucaagcacauaacccggcuacccagcucuaaacccacagucagacucuguccaaggugcugcuggcuaagcgccccaccaccaccccccacaccccccagaagaguccugagcagcgcaggcgcuuacccacuuuggaggcauauuuccauuggcgggg

SEQ ID NO: 10830 - RNA, 2501 nt, Mus musculus
ccccgccaauggaaauaugccuccaaaguggguaagcgccugcgcugcucaggacucuucuggggggugugggggguggugguggggcgcuuagccagcagcaccuuggacagagucugacuguggguuuagagcuggguagccggguuaugugcuugagguaggugcccaaaggugcggcaaccugaaggucauuaagaaagcuggggugugauaauguugguagacccaaggugcuaggccacuccaguggaggagcccgacacagaaacucgcgucgcaagccaacagccacuccacgcaaagaaggcuggaaccgcauauguuaaaaagagaaggcaugggcggucucggggcggagcaucuccguccgcagagcccauuggucccugcaacaagaacgucaggaauccagcgcgcgaaacacaggcaggguggcgggggcgaggagccgggguggagccugcuguccccuccggcguccggccgcgcccguccuccgggcugcggcgagacgccuggcugccguugcggccaaccggagcucucccuccgccgcucugcuacgguggagcugaaugcacugagcuccgaccugggguugccagcuuucucucccuugcgggggcgucgaacucgcgcgugcgcagcgcgugagggaagggggccgggaccuccuugcugacccgggcagggccaccggauagccggaggugaaucgggaugagcuucccagcgcugcagcuccacugagaaggaagcccaggcgcagagggucgccggucggccgcagugcgugaggccauggcauuccugaccgggccucgucuccuggacugggcuagcucgccgccgcaccugcaguucaauaaguucguauuaaccggcuaccggccggccagcagcggcucgggcugucugcgcagccuuuucuaccuacacaacgagcugggcaacaucuacacacacgguaggugagccgcgccccgauucacgcuucuugcacucgcggccgccuugccugugagcacagcagccccccaagcucaaguccuggacugucccugcucugguugggucaggcgccgcggugacaaagcugccauugucccaagcuucguugccagcuccugcuuucccaguagugccccaaagcaggacaggggagcagagugagagccagcuuaauccggcugagcucuagggguaagaauccugguauccccuugauaauccugcgccuugggcacccucccccuccagcgcucauccuggagaugggcguucacuggcuaggaggaauuggagagaagacugccccugccugacccaagcccuuccucgcgauagccuugaguccccacgaccauagcaguaccguggggcuccgcuuucccccaccccgccccccaacacacuucuugcgggccccuagagcucugcugacacagcccuggccuguccuugagccgccccagcugggagagggaacuagagccagcuagguuuagacuugggcuuuucucuagaggaagagcgcuauugucuagucagacccccaccaagaguggggcugaugccugcauuuguccucuauuaaggcaaugccaacugguuguggggaagggaggaauguccaagaaaggccagcacuggaaagaacagagcugaaagcgccccaguggagacaggauaggcuucuuccaguccuuuccccucauucuggccuuuccuggcuuucuuuauggaaaacaaaaagacccaaagccuccaucugccuggacauuugacaauguuaaguaacccugaggcugguaugucccuccuguccuaaucagaacucaggcugaggucaugcuucuccagauuucugcaggacggacagacagacagacaagacagaccuggucuggccuccuguguggcagggaggaacuguggcuuuagccaggaauuggucugcccugguucaucauccucucuccuuugccuacucgcugggcucagcugggacagauuacuccaagcuaguuuuugcaccugcaaaguagggcuuauugucucugcuuccuagaucugcagugauccugacagacaguaacccuucugaaaguuuguagcccgcaagaccugcucugugugggcaggcagcagcacugaacucugccuugcucugacuuucguuuguuuuucauagucaggccacuuuaguuuuuuuauuuuuaaacauacucauaguguaugagugggugggcagguguacuucugcccaggaauguggagguuagaagacaauuugugagaauugguucucuccuaccauguggaguucaggaucaaguuaagguugucaggcuuaacagcuuuuaccgacuaagcuauuuuccuggcuccaguugguaccuuuguggauaugauucuccuuuuaugcugauugugucugauauauaacucucccucccuucuagggcuagcccugcugggcuuccugguguuggugc

SEQ ID NO: 10831 - RNA, 2501 nt, Mus musculus
cacucacccuguggcuccacaggacugcuuucuucgguggguccagggacaggagucucuaaggagugugggagaauagucuauaaugggguaucugacggaaaggcucagggaacagacaacagucaguagcugaugcgacuuuggcugaggugacugagacagggcagggucacucacuaacgcaaggugccacaggagaacggcucugcuggaaaccuggggcacagcgguuacaggugaggccaguaacaccauccuuacagggacacuggccuguggucugguuacagguuuugccagcagcaccaacuggguggcagucacaagcugaggacagaaaugauaagcucagaacuguagcugggguucuggggaaguaaaucacgaacguguauagguggcaggcucaccucugcaagcacgacggucacucaggacacggccuggaucacgauagaagcccucccggcaguaguggcagugacgaccagcuguauugugccggcaguugaggcacacgcccccacugcggcggccggacagucgguagagcuccauguugaagcggcaucuucgcgcauggccguugcaggagcaagcugcagggaagggucagucaggggcagcccugccuggucagaaguccccaggcuacccuccaaggccucaccaaggcaagcgugggcuuccugcccuguagcccgcugccauggccugucgcaguagaagggcuugcagcggcugcaaucagggcccucuguaccaugcuggcagucgcagaccagguggccauggguguccaacagacaccgugaggcaugcccauugcacuugcaucgaccucccaccugaagcucaguggcugaguaggaguaggggacugucaccccaccgucccuggugucucccugaauggcaggccuugugaguacuaugcgaauaucuguggcagucacccagucuuggagcacggggcuguuguccagauccaggcccugugggcugccauccugcacacugaaggccagaaggccuccaccaucaggcugagccuggggggcuggaaagcagagggcuucuggcccuggaccagaagggccaucagcaggagcaggcagacggccauaguccaggguacagcuggaagagaagaagcccaaggggacccagcugcggccaugguccugcgacuuaagcagggccacggagguuggaggagcugagcagaagcgcaggcucacgaagaccagcucaaaagccuuccccaggggcacugugaggguuacguugaaaggugccuguugcagcaaaucggagcgccaacagagaggacuugcagugcccggagcagaggucaggaggucugcagagugugcccgcugcggguccgaggaaucgcagacgcgauuggccgaccucccgcacgugcuggacgccagcaccucucggcccagagcagcguucacaaggccaggaauacaagagcgaggcucccucgccucaucauagcaggggucggcagaggccggcagcccugggcucagugcagcggagagcgugcccgcggucagcagcagcccccagagccaggugggcauggccguggccgcuguaagucaaccagccagcuuccgccuaacgagucugcccucgaagagagagccuaguccgcuacucugcgugccgggucugcagugccaagauagcagagcaccagggcggcccccagcacaggcccagaagugggagcagccaccggcacgcccggggccgagcacaggagcagggauguuggcgaguccuccugcuaggccugaagcguugacaggcgucgcccccgcucccggugccuccgcccgcggaggccccacccgccgccggccgccagcacucacccacggagggccaggaggagcaggucucccggccucccgggaagggccuugggcgggcggggccuggggcgcccgggcugccggcuucuccuggcugcagcgagagcagaggagcugugccagaaggggguggggggcucagcaggagcaagccugguccuagccaggggcggagcugcucgggccgggaaggaaggaggggagggggccuugucccgacagccagaaucagaagcagauucagacacaggcugggccagcgcgggagggggcugggaggcccacgauccggggggaggggcuggagagccaggaaugcgcuuacgggagggggcagcucagccuuacagcccgugagggaccacccagcaggguccucggccugaagccaggcuuugacugcuccugggguggugccacgugcugggcuggggucugggccacuccucccagaggcccaucaugcaggcacaaccuuagaacugaagcuugaagucuuggaugcuccccagaaugggggaagaagacaguuggggcugguguucuuguaagguauccccaaggcaguagucuguucuagcagaaagaacucaggucuuauuu

SEQ ID NO: 10832 - RNA, 2501 nt, Mus musculus
aaauaagaccugaguucuuucugcuagaacagacuacugccuuggggauaccuuacaagaacaccagccccaacugucuucuucccccauucuggggagcauccaagacuucaagcuucaguucuaagguugugccugcaugaugggccucugggaggaguggcccagaccccagcccagcacguggcaccaccccaggagcagucaaagccuggcuucaggccgaggacccugcuggguggucccucacgggcuguaaggcugagcugcccccucccguaagcgcauuccuggcucuccagccccuccccccggaucgugggccucccagcccccucccgcgcuggcccagccugugucugaaucugcuucugauucuggcugucgggacaaggcccccuccccuccuuccuucccggcccgagcagcuccgccccuggcuaggaccaggcuugcuccugcugagccccccacccccuucuggcacagcuccucugcucucgcugcagccaggagaagccggcagcccgggcgccccaggccccgcccgcccaaggcccuucccgggaggccgggagaccugcuccuccuggcccuccgugggugagugcuggcggccggcggcggguggggccuccgcgggcggaggcaccgggagcgggggcgacgccugucaacgcuucaggccuagcaggaggacucgccaacaucccugcuccugugcucggccccgggcgugccgguggcugcucccacuucugggccugugcugggggccgcccuggugcucugcuaucuuggcacugcagacccggcacgcagaguagcggacuaggcucucucuucgagggcagacucguuaggcggaagcuggcugguugacuuacagcggccacggccaugcccaccuggcucugggggcugcugcugaccgcgggcacgcucuccgcugcacugagcccagggcugccggccucugccgaccccugcuaugaugaggcgagggagccucgcucuuguauuccuggccuugugaacgcugcucugggccgagaggugcuggcguccagcacgugcgggaggucggccaaucgcgucugcgauuccucggacccgcagcgggcacacucugcagaccuccugaccucugcuccgggcacugcaaguccucucuguuggcgcuccgauuugcugcaacaggcaccuuucaacguaacccucacagugccccuggggaaggcuuuugagcuggucuucgugagccugcgcuucugcucagcuccuccaaccuccguggcccugcuuaagucgcaggaccauggccgcagcuggguccccuugggcuucuucucuuccagcuguacccuggacuauggccgucugccugcuccugcugauggcccuucugguccagggccagaagcccucugcuuuccagccccccaggcucagccugaugguggaggccuucuggccuucagugugcaggauggcagcccacagggccuggaucuggacaacagccccgugcuccaagacugggugacugccacagauauucgcauaguacucacaaggccugccauucagggagacaccagggacgguggggugacaguccccuacuccuacucagccacugagcuucaggugggaggucgaugcaagugcaaugggcaugccucacggugucuguuggacacccauggccaccuggucugcgacugccagcaugguacagagggcccugauugcagccgcugcaagcccuucuacugcgacaggccauggcagcgggcuacagggcaggaagcccacgcuugccuuggugaggccuuggaggguagccuggggacuucugaccaggcagggcugccccugacugacccuucccugcagcuugcuccugcaacggccaugcgcgaagaugccgcuucaacauggagcucuaccgacuguccggccgccgcagugggggcgugugccucaacugccggcacaauacagcuggucgucacugccacuacugccgggagggcuucuaucgugauccaggccguguccugagugaccgucgugcuugcagaggugagccugccaccuauacacguucgugauuuacuuccccagaaccccagcuacaguucugagcuuaucauuucuguccucagcuugugacugccacccaguuggugcugcuggcaaaaccuguaaccagaccacaggccagugucccuguaaggaugguguuacuggccucaccuguaaccgcugugccccagguuuccagcagagccguucuccuguggcaccuugcguuagugagugacccugcccugucucagucaccucagccaaagucgcaucagcuacugacuguugucuguucccugagccuuuccgucagauaccccauuauagacuauucucccacacuccuuagagacuccugucccuggacccaccgaagaaagcaguccuguggagccacagggugagug

SEQ ID NO: 10833 - RNA, 2501 nt, Mus musculus
uuuuuuuuuuuuuuuuuuuuuuuacaagggaucggggaagacccagcccuccucagacugccaaccauggagggaagaccuacccacacuccagaucaguccugcuauugcccgucccccaugcuaaggguccuggagcccaccugugugguggucacugugauggugugccucgccgagcacugcaucagcuuuguacaugggaccaccagggugguggcccaguucaguaccagagucugagucgcuccggccagucuucacacucuuccuucgccuuggcugguauuuguaaucuggguggucuuucuugugcugcacacggagccucucggccuccuccacaaacggccucuucucgcuuucacucagcaagcuacagaaaacacaguagagcgaggaugcccacggagcuccagacuugccaaggaccuaggcagcgccagcaaacacugcugccugcagucagacaguuggagcacaggauagggugcuggagagcucaggauacccuccaagggguaaccugcccuccugcugagaacuccgacaccaguggggcagagcccaacaguguggucuaaggaccaagaccccaauucuccaucuuucccgaagucccccuuuccagcacuauuugcucauccagucacccaccacugcuaccaccgccgccgcuaccaccaccaccaccaaucucucucaagaaagacaacaggacccagugaaaacuauacuucgacaaaggcaaggaaggcuuucuggaaaccagccaucccaaguugccaggagugauggagaaacuccgggagauuguccucagagcacacacacacacacccugagaaucucucgaccuugaaccucaacuugccggccaagcugagagggcaagacaaccuggcuguccugcucagcccaguaucacuacuacacacuguuucaaacucgaauagaggcagcuugggaggugggacugugcagcugucuucaauaaugccugccuuucucaggccaaagugcucauugagccugucacuuucaccugcucuuuccuuccccaauuccagguuccuguggccugggagcaguaccugccagaggacuuggacuccucauggaccccggagucccagcuucugcccaggacaaagcagcuugaugccuacccaauaugccuacaggccgugguggccacucgaugcuaggauccccaguucugcaguucucagcaggauaucccaggagaggagaaaggacuggagggucacacuccaggcacuggccuccguccaucuccaaagucccacaccuggugucucuguugaccagacccacccuggaaccagcccaggagcacagcccaagcuggggcacgaagucacuccuuuccucagccugagugucaagaguccccacacucaccgccacagcuugccuagggucuugcugagcucugcguuauggagaugcggguacugguccgccagcuugcggcgcgccgccugugcccacaccaugaaggcauucaugggccgcuucacguguggcuuggccuugagcgugccgccaccgccgccgcgcacaggcauaggcaccagacuccagucauaacccuuaagcaccugcgacacggcaucacggaugcaggcugggaagcguucgucugcugccucagcaguauccccucggccgccgccccccgcgcggcccaggcccucugaucccgcgggcgacgguggcgcgucggaguccgaauccuccacgugugacauggagcuagcggugccagacgggcugcagggaggcugggcgcgggccucacucauguccagcaucggggccacgcgcggaggggcacucaguggggauggacgcaggggucgcgcccggucacucuguggaaggacacucuagaauccaagguugccacgcaggacccaaucuuuguccucaccgcaggggcccagcagcagcuccuccgccgcaguagcucagucucaguucugggacccgcaacaaguuucuuuaagccguggucgaaaccccgccccucccgguccggguuggcagguccuccccaggcggagcuuguaugccccgccccgaauccaaagaagccuugcgaccccgcuccacccuccguaccacgugggccaggcgccccgcagccugaucccucggcugaggcggggucagagggcuaagggugacugacugcccagugcauggaucucagcagcacggcuugacuuucgggcggcaggcaaggaugcuaauccacaagguuccugaguccaacaucccucccuccaauguggggcucgaauccgcuauugcaaccaaacccggguucugcccgcaggguggcgcaaugacaagagccaccaggugacccugguaacucccgcaccuaggugagcuggaggaccccggggcuagacagaggugggagggcgggggcgcugggcggggcugcucuggcagugacugcugagucc

SEQ ID NO: 10834 - RNA, 2501 nt, Mus musculus
ggacucagcagucacugccagagcagccccgcccagcgcccccgcccucccaccucugucuagccccgggguccuccagcucaccuaggugcgggaguuaccagggucaccugguggcucuugucauugcgccacccugcgggcagaacccggguuugguugcaauagcggauucgagccccacauuggagggagggauguuggacucaggaaccuuguggauuagcauccuugccugccgcccgaaagucaagccgugcugcugagauccaugcacugggcagucagucacccuuagcccucugaccccgccucagccgagggaucaggcugcggggcgccuggcccacgugguacggaggguggagcggggucgcaaggcuucuuuggauucggggcggggcauacaagcuccgccuggggaggaccugccaacccggaccgggaggggcgggguuucgaccacggcuuaaagaaacuuguugcgggucccagaacugagacugagcuacugcggcggaggagcugcugcugggccccugcggugaggacaaagauuggguccugcguggcaaccuuggauucuagaguguccuuccacagagugaccgggcgcgaccccugcguccauccccacugagugccccuccgcgcguggccccgaugcuggacaugagugaggcccgcgcccagccucccugcagcccgucuggcaccgcuagcuccaugucacacguggaggauucggacuccgacgcgccaccgucgcccgcgggaucagagggccugggccgcgcggggggcggcggccgaggggauacugcugaggcagcagacgaacgcuucccagccugcauccgugaugccgugucgcaggugcuuaaggguuaugacuggagucuggugccuaugccugugcgcggcggcgguggcggcacgcucaaggccaagccacacgugaagcggcccaugaaugccuucauggugugggcacaggcggcgcgccgcaagcuggcggaccaguacccgcaucuccauaacgcagagcucagcaagacccuaggcaagcuguggcggugaguguggggacucuugacacucaggcugaggaaaggagugacuucgugccccagcuugggcugugcuccugggcugguuccagggugggucuggucaacagagacaccaggugugggacuuuggagauggacggaggccagugccuggagugugacccuccaguccuuucuccucuccugggauauccugcugagaacugcagaacuggggauccuagcaucgaguggccaccacggccuguaggcauauuggguaggcaucaagcugcuuuguccugggcagaagcugggacuccgggguccaugaggaguccaaguccucuggcagguacugcucccaggccacaggaaccuggaauuggggaaggaaagagcaggugaaagugacaggcucaaugagcacuuuggccugagaaaggcaggcauuauugaagacagcugcacagucccaccucccaagcugccucuauucgaguuugaaacaguguguaguagugauacugggcugagcaggacagccagguugucuugcccucucagcuuggccggcaaguugagguucaaggucgagagauucucagggugugugugugugugcucugaggacaaucucccggaguuucuccaucacuccuggcaacuugggauggcugguuuccagaaagccuuccuugccuuugucgaaguauaguuuucacuggguccuguugucuuucuugagagagauugguggugguggugguagcggcggcggugguagcaguggugggugacuggaugagcaaauagugcuggaaagggggacuucgggaaagauggagaauuggggucuugguccuuagaccacacuguugggcucugccccacuggugucggaguucucagcaggagggcagguuaccccuuggaggguauccugagcucuccagcacccuauccugugcuccaacugucugacugcaggcagcaguguuugcuggcgcugccuagguccuuggcaagucuggagcuccgugggcauccucgcucuacuguguuuucuguagcuugcugagugaaagcgagaagaggccguuuguggaggaggccgagaggcuccgugugcagcacaagaaagaccacccagauuacaaauaccagccaaggcgaaggaagagugugaagacuggccggagcgacucagacucugguacugaacugggccaccacccugguggucccauguacaaagcugaugcagugcucggcgaggcacaccaucacagugaccaccacacaggugggcuccaggacccuuagcaugggggacgggcaauagcaggacugaucuggaguguggguaggucuucccuccaugguuggcagucugaggagggcugggucuuccccgaucccuuguaaaaaaaaaaaaaaaaaaaaaaa

SEQ ID NO: 10835 - RNA, 2501 nt, Mus musculus
uccgucgccgccgugcgcguggucucucggcgccauccgucucggcuuuguccagcuccacugccuucugcagcgcgcacagcucugaaggggaagagaggcagagagguggcggguuagagcggcgggccggggaccucagggcccuuguagggguggcagggaguaucacucugguccuaugccggacacccagcuccgcuuaagcuaaucgccgagugcacgggcucgcucgguucgauguuggcgcaauugcgcaucugggaaaugccuaaguggcuuggacaaaacaaaacaagagaaaucucgggcgcccuaucccagaccucuuccccggauaguuagcguucucuuaacagucugggauuuagcuuuagcuuuucuggcugcaaagaaaauaaagucaugaggaugcucggagugaauuacauuaggaauacuccgguuugucccucggguggucagcugauguuggcauggcuucuggacuucccaguacccggaggaggacagaggccucuacaccagcccugcgggauuccgguugguagcaauaaguucuaauccuccuccaguccuucuccaauguuccuggaccuucucucugcucccagggaaaaccuaggaacguccucuaacucgcagaaaccauugggccucucuggcuuuacucagcacaggaucugggccugggacuucccugcuccuucugugagcuggccaggagccccucucccuacucugagauauuugguauucggccaccuucggaagccugcucuucacuucucagugucuuuauucguuccguauuucccaacaguucccagaaaggaauuucugccugauccugccuggagauuguacuagaaaaacaaagccaaccccagcuccugggauccgcagcaucgcaucucaaaaucacaacccgguccccagacuccucucuuuuggcacaaaggaggcaaggcccagaaaggcagggugggcuacacaaggcccaggauacacggggcuaagcuuucgguuuagcaguucucagugucucaaaguacccccaaaucuggaagagauuuuaacucuccaguacgaagauuuguucuaacgcggauuguuagauagcuuaacuuuguaacagauccaagaacaaggcccuaaccuacugggguuuuguaggccgaaaacaacauuuuaaucuucucucucucucucucucucucucucacucucacucucucacucucucccucucucucucucccuucuuuuuuccugacccucuaaauucggcguucccucuaaacuucggacugacugcgggacagccuggaaucuuauacuccaaacuccccgcgcccagccuucaccccggacugagcuacugucaggccuggguuucuuggcucaggguuuuggacaugaaagcgauuccagaagggaagagcuugagguucuccuuaccuuuuuuauccgcccgagggucuuuggcugggucagggucaccguaggcucccggguaaaaugugggggcggcugggaaagcaggagagcacuuggggggcgaaggcgcggggcccaucuccgcgcgcagcucugccaggccggacgcugccgccucggggccagaguaggccucgggcuugaaggcggccagcaugcaggaggcaggggccaggguggccucgaggcgcgcagacagguccccagacgccaggcuacgcugcugcugcuccagguucaggaugucuuugacugagaaaggcgugggugugagcgcagggcuggggaacaugguggcgacgcagguuucacagcgccagguggguagcagagaguggugcugcccaccccuggggacagccuccccgcauggugcccgccgcccgcccgcgcacccgccucucugcccuggauguggcgcgcggcagcagguagcgcggagcaccaggggcagaagaggcgggagcaggcuggaguaggggggauucagccugccauugggccaggggccuggaugacaggagcgacgggcaguucugcgucaccuaauauagacauagggaugggaaaaaaaaauccugcucagcuuuuuuuaaaggggccgcgacacauuugggauagucucccacuccugcaaggagauugcuccucguuagccugaaaaucccagccagacacacucaaagaaaauaccugauucuguuaugcugagucuaaacgcaggguugggggugggucgaggauuugaauaaauauucuuugcacuguguccuguaucacuaaaugggcuggugaggauggauugaaagccagaagagggggguuauuuucagggaucaagacuaugacuacaauauuguuuacugaagucugccuaagaguagccugcauagaaagagaaucacagagaagacaguuguucugggacgaacacugaguuuaacacaugaguuuaagaauuggauuggggagcgguaguuaauuugaccuacaggaccaaa

SEQ ID NO: 10836 - RNA, 2501 nt, Mus musculus
uuugguccuguaggucaaauuaacuaccgcuccccaauccaauucuuaaacucauguguuaaacucaguguucgucccagaacaacugucuucucugugauucucuuucuaugcaggcuacucuuaggcagacuucaguaaacaauauuguagucauagucuugaucccugaaaauaaccccccucuucuggcuuucaauccauccucaccagcccauuuagugauacaggacacagugcaaagaauauuuauucaaauccucgacccacccccaacccugcguuuagacucagcauaacagaaucagguauuuucuuugagugugucuggcugggauuuucaggcuaacgaggagcaaucuccuugcaggagugggagacuaucccaaaugugucgcggccccuuuaaaaaaagcugagcaggauuuuuuuuucccaucccuaugucuauauuaggugacgcagaacugcccgucgcuccugucauccaggccccuggcccaauggcaggcugaauccccccuacuccagccugcucccgccucuucugccccuggugcuccgcgcuaccugcugccgcgcgccacauccagggcagagaggcgggugcgcgggcgggcggcgggcaccaugcggggaggcuguccccaggggugggcagcaccacucucugcuacccaccuggcgcugugaaaccugcgucgccaccauguuccccagcccugcgcucacacccacgccuuucucagucaaagacauccugaaccuggagcagcagcagcguagccuggcgucuggggaccugucugcgcgccucgaggccacccuggccccugccuccugcaugcuggccgccuucaagcccgaggccuacucuggccccgaggcggcagcguccggccuggcagagcugcgcgcggagaugggccccgcgccuucgccccccaagugcucuccugcuuucccagccgcccccacauuuuacccgggagccuacggugacccugacccagccaaagacccucgggcggauaaaaaagguaaggagaaccucaagcucuucccuucuggaaucgcuuucauguccaaaacccugagccaagaaacccaggccugacaguagcucaguccggggugaaggcugggcgcggggaguuuggaguauaagauuccaggcugucccgcagucaguccgaaguuuagagggaacgccgaauuuagagggucaggaaaaaagaagggagagagagagagggagagagugagagagugagagugagagagagagagagagagagagagaagauuaaaauguuguuuucggccuacaaaaccccaguagguuagggccuuguucuuggaucuguuacaaaguuaagcuaucuaacaauccgcguuagaacaaaucuucguacuggagaguuaaaaucucuuccagauuuggggguacuuugagacacugagaacugcuaaaccgaaagcuuagccccguguauccugggccuuguguagcccacccugccuuucugggccuugccuccuuugugccaaaagagaggagucuggggaccggguugugauuuugagaugcgaugcugcggaucccaggagcugggguuggcuuuguuuuucuaguacaaucuccaggcaggaucaggcagaaauuccuuucugggaacuguugggaaauacggaacgaauaaagacacugagaagugaagagcaggcuuccgaagguggccgaauaccaaauaucucagaguagggagaggggcuccuggccagcucacagaaggagcagggaagucccaggcccagauccugugcugaguaaagccagagaggcccaaugguuucugcgaguuagaggacguuccuagguuuucccugggagcagagagaagguccaggaacauuggagaaggacuggaggaggauuagaacuuauugcuaccaaccggaaucccgcagggcugguguagaggccucuguccuccuccggguacugggaaguccagaagccaugccaacaucagcugaccacccgagggacaaaccggaguauuccuaauguaauucacuccgagcauccucaugacuuuauuuucuuugcagccagaaaagcuaaagcuaaaucccagacuguuaagagaacgcuaacuauccggggaagaggucugggauagggcgcccgagauuucucuuguuuuguuuuguccaagccacuuaggcauuucccagaugcgcaauugcgccaacaucgaaccgagcgagcccgugcacucggcgauuagcuuaagcggagcuggguguccggcauaggaccagagugauacucccugccaccccuacaagggcccugagguccccggcccgccgcucuaacccgccaccucucugccucucuuccccuucagagcugugcgcgcugcagaaggcaguggagcuggacaaagccgagacggauggcgccgagagaccacgcgcacggcggcgacgga

SEQ ID NO: 10837 - RNA, 2501 nt, Mus musculus
ugccuauuucccccuccucaccccccacugggcgcuguuauuacagacgugaccccgcaugcccaguuuauggggcccuggagcuccaacccagggcuucacuuccagcaaguuaggcaaacacuguaccaacagacccaccucccgaaacccaggauuuuauuuacuaauaucagugaucuggaaaagaguuaguccuucccacaguuggucagggacagacccauaaacacucacucagcucuaacuguacuguuguucauagauguauguggcucugcuggugcgcugcgugacaagagaauagcccaggugugggggaggggagggcgcgcccucuuaacgcgcgccgguucuagcugucuggcgcgggcuuagauucccagaggggagggcgggccagcgaguccccgggaucggugaaggaguggguugguccugccucugagggggcggggccugggccgacgcuauaaggaggcagcucgacgccaacugcagcagccgagaggugugagccgccgcggugucagagucuaggggaauuggagucaggcgcagauccacagcgauauccagacauucagaggugagagcuucguggcagggaacaauaguucuuccccguagcaaugcgcugagcccaguggguguccccagaaguguguguguguguguguguguguguguguggugaugaguggaucaccuguguguguauauguguauuugugcgugcccgccagagucacagguguguccgcggcagguggaugacgggugugggucugagcguccgugguggcugaaggcuucguuuguuggagugugacgagggucaggcuaugucgcggacucggcauacagagucugaacuccaggaccacggauggcagccacucuuccaguccuuggagaccggguccgagcgauggcuggcggggaucggcuaccgggagcucgcuucugguugccaauguuucuagggauuccaggugcggcucgcccaaagcgugagaaugaagcucacggugccccgagauggguccuggguggcgguugugacaagcuucggcgagucuaucuagagcuuagcgcagagcgguucuccgaucccaugggugccgccggauccccgguccuugugaaccaagugcccuguuucgcgguagccaccaccccacugggcucugaggucagcgcgagcuguguccuccgcccucgggaucgugccugggcacguccuagaggacaggcgaggaggugacucauugugacaaggagaccccgggcacuggauugagaccagaaucgcgccacaacuggggaugggucaguggcagcccagaagccccuuucccugcccggguacagccucguuccugccccguccccucccccgcgcggcacagugaccuauuuggcgggcacaguauguucccagggaacccgggacacggggagguccaggacgcgguguccgguccccgcucggcggcgcgcccucggggacagggagucugggcggguccuguccacccugccagcccgggaagcgcaaagggucccacccaccgcgcccaccacgacccggaccagugaccguggggcgcgagaggagcccgcacuguagagcggccgguauccucgcggagugaggcuuacgggugccguacaucagacgccccggggcuggggcccucgacccaguccacacccaguguaggaaggugaccaggcugagugcgcccacuagggcacauccauuccacucggaaccuccggggacaagggcuacacuugcacccuggucgugcgggaaauacuuugggcuuggguuuggcauuugggggcgcgcuggcagcuuccucuguccccuacgucgcguuucagagaggacacucaggcgguuuuuuguuguccucgcccucaucuauuuuuauuuuccagggaucugacucaucgcgugcuuugggcguggagaucaagguggagggggccagagcuaagagcacuuucuuugcucucgaguguccgugcgugcgugugugcgugcgugcguaugugugugugugugugugucuguguacgugcguguguguguguguguguaugcgugcgcgcgcgcgcgcucagucugguuucccaacauaggcgggaauuuaggaagccugggcucaucgugacguguuuuguggcccggggucccccuccuuuccucuccucucuccaccccagggugacgcgcagcuccggugcccaagcaguuuuggcgggcgggcagcgccgggcaggaaacugacucaccacuccuugcucggccuacgcgccgccuaccgagcgccauuuccugagugcacagcgcccccuaccggcaucagugaggacugcaaggccggcuaggcgcggguggcaccacgggcuucugccacccccaccgcggcuuaaagggaauuaaaauaugccugauggccagauacaagugauuuuagcagggugug

SEQ ID NO: 10838 - RNA, 2501 nt, Mus musculus
cacacccugcuaaaaucacuuguaucuggccaucaggcauauuuuaauucccuuuaagccgcgguggggguggcagaagcccguggugccacccgcgccuagccggccuugcaguccucacugaugccgguagggggcgcugugcacucaggaaauggcgcucgguaggcggcgcguaggccgagcaaggaguggugagucaguuuccugcccggcgcugcccgcccgccaaaacugcuugggcaccggagcugcgcgucacccugggguggagagaggagaggaaaggagggggaccccgggccacaaaacacgucacgaugagcccaggcuuccuaaauucccgccuauguugggaaaccagacugagcgcgcgcgcgcgcacgcauacacacacacacacacacgcacguacacagacacacacacacacacacauacgcacgcacgcacacacgcacgcacggacacucgagagcaaagaaagugcucuuagcucuggcccccuccaccuugaucuccacgcccaaagcacgcgaugagucagaucccuggaaaauaaaaauagaugagggcgaggacaacaaaaaaccgccugaguguccucucugaaacgcgacguaggggacagaggaagcugccagcgcgcccccaaaugccaaacccaagcccaaaguauuucccgcacgaccagggugcaaguguagcccuuguccccggagguuccgaguggaauggaugugcccuagugggcgcacucagccuggucaccuuccuacacuggguguggacugggucgagggccccagccccggggcgucugauguacggcacccguaagccucacuccgcgaggauaccggccgcucuacagugcgggcuccucucgcgccccacggucacugguccgggucguggugggcgcggugggugggacccuuugcgcuucccgggcuggcaggguggacaggacccgcccagacucccuguccccgagggcgcgccgccgagcggggaccggacaccgcguccuggaccuccccgugucccggguucccugggaacauacugugcccgccaaauaggucacugugccgcgcgggggaggggacggggcaggaacgaggcuguacccgggcagggaaaggggcuucugggcugccacugacccauccccaguuguggcgcgauucuggucucaauccagugcccggggucuccuugucacaaugagucaccuccucgccuguccucuaggacgugcccaggcacgaucccgagggcggaggacacagcucgcgcugaccucagagcccaguggggugguggcuaccgcgaaacagggcacuugguucacaaggaccggggauccggcggcacccaugggaucggagaaccgcucugcgcuaagcucuagauagacucgccgaagcuugucacaaccgccacccaggacccaucucggggcaccgugagcuucauucucacgcuuugggcgagccgcaccuggaaucccuagaaacauuggcaaccagaagcgagcucccgguagccgauccccgccagccaucgcucggacccggucuccaaggacuggaagaguggcugccauccgugguccuggaguucagacucuguaugccgaguccgcgacauagccugacccucgucacacuccaacaaacgaagccuucagccaccacggacgcucagacccacacccgucauccaccugccgcggacacaccugugacucuggcgggcacgcacaaauacacauauacacacacaggugauccacucaucaccacacacacacacacacacacacacacacacuucuggggacacccacugggcucagcgcauugcuacggggaagaacuauuguucccugccacgaagcucucaccucugaaugucuggauaucgcuguggaucugcgccugacuccaauuccccuagacucugacaccgcggcggcucacaccucucggcugcugcaguuggcgucgagcugccuccuuauagcgucggcccaggccccgcccccucagaggcaggaccaacccacuccuucaccgaucccggggacucgcuggcccgcccuccccucugggaaucuaagcccgcgccagacagcuagaaccggcgcgcguuaagagggcgcgcccuccccucccccacaccugggcuauucucuugucacgcagcgcaccagcagagccacauacaucuaugaacaacaguacaguuagagcugagugaguguuuaugggucugucccugaccaacugugggaaggacuaacucuuuuccagaucacugauauuaguaaauaaaauccuggguuucgggaggugggucuguugguacaguguuugccuaacuugcuggaagugaagcccuggguuggagcuccagggccccauaaacugggcaugcggggucacgucuguaauaacagcgcccaguggggggugaggagggggaaauaggca

SEQ ID NO: 10839 - RNA, 2501 nt, Mus musculus
uccacagaggucaguuuaggacauuuagagccuuggaacuggaguacagugggauaccaucuggacacugggaauccaacuuggguucuuugaauaacaagugcccuccucuguugagucaucccuccagccccugccccucaagugcugauaguaguagguauaugcuaguauagucagcuccacgaacuuuccuucacguacaaagucacuaagauuauuguaugaauuucuuucagucuacucaagucuagguacaggaaguauauaggaagcauaaauuaaugucaugcucagagcuaggcucuagcaacaagaugaucugaugauguguguaaacacucuaaaaauaaaagaaaaugcaaaaaucagaaacacuccugacccaggcuuuucccuccuuccccucucucucucucucucccucucccucucucucucucucucucucucucucucucucucucucucccucucccucucucucucucucucucucucucucucucucucucucucucucucaaugcuggagagcacaccuuuucccgcuaauauaguaaacaaaugugcaaccacuuaacuauacuccaucaccuccaaccugaaagugcucaagacaauuuacauuacuccuaaguguacuagcauuuaucuggauccccgugccaggucacaggugaauacacgggcuuuaggcauaguccaacacaccuuggaucacugacaugggaggaccauuggccacaaccauacgcuccacuagggauggguaguagauggagaacucccaggcaagggaggccccccagucguggcucacgaggaugcacuuggaguacccugguggugggaagagagagacacaaugguauaagauacaguagggaugagguagacguguaggaguaggucccaaaaggagcaaaaaugagaagaugagucauacccaggccuaggaugguauccuugaugucauccaacaacaagucaaugguguaacaauccacuuccuuuggagcaucagagggacuauaaccacgcaugucuacagccacgacauggaaauggcucugaaacucucgcagcugguagcgccagcugaaccuguuggguaagggaguugggaguuuagucagcagaaugcaccuccuauacccagcuuugggccaucccaccuuucugcucuggacuucuuaggaaggaaauaguggaaucccaggauuacucaacccuaccgguucccauuucccaaguaccucauagucagaacucuaccuuucccuaguccagugagcaucaggauccaggggcccagacauaccaguucucugggaagccaugcagaaauagcaugaguggcccauugccaugaccagcagagacauagugcagacgcaggccggaacucugcagaaggacccaaucuaaguaagagcugaaggguaaggaaauaugggagcuuccucccgagacuugaacacccaaggauguuccagauccgacauuucaaccuccuuucuucaauccgcauccgcccccugaaaccuaccuucacgggaggaacacucacccugaggguuagaaagcaaugcucgcccagcguggggucucucaggcacucugggggagacaaccucuggcggccgcagcagccccugcgaggacggcacaucacaugggugagcgcgaugcagcuguagacaaacgcggccaccaaggcagccaaguacaccaggcucaucaccagcgcucgcagcagcuucagcgagaggcgugagggugcgaguagcgcugucaccacaaacuccggcauauccuugcgcucugggacgacuacagagccgccguggucgggagacugagccaggggugcuggcgccagcagcccaccaccuuuguuuugggauuccaccgugcuaucggaguccacuggaccggucgaggaaacagaugcgcggcucggacagauacugccaccucucaugacucacucuaaaguggcagcuaaaguaccugggcagaacgagacacuuaaggaugaggggguuggggguggagccugcgaggaccugguuucggagguugcggaaagagggaccgugggcggagcccuaggacaugcuggauggaguuuaaacaggaacagagaauuaaaauuucuguagcagguggcaguguucaggaccuagaaaaggcucggcagguaagagcacuuggcagcacaccugcccaucuaacuuugaucccagggaaccacaaguggaaggagaggacugacucucaacuguucacacauauacugcagcacaugcaccccucuaugcuuuaaucucagcacucaagaggccgaggcaaauggaucucugaguucaagggcagaugauuuauaucuaaaguucuagacuagccagagcuacaaccccccccccccaaaaaaaaaaaaaagccacuggcaaagcucuaaggaaggagaguugaauccaggacgaaggaaggga

SEQ ID NO: 10840 - RNA, 2501 nt, Mus musculus
ucccuuccuucguccuggauucaacucuccuuccuuagagcuuugccaguggcuuuuuuuuuuuuuugggggggggggguuguagcucuggcuagucuagaacuuuagauauaaaucaucugcccuugaacucagagauccauuugccucggccucuugagugcugagauuaaagcauagaggggugcaugugcugcaguauaugugugaacaguugagagucaguccucuccuuccacuugugguucccugggaucaaaguuagaugggcaggugugcugccaagugcucuuaccugccgagccuuuucuagguccugaacacugccaccugcuacagaaauuuuaauucucuguuccuguuuaaacuccauccagcauguccuagggcuccgcccacggucccucuuuccgcaaccuccgaaaccagguccucgcaggcuccacccccaacccccucauccuuaagugucucguucugcccagguacuuuagcugccacuuuagagugagucaugagagguggcaguaucuguccgagccgcgcaucuguuuccucgaccgguccaguggacuccgauagcacgguggaaucccaaaacaaagguggugggcugcuggcgccagcaccccuggcucagucucccgaccacggcggcucuguagucgucccagagcgcaaggauaugccggaguuuguggugacagcgcuacucgcacccucacgccucucgcugaagcugcugcgagcgcuggugaugagccugguguacuuggcugccuugguggccgcguuugucuacagcugcaucgcgcucacccaugugaugugccguccucgcaggggcugcugcggccgccagagguugucucccccagagugccugagagaccccacgcugggcgagcauugcuuucuaacccucagggugaguguuccucccgugaagguagguuucagggggcggaugcggauugaagaaaggagguugaaaugucggaucuggaacauccuuggguguucaagucucgggaggaagcucccauauuuccuuacccuucagcucuuacuuagauuggguccuucugcagaguuccggccugcgucugcacuaugucucugcuggucauggcaaugggccacucaugcuauuucugcauggcuucccagagaacugguaugucugggccccuggauccugaugcucacuggacuagggaaagguagaguucugacuaugagguacuugggaaaugggaaccgguaggguugaguaauccugggauuccacuauuuccuuccuaagaaguccagagcagaaaggugggauggcccaaagcuggguauaggaggugcauucugcugacuaaacucccaacucccuuacccaacagguucagcuggcgcuaccagcugcgagaguuucagagccauuuccaugucguggcuguagacaugcgugguuauagucccucugaugcuccaaaggaaguggauuguuacaccauugacuuguuguuggaugacaucaaggauaccauccuaggccuggguaugacucaucuucucauuuuugcuccuuuugggaccuacuccuacacgucuaccucaucccuacuguaucuuauaccauugugucucucucuucccaccaccaggguacuccaagugcauccucgugagccacgacuggggggccucccuugccugggaguucuccaucuacuacccaucccuaguggagcguaugguuguggccaaugguccucccaugucagugauccaagguguguuggacuaugccuaaagcccguguauucaccugugaccuggcacggggauccagauaaaugcuaguacacuuaggaguaauguaaauugucuugagcacuuucagguuggaggugauggaguauaguuaagugguugcacauuuguuuacuauauuagcgggaaaaggugugcucuccagcauugagagagagagagagagagagagagagagagagagagagagagagagggagagggagagagagagagagagagagagagagagagagagagagagggagagggagagagagagagagaggggaaggagggaaaagccugggucaggaguguuucugauuuuugcauuuucuuuuauuuuuagaguguuuacacacaucaucagaucaucuuguugcuagagccuagcucugagcaugacauuaauuuaugcuuccuauauacuuccuguaccuagacuugaguagacugaaagaaauucauacaauaaucuuagugacuuuguacgugaaggaaaguucguggagcugacuauacuagcauauaccuacuacuaucagcacuugaggggcaggggcuggagggaugacucaacagaggagggcacuuguuauucaaagaacccaaguuggauucccaguguccagaugguaucccacuguacuccaguuccaaggcucuaaauguccuaaacugaccucugugga

SEQ ID NO: 10841 - RNA, 2501 nt, Mus musculus
gaaacagcauggaugucaucccagucugacuugugugugagcaaacuagccaggacgggagaccaaucaaacuuacuucaaacucaggcaaaugagugagauaacugcuucagaaaaccaccauuuaucuuuuauccuaacugcagauaacacaguccaucuacaaccuacccgugucccuccgagauacuauuucuuuauguccaucaagcuacaaaauauucaugaaugccauggauucagaggcccagacgccucuccaucaaugcauuaugauacuuuuuuggaaagaucagcuucauuucuuggaagguuaucauacuccucagaagugggcaagaaaaaugugcacuuagggccaccagcuucccuccaacacacgggccuuugacacuacucaccccgcugacacccgggaaucagagcccaccacgacacccccgucaaacuccacugccaugaugguugucugcagagagacaguacgaaaagucagagcuaggagcgucuugagccuccaucuuaaggaggagaaaauguccaugcaggaggugaccgacucaaggucacccugaaaagcaaggaugguuccuggaggcagacacaaucugcaugaggagagcaagaacugagaggaaggcccaggaaaccggccccgcugcuugugaauugcguaccacaugcaucauuacugugaauuacugugacacaagaccaggucuuuccugguccuggaucccccaccugcaaccuuacuuuaucagaaggggagccuuaguguuacugaacaagggacacagagaggccggggguuaacauggccaggagucgagacacagaagcagcaaggauccuucagguagggcacaaauuucacuuaagcgaagucucugcagccaggggaaaggacuucuggauagcagaguuuuuccaggucaaggaaagaauuacggauaagugaaggaggguagacacaucuacuucccccacaccuucuagguuaaaaggcaccuuaggagacccuugggugcacugagaaaacugacuuauggagacgaaugagcuucccaaguugacucaggucucacucugaacccuugauugauuugauuucuaagucccacagcuccguggcagcgagggagacuuuuuccaaccuuucuguccacuccaugucguucugaucuccggggacccugcccgcgagugugcuuucugagcacaaguaaaaggccagaaauguccacuuuguuccuccacaccauguuaacacugugguugguggcuuuuagagagcagaaaccagcugccaucuucccagcuccuaggucugggcaaaguucucaggcaagcaugggaaugacgguguugggacagggugggguggagugugcugcagggcagcaccuggaacaaggaggaccaccgaucauccccaucucccccucaauccuggcgccagagagcuuguccucacucagggugggggcugucuggggcuagguuaagcaaagaucuguaugauguguagguagguccuuuucagugagccuccauauuaccuucucucaggugcuucauccaggacaccucagcaccucuuuugcagggguccccaagccccucacuugauuuagccaguaaccccaacugcgcagucuagagugaaagcgaaagcgcuuuggagcaacuucccuuagacgcuuccagcucaagccaaagaacgcaccuucucaccagcuucgcaugcggaucccuccacagaccccuggacaccacacuucugagcagggauacccuacguucacuguggagcgcaagcgcugggcgcuacaagcuuccuaagucucuugguuuacuuccagagcuuuaggggucccugaucacuccacccgcugacucucaccccgagacccauuaccccgguguggacuucuuccguccggaacgagccggcgguaggugcuccugcccgcagcaucucagcagagcggggcucggcuuuccaaucagcggcugcgcgcggugcaggcaacuugcagacugaggccccgccccaucaucgcgcaaggggcgugccguucuaccagcauuuggcgcccagagcaaaccugagcagggcaaaucugcccagagacaggugacgacagaggguccugcccucaaucugggguggggccugggaugggaaaauucacgcaagcaaguuaagggggcuggggaagaagaggagaaugagauucauggagaagaacacgacaggccagggcugcuaggcagaacuccaacuacagcuucagcggcagcuuccagaacagccugagcaagccagucucagaaggaggcgugucuagugauucgaggucggcuuucgguuucuucuuccucuaaacgccagcacuucuagucagcuccaccagcucgagcggguucccgggacuuuacgcgcacgcccucggacccgcccuucuuccuuccccacggagacuccugugcagcgc

SEQ ID NO: 10842 - RNA, 2501 nt, Mus musculus
gcgcugcacaggagucuccguggggaaggaagaagggcggguccgagggcgugcgcguaaagucccgggaacccgcucgagcugguggagcugacuagaagugcuggcguuuagaggaagaagaaaccgaaagccgaccucgaaucacuagacacgccuccuucugagacuggcuugcucaggcuguucuggaagcugccgcugaagcuguaguuggaguucugccuagcagcccuggccugucguguucuucuccaugaaucucauucuccucuucuuccccagcccccuuaacuugcuugcgugaauuuucccaucccaggccccaccccagauugagggcaggacccucugucgucaccugucucugggcagauuugcccugcucagguuugcucugggcgccaaaugcugguagaacggcacgccccuugcgcgaugauggggcggggccucagucugcaaguugccugcaccgcgcgcagccgcugauuggaaagccgagccccgcucugcugagaugcugcgggcaggagcaccuaccgccggcucguuccggacggaagaaguccacaccgggguaaugggucucggggugagagucagcggguggagugaucagggaccccuaaagcucuggaaguaaaccaagagacuuaggaagcuuguagcgcccagcgcuugcgcuccacagugaacguaggguaucccugcucagaagugugguguccaggggucuguggagggauccgcaugcgaagcuggugagaaggugcguucuuuggcuugagcuggaagcgucuaagggaaguugcuccaaagcgcuuucgcuuucacucuagacugcgcaguugggguuacuggcuaaaucaagugaggggcuuggggaccccugcaaaagaggugcugagguguccuggaugaagcaccugagagaagguaauauggaggcucacugaaaaggaccuaccuacacaucauacagaucuuugcuuaaccuagccccagacagcccccacccugagugaggacaagcucucuggcgccaggauugagggggagauggggaugaucggugguccuccuuguuccaggugcugcccugcagcacacuccaccccacccugucccaacaccgucauucccaugcuugccugagaacuuugcccagaccuaggagcugggaagauggcagcugguuucugcucucuaaaagccaccaaccacaguguuaacaugguguggaggaacaaaguggacauuucuggccuuuuacuugugcucagaaagcacacucgcgggcaggguccccggagaucagaacgacauggaguggacagaaagguuggaaaaagucucccucgcugccacggagcugugggacuuagaaaucaaaucaaucaaggguucagagugagaccugagucaacuugggaagcucauucgucuccauaagucaguuuucucagugcacccaagggucuccuaaggugccuuuuaaccuagaaggugugggggaaguagaugugucuacccuccuucacuuauccguaauucuuuccuugaccuggaaaaacucugcuauccagaaguccuuuccccuggcugcagagacuucgcuuaagugaaauuugugcccuaccugaaggauccuugcugcuucugugucucgacuccuggccauguuaacccccggccucucugugucccuuguucaguaacacuaaggcuccccuucugauaaaguaagguugcaggugggggauccaggaccaggaaagaccuggucuugugucacaguaauucacaguaaugaugcaugugguacgcaauucacaagcagcggggccgguuuccugggccuuccucucaguucuugcucuccucaugcagauugugucugccuccaggaaccauccuugcuuuucagggugaccuugagucggucaccuccugcauggacauuuucuccuccuuaagauggaggcucaagacgcuccuagcucugacuuuucguacugucucucugcagacaaccaucauggcaguggaguuugacgggggugucguggugggcucugauucccgggugucagcggggugaguagugucaaaggcccguguguuggagggaagcugguggcccuaagugcacauuuuucuugcccacuucugaggaguaugauaaccuuccaagaaaugaagcugaucuuuccaaaaaaguaucauaaugcauugauggagaggcgucugggccucugaauccauggcauucaugaauauuuuguagcuugauggacauaaagaaauaguaucucggagggacacggguagguuguagauggacuguguuaucugcaguuaggauaaaagauaaauggugguuuucugaagcaguuaucucacucauuugccugaguuugaaguaaguuugauuggucucccguccuggcuaguuugcucacacacaagucagacugggaugacauccaugcuguuuc

SEQ ID NO: 10843 - RNA, 2501 nt, Mus musculus
uuccugguugucccaggaccuaaagaccccugugcauccauuuaucgcauuuuccaguuucuauaaaaugaugcucauuuauuugagugcugcccccauccccaggacgcacgccuagguggaucugcucaauacuccucucagguuccaacguucuagacaaccucuuuaggagauaggacccuauucaguccuccgcuguucccagaagaugcccccccccgucccccgccugugggucuucacgcaccccacugcuaggcggccuccgaaggcgcaccucuucuuccaccccacagcccauucucuagcugguuucacugauguggcagcaggaaaacucguccccaacacauuguuuuaguucagacacccauuaacugggcucuacucggaaagggcaggggaugggggugggggacugguucccuccccuugguacuguggcuuucgcuuucacuuccuugucgcagagucgacggaucuucggggccaaguggucauggcguuacuggaucugugcggugccgcucgggggcagcggcccgagugggcugcccuggaugcgggaagcgggggucgcucggacccgggacacuacaguuucuccgcgcaagcuccggagcucgcacuuccccggggaaugcaggugaggacuguagggcguucuggagagaugcaggagguggguggugguggguggcacagaggaaggagugucugccugggucugaggaggugaggacgccaggaggggccguccaggagagcagcaucgaggcuagcccugaagaaccaacguggagauuaaggcaugggaaggcgggagaaaggggugggggagggacagaaggagagagagucacgcacggaguugagacagcgagacugagaagaugguuggugccaaucccaagacacagugcacagaccaccaugccuuccacagacucacugcuaacuacuacaggggcuguacaguugucuuggaagaccuaugaacuuugguggccuuacuuggucucagcaacccacccuguguguccuacgacacauuagauggccuaggucucaagccccucuacuguaaaaugagagcaaguuauuaaaaugugcuuucgagaaccaaaggagccacggauuaggaaacaccuugaagucgccuaccaugaccuuuguucccacgugcuggaaagcagaaagcuggugggcuuaaauccugcuuuucuuucuucggagcuacugacaucuagagucugcagaccccuccucacucugccacccugccaggagccuccuagcacugaggugccccucugccucuugcaucucuuagcccaccgcauuccugagguccuuugguggugaccaggaaaggaauguucaaauugagauggcccacggcacaaccacacucgccuucaaguuccagcauggcgucaucguggcuguggacuccagggccacugcagggaguuacauuagugaguaugugugcuccaugugugcuccaaugguccgacucguggagcuguucccucaguagagcagaaggccugggccgaaguucagacagagcuggcauuauagcacacugagggugggggugggauggggggugagggguggguggggagcugugggcucauuucuuugaucucaaaacucuuccaggcuccuuaaggaugaacaaagugaucgagauuaacccuuaccugcuuggcaccaugucugguugugcagccgacugccaguacugggagaggcuguuggccaaggagugcagguaggccgguuuuaucaucucauuuguucagccccucccccguccccaccaugucccaggucacuuacacccccaucgggugauccauuuuagcaaccauaagggauauauauauauauauauauauauauauauauauauauauauauauauaucuccuucaugugauuaaaaaucucccaaauccuagccugggucccugcuuauaaaccagauaaucuggcagucacuuaaccugcagggugguaucauuuacuaggcuuuuaaaaugcggaucagagauuuuaaauucccaaacucuccuuuacucuuaugucccgucccacaaguccauaccuuccaaacacucaucucuacaaucccugcucccucgugcuaugggagaaaaugaaugcagguguagcugccgccccugaggccuccuucucucuccuccuccuccucgaucgaucguacagguuguauuaucuucggaauggggaacgcaucuccgugucugcagcauccaagcugcuuuccaacaugaugcugcaguaccgggggaugggccucuccaugggcagcaugaucuguggcugggacaagaagguggguggccuaugucugugagccccccccccccccgaggugucuuacccauugaacccuccccucccccaugcuugauccagguuuugauguuuaccaaagugugcugucuuuuguuuuuguuuuu

SEQ ID NO: 10844 - RNA, 2501 nt, Mus musculus
aaaaacaaaaacaaaagacagcacacuuugguaaacaucaaaaccuggaucaagcaugggggaggggaggguucaauggguaagacaccucggggggggggggggcucacagacauaggccacccaccuucuugucccagccacagaucaugcugcccauggagaggcccaucccccgguacugcagcaucauguuggaaagcagcuuggaugcugcagacacggagaugcguuccccauuccgaagauaauacaaccuguacgaucgaucgaggaggaggaggagagagaaggaggccucaggggcggcagcuacaccugcauucauuuucucccauagcacgagggagcagggauuguagagaugaguguuuggaagguauggacuugugggacgggacauaagaguaaaggagaguuugggaauuuaaaaucucugauccgcauuuuaaaagccuaguaaaugauaccacccugcagguuaagugacugccagauuaucugguuuauaagcagggacccaggcuaggauuugggagauuuuuaaucacaugaaggagauauauauauauauauauauauauauauauauauauauauauauauauaucccuuaugguugcuaaaauggaucacccgauggggguguaagugaccugggacaugguggggacgggggaggggcugaacaaaugagaugauaaaaccggccuaccugcacuccuuggccaacagccucucccaguacuggcagucggcugcacaaccagacauggugccaagcagguaaggguuaaucucgaucacuuuguucauccuuaaggagccuggaagaguuuugagaucaaagaaaugagcccacagcuccccacccaccccucaccccccaucccacccccacccucagugugcuauaaugccagcucugucugaacuucggcccaggccuucugcucuacugagggaacagcuccacgagucggaccauuggagcacacauggagcacacauacucacuaauguaacucccugcaguggcccuggaguccacagccacgaugacgccaugcuggaacuugaaggcgagugugguugugccgugggccaucucaauuugaacauuccuuuccuggucaccaccaaaggaccucaggaaugcggugggcuaagagaugcaagaggcagaggggcaccucagugcuaggaggcuccuggcaggguggcagagugaggaggggucugcagacucuagaugucaguagcuccgaagaaagaaaagcaggauuuaagcccaccagcuuucugcuuuccagcacgugggaacaaaggucaugguaggcgacuucaagguguuuccuaauccguggcuccuuugguucucgaaagcacauuuuaauaacuugcucucauuuuacaguagaggggcuugagaccuaggccaucuaaugugucguaggacacacaggguggguugcugagaccaaguaaggccaccaaaguucauaggucuuccaagacaacuguacagccccuguaguaguuagcagugagucuguggaaggcaugguggucugugcacugugucuugggauuggcaccaaccaucuucucagucucgcugucucaacuccgugcgugacucucucuccuucugucccucccccaccccuuucucccgccuucccaugccuuaaucuccacguugguucuucagggcuagccucgaugcugcucuccuggacggccccuccuggcguccucaccuccucagacccaggcagacacuccuuccucugugccacccaccaccacccaccuccugcaucucuccagaacgcccuacaguccucaccugcauuccccggggaagugcgagcuccggagcuugcgcggagaaacuguagugucccggguccgagcgacccccgcuucccgcauccagggcagcccacucgggccgcugcccccgagcggcaccgcacagauccaguaacgccaugaccacuuggccccgaagauccgucgacucugcgacaaggaagugaaagcgaaagccacaguaccaaggggagggaaccagucccccacccccauccccugcccuuuccgaguagagcccaguuaaugggugucugaacuaaaacaauguguuggggacgaguuuuccugcugccacaucagugaaaccagcuagagaaugggcugugggguggaagaagaggugcgccuucggaggccgccuagcaguggggugcgugaagacccacaggcgggggacgggggggggcaucuucugggaacagcggaggacugaauaggguccuaucuccuaaagagguugucuagaacguuggaaccugagaggaguauugagcagauccaccuaggcgugcguccuggggaugggggcagcacucaaauaaaugagcaucauuuuauagaaacuggaaaaugcgauaaauggaugcacaggggucuuuagguccugggacaaccaggaa

SEQ ID NO: 10845 - RNA, 2501 nt, Mus musculus
cugcaucugugaggauaugggggaggcucagaacuggcucccauaaggaucaucuguguacuuauuaagagacaggaguaagccauuacaggacucauuucuuuaaauaauacaaugguagaaagagauagaucccaagauacacuugcagaugaugagcucugagcuguugucuuagccagagauuguaacaauaucauauggaacucuuuagagucacacuuaacuuaaaaaaaaauccuuucauagcuauaauauucuacuguuuuaguuuucuucucugugcuaugauagaacguuggcaaaaaccaaguugaggaggaaaggauuuauuucauuuucuacuuucacaucucagugcaucacugagagaacccagagcaggaacucaaacaggagcccagaggcagaggcugugaagaaacagcagguucuccguggcaugcucagccugcuugcuuagauuguuaggaccacggacccaguguaggcuggaugcucccaaaucaauaaucacgaugucucacagacuuaccacauacagccaaucugaaagaaauguuuuucucggcugauuuuuuguuuucaauuccucauuuaggaaggguucccucuucccagaugacccuugcuugagucaauuuggcaaacaaacaaaaacaacaacaaaacuaaccacacaaaacuaacuacuaugucuucuuuagacucaugaauaacuguuguaauuuauuuuuuuucuugagauacauguccaugucuuaugcauucuaggcuggccucaaacucaauucacaaugaagucaaagaugacauugagcuuuugacgcucuuaacuccaucacccaagugcugcaauuauagaacacuccuauucagugcugaguauugaauauagggcuccauguauucuacgcaaccacuguucauacugagcuagcuacccaacauguuaggaugguggcacaugccuguaauuccagcaccugugggggcagagaaaauaggauccgcuaaguagugacuuugaggccaguuugagcuacaugagacucuguaccuaaacaaacaaacuggaacaaaggaacagacagccauaggugugugugugaucuuuaccagaaccuccuggagcuucuggucuucuugacauuuccuaucuucuaucuugucccucuccauucuuagagcuucuaaccgacuccugagacgauccugucagaaaaaagaaagcagagggucggugaauaaucccacuggcaaauaccgugugcuauguuguggacacaccaccgaggcugagagauucaaacugacaagaguccuaauccuugaccuucauuguaucaccauuuagggcaagaauuggguuggguggcacuauggagauagaaagugugugguaaguaagguguaugugcccgcagggaaaccaggagcaaagaggaggacugagaggauuuuagacaguaaaucucuaucccuuuuccuucacucacccacaucaggucaccauccugcccccacgaagcagcgccucagcuccuuacccuguaggguuggauggcuucauccaggaaccccacagugugugccuggugggcggggcccucccugcagaacacgcagagcagcuccgcgucugucuuacagaagaaauagaucuucucuccgugcucuucacaguaggucucgcucaggggaccuagggacaccggggccacugcggccuggauuuucuccucuucugcccccugacagagagggcacagcagcugggcucccauuggggugcgcgggaggcagaguaggcagacaguguguccgcaggcuguggucaccgcauccugcaagggucgggugcagacaggacaggcuacuuggugaaguccccgcagggaccggguugagggcaucaccgugccuuccccugccuguccacagucuucugacucgguccacuccaauuuccuuucccugaaacugagucacuuuuaagugcgucacugucacagaagcaaaggaaucggaggcugaaagaaaggcaggaaugucagcucagcgaggucaccuggcugccacgcccagaacccagcagcuaagcagguccaaacuccagggcgucuugacuacccagcguuucccaggggcaggcaggugaccuagcucuccacuccugucgccuucggucccuuggguggggagcagcguauugcaucaugaggucacuuggaaaugggguuuccuggaaucucuuggcuacagagaggugaggccauuggggaggagccgcuuccugucacgcugggcaggugagagccauaguucaggcuaggaggcuggcaguggcaucagaguccagccugugauguugagacugaccucgaauuucgagcccaaaugcacguuccccucgucuggcaauaugcacucaccaccaccuccaccaccaccaccaccaccccaagaaauuacuccagaacaaccaauuuaauaacaac

SEQ ID NO: 10846 - RNA, 2501 nt, Mus musculus
guuguuauuaaauugguuguucuggaguaauuucuuggggugguggugguggugguggaggugguggugagugcauauugccagacgaggggaacgugcauuugggcucgaaauucgaggucagucucaacaucacaggcuggacucugaugccacugccagccuccuagccugaacuauggcucucaccugcccagcgugacaggaagcggcuccuccccaauggccucaccucucuguagccaagagauuccaggaaaccccauuuccaagugaccucaugaugcaauacgcugcuccccacccaagggaccgaaggcgacaggaguggagagcuaggucaccugccugccccugggaaacgcuggguagucaagacgcccuggaguuuggaccugcuuagcugcuggguucugggcguggcagccaggugaccucgcugagcugacauuccugccuuucuuucagccuccgauuccuuugcuucugugacagugacgcacuuaaaagugacucaguuucagggaaaggaaauuggaguggaccgagucagaagacuguggacaggcaggggaaggcacggugaugcccucaacccggucccugcggggacuucaccaaguagccuguccugucugcacccgacccuugcaggaugcggugaccacagccugcggacacacugucugccuacucugccucccgcgcaccccaaugggagcccagcugcugugcccucucugucagggggcagaagaggagaaaauccaggccgcaguggccccggugucccuagguccccugagcgagaccuacugugaagagcacggagagaagaucuauuucuucuguaagacagacgcggagcugcucugcguguucugcagggagggccccgcccaccaggcacacacugugggguuccuggaugaagccauccaacccuacaggguaaggagcugaggcgcugcuucgugggggcaggauggugaccugaugugggugagugaaggaaaagggauagagauuuacugucuaaaauccucucaguccuccucuuugcuccugguuucccugcgggcacauacaccuuacuuaccacacacuuucuaucuccauagugccacccaacccaauucuugcccuaaauggugauacaaugaaggucaaggauuaggacucuugucaguuugaaucucucagccucggugguguguccacaacauagcacacgguauuugccagugggauuauucaccgacccucugcuuucuuuuuucugacaggaucgucucaggagucgguuagaagcucuaagaauggagagggacaagauagaagauaggaaaugucaagaagaccagaagcuccaggagguucugguaaagaucacacacacaccuauggcugucuguuccuuuguuccaguuuguuuguuuagguacagagucucauguagcucaaacuggccucaaagucacuacuuagcggauccuauuuucucugcccccacaggugcuggaauuacaggcaugugccaccauccuaacauguuggguagcuagcucaguaugaacagugguugcguagaauacauggagcccuauauucaauacucagcacugaauaggaguguucuauaauugcagcacuugggugauggaguuaagagcgucaaaagcucaaugucaucuuugacuucauugugaauugaguuugaggccagccuagaaugcauaagacauggacauguaucucaagaaaaaaaauaaauuacaacaguuauucaugagucuaaagaagacauaguaguuaguuuugugugguuaguuuuguuguuguuuuuguuuguuugccaaauugacucaagcaagggucaucugggaagagggaacccuuccuaaaugaggaauugaaaacaaaaaaucagccgagaaaaacauuucuuucagauuggcuguaugugguaagucugugagacaucgugauuauugauuugggagcauccagccuacacuggguccgugguccuaacaaucuaagcaagcaggcugagcaugccacggagaaccugcuguuucuucacagccucugccucugggcuccuguuugaguuccugcucuggguucucucagugaugcacugagaugugaaaguagaaaaugaaauaaauccuuuccuccucaacuugguuuuugccaacguucuaucauagcacagagaagaaaacuaaaacaguagaauauuauagcuaugaaaggauuuuuuuuuaaguuaagugugacucuaaagaguuccauaugauauuguuacaaucucuggcuaagacaacagcucagagcucaucaucugcaaguguaucuugggaucuaucucuuucuaccauuguauuauuuaaagaaaugaguccuguaauggcuuacuccugucucuuaauaaguacacagaugauccuuaugggagccaguucugagccucccccauauccucacagaugcag

SEQ ID NO: 10847 - RNA, 2501 nt, Mus musculus
ugugagccaccagugccauccuagagauguccaggcacaaauggucagauggguggcuugaguuucgcuccacacacaaagccuuucuaugccucaguuucgccaaccucaacgucucagucgguagggcgcuugcuaguaugcacaaagccuggagugucaucccuaaaugcugggagacugaggcaggaggaucaggaguucgaggucauccuuugcugcaagugaguuggaggccagccugggcuacaugagacccuuagcaguaacucuugcugucaaugccuccugcaccgauuaccaguuggggagacuaaggcggacagacaguuggccauggcuuuugggucacucuggcugacuacugcccgccugucucuccuugggguucgaccuccuagcuccaucugcagcccuugaggucugagcccaccucccucccuccgcucgcggacccgcagcugccgacgccucccaccccucccccucgcccggcacaaagcgacggacggacgcagcggugacggacgacgccucccgcccugcgccaccuccagccgcgacccugcgcgaugcucgggccucucgcccaaucccugcccggcccuggucccaagggcaacucgguccccacgccgguggucucguccuccgggauccuccaggguccgaguccugcugucuccaccccggagccacagaaggucugaggucugcaggucuguccgcaaggcgggacccaaugggacgcggguguucucgccccuccgguggcccugagaacccgggccuggacucagugguuuaagucccuuuuguugugcaguggcggcggcugcaggcgguuaagggauaggggagguuaagggauugagggggcgguguggagcaggaguuaggggaccgggagguuaaaggaaauggaggggucuggagauuaaggaauacuggagauggaauuaaaggauucagagauuaagggauggagauaaaggauuggaggugugacgggggcggggugugaaggaucaggggucaagaaaucuggguaauucggacugguggggcucgcgggaucggacagcagccccacagggaguacgacccucuggaguggcucagccucugacaacuuuaugcauggagcugaagggguaaugugaaacagcccuguugacaucacaccugcaacacggacccuaaaguucgcaguucccgcagacccuuggccugcagcaccagggucgccaccugcugcccccucugcucugagcccagccaaggacuucugaccuccaaucuuccuguccucuuccucuucucucuucucccuucuuccuccccccuuuugucucccccuccucuucucuccccuccuuccuccccccagccccaggacgagcugcagagcuaggcaugaagguccuuguuugacaccagcauauuuugggggcaccaauggccaaguggcuccgagacuaucugaacuugggcagccggaggccgccuccgcagccgcccacccccgacuacaccgagagcgacauccugcgggccuaccgcgaacagaaggaccuggacuucgaggaccccuaugaggauuccaauggccgcgcugagccagaggucaccggguccggugaccccaaguacaacucuccuaggcaccggcugaucaagguggaggcugcagacauggccagagccaaggcucugcuggggagcccgggggaagaggugcguggaggaccuggacggguguucugucccuaucacccuggguuccccaccucaucccccgcccccuggggaguccaagaucuucugggcuagccauuaucccccucggcccauucucccuucagggagacagaggguagguguuguuuuugguuugugugagaccugguccaacauugcccaggcugaccuaaaacuagcuacaaugaguuugaacuccugauccuccugcugccuguacuucugaagugugugucacaggaugacaggcaugugucacagucacuguuuaugcugugccugauggaagcuggaccuggugcaugcccugcuugguuuuaccgaaggcugagaccccuuuaaggucgaaugacccuuucacagggguugccuaaaaccaucagaaaacacagauaauaaauuuuaaaaaucauaauucauuuuuuaaaguuacaguuaugaaauagcaacaaaauuauuuuaugguuggguguugcgguguuaggaaaguccagaaccacugcucuguugguuucguuugguuugguuugguuugguuuggauugguuugguuugguuugguuugguuugguuugguuuggggacagguucucccugugcaguccaagcugcucuaaaacuuguaguccucuuaccccacaaaucucuggaaggcauaagagaaguaaggaacacagagagacaagacacacugggaucaaggccugccucguacucaugugugacccugugugacucuc

SEQ ID NO: 10848 - RNA, 2501 nt, Mus musculus
gagagucacacagggucacacaugaguacgaggcaggccuugaucccagugugucuugucucucuguguuccuuacuucucuuaugccuuccagagauuugugggguaagaggacuacaaguuuuagagcagcuuggacugcacagggagaaccuguccccaaaccaaaccaaaccaaaccaaaccaaaccaaaccaauccaaaccaaaccaaaccaaaccaaacgaaaccaacagagcagugguucuggacuuuccuaacaccgcaacacccaaccauaaaauaauuuuguugcuauuucauaacuguaacuuuaaaaaaugaauuaugauuuuuaaaauuuauuaucuguguuuucugaugguuuuaggcaaccccugugaaagggucauucgaccuuaaaggggucucagccuucgguaaaaccaagcagggcaugcaccagguccagcuuccaucaggcacagcauaaacagugacugugacacaugccugucauccugugacacacacuucagaaguacaggcagcaggaggaucaggaguucaaacucauuguagcuaguuuuaggucagccugggcaauguuggaccaggucucacacaaaccaaaaacaacaccuacccucugucucccugaagggagaaugggccgagggggauaauggcuagcccagaagaucuuggacuccccagggggcgggggaugagguggggaacccagggugauagggacagaacacccguccagguccuccacgcaccucuucccccgggcuccccagcagagccuuggcucuggccaugucugcagccuccaccuugaucagccggugccuaggagaguuguacuuggggucaccggacccggugaccucuggcucagcgcggccauuggaauccucauagggguccucgaaguccagguccuucuguucgcgguaggcccgcaggaugucgcucucgguguagucgggggugggcggcugcggaggcggccuccggcugcccaaguucagauagucucggagccacuuggccauuggugcccccaaaauaugcuggugucaaacaaggaccuucaugccuagcucugcagcucguccuggggcuggggggaggaaggaggggagagaagaggagggggagacaaaaggggggaggaagaagggagaagagagaagaggaagaggacaggaagauuggaggucagaaguccuuggcugggcucagagcagagggggcagcagguggcgacccuggugcugcaggccaagggucugcgggaacugcgaacuuuaggguccguguugcaggugugaugucaacagggcuguuucacauuaccccuucagcuccaugcauaaaguugucagaggcugagccacuccagagggucguacucccuguggggcugcuguccgaucccgcgagccccaccaguccgaauuacccagauuucuugaccccugauccuucacaccccgcccccgucacaccuccaauccuuuaucuccaucccuuaaucucugaauccuuuaauuccaucuccaguauuccuuaaucuccagaccccuccauuuccuuuaaccucccgguccccuaacuccugcuccacaccgcccccucaaucccuuaaccuccccuaucccuuaaccgccugcagccgccgccacugcacaacaaaagggacuuaaaccacugaguccaggcccggguucucagggccaccggaggggcgagaacacccgcgucccauugggucccgccuugcggacagaccugcagaccucagaccuucuguggcuccgggguggagacagcaggacucggacccuggaggaucccggaggacgagaccaccggcguggggaccgaguugcccuugggaccagggccgggcagggauugggcgagaggcccgagcaucgcgcagggucgcggcuggagguggcgcagggcgggaggcgucguccgucaccgcugcguccguccgucgcuuugugccgggcgagggggaggggugggaggcgucggcagcugcggguccgcgagcggagggagggaggugggcucagaccucaagggcugcagauggagcuaggaggucgaaccccaaggagagacaggcgggcaguagucagccagagugacccaaaagccauggccaacugucuguccgccuuagucuccccaacugguaaucggugcaggaggcauugacagcaagaguuacugcuaagggucucauguagcccaggcuggccuccaacucacuugcagcaaaggaugaccucgaacuccugauccuccugccucagucucccagcauuuagggaugacacuccaggcuuugugcauacuagcaagcgcccuaccgacugagacguugagguuggcgaaacugaggcauagaaaggcuuuguguguggagcgaaacucaagccacccaucugaccauuugugccuggacaucucuaggauggcacugguggcucaca

SEQ ID NO: 10849 - RNA, 2501 nt, Mus musculus
gggccgacucggugccgggcugcggaggaaggagagggggaggaggaggaggcguggagggaggaagggccggggcagccccggagggaggcgagggggaggggagggggccggccggcccgagggugggggggcagccaaugagcagcgcgcggcgcggggagggcgggggggggaaugagguaggaugggggagggcgcagccggagcggcggaggcuccagccauaaacaagcgcccggaggagcggcgcgggagagagccgagccgggcacaaggaacggacgccacggaccuucugcugagccaccgcgcccacucggcggcucgggaggcggggaccggcccggaggcugcgcugccgucgucuuuccccggcaaucaggagcagcgcggaggaccagaaggagccaccagcccuucuucggagcggugcgcagccaccgccgccgccagaaguuuggguugaaccggagcugccgagaggaaacuuuuuuuccucuuuucccccucccgcccgggaggagaaggaggaggaggggaagccacccgccaccgcugccgcuggcgccaacgcucgugggcuccgggucggcgcggcccgcaggggcggcgggggccucgccccgcgaggggaggagcgccccgggggccccuaguggggcacgaggaccgcgggcugcgggugcggcggcggcgcgugugccccgcgcaggggagggcgcccgccccgcucccggcccgacugcgaggaggaggcggcggcgcaggaggauguacuugguggcggggggcagggggcuggccggcugcgggcaccucucggucucgcugcuggggcugcugcugcugcuggcgcgcucaggcacccgggcgcuggucugccugcccugugacgaguccaagugcgaggagccucggagcugcccaggaagcaucgugcagggcgucugcggcugcugcuacaugugcgcccgccagaggaacgagagcugcgguggagccuaugggcuccauggagccugcgaccgggggcugcgcugugucauccgccccccgcucaauggcgacuccaucaccgaguacgaagugggcgucugcgaagguacggcugcccugcugcgcgcccccucccaccuggcgggcgcggaacaaaguuugcuugagacuuuucccagaggagagaggguucccggggaggagggacggucgcuguccccuggagggugcccuagaugccugcccaggggcgggcgagguuggguugcgugggugagcuccgaacacgcauagacacacacaggugcggugauuagggcuuacacuggguggccuuucucgccccaggcaggggugcccugugcgggggcacacugcggagucuggcacgcacaagucccucggggaguccgccccugcugcccugcccgcauagcgcaguguggcaccgagggcguacgcaguccgcgcagccggcuucugauagcggaguagaccugugcuccagccugcacucccuaugugacucuuacuauuuuuucuuugcgcucuuccuucaccuccuucuuccuccuucgcguaauaaaucaguuucagcuccggaguaugucaguccaggcgaaguugcacauggcgauuacucauuuauuugccuauuggaaacggucaaaggcuuacucuucuggauggcugaagggggugggugggggcugcaccuggauuaaaaaguuaugguucacuacaagagguuuccuuucaagagccaaccucugcguguuucuagagcuggugcuguugucuuuuuguuuguuugacagcagauucugcucugcucgcuucaccguggcgcaucaugcaccgcuguguguagauguacugagggcgggggcguugauaguggcgccucccuguuucggaagcacuguuggacccggugggccuccaucagcacauggcucuacuucugccucaaggugcccgauuaggucugaggucuagagagaaauagugaguucuuuuauuuugacaauggacuggauugucuguuaaaagugggguccuugucuuccuagagaucaaacauuugggcuccucgaugcuguucccgguaucuugccagggauuagggcucacuuguaagaaaagacaacugcucucugccuuuacugcuguuaaccagccccugggacaggacacugguguauccugaaguauccucgugugugugugugugugugugugugugugugugugugugugugugugugaugugugucgaacugagaugcuggaaaggacaaagguggcuguauuaaauggcuucaguacugugguaacucuuuaaacacacaugcauuuauuuuugcgugugguuuuaagguuuuggacaguuguggaauaaucggggaagccuuccugguuuggaagcuagugggcaguaaugagugugcaggggggauggcggcacuggggggacaggggggugggguggggguggggug

SEQ ID NO: 10850 - RNA, 2501 nt, Mus musculus
caccccacccccaccccaccccccuguccccccagugccgccauccccccugcacacucauuacugcccacuagcuuccaaaccaggaaggcuuccccgauuauuccacaacuguccaaaaccuuaaaaccacacgcaaaaauaaaugcauguguguuuaaagaguuaccacaguacugaagccauuuaauacagccaccuuuguccuuuccagcaucucaguucgacacacaucacacacacacacacacacacacacacacacacacacacacacacacacgaggauacuucaggauacaccaguguccugucccaggggcugguuaacagcaguaaaggcagagagcaguugucuuuucuuacaagugagcccuaaucccuggcaagauaccgggaacagcaucgaggagcccaaauguuugaucucuaggaagacaaggaccccacuuuuaacagacaauccaguccauugucaaaauaaaagaacucacuauuucucucuagaccucagaccuaaucgggcaccuugaggcagaaguagagccaugugcugauggaggcccaccggguccaacagugcuuccgaaacagggaggcgccacuaucaacgcccccgcccucaguacaucuacacacagcggugcaugaugcgccacggugaagcgagcagagcagaaucugcugucaaacaaacaaaaagacaacagcaccagcucuagaaacacgcagagguuggcucuugaaaggaaaccucuuguagugaaccauaacuuuuuaauccaggugcagcccccacccacccccuucagccauccagaagaguaagccuuugaccguuuccaauaggcaaauaaaugaguaaucgccaugugcaacuucgccuggacugacauacuccggagcugaaacugauuuauuacgcgaaggaggaagaaggaggugaaggaagagcgcaaagaaaaaauaguaagagucacauagggagugcaggcuggagcacaggucuacuccgcuaucagaagccggcugcgcggacugcguacgcccucggugccacacugcgcuaugcgggcagggcagcaggggcggacuccccgagggacuugugcgugccagacuccgcagugugcccccgcacagggcaccccugccuggggcgagaaaggccacccaguguaagcccuaaucaccgcaccugugugugucuaugcguguucggagcucacccacgcaacccaaccucgcccgccccugggcaggcaucuagggcacccuccaggggacagcgaccgucccuccuccccgggaacccucucuccucugggaaaagucucaagcaaacuuuguuccgcgcccgccaggugggagggggcgcgcagcagggcagccguaccuucgcagacgcccacuucguacucggugauggagucgccauugagcggggggcggaugacacagcgcagcccccggucgcaggcuccauggagcccauaggcuccaccgcagcucucguuccucuggcgggcgcacauguagcagcagccgcagacgcccugcacgaugcuuccugggcagcuccgaggcuccucgcacuuggacucgucacagggcaggcagaccagcgcccgggugccugagcgcgccagcagcagcagcagccccagcagcgagaccgagaggugcccgcagccggccagcccccugccccccgccaccaaguacauccuccugcgccgccgccuccuccucgcagucgggccgggagcggggcgggcgcccuccccugcgcggggcacacgcgccgccgccgcacccgcagcccgcgguccucgugccccacuaggggcccccggggcgcuccuccccucgcggggcgaggcccccgccgccccugcgggccgcgccgacccggagcccacgagcguuggcgccagcggcagcgguggcggguggcuuccccuccuccuccuucuccucccgggcgggagggggaaaagaggaaaaaaaguuuccucucggcagcuccgguucaacccaaacuucuggcggcggcgguggcugcgcaccgcuccgaagaagggcugguggcuccuucugguccuccgcgcugcuccugauugccggggaaagacgacggcagcgcagccuccgggccgguccccgccucccgagccgccgagugggcgcgguggcucagcagaagguccguggcguccguuccuugugcccggcucggcucucucccgcgccgcuccuccgggcgcuuguuuauggcuggagccuccgccgcuccggcugcgcccucccccauccuaccucauucccccccccgcccuccccgcgccgcgcgcugcucauuggcugcccccccacccucgggccggccggcccccuccccucccccucgccucccuccggggcugccccggcccuuccucccuccacgccuccuccuccucccccucuccuuccuccgcagcccggcaccgagucggccc

SEQ ID NO: 10851 - RNA, 2501 nt, Mus musculus
uggggcgcaacaucagagaugcuggaaaguccuggcaacacuuauagagggggagcacaugucuuggccugcccaguugaacccggccuuaucuuaccugagaucucaguuucgaggaauuggggguuggggggcgacgcagcgcgaaaccucaaacccugcgcccagaggcacuccuuuuuucaaaggaggaaaagaaggacugacccagcccucccggaggcuuuaccugguaaagaggaugagcagccacagcagcgcgguggaaaggguguccuggcuggcuccgaagauguccguaauaguggcaggcacauccuccaaguccagcccggaggaaucgucgccaggggccccagacgcuuucuuuucggcagagaggaugaaggcguccgucaugucucgaggagcagccccgggcaccaggcuuucgcggugccucaggaacuuguccagaacgaaguugcugaaguugcgguugagcugcucgaacuugcggaagguggugcgcaccggguugggaaauagcugcagccagggcagcacauccaccaggcugcccgcacccacugugcgcccgaacuccucauuguggcugagcagcucuaggaacuccgcaucgucgugguuguaccgacagccgaagcacacagcgcucaugacguuggccaccgccacaaugaccggcugcguuggaucgaggaaggcgccgcccgcacagcgccgcaccagcacugccaccaauucucgagccucugccagcgcguggcccucgagaagaccgcgacugcgcggguggcgcguggagaaagcacgcaucgugcuauaggccgagcgucgcugcgucuuccagugcucagaguagugaccgaacgccagacugcggccaccagacaccacacggaaagaggcgaagggcggccgguccgcgaagaugcugcccugcugcaccagggccugguggauggcacucucuccauucagcaccaccacgggacagcugcccagacggaucuggaaaacgucgccauagcgccuugcaaggcgagcgaaguacaagugcgacgccuggccaacagccgccgcguuuccgaucaguggccaaggaaagggaccugggggcgaggaccacgguuuccguugccacugucgcagcagccacuggccuaagugcacggcggccaggacggagaagaguagcagaagaguggucugcuggguagacagcgagcucagcugcuguggacugucugcacuaaggcugguggccaugcuggggacacaaaggcaaaccgugaaacucaggugugcaaaggaaaaaaagagugcccuccgucccgcgucucggccccagcauggggcuuuacccugggauugaguagagaggaggcagugcauaauucagguaaaggcuagcuuucugggcaagaugcuuaaaacuauguuuccuacccaacucagccuccagcagagaccuaucggcuuccaaauccccagcugccuaacgguucccagaauuccgacacaaugccgguggguggcagacacugaggcagguuucuuuuaaaguaccuaauacccccaccccugaccuucaagaacugcccugaagagaccucaggaaaguggcuccgcggacagacugaccugcgaugaagcgugguuuccagcgguguagagcagcgggaucugggagaagcucuggagccucugcccagauucuggcaaggcuucaaccugagaguccccagggaccccgagaccuagacaccugaggcccgcugcuuuagcaccuacucuugacucaaucagagccuaaacuuagauuaggauggaggacagggacaaaagugucucaaguuugcaccugggaccccgcaaagucagggcuuucucacggaguugggguugcaguugagaagggucgggggugggaguugauaaaguggaguuaaaucccagcccgcuggcaguuuucaagcuggcgucgcagaggugucugcaacgcaccccagaggcgaugcgccaucccucuacuccgggguuuuaaggacuggguagagacuggaggaagcgggaccuuaggggguggggcgugaggggcgggacgcacugcgaaaauccacagaucugugaguugggucucacauccgugcuuagugacccagggugguccagugggaaauccgcgccucuggcugggacccuccugaaacaauagcuggcagcuuuguuaggauccgccuuguaaaguuuuccuuuggcgacaagggcuugucgucagucauccuccccaccccccaccccccagucaagacccccacgcuuuccucagaaccgagcuugggacagaauuuccaacgccucugcgcgcuggagcaaagcucaaccaggagcacgcccuccuccuccaggugacucgaguuuggugccuugcucaugauccuuaggcaccgagccaggaaaagaaacuugcuauuuuaauaucaggacagcuuggu

SEQ ID NO: 10852 - RNA, 2501 nt, Mus musculus
accaagcuguccugauauuaaaauagcaaguuucuuuuccuggcucggugccuaaggaucaugagcaaggcaccaaacucgagucaccuggaggaggagggcgugcuccugguugagcuuugcuccagcgcgcagaggcguuggaaauucugucccaagcucgguucugaggaaagcgugggggucuugacuggggggugggggguggggaggaugacugacgacaagcccuugucgccaaaggaaaacuuuacaaggcggauccuaacaaagcugccagcuauuguuucaggagggucccagccagaggcgcggauuucccacuggaccacccugggucacuaagcacggaugugagacccaacucacagaucuguggauuuucgcagugcgucccgccccucacgccccacccccuaaggucccgcuuccuccagucucuacccaguccuuaaaaccccggaguagagggauggcgcaucgccucuggggugcguugcagacaccucugcgacgccagcuugaaaacugccagcgggcugggauuuaacuccacuuuaucaacucccacccccgacccuucucaacugcaaccccaacuccgugagaaagcccugacuuugcggggucccaggugcaaacuugagacacuuuugucccuguccuccauccuaaucuaaguuuaggcucugauugagucaagaguaggugcuaaagcagcgggccucaggugucuaggucucggggucccuggggacucucagguugaagccuugccagaaucugggcagaggcuccagagcuucucccagaucccgcugcucuacaccgcuggaaaccacgcuucaucgcaggucagucuguccgcggagccacuuuccugaggucucuucagggcaguucuugaaggucagggguggggguauuagguacuuuaaaagaaaccugccucagugucugccacccaccggcauugugucggaauucugggaaccguuaggcagcuggggauuuggaagccgauaggucucugcuggaggcugaguuggguaggaaacauaguuuuaagcaucuugcccagaaagcuagccuuuaccugaauuaugcacugccuccucucuacucaaucccaggguaaagccccaugcuggggccgagacgcgggacggagggcacucuuuuuuuccuuugcacaccugaguuucacgguuugccuuuguguccccagcauggccaccagccuuagugcagacaguccacagcagcugagcucgcugucuacccagcagaccacucuucugcuacucuucuccguccuggccgccgugcacuuaggccaguggcugcugcgacaguggcaacggaaaccgugguccucgcccccaggucccuuuccuuggccacugaucggaaacgcggcggcuguuggccaggcgucgcacuuguacuucgcucgccuugcaaggcgcuauggcgacguuuuccagauccgucugggcagcugucccgugguggugcugaauggagagagugccauccaccaggcccuggugcagcagggcagcaucuucgcggaccggccgcccuucgccucuuuccguguggugucugguggccgcagucuggcguucggucacuacucugagcacuggaagacgcagcgacgcucggccuauagcacgaugcgugcuuucuccacgcgccacccgcgcagucgcggucuucucgagggccacgcgcuggcagaggcucgagaauugguggcagugcuggugcggcgcugugcgggcggcgccuuccucgauccaacgcagccggucauuguggcgguggccaacgucaugagcgcugugugcuucggcugucgguacaaccacgacgaugcggaguuccuagagcugcucagccacaaugaggaguucgggcgcacagugggugcgggcagccugguggaugugcugcccuggcugcagcuauuucccaacccggugcgcaccaccuuccgcaaguucgagcagcucaaccgcaacuucagcaacuucguucuggacaaguuccugaggcaccgcgaaagccuggugcccggggcugcuccucgagacaugacggacgccuucauccucucugccgaaaagaaagcgucuggggccccuggcgacgauuccuccgggcuggacuuggaggaugugccugccacuauuacggacaucuucggagccagccaggacacccuuuccaccgcgcugcuguggcugcucauccucuuuaccagguaaagccuccgggagggcugggucaguccuucuuuuccuccuuugaaaaaaggagugccucugggcgcaggguuugagguuucgcgcugcgucgccccccaacccccaauuccucgaaacugagaucucagguaagauaaggccggguucaacugggcaggccaagacaugugcucccccucuauaaguguugccaggacuuuccagcaucucugauguugcgcccca

SEQ ID NO: 10853 - RNA, 2501 nt, Mus musculus
cccuagcacacacaggcccaucgggaaaggauuacaggacacggucuugacuugaaagugaagggggaaaaaaauuagggcagaaaaugaaugggugaaggcuccuagaagaguuaucaaacaaagggugaaagagaauauacaguuuggguuuuaugcccaaaauggcugucugcucggaaaguccaacuuuagucugcuuauuccucccaccaaauaugcaaaauaaacucacuuguucuaaaaacaggagagugcuaucaccauuaagagauaagcaugagcucaggaaagauuaaaguguuuucuuuucauccuaguaaaguggggggaggcgggaagacacuucaaugaccgaauccuguuucuggguuuggggaaguuucgcuuuuucuucucucccaagguaauagcuguuuuuguuuucuucuccacacugaagacccucugaaugaaacuccaaauccuuaaugccacacagaggagaggaauuugcuagguccacacuugcucggaaaggagagaggaaaaagggcacaggcacccauuauucagagucuaucacuaaauuagccuccuuuauaauacggauuccaucccagcacacauuacgccgggagcagggugugcagaaugugugggcacugaagcagaccacauuucaccgaaaugagacuucaucuuuucaaacaccaccaguacuggcacauauuucaaagagcucuuagcucaaacugaaucaucgugcaaauuauugcguguuagcaauaaaaguuuggaaaaucuaauuagcagguugcuauuuggucagaacuaaaacacaaagccuggagguuuuacucuaaaaggugagacccaagcacaaccacaggcugcgccugugaaaagggggcgggguuggggacccauagauuccucacaccccucggcuggagcgccagggaccuccuggggcaggaaaaaagccuagcugagcugccaggcagacaggacggagaccggacggacggacggcacggauagacgggacuggacggacuggacgggcaaaaaaagcagugcguccuacccggaggguucccucccagggcuggcggaguaccugcuccggucauccagacugcgguugucagcaaccgccgcacgccagucgggcagcgugcuggcgcacagcaccaccauggacacgaucacgaacaccacggacacgcuggccaggaucugcgcggccagcgacgacgugggcuccucgaagguccgccgcaugcgcuccagccagcgccgggagggggccgccucggguccggcgggacgaggcugcucgcggcccagcucgucugccgcgugaaaggugugggugucggacaugcggucgucuaggcggcgcuggcagcaguacuccaggugcgcacccuccaggccccaguagaucaucucguuguagaaggagagcucgcacauccgcggcgcgaagcgcagcuucccguggccgcgcacguacagcaggaugaagccgaaggccuccgagugucggucgaagaaguacucguugcgcucccggucguagucgucgcacacuucgagcacgucgcgcuccgagcggcagccgugcagccggcucacgcggcgcagcgggaaguccuugagcagcucccgggacagcgaguaccgggcgccgcccacguucagcaccaccgaggccgccccgccgcgcccgaaggucauggcuggccgccccgggggccugcccgccgcgcgcacggggaggccgcgccgucggggcccgagcucccccggggcucgcgccccgcaccgcccgcgucccccgcggugucagugccgccgccccucgcucccggguucgcccucccgaauccggguggcuggccgcagcuccagguggcgccggucucccagagggcgaacguuagccgaggcaccgugggcaggucugcccgguccccggcgcacgcagccccgccgccguccagaggcgaaaggcaaagugagccggcuccggcggcgaggagcgggcuccgggaggcgggggcggggccucccucgccguccuccuccucgcccgccggcuccgcgcgcuccgcucccuccgcgcgcaccuccuugcccgcccgcgcccgcaccucccggcucgcuccggcugggauuccccggcgccccgccccggaccucgggcuccccgccucgugacgccgugcgcccccgcccgcaguggccgggaggggugcgcagggcgugaugcgagcugcggggagccccggggccauccggaugauggacacaccucccccaggcuccuuuaaagagucccccgaagggaggagacaggagggaaggaggggugcugaggugaggaccaaggugcgagguuugaaguagggagcagacggcgucuggaugagccuuugccagagacuguuggaaacccuggucggcuucuaaggccgccccaaaggauuucucaaagcaggcaacccagucgc

SEQ ID NO: 10854 - RNA, 2501 nt, Mus musculus
gcgacuggguugccugcuuugagaaauccuuuggggcggccuuagaagccgaccaggguuuccaacagucucuggcaaaggcucauccagacgccgucugcucccuacuucaaaccucgcaccuugguccucaccucagcaccccuccuucccuccugucuccucccuucgggggacucuuuaaaggagccugggggagguguguccaucauccggauggccccggggcuccccgcagcucgcaucacgcccugcgcaccccucccggccacugcgggcgggggcgcacggcgucacgaggcggggagcccgagguccggggcggggcgccggggaaucccagccggagcgagccgggaggugcgggcgcgggcgggcaaggaggugcgcgcggagggagcggagcgcgcggagccggcgggcgaggaggaggacggcgagggaggccccgcccccgccucccggagcccgcuccucgccgccggagccggcucacuuugccuuucgccucuggacggcggcggggcugcgugcgccggggaccgggcagaccugcccacggugccucggcuaacguucgcccucugggagaccggcgccaccuggagcugcggccagccacccggauucgggagggcgaacccgggagcgaggggcggcggcacugacaccgcgggggacgcgggcggugcggggcgcgagccccgggggagcucgggccccgacggcgcggccuccccgugcgcgcggcgggcaggcccccggggcggccagccaugaccuucgggcgcggcggggcggccucgguggugcugaacgugggcggcgcccgguacucgcugucccgggagcugcucaaggacuucccgcugcgccgcgugagccggcugcacggcugccgcucggagcgcgacgugcucgaagugugcgacgacuacgaccgggagcgcaacgaguacuucuucgaccgacacucggaggccuucggcuucauccugcuguacgugcgcggccacgggaagcugcgcuucgcgccgcggaugugcgagcucuccuucuacaacgagaugaucuacuggggccuggagggugcgcaccuggaguacugcugccagcgccgccuagacgaccgcauguccgacacccacaccuuucacgcggcagacgagcugggccgcgagcagccucgucccgccggacccgaggcggcccccucccggcgcuggcuggagcgcaugcggcggaccuucgaggagcccacgucgucgcuggccgcgcagauccuggccagcguguccgugguguucgugaucguguccaugguggugcugugcgccagcacgcugcccgacuggcgugcggcgguugcugacaaccgcagucuggaugaccggagcagguacuccgccagcccugggagggaacccuccggguaggacgcacugcuuuuuuugcccguccaguccguccagucccgucuauccgugccguccguccguccggucuccguccugucugccuggcagcucagcuaggcuuuuuuccugccccaggaggucccuggcgcuccagccgaggggugugaggaaucuauggguccccaaccccgcccccuuuucacaggcgcagccugugguugugcuugggucucaccuuuuagaguaaaaccuccaggcuuuguguuuuaguucugaccaaauagcaaccugcuaauuagauuuuccaaacuuuuauugcuaacacgcaauaauuugcacgaugauucaguuugagcuaagagcucuuugaaauaugugccaguacuggugguguuugaaaagaugaagucucauuucggugaaauguggucugcuucagugcccacacauucugcacacccugcucccggcguaaugugugcugggauggaauccguauuauaaaggaggcuaauuuagugauagacucugaauaaugggugccugugcccuuuuuccucucuccuuuccgagcaaguguggaccuagcaaauuccucuccucuguguggcauuaaggauuuggaguuucauucagagggucuucaguguggagaagaaaacaaaaacagcuauuaccuugggagagaagaaaaagcgaaacuuccccaaacccagaaacaggauucggucauugaagugucuucccgccuccccccacuuuacuaggaugaaaagaaaacacuuuaaucuuuccugagcucaugcuuaucucuuaauggugauagcacucuccuguuuuuagaacaagugaguuuauuuugcauauuuggugggaggaauaagcagacuaaaguuggacuuuccgagcagacagccauuuugggcauaaaacccaaacuguauauucucuuucacccuuuguuugauaacucuucuaggagccuucacccauucauuuucugcccuaauuuuuuucccccuucacuuucaagucaagaccguguccuguaauccuuucccgaugggccugugugugcuaggg

SEQ ID NO: 10855 - RNA, 2501 nt, Mus musculus
caugugcaaaccuugccaggucaccugauccccagccucaucuaaggcugccuggugcuccugaggcuggagucucuuccuaaccccaaacacuccguguaacgaauagcucgcugcauucaacuacucuacuccuauuccuuuucgaauuuuugaucaaaacuucuuugagcaagaggaggaggaagaggagagagaaagagagagagagagagagagagagagagagagagagagagagagaggauauuaagaguugcaaagauuuuuuuuaauucuguuucgcccucuucucccucacccccccccccuccggcuaagugguaaaaccguccuuacguucucaguauugauuggcagggcugacagugauuggcagugguugccguggcaacgccacaacgacacgccacagaccaauagaaaagcgaaacaaaauguuucaaugcugcacucacuguggauuuaggggagauauuaugaggcuguugucauuagggcgauugcuguggaaucgcugaaucuugacucggccgugguuggcucucgcucuccucucucccucucccucucucugccucgggcucgcgcucucucucucucucucucucucucucucucucucucucucucucucucucucucucucugcgcgcgcgcaccgggccgcucuccuuccucccucucuauguggcugcgcggguguguguguauguggauguguguggggugugggugucccuuacguccuuccuccucccccuccuucuccuucugcuccccccuccuuuccaucuccuccuccccccucuccucucccuccuccugguccucaucgccccucuccuccucuuccuccccucucucuuccucucccugaauuuuuuccucuccucucaggucaguccaugguauuccgcuccccccuagaucucuauuccucccacuucuuguugccaaacuucgccgauucucaccacugcucccuacuucuggcgaguagcggcggcgggagcggugcgagcggcggcggcggcggcgcgggaggaggcggcggcgggaaccgugcgggaggcggcggugcuggcggagcaggcggcggcagcggcggcggcggcuccagggcccccccggaagaguuguccauguuccaguugcccacccucaacuucucgccggagcagguggccagcgucugcgagacgcuggaggagacgggcgacaucgagcggcugggccgcuuccucuggucgcugcccguggcccccggggcgugcgaggccaucaacaaacacgagucgauccugcgcgcgcgcgcugucgucgccuuccacaccggcaacuuccgcgaccuguaccacauccuggagaaccacaaguucacuaaggagucucacggcaagcugcaagccauguggcucgaggcgcacuaccaggaggccgagaagcugcgcggccgcccgcucggcccgguggacaaguaccgcgugcgcaagaaguucccucugccgcgcaccaucugggauggcgagcagaagacccauugcuucaaggagcggacucggagccugcugcgggagugguaccugcaggaucccuaccccaaccccagcaagaaacgcgaacuggcgcaggccaccggccucacccccacacaaguaggcaacugguuuaagaaccggcgacagcgcgaccgcgcagcggcggccaagaacaggucaguggcggggaccgcggccaggccaccacaggcuccgggcuagaaaaauggaaacggguggaaacucaggcugucggggaaugguagaggcggcugauccaguucuggagauaccggugcucucuggacaguuagagaaaaguuucugguugcccuggaacagggaacaacuggcuguggguuuauauacugcuuugcucaagaagggcuuuuuuuaucagagccagcgcugugugagcaugccccugguguccucaacccuccgugccugucccuaggggccuuaaaccccucgcgggucucuucagcccuggcaccagcuagaagacuggaaggaaaggaaaauacuacuugcuaucugauuauuucugugcaccgcaaaagggggggggcuugguuuagaggcguccauaggagucaaagaggggaaaggaggccaggguuccugccacaaagagaaggccgguggccuccaucccuugagcuggcacuggacaggagaggcaggccuggagugaagaggccuggaguguuaguguguucauggguuugaggggguggugguaggagugagagcuucaagucucccuaucgccucaguucaggagcauccacuuguuuugguccacuuauucgggaagcaaaaucgcaggugcagucauggcaggcaaguugguuacagacucacaaaguuguuugguucugguggaucuuuaaagcucaauugugagaaaguaaaaagaaaaaggagaggacggagagacgauuaguccaaagggaa

SEQ ID NO: 10856 - RNA, 2501 nt, Mus musculus
uucccuuuggacuaaucgucucuccguccucuccuuuuucuuuuuacuuucucacaauugagcuuuaaagauccaccagaaccaaacaacuuugugagucuguaaccaacuugccugccaugacugcaccugcgauuuugcuucccgaauaaguggaccaaaacaaguggaugcuccugaacugaggcgauagggagacuugaagcucucacuccuaccaccacccccucaaacccaugaacacacuaacacuccaggccucuucacuccaggccugccucuccuguccagugccagcucaagggauggaggccaccggccuucucuuuguggcaggaacccuggccuccuuuccccucuuugacuccuauggacgccucuaaaccaagcccccccccuuuugcggugcacagaaauaaucagauagcaaguaguauuuuccuuuccuuccagucuucuagcuggugccagggcugaagagacccgcgagggguuuaaggccccuagggacaggcacggaggguugaggacaccaggggcaugcucacacagcgcuggcucugauaaaaaaagcccuucuugagcaaagcaguauauaaacccacagccaguuguucccuguuccagggcaaccagaaacuuuucucuaacuguccagagagcaccgguaucuccagaacuggaucagccgccucuaccauuccccgacagccugaguuuccacccguuuccauuuuucuagcccggagccugugguggccuggccgcgguccccgccacugaccuguucuuggccgccgcugcgcggucgcgcugucgccgguucuuaaaccaguugccuacuugugugggggugaggccgguggccugcgccaguucgcguuucuugcugggguugggguagggauccugcagguaccacucccgcagcaggcuccgaguccgcuccuugaagcaaugggucuucugcucgccaucccagauggugcgcggcagagggaacuucuugcgcacgcgguacuuguccaccgggccgagcgggcggccgcgcagcuucucggccuccugguagugcgccucgagccacauggcuugcagcuugccgugagacuccuuagugaacuugugguucuccaggaugugguacaggucgcggaaguugccgguguggaaggcgacgacagcgcgcgcgcgcaggaucgacucguguuuguugauggccucgcacgccccgggggccacgggcagcgaccagaggaagcggcccagccgcucgaugucgcccgucuccuccagcgucucgcagacgcuggccaccugcuccggcgagaaguugagggugggcaacuggaacauggacaacucuuccgggggggcccuggagccgccgccgccgcugccgccgccugcuccgccagcaccgccgccucccgcacgguucccgccgccgccuccucccgcgccgccgccgccgccgcucgcaccgcucccgccgccgcuacucgccagaaguagggagcaguggugagaaucggcgaaguuuggcaacaagaagugggaggaauagagaucuaggggggagcggaauaccauggacugaccugagaggagaggaaaaaauucagggagaggaagagagaggggaggaagaggaggagaggggcgaugaggaccaggaggagggagaggagaggggggaggaggagauggaaaggaggggggagcagaaggagaaggagggggaggaggaaggacguaagggacacccacaccccacacacauccacauacacacacacccgcgcagccacauagagagggaggaaggagagcggcccggugcgcgcgcgcagagagagagagagagagagagagagagagagagagagagagagagagagagagagagagcgcgagcccgaggcagagagagggagagggagagaggagagcgagagccaaccacggccgagucaagauucagcgauuccacagcaaucgcccuaaugacaacagccucauaauaucuccccuaaauccacagugagugcagcauugaaacauuuuguuucgcuuuucuauuggucuguggcgugucguuguggcguugccacggcaaccacugccaaucacugucagcccugccaaucaauacugagaacguaaggacgguuuuaccacuuagccggagggggggggggugagggagaagagggcgaaacagaauuaaaaaaaaucuuugcaacucuuaauauccucucucucucucucucucucucucucucucucucucucucucucuuucucucuccucuuccuccuccucuugcucaaagaaguuuugaucaaaaauucgaaaaggaauaggaguagaguaguugaaugcagcgagcuauucguuacacggaguguuugggguuaggaagagacuccagccucaggagcaccaggcagccuuagaugaggcuggggaucaggugaccuggcaagguuugcacaug

SEQ ID NO: 10857 - RNA, 2501 nt, Mus musculus
cugcuuuugcggacagucccugaccagauauggguauuugaaauccuggguaaaaccuauuaguggauuccuaacggccauucuuucagauuucuugggguggggggugggggaaugagcaagacaucaucgccauucaaagucaaacuuggggauuucaaauacccagguccagucugcagcuugcucuucugccccuacuguucgauacccugacccuggauccuucaaacgguguucaacacauccacaucaccuaacccaggugucuuguuuugcuguuccccaaggagaaauccguucccauaauccguuucucuccgaucucgauccccuaguuuccuuguccagauuuaagcccaaagcggguuacagacaguuacaggggugucuguagcuuagguuaguuuggaaagucuuagauuccgauagaaaagaaagcucccagucuuucggcagaucccaguuuaccucgcacacccgacuugcccaucaaagagagcagaaccuaaggagagcgaggucuucaagggucuggcaaguucaggaaaggcaggcuggauugccuucucuuccucagcagacauuucccccggaggccuuacaucuuuggguccuuucuacgcgggauaacucccaacucucuugugcccagcucuuaugcccagacaaggaauaggucuaccuugcauagauauugcagucauuacccagauaauacuagggagauuccaaccccugcccugaccccuaaaaaucucuuugaccuggaggugacguccuaaacccccugauccccgacgcccuugguuguucgaagaucaggcccuaagccuacgcuuaccucgcagggaauucaggcccacagcccugcccucucugaaacucgccguuuuuccaguuuaguccacaagcgacugaggaauuaguuacugaacuuacgcaccgcuuugcccgcuuuagacaaauuccgggucgcucagccuccagaaaagaccuaagcgcuguuuugagccagccugagcugcggccgagcuugguacccgggguccgggugcgauuuaguccuguccaggagcuccccauccucccgcacccguuucucccaggaccagggaagccggcgcagaugcucacuuacucguaccuuuccuuggccucggccgcccugucgcgcugccgccgguucuugaaccaguugcugacuugcgugguggugaggccgguggccucggccagcucgcgcuucucucguggcgacggguagggguugugagcguaccacucgcgcagcacgcugcggcucuucuccuugaagcaguagcuggucuccucgccgucccagauggagcggggcagcgggaacuugcgccgcacgcgguacuugcccacggcgcccagcggccggccgcgcagcuucuccgccucgauguagugcgccuugagccacaacugcugcagcuuggcgugguugugcggcgagaacugguggcucuccaggauuuuguagagcucgcggaaguugccccgguggaaggccaccacggccuuggccuugagcacgcuuucauucuuguggaggugcucgcaggcgggcagcgaccacaggaagcgacccagccgcucgauguugccgcccugcugcagcaccucgcacacgcacgccacuugcuccugcgugaagccgaaggugggcagcauggacaugguggcggcugcgcgcccgcccgcccgcgcgcgcccucaccgcgcuucgcggccccgcaugggcgccuccccgccggccccggccggccgacaggcgggcggggcccccuggccaggcgccggcucccgagcgacuccugagucacaacgauccguccucgcucccgccgccggccccgcgcagcuccgcgcccccgccgcccgcgcgccucgcccgcgcccaagcccggaggccgcccggggcgccgcuccgcaugcuccgcgcccgcccgccgcucgcucgccggcuccucgcucguucgcucucccucccgucuagcucgcuugcagcuuuuuuaauaauauuauucuaagcgggcaugaggcgcggcggcccgcgcccugauuggucggguuaucugacccggggccugcccgcgccagacaauagucgagucaaauuauucgccauggagacgcugucagucaccgguaacccgagccccggcggcccgggcggcucccacccccgccccccucggccagcuccgcugacagaucgccccggcucugcacagagcggagguuggccgagacgggagccccaggcacucccagagcccgggaggcggagaggagccgggcuggggccccgagacggcggugauugacggggcggacgcccaaagagcagaggaggaggaggaccccgaaggagggggcugggugggggcccucgaagaaaagaggaggaccgaaguggggaaggaagggaguagaagggaaggcggaggaccguuuaagggggugccuuu

SEQ ID NO: 10858 - RNA, 2501 nt, Mus musculus
aaaggcacccccuuaaacgguccuccgccuucccuucuacucccuuccuuccccacuucgguccuccucuuuucuucgagggcccccacccagcccccuccuucgggguccuccuccuccucugcucuuugggcguccgccccgucaaucaccgccgucucggggccccagcccggcuccucuccgccucccgggcucugggagugccuggggcucccgucucggccaaccuccgcucugugcagagccggggcgaucugucagcggagcuggccgaggggggcgggggugggagccgcccgggccgccggggcucggguuaccggugacugacagcgucuccauggcgaauaauuugacucgacuauugucuggcgcgggcaggccccgggucagauaacccgaccaaucagggcgcgggccgccgcgccucaugcccgcuuagaauaauauuauuaaaaaagcugcaagcgagcuagacgggagggagagcgaacgagcgaggagccggcgagcgagcggcgggcgggcgcggagcaugcggagcggcgccccgggcggccuccgggcuugggcgcgggcgaggcgcgcgggcggcgggggcgcggagcugcgcggggccggcggcgggagcgaggacggaucguugugacucaggagucgcucgggagccggcgccuggccagggggccccgcccgccugucggccggccggggccggcggggaggcgcccaugcggggccgcgaagcgcggugagggcgcgcgcgggcgggcgggcgcgcagccgccaccauguccaugcugcccaccuucggcuucacgcaggagcaaguggcgugcgugugcgaggugcugcagcagggcggcaacaucgagcggcugggucgcuuccuguggucgcugcccgccugcgagcaccuccacaagaaugaaagcgugcucaaggccaaggccgugguggccuuccaccggggcaacuuccgcgagcucuacaaaauccuggagagccaccaguucucgccgcacaaccacgccaagcugcagcaguuguggcucaaggcgcacuacaucgaggcggagaagcugcgcggccggccgcugggcgccgugggcaaguaccgcgugcggcgcaaguucccgcugccccgcuccaucugggacggcgaggagaccagcuacugcuucaaggagaagagccgcagcgugcugcgcgagugguacgcucacaaccccuacccgucgccacgagagaagcgcgagcuggccgaggccaccggccucaccaccacgcaagucagcaacugguucaagaaccggcggcagcgcgacagggcggccgaggccaaggaaagguacgaguaagugagcaucugcgccggcuucccugguccugggagaaacgggugcgggaggauggggagcuccuggacaggacuaaaucgcacccggaccccggguaccaagcucggccgcagcucaggcuggcucaaaacagcgcuuaggucuuuucuggaggcugagcgacccggaauuugucuaaagcgggcaaagcggugcguaaguucaguaacuaauuccucagucgcuuguggacuaaacuggaaaaacggcgaguuucagagagggcagggcugugggccugaauucccugcgagguaagcguaggcuuagggccugaucuucgaacaaccaagggcgucggggaucaggggguuuaggacgucaccuccaggucaaagagauuuuuaggggucagggcagggguuggaaucucccuaguauuaucuggguaaugacugcaauaucuaugcaagguagaccuauuccuugucugggcauaagagcugggcacaagagaguugggaguuaucccgcguagaaaggacccaaagauguaaggccuccgggggaaaugucugcugaggaagagaaggcaauccagccugccuuuccugaacuugccagacccuugaagaccucgcucuccuuagguucugcucucuuugaugggcaagucgggugugcgagguaaacugggaucugccgaaagacugggagcuuucuuuucuaucggaaucuaagacuuuccaaacuaaccuaagcuacagacaccccuguaacugucuguaacccgcuuugggcuuaaaucuggacaaggaaacuaggggaucgagaucggagagaaacggauuaugggaacggauuucuccuuggggaacagcaaaacaagacaccuggguuaggugauguggauguguugaacaccguuugaaggauccagggucaggguaucgaacaguaggggcagaagagcaagcugcagacuggaccuggguauuugaaauccccaaguuugacuuugaauggcgaugaugucuugcucauucccccaccccccaccccaagaaaucugaaagaauggccguuaggaauccacuaauagguuuuacccaggauuucaaauacccauaucuggucagggacuguccgcaaaagcag

SEQ ID NO: 10859 - RNA, 2501 nt, Mus musculus
aacacccuucuuccauaccuugcuaccuacacacucauacagcgcuccugggacaguucccuacccugcuucucuggccaaucaagcucccacaccucuagaaacuucaaacaaauaauuuaccuaguaagaaaaagcaguuuccaaaggaacuaagagagacacaaucaggacaguaaagcggaauaaucaaguaagggaaauguucauuaagcgccacacagauuaaagccucuucugggguauucagagguuggaaggaagagacgauuuaaaauaacaugaaugaauaauugaguccacaaagacacaucaaugcguucuagaucuugguguuaggauuuucauguuuucuagauccuggaccauaugauggaaaccccugcgucuucgguuauccuuaugauggagaccccugcgucuuuugguuaagcucucccggugggauaagagcaaugggaaguagagccccaaaccugaaaaucaaauggucuaaggaaaagaugucacagauuuucccacccccacccccaaucuugcuagggaacuccgaacgaaggugccagguccuagucucuggggauuacaguccacaggaauucgagccuauuuuggacgccgggaaucuccaaguuggcagagacccgcauaccuuucagacccugggcuccuggacagcccgaggcucaccucuggaguuggagugccucggggccucagcccgccaggugcggacauccgaagcaaggccgcgcggcugcaguacagccacaauacuguugugagaaucggaacaagccgccggcaagaucucccuccaacacccuccccacuccgcgcgcaacuacggguagcucguucaacccacugccagcauccccucaaaacacacacacacacacacacacacacacacacacacacacacacacacacacacacacacagagagagagagagagagagagagagagagagagagagagagagauugauucuccaauacgcagcaccuacacucgcuaacugcccccuccccucuuuugucgcugcaguggcugcuacuacuacgcgcgacauuuaggacagggcacagcaacuaggugacggccacggucaguauugguguggaaagugaagucagaccuaugguggccgcugcguugugcccuugggcugaauccugcucaggcggguacgggccuggagugcgcaccccgccucgucgauaagugucaaagcaaguuuggaagacugacucccccacccuaaugauuaguguccacuccucuuugugggugcaagcucccuucccccaugccauuccacuucuuuccaccaacccaguccuaaucgcaacggcucacuuucccaagcaaagccuuggugagcuuugccaccaaggaccuuucccacagucugcaaacaccgccaugcucuaauucugcgacugcaggcgccguggcaggagagcccugaaccauugcaaugggcgugaggcacgaggcaguggagaccugcgguucccaauucuuccugggcuccagugagagguccccaacaccccauaucagccccugugcucuacacguaccuagauucgcuccuagcaguguugacgagcgcggucccagcagaacugcccggcggauaauuaaaaagcaaagcgagggcagccagguggguugcuagcugcuuccuagacccacccucuagcuuugacuuacacuaggagcgcgucuccccccacaagaucucagacggaggugggggaggggagggcagagccagggcaugcagagagcagaggauccagccuugguuagccuaggguucagcgcucggggaaggggagaaaaggucauaccuguggccgcggaaucggcagccagcggcugacacuccugucucuggacuaggcacacucccauccccaccgcauguucucggcucaggcuccgacgcguucaccggggccaccggagucgucucugcuuuauuuacccagacugaugcgcgcggcccaggaacaggaauaccgaagccuucucauguuucccgacuguccggcccagccuacgaacaucccgcggacgcgguauccauguucccgggcggcgagagaggaagcgaucgcgccggucgggcggcgggagcugcuguuaaccccucugguagacagcagccaccggccaagacgggagccccaggcagucucauccucccagcggggcaccgcucccugaugcuuuugccuagcagcgcccagcaaaaccagcuuuuucuuuccuuuugcgcucaaaggaguaauccgagaagcugccgggagcccggggcucgcauaaacaggacagagguugcggugcaaauccugcguuuuagcugcuccuagugucggaaaugucaccaacccaggccgggggcaaggaggucgcagagacgccccagguguuucccuccugauuagcuggagguuagagcuucuugcaccuggggacccc

SEQ ID NO: 10860 - RNA, 2501 nt, Mus musculus
gggguccccaggugcaagaagcucuaaccuccagcuaaucaggagggaaacaccuggggcgucucugcgaccuccuugcccccggccuggguuggugacauuuccgacacuaggagcagcuaaaacgcaggauuugcaccgcaaccucuguccuguuuaugcgagccccgggcucccggcagcuucucggauuacuccuuugagcgcaaaaggaaagaaaaagcugguuuugcugggcgcugcuaggcaaaagcaucagggagcggugccccgcugggaggaugagacugccuggggcucccgucuuggccgguggcugcugucuaccagagggguuaacagcagcucccgccgcccgaccggcgcgaucgcuuccucucucgccgcccgggaacauggauaccgcguccgcgggauguucguaggcugggccggacagucgggaaacaugagaaggcuucgguauuccuguuccugggccgcgcgcaucagucuggguaaauaaagcagagacgacuccgguggccccggugaacgcgucggagccugagccgagaacaugcgguggggaugggagugugccuaguccagagacaggagugucagccgcuggcugccgauuccgcggccacagguaugaccuuuucuccccuuccccgagcgcugaacccuaggcuaaccaaggcuggauccucugcucucugcaugcccuggcucugcccuccccucccccaccuccgucugagaucuuguggggggagacgcgcuccuaguguaagucaaagcuagagggugggucuaggaagcagcuagcaacccaccuggcugcccucgcuuugcuuuuuaauuauccgccgggcaguucugcugggaccgcgcucgucaacacugcuaggagcgaaucuagguacguguagagcacaggggcugauaugggguguuggggaccucucacuggagcccaggaagaauugggaaccgcaggucuccacugccucgugccucacgcccauugcaaugguucagggcucuccugccacggcgccugcagucgcagaauuagagcauggcgguguuugcagacugugggaaagguccuugguggcaaagcucaccaaggcuuugcuugggaaagugagccguugcgauuaggacuggguugguggaaagaaguggaauggcaugggggaagggagcuugcacccacaaagaggaguggacacuaaucauuagggugggggagucagucuuccaaacuugcuuugacacuuaucgacgaggcggggugcgcacuccaggcccguacccgccugagcaggauucagcccaagggcacaacgcagcggccaccauaggucugacuucacuuuccacaccaauacugaccguggccgucaccuaguugcugugcccuguccuaaaugucgcgcguaguaguagcagccacugcagcgacaaaagaggggagggggcaguuagcgaguguaggugcugcguauuggagaaucaaucucucucucucucucucucucucucucucucucucucucucucuguguguguguguguguguguguguguguguguguguguguguguguguguguguguguguuuugaggggaugcuggcaguggguugaacgagcuacccguaguugcgcgcggaguggggaggguguuggagggagaucuugccggcggcuuguuccgauucucacaacaguauuguggcuguacugcagccgcgcggccuugcuucggauguccgcaccuggcgggcugaggccccgaggcacuccaacuccagaggugagccucgggcuguccaggagcccagggucugaaagguaugcgggucucugccaacuuggagauucccggcguccaaaauaggcucgaauuccuguggacuguaauccccagagacuaggaccuggcaccuucguucggaguucccuagcaagauugggggugggggugggaaaaucugugacaucuuuuccuuagaccauuugauuuucagguuuggggcucuacuucccauugcucuuaucccaccgggagagcuuaaccaaaagacgcaggggucuccaucauaaggauaaccgaagacgcagggguuuccaucauaugguccaggaucuagaaaacaugaaaauccuaacaccaagaucuagaacgcauugaugugucuuuguggacucaauuauucauucauguuauuuuaaaucgucucuuccuuccaaccucugaauaccccagaagaggcuuuaaucuguguggcgcuuaaugaacauuucccuuacuugauuauuccgcuuuacuguccugauugugucucucuuaguuccuuuggaaacugcuuuuucuuacuagguaaauuauuuguuugaaguuucuagaggugugggagcuugauuggccagagaagcaggguagggaacugucccaggagcgcuguaugaguguguagguagcaagguauggaagaaggguguu

SEQ ID NO: 10861 - RNA, 2501 nt, Mus musculus
guucuguagagucugugucuguccauuggugauucaggguucuuagagcguucuccggggcuuuucagccaacacccaauuuacacagacgcuugccaacuugaaccucgaggaccucuaugcccccagaguuuuuuuugacuaaaggacgaauuuacuguggccucauugcuccccaacuuucugcccaacacucuagagauggucugcguucuagaaacaagccuagcaagcagugccuuccgcgcaugcgagagggguucuacggauuucucuagaaugcaggucgggcuggagaaagagggacccacgagggugcggggcggccucggagggccgggagagcggccgagggcggagcgaagguugcggaggggcgugggcgcggccggacaagcggccagggggaggggcgcaagggggagcggcgccucccgcccggggugagaggcgcgcggcggccccgcggcagcagagugcagaacgggacgcuaggacuggaacgcugaaggcugccaugggcgugcagugagagacacugguacgacuucuccgggcggagcguguccucagucaccaugaaagguagggcggcagccgucuuuggggcucacggaaggucggcggagguguagcccgggcgcccgggucgcccucggacucgaggaacgcugcgccgcacagcgggagcccucgaggcuggguuugggaagugcucaggcgcucuccuuuucgucggucuccucaguccuuuagaaaucccaaaucguuguuuacggauuucaguuuccaacuuuguaauugaaaaaacaugcggaggagauuuaggcaucaucauucuuccgagugaguuugucgagcuugccacucucccggguccucugcccucgcccgaugacccuuccgcggucccagacgucacacugccacaggccggcuguuuucccgggacucgggauguccucggugcgcgcgcggcacaucuggcaacgauuaggugcccgcggaguucagcuggcuaggaaagugcguuuggcaucucucuccaucggauccacugacuggaaaauaacugcuccuuucccuacgcccgcccagggaauaguuguccccacgugugcccagagaaugccacaaaucuuacugauauugguccccuaggugauguccucugcaggcggguuuauuggagugucagauuuuaucuugcuuuuuaaaagaaucuggagaccacggccuggggguggggagcaaucuucagucuaguggaaacaugcggauuugucagcagaaccuugauuuaugugggagauaaauaauuacagucggaccaucggagauggggugcgucguuaaaaaauagacgggaguaguguuuacuuaaggcugaaguugcugguuugggacugggguaaaacguuucauucccugcgcgguccugggcugaaugcgaaaugacuucugaguuuccagccacaccagacuacgugaugugaucuguuaggcugaggggggcgcccuaggagcuccaggaauuuggaaaguaucuuugcuccgugagguucgugcugaacuacguggagaucccgguccuguggaagcaaucgccuuccaaaggcgcugccgugucuucacuggagggaacugcaaggaacgugacuguaagccaggugcuaagaggcuugucccaaggaaaggauacucagaacaggccacaacuuuaugaguugagacuuuuuguuuguuuguuuguuuuuuguuuuuucgagacaggguuucucuguguagccuggcuguccuggaacccacucuguagaccaggcgccugccuuugccucacaagugcugggauuaaugcaugagccaccacugccccgcugacuugagacuuuuaaaacgcugugauaugcuuucuugcucugccucuguuucuauugccuugccccuuauuaacuacuuagaaaacauguguguuucuuagcuagaguuccccuaacuccuaaagugggaauugaaauuaggcccuaucccacugaacuacauccauuacuucucuccgauuuguaauuuacgauagaaagauagggucucacuaaauuauucagucugaucuagggccugcaaguguaggcagugaacuugagaacuaccugacucagccucccaaguagcuggagcuacagguaccauaugacuuauugccaaugguuaagucuaucaguuucucaguuuuuggcaagacaacccugcccccagcaccaccucaggcaugccugcgcuuccaucaauuccagcucuggaaugcaaaacacagguuuuaaacgcauuuuggaugagacuuaauaacucacuggggaccagauuggaaguucauaauuuaccucuuguggucugagcccauuagcucucaucacuuucuuccacagucagggagacuggauccagggacuggugaaucuguauguaguuuuaucuuauuuaauuaguuaauuaauuagaga

SEQ ID NO: 10862 - RNA, 2501 nt, Mus musculus
ucucuaauuaauuaacuaauuaaauaagauaaaacuacauacagauucaccagucccuggauccagucucccugacuguggaagaaagugaugagagcuaaugggcucagaccacaagagguaaauuaugaacuuccaaucugguccccagugaguuauuaagucucauccaaaaugcguuuaaaaccuguguuuugcauuccagagcuggaauugauggaagcgcaggcaugccugagguggugcugggggcaggguugucuugccaaaaacugagaaacugauagacuuaaccauuggcaauaagucauaugguaccuguagcuccagcuacuugggaggcugagucagguaguucucaaguucacugccuacacuugcaggcccuagaucagacugaauaauuuagugagacccuaucuuucuaucguaaauuacaaaucggagagaaguaauggauguaguucagugggauagggccuaauuucaauucccacuuuaggaguuaggggaacucuagcuaagaaacacacauguuuucuaaguaguuaauaaggggcaaggcaauagaaacagaggcagagcaagaaagcauaucacagcguuuuaaaagucucaagucagcggggcagugguggcucaugcauuaaucccagcacuugugaggcaaaggcaggcgccuggucuacagaguggguuccaggacagccaggcuacacagagaaacccugucucgaaaaaacaaaaaacaaacaaacaaacaaaaagucucaacucauaaaguuguggccuguucugaguauccuuuccuugggacaagccucuuagcaccuggcuuacagucacguuccuugcaguucccuccagugaagacacggcagcgccuuuggaaggcgauugcuuccacaggaccgggaucuccacguaguucagcacgaaccucacggagcaaagauacuuuccaaauuccuggagcuccuagggcgccccccucagccuaacagaucacaucacguagucugguguggcuggaaacucagaagucauuucgcauucagcccaggaccgcgcagggaaugaaacguuuuaccccagucccaaaccagcaacuucagccuuaaguaaacacuacucccgucuauuuuuuaacgacgcaccccaucuccgaugguccgacuguaauuauuuaucucccacauaaaucaagguucugcugacaaauccgcauguuuccacuagacugaagauugcuccccacccccaggccguggucuccagauucuuuuaaaaagcaagauaaaaucugacacuccaauaaacccgccugcagaggacaucaccuaggggaccaauaucaguaagauuuguggcauucucugggcacacguggggacaacuauucccugggcgggcguagggaaaggagcaguuauuuuccagucaguggauccgauggagagagaugccaaacgcacuuuccuagccagcugaacuccgcgggcaccuaaucguugccagaugugccgcgcgcgcaccgaggacaucccgagucccgggaaaacagccggccuguggcagugugacgucugggaccgcggaagggucaucgggcgagggcagaggacccgggagaguggcaagcucgacaaacucacucggaagaaugaugaugccuaaaucuccuccgcauguuuuuucaauuacaaaguuggaaacugaaauccguaaacaacgauuugggauuucuaaaggacugaggagaccgacgaaaaggagagcgccugagcacuucccaaacccagccucgagggcucccgcugugcggcgcagcguuccucgaguccgagggcgacccgggcgcccgggcuacaccuccgccgaccuuccgugagccccaaagacggcugccgcccuaccuuucauggugacugaggacacgcuccgcccggagaagucguaccagugucucucacugcacgcccauggcagccuucagcguuccaguccuagcgucccguucugcacucugcugccgcggggccgccgcgcgccucucaccccgggcgggaggcgccgcucccccuugcgccccucccccuggccgcuuguccggccgcgcccacgccccuccgcaaccuucgcuccgcccucggccgcucucccggcccuccgaggccgccccgcacccucgugggucccucuuucuccagcccgaccugcauucuagagaaauccguagaaccccucucgcaugcgcggaaggcacugcuugcuaggcuuguuucuagaacgcagaccaucucuagaguguugggcagaaaguuggggagcaaugaggccacaguaaauucguccuuuagucaaaaaaaacucugggggcauagagguccucgagguucaaguuggcaagcgucuguguaaauuggguguuggcugaaaagccccggagaacgcucuaagaacccugaaucaccaauggacagacacagacucuacagaac

SEQ ID NO: 10863 - RNA, 2501 nt, Mus musculus
uuugggccuggugggggccggcugggauccggacgaaguugggagugacuggcacuggacuccuaaggguucugacacgcguggcccaagccaaagccaccuggguguccagccgcgcuccgucgcagcaaaccaggaguucucugaccccgaguuaagcucuccugccccucccagugcguccaggguucauccuguccuggaggguuggccauuggggccucccguggguguccucagccugggcgcuagccugggggccucuggggccgguuccggggccuggaggggcugcaggaagcggagguagcucgggacgccuggaucgaagcgggcgcagacacccgaaacggcugggguggccgcgagccggcugcugaguaaucccgggcggcgggugggggcggccgggcgcccacguuccccgcgccgcagcccggcggcggcuccgccuucgcguccauccccgcccccugccggcugcugugcucugcuccccgcaggucggagccgggcuccgggagcgcgggccgcugcagccgccuccuccggcaccucgccucggcccacucgaggccucgugugcccauggccggcucggaggagcaguggccgcggcggagggaggacggcgacccggacgccgcagcggcgccccugcaggacgcggagcuggccuuggcuggcaucaauaugcuucucaacaacggcuucagggagucggaucagcuuuucaaacaauacaggugacuccggcuccccugacucucugccccgccugcgcgcaccggguggucacuucgcgaccuguggcugcucucuucccugcuccccuucgcuucccagggcuuuaucugcagccuuugcccugcgccuuggccccauccuccuccccaccccaucccccgccgcgcugacccuucccucccuaugaccgcaguacggccucacuuuccgcccuccgagggguguccaguauuucuccacugcuuucaagcugucgccuggucucccaccgcgcauuggcccagggggcuggcugaugcauuagaggcagcagcgagccuggcacuugcaggguugggacucuggcucgcgcgcugucggggcagccagccuuugugaccugagcacagcccacugcacccuugccagguccuuguguggcgcucuccuuuguauauaccccgacacucccggugcuuuuguuauuuaaagacaguguaguguauugucgcucugaagaggaacuuaaaacguuucagcccaaacucucaucacccaucucugccucauccuucuaaaaucaagaugaguucugaugccuuucaagagagccgauuuauuaagaauuaucuaguaagaagaaaauagagggauuuaaaaaauacgggagaauggaaggggaaucacguguguugcguuaauuuuuguuugcuuuugaaaauuaagcucuaagcccuguugugaaagaagccuugggaacucaaagcauccagguguucugcuucagaaagcaagcuggcuuaccugagagccugccuggccaucaaaugccuaguagcuguccucaacauguuuaagggcggcuaccacagaguuucuucaggcccguaguuuagauugaaaugagcggcucccagugugaugggauguagcugugauggagaaagaguguguuggugaggaaugcuuaggcuuuaaagaauggugguugccaccaagcccacucacugcacucccaccgcaaagcaggucucuuacaacuaggaacuuuccacuaagucugcuuuacuuuguuguuuuggcuuugagacauagcgugcuguuuguagcucaggcuagccuugcuccucuuaucucagcccccucagggcuaggguuacaggcuugaacucccacaccuuggcccuacagcuuguuuccuuuuaagucagcuucucaccuugaggcucuggaaagaacaacuuaagaaugucuuauuuaaaacacacagcacacacauacauucacacacuauauaaguuugauuuaagcuucaucaaaggcuuugauggaagauuuuuuaaaaguuacuauguuagugcuugcuuguagguuuuaauuaauuaaauaaauaauuaauuaaaauuuguugagacaggcuuucacuacguauccuuggcuggccuggaacuaaccauauaaacgaagcggcaaugccguugccacacugaaggcaggcaaccuagucuuuaucuccccggugauccucaaccuguggguuacaaccccuuuggcaaaacugucuccaaaaauauuuauauugcgauuccuaguaguagcaacauuagaguuaugaauuagcaguggaaauaauuuuaugguuggugauuacuacagcaugaggaauuaaagggucacagcauuaggaagguggagaagcacuguccaggccuauggguugucaacggagggcuggugcucugcguagagcacagagaugcaucuugaauggaagu

SEQ ID NO: 10864 - RNA, 2501 nt, Mus musculus
acuuccauucaagaugcaucucugugcucuacgcagagcaccagcccuccguugacaacccauaggccuggacagugcuucuccaccuuccuaaugcugugacccuuuaauuccucaugcuguaguaaucaccaaccauaaaauuauuuccacugcuaauucauaacucuaauguugcuacuacuaggaaucgcaauauaaauauuuuuggagacaguuuugccaaagggguuguaacccacagguugaggaucaccggggagauaaagacuagguugccugccuucaguguggcaacggcauugccgcuucguuuauaugguuaguuccaggccagccaaggauacguagugaaagccugucucaacaaauuuuaauuaauuauuuauuuaauuaauuaaaaccuacaagcaagcacuaacauaguaacuuuuaaaaaaucuuccaucaaagccuuugaugaagcuuaaaucaaacuuauauagugugugaauguaugugugugcuguguguuuuaaauaagacauucuuaaguuguucuuuccagagccucaaggugagaagcugacuuaaaaggaaacaagcuguagggccaaggugugggaguucaagccuguaacccuagcccugagggggcugagauaagaggagcaaggcuagccugagcuacaaacagcacgcuaugucucaaagccaaaacaacaaaguaaagcagacuuaguggaaaguuccuaguuguaagagaccugcuuugcggugggagugcagugagugggcuugguggcaaccaccauucuuuaaagccuaagcauuccucaccaacacacucuuucuccaucacagcuacaucccaucacacugggagccgcucauuucaaucuaaacuacgggccugaagaaacucugugguagccgcccuuaaacauguugaggacagcuacuaggcauuugauggccaggcaggcucucagguaagccagcuugcuuucugaagcagaacaccuggaugcuuugaguucccaaggcuucuuucacaacagggcuuagagcuuaauuuucaaaagcaaacaaaaauuaacgcaacacacgugauuccccuuccauucucccguauuuuuuaaaucccucuauuuucuucuuacuagauaauucuuaauaaaucggcucucuugaaaggcaucagaacucaucuugauuuuagaaggaugaggcagagaugggugaugagaguuugggcugaaacguuuuaaguuccucuucagagcgacaauacacuacacugucuuuaaauaacaaaagcaccgggagugucgggguauauacaaaggagagcgccacacaaggaccuggcaagggugcagugggcugugcucaggucacaaaggcuggcugccccgacagcgcgcgagccagagucccaacccugcaagugccaggcucgcugcugccucuaaugcaucagccagcccccugggccaaugcgcggugggagaccaggcgacagcuugaaagcaguggagaaauacuggacaccccucggagggcggaaagugaggccguacugcggucauagggagggaagggucagcgcggcgggggaugggguggggaggaggauggggccaaggcgcagggcaaaggcugcagauaaagcccugggaagcgaaggggagcagggaagagagcagccacaggucgcgaagugaccacccggugcgcgcaggcggggcagagagucaggggagccggagucaccuguauuguuugaaaagcugauccgacucccugaagccguuguugagaagcauauugaugccagccaaggccagcuccgcguccugcaggggcgccgcugcggcguccgggucgccguccucccuccgccgcggccacugcuccuccgagccggccaugggcacacgaggccucgagugggccgaggcgaggugccggaggaggcggcugcagcggcccgcgcucccggagcccggcuccgaccugcggggagcagagcacagcagccggcagggggcggggauggacgcgaaggcggagccgccgccgggcugcggcgcggggaacgugggcgcccggccgcccccacccgccgcccgggauuacucagcagccggcucgcggccaccccagccguuucgggugucugcgcccgcuucgauccaggcgucccgagcuaccuccgcuuccugcagccccuccaggccccggaaccggccccagaggcccccaggcuagcgcccaggcugaggacacccacgggaggccccaauggccaacccuccaggacaggaugaacccuggacgcacugggaggggcaggagagcuuaacucggggucagagaacuccugguuugcugcgacggagcgcggcuggacacccagguggcuuuggcuugggccacgcgugucagaacccuuaggaguccagugccagucacucccaacuucguccggaucccagccggcccccaccaggcccaaa

SEQ ID NO: 10865 - RNA, 2501 nt, Mus musculus
ugccucuucuccaaaaauagaaggagcccuuugcuagggcucauuaaaaggguuuugaaauuggagccaaucaaacaggauugucaguuucuguagucucaucucagcagcacuuuacaaaagcaugguucucucucccuuuggacacgaaauacuguuugcaacacaaacagauacuuccuaaauggcaauggcagacagcaucaacaguucccuaacuucuuugugacucuugcuagacacacagagcaacuggaggugcaggacuccacucccuguucuccacucccggcugucaaugcccaagacauccuggggacagaaguuaguaggcaagauucaccucaccacccugaaauguguguggcuuugcucuccuuuaaagaaaagaaaguguuuucugcaaaguagaaaaguucacuuggccacagaaugcccaucauuacuauuccuaguaguaggaauagacaacuccuuuugggaguucaaucuagaaagagagcagaccucagucacagcacaaacaccaaccaaaauauuaaaaacuuaagugcaugacagaaagacuaugaaguucucuucugcuaacacugagaguucuuccuggcucaaaacaggaccgaggaagaucugcaccacaggcucaaucuccuugaacagguccacuuuaaggggcgggcagagggagcucugacugaccaaggugcccagagcuguucuucuaaacugcauaggccuuugggccccaccuaucuguucaguuucaaccucagucugaaaucuucaauguuucuugcccugaagacaugggaaucugggcauucaagcgcucagggaugcuguuaggccagguccccguugccccuucugacacucuaaaaucaacuuucuccauaccagcugaaguguucgaaauguuuuuucacgugcaggagccucccgcccagcccacccaguucuccccuccuccuugcccccuccccucccuccggccucuucaacuccccaccaccccaucccaccccgccuuccucuuuguugucuccuaccugcuggccaggcucugccugcagugcugccugaagggcaucaggugguaguucauggcguccagcagcagcuucuggcagaccgggucggugcgcaugaaauccaccgacuggacccgcucuaccagcuccggggcggggaugagcgcaaagcggaggcgcuucaugaggucgggcgcguacugcaugcgggucucacggucgugcuccagccacagcacggacaucuggaaaagugccagcuccgacuccacggggggcggcagcgaguccagcagggcacgcaucuccucgaaguuaagcaacagcacaucuuccaccagguacuuguuggccagcuucuuggucuccuccaggccgugcagugcggcgaucuugcacaccugcuuguaguucugcaccgagaucuggucguugaggaacugaacgcagagcuuggugaccugaggaaugugcaggauuuugcugaccgacagcacuuccuccacgguguccagggagagggucacguuggcuguguagagguauucaagcacuaggcgcagcccgauggacgagcagcccugcagcacuagguuguugauggcucuggggcuggucagcagcuugucgucgggggaggaggaaggagucccgggcuccuccuguggcggcggcugcugcugcuguggaggcugcugcugaggcugcugcugcugcugcugguccuugggggcccccaggccguccuggccgccgaccccucccccgagagggggguggcuggagaagagugaucggaaguacugcgagcaggaggccagcacggccuuguggcaguggaacuguuggccuugggcugucaggguuacgucgcaaaauagcugcuuccuccacagcagguugagaccgugcagcagguugucacuguggcuggggucgaagguggagguccuguccccggaucuggacauggcgagcugacucugcgcaccuggcuuuaaacccuccuccaaccuggcagacgggugggggaugggagggguagcagggagguguaggggguggggugugguguggucgggguggggaaggguguggaggggagagaggaacaacaaucaaggccccgcuugguucccucccugcgcucuuaggauccgaaccuaagagggaggugugaaggcgccggguccugagcgccuccagaaggguccucgucuggggucgggacuucgguucugcuccuugcuaucucuuauacacuucgccccucacuuuccuaaaagcacccaggcuucucucuuggcagcaacagcggugauagcagcggcggcaaaaguggaggcugaggccgugacaccucgugggcucgaguccaugcccggcuggaugaacggaaaggccgggaguggggagucagggggugccucaagagcucagaggcgaccgacggcggcgguuccaggucaa

SEQ ID NO: 10866 - RNA, 2501 nt, Mus musculus
uugaccuggaaccgccgccgucggucgccucugagcucuugaggcacccccugacuccccacucccggccuuuccguucauccagccgggcauggacucgagcccacgaggugucacggccucagccuccacuuuugccgccgcugcuaucaccgcuguugcugccaagagagaagccugggugcuuuuaggaaagugaggggcgaaguguauaagagauagcaaggagcagaaccgaagucccgaccccagacgaggacccuucuggaggcgcucaggacccggcgccuucacaccucccucuuagguucggauccuaagagcgcagggagggaaccaagcggggccuugauuguuguuccucucuccccuccacacccuuccccaccccgaccacaccacaccccacccccuacaccucccugcuaccccucccaucccccacccgucugccagguuggaggaggguuuaaagccaggugcgcagagucagcucgccauguccagauccggggacaggaccuccaccuucgaccccagccacagugacaaccugcugcacggucucaaccugcuguggaggaagcagcuauuuugcgacguaacccugacagcccaaggccaacaguuccacugccacaaggccgugcuggccuccugcucgcaguacuuccgaucacucuucuccagccaccccccucucgggggaggggucggcggccaggacggccugggggcccccaaggaccagcagcagcagcagcagccucagcagcagccuccacagcagcagcagccgccgccacaggaggagcccgggacuccuuccuccucccccgacgacaagcugcugaccagccccagagccaucaacaaccuagugcugcagggcugcucguccaucgggcugcgccuagugcuugaauaccucuacacagccaacgugacccucucccuggacaccguggaggaagugcugucggucagcaaaauccugcacauuccucaggucaccaagcucugcguucaguuccucaacgaccagaucucggugcagaacuacaagcaggugugcaagaucgccgcacugcacggccuggaggagaccaagaagcuggccaacaaguaccugguggaagaugugcuguugcuuaacuucgaggagaugcgugcccugcuggacucgcugccgccccccguggagucggagcuggcacuuuuccagauguccgugcuguggcuggagcacgaccgugagacccgcaugcaguacgcgcccgaccucaugaagcgccuccgcuuugcgcucauccccgccccggagcugguagagcggguccagucgguggauuucaugcgcaccgacccggucugccagaagcugcugcuggacgccaugaacuaccaccugaugcccuucaggcagcacugcaggcagagccuggccagcagguaggagacaacaaagaggaaggcggggugggauggggugguggggaguugaagaggccggagggaggggagggggcaaggaggaggggagaacugggugggcugggcgggaggcuccugcacgugaaaaaacauuucgaacacuucagcugguauggagaaaguugauuuuagagugucagaaggggcaacggggaccuggccuaacagcaucccugagcgcuugaaugcccagauucccaugucuucagggcaagaaacauugaagauuucagacugagguugaaacugaacagauagguggggcccaaaggccuaugcaguuuagaagaacagcucugggcaccuuggucagucagagcucccucugcccgccccuuaaaguggaccuguucaaggagauugagccuguggugcagaucuuccucgguccuguuuugagccaggaagaacucucaguguuagcagaagagaacuucauagucuuucugucaugcacuuaaguuuuuaauauuuugguugguguuugugcugugacugaggucugcucucuuucuagauugaacucccaaaaggaguugucuauuccuacuacuaggaauaguaaugaugggcauucuguggccaagugaacuuuucuacuuugcagaaaacacuuucuuuucuuuaaaggagagcaaagccacacacauuucaggguggugaggugaaucuugccuacuaacuucuguccccaggaugucuugggcauugacagccgggaguggagaacagggaguggaguccugcaccuccaguugcucugugugucuagcaagagucacaaagaaguuagggaacuguugaugcugucugccauugccauuuaggaaguaucuguuuguguugcaaacaguauuucguguccaaagggagagagaaccaugcuuuuguaaagugcugcugagaugagacuacagaaacugacaauccuguuugauuggcuccaauuucaaaacccuuuuaaugagcccuagcaaagggcuccuucuauuuuuggagaagaggca

SEQ ID NO: 10867 - RNA, 2501 nt, Mus musculus
ccccaauggccaguaaucugcucugaaagcccucgcuacacauucaucgucccccucggcucgagcuugggaacacgucucugcaguucuuuucuugaggagagaggaguucuagggagauggagauaguuuaagaaugaauuccucauuuagcacugagccugaccuauggcagauacuuaguaaagaucuuaguaaagagugaguggccuggacucgugguucaggaugacuucaacugggcauggaggcacaucccuuuaaccagagcauuuggagguagaggcaggccgaucuugaucuuuaugaguuugaggccagccaaggauacauagccagacugucucaaaaacaaaacaaaacaaacaaaaccacaacaaaacccaaacaaaaacaaaaccaacaaacacauuguuauuuuaaaaaauauuuauuugugagcacagauggacaacuuucaggagugaguuuuccccuuccguguggauccugaggguuaaaaucaggggucaaguuugcuggcuuuuacccacugaaccaucuugacugccuuucuuuccuuacaucguggauuaagauuuuaauaaauuuaaagcagaggauucguugacgaggacccucagaaaccaggaggaugcaaauguuccuuaaacaaagaggcgaucuccuaggagcaaagccagaguuccugacaaggccacugcuugggaugauggagcuccggcggugacuacgccagaguuaaacuucuccgagugggauucagaguccaaaaagggauuuccuuuaagugacagguuccccacuuggggcagcucaucugggcuaggguuccuauccagccuguuguaacugagauccagcacgcugagcuuggcuggcagcccuuuagguaccugcuucagcccagugaaagacagauugagcgaguuuagcugacugggccagucacaacucggagcgccugcagcaucccgcagugaauugugacuaaggucuaguccuugcagcuguacccuugcugcggccagcgcagagcacacgccgcugggcgucuccauccccgcguuacgcagcgcuaaaacuuggagggucgggaacuugaggggacagagggcugagaucaguccucucucgcccaauucaggauugucagacaggucuaagguggagagggcagggaagacgcggaccuguucgcaggaaaaguugagcgagugugcuugggcaauacucaguaccuugaguccaggcuuuagccacugcugcaguucugcgagccaggcaucccuuguugcccacgacacguugcggagguucaagauguugagaucggguccgguggcuuccagaagcgguggcggcgcggugccgguuaccucgagauuuucaagagucaguuccuggaggccggaaaucccgagcacacgcagggcuccgaauagaauccgacuaggaauccgcgcggcccgcaccguaagccgcuuuaaggacagagacuugauaauaucagugaacugccccagaucugcuuccguguccacacgcuuuagaagguauuccaggcugcggccgccgccguacaauuccacaucugccgcccccaaacaauugaaagcgcuggaccaaucuggcuucggaucugagaaguugcaggaacaacuuuccucgucuagcucgcagggcucugguggggcgggagaggcgugcaccagaagcaacagcaacaagccaagcacacgcuccugaggagaaaguaggggucagggagacuccugccagacccugagauuccucagguuggcuccaguuccaccccaagacugucugacucaccauggucgguagauucugaaaguuugagcagcccagauaggcuccgagaaaggcuucaguuucuuuccuuuacagcggugguguucucuggcuuccagguuccacgggcuuguucgaccaauuuggcagccccuguaaauuuauguaauccuggggugucacccugucccuuccucugugaauucuaauugcgucuccacuucucuuccuccuaacagcccuacucacuucuaguaaauauugcaacgaaguguuuuuuaggaagggacgaaaaacaggaagaauucagaguggcauuagggcauucugugccaggaggaugaccuaugcgccccggacuugucuggugcguacaggaaaagggugaaucacaccuagugccuuagaucauuauucuguugcucagucccauugauucaccuccauuuuccccuagucuuaguugcuagcaauuucccaccguucaaauccagcucuugauuuucuuugaauguaauuggacauuuguggaaagauugugaacuuaucuauagauuccaggcagagaauaaagcucaaaguugagaguuaauaugaaaaauaauucucccuucuucccgucuuauucaguucuuuauuaauucauucuucucccacucucuaccucuccauucuccccaugauau

SEQ ID NO: 10868 - RNA, 2501 nt, Mus musculus
auaucauggggagaauggagagguagagagugggagaagaaugaauuaauaaagaacugaauaagacgggaagaagggagaauuauuuuucauauuaacucucaacuuugagcuuuauucucugccuggaaucuauagauaaguucacaaucuuuccacaaauguccaauuacauucaaagaaaaucaagagcuggauuugaacggugggaaauugcuagcaacuaagacuaggggaaaauggaggugaaucaaugggacugagcaacagaauaaugaucuaaggcacuaggugugauucacccuuuuccuguacgcaccagacaaguccggggcgcauaggucauccuccuggcacagaaugcccuaaugccacucugaauucuuccuguuuuucgucccuuccuaaaaaacacuucguugcaauauuuacuagaagugaguagggcuguuaggaggaagagaaguggagacgcaauuagaauucacagaggaagggacagggugacaccccaggauuacauaaauuuacaggggcugccaaauuggucgaacaagcccguggaaccuggaagccagagaacaccaccgcuguaaaggaaagaaacugaagccuuucucggagccuaucugggcugcucaaacuuucagaaucuaccgaccauggugagucagacagucuugggguggaacuggagccaaccugaggaaucucagggucuggcaggagucucccugaccccuacuuucuccucaggagcgugugcuuggcuuguugcuguugcuucuggugcacgccucucccgccccaccagagcccugcgagcuagacgaggaaaguuguuccugcaacuucucagauccgaagccagauugguccagcgcuuucaauuguuugggggcggcagauguggaauuguacggcggcggccgcagccuggaauaccuucuaaagcguguggacacggaagcagaucuggggcaguucacugauauuaucaagucucuguccuuaaagcggcuuacggugcgggccgcgcggauuccuagucggauucuauucggagcccugcgugugcucgggauuuccggccuccaggaacugacucuugaaaaucucgagguaaccggcaccgcgccgccaccgcuucuggaagccaccggacccgaucucaacaucuugaaccuccgcaacgugucgugggcaacaagggaugccuggcucgcagaacugcagcaguggcuaaagccuggacucaagguacugaguauugcccaagcacacucgcucaacuuuuccugcgaacagguccgcgucuucccugcccucuccaccuuagaccugucugacaauccugaauugggcgagagaggacugaucucagcccucuguccccucaaguucccgacccuccaaguuuuagcgcugcguaacgcggggauggagacgcccagcggcgugugcucugcgcuggccgcagcaaggguacagcugcaaggacuagaccuuagucacaauucacugcgggaugcugcaggcgcuccgaguugugacuggcccagucagcuaaacucgcucaaucugucuuucacugggcugaagcagguaccuaaagggcugccagccaagcucagcgugcuggaucucaguuacaacaggcuggauaggaacccuagcccagaugagcugccccaaguggggaaccugucacuuaaaggaaaucccuuuuuggacucugaaucccacucggagaaguuuaacucuggcguagucaccgccggagcuccaucaucccaagcaguggccuugucaggaacucuggcuuugcuccuaggagaucgccucuuuguuuaaggaacauuugcauccuccugguuucugaggguccucgucaacgaauccucugcuuuaaauuuauuaaaaucuuaauccacgauguaaggaaagaaaggcagucaagaugguucaguggguaaaagccagcaaacuugaccccugauuuuaacccucaggauccacacggaaggggaaaacucacuccugaaaguuguccaucugugcucacaaauaaauauuuuuuaaaauaacaauguguuuguugguuuuguuuuuguuuggguuuuguugugguuuuguuuguuuuguuuuguuuuugagacagucuggcuauguauccuuggcuggccucaaacucauaaagaucaagaucggccugccucuaccuccaaaugcucugguuaaagggaugugccuccaugcccaguugaagucauccugaaccacgaguccaggccacucacucuuuacuaagaucuuuacuaaguaucugccauaggucaggcucagugcuaaaugaggaauucauucuuaaacuaucuccaucucccuagaacuccucucuccucaagaaaagaacugcagagacguguucccaagcucgagccgagggggacgaugaauguguagcgagggcuuucagagcagauuacuggccauugggg

SEQ ID NO: 10869 - RNA, 2501 nt, Mus musculus
auaaaugauucaucaacagaaaauguuacagagaacacaaaauaauacacaggaauauauuugcaguagaguuuuacaauagagauuuaaauaacguuuacauguuugccugacaaggcuuaauuuucucuaauuaaaaaugagaauuugugcucaagaacauaaccuaagcauugcuuccugaaagauauuuuuaaaauauauuuggauuuaucagagagccaauaccuuaaaauguaccuuuaaaguguauccguggugucugggaugaagaaauauaagcaaacagaaauuugaagaauuaaacaucuuucuguaaaaaucaguuaauuuugcuucaagaugaugcaguaacuuaguaaggacucugcgcgccgcuguucaccaaccaugagaugguggugacggagcucagacagaaccaccgaguuuacagcacaaagagaggacagacugagacaagcaaguccuccaccaagcagcaacaaacuaaagcgaauggcuggauucccggcuucccuuccgcacacugggguccuggcggacacaacuggguucugaggcaccuuccaagaccucucagggugugagcgagauccucagggcagcaauggcgccuggacagagaggcuggggcucgcacuacagaggauuugugcugcucuccauucuccuggggaugcggugggaagccugggcaggacagauucucuacuccgugucugaagagacagacaagggaucuuuugugggaaauaucaccaaggaucugggacugcagccucgggagcuggcggagcgcgggguccgcaucaucaccaaagguaagacccagcuuuucucucugaacccgcggagcggcagccuggucaccgcgggcaggauagaucgggaggagcugugcgcucagagcccgcgaugucucgugagcuuuaacaucuugauagaagacaagaugaaucuuuacccuauagagguggaaauaauggauguuaaugacaacgcucccagauucuuaacagaagaaauaaacauaaaaauuauggagaaugcagcuccuggggugcgguuuccacuaaaggaagcuacagauucagacgugggcaagaacucccuccagagauaccagcucagccccaaucaccauuucucccugguugugcaaaguggagaugauggcaccaaguacccagaacuggugcuggagaaggcucuugaucgggaagaagaggggcuucaccaucugguccucacagccuaugauggcggggacccgcuccgaucuggcacugccagcauccgcgugacagugguggaugugaaugaucacacgccagucuucucucuaccccuguaucaagcgacagucccugagaacgugccaguaggcacaagacuucucacuguaaaugcuaucgacuuggaugagggaaucuauggggaagugacuuauucuuucuggaaaauaacuccagaacuucuacaaauauuccaucugagcucccugacaggagagcugucgacuuuaaaaggucuagauuaugagcaauccagcuucuaugagcuggaaguucaagcucaagauggugcuggcagucugaccaaggcaaaaguacugaucacaguuuuggaugugaaugacaaugccccagaagugacugucacaucugugagcagcccagucccugaagacacgccaccugggacagugaucgcucucuucuaccuccaagacaaagauucggggaagaauggugaggugaccugcucuuugccagaaaaccugccuuuuaaguuagagcgaucaauugauaauuauuacagguuggucacagcacgaaaccuggaccgggaaaagaugucuguguacaacaucacacugaaggccacagaugguggaaucccuccccuguccacugaaacucgcauguccauucaugugucagacaccaacgacaacccacccaccuuuuccgacucuucuuacucuaucuacgucccggagaacaaucccagaggagccuccaucuucucggugacugcacaagacccggacagugacaagaaugcccaagucacuuacgcuuuagcagaagacaccauccaggggguaccggugucguccuacgucuccaucaacucugacacggguauccuauaugcacuuggauccuucgacuaugagcaauuucgggaucuacaacuucgagugacugcucgugacaguggggacccaccucucagcaguaaugugucacugaaacucuuugugcuggacaagaaugauaacgccccugagauccuguacccugcccugcccacugauggcuccacagggguggagcuggcuccccgcucugcagaaccuggauaccuagugaccaaggugguagcuguggacaaagacucaggcccaaaugcuuggcuguccuaccgccugcuuaaagccagugagccagggcuuuucucaguagggcuacacacuggugaggugcgcacag

SEQ ID NO: 10870 - RNA, 2501 nt, Mus musculus
cugugcgcaccucaccaguguguagcccuacugagaaaagcccuggcucacuggcuuuaagcaggcgguaggacagccaagcauuugggccugagucuuuguccacagcuaccaccuuggucacuagguauccagguucugcagagcggggagccagcuccaccccuguggagccaucagugggcagggcaggguacaggaucucaggggcguuaucauucuuguccagcacaaagaguuucagugacacauuacugcugagagguggguccccacugucacgagcagucacucgaaguuguagaucccgaaauugcucauagucgaaggauccaagugcauauaggauacccgugucagaguugauggagacguaggacgacaccgguacccccuggauggugucuucugcuaaagcguaagugacuugggcauucuugucacuguccgggucuugugcagucaccgagaagauggaggcuccucugggauuguucuccgggacguagauagaguaagaagagucggaaaagguggguggguugucguuggugucugacacaugaauggacaugcgaguuucaguggacaggggagggauuccaccaucuguggccuucagugugauguuguacacagacaucuuuucccgguccagguuucgugcugugaccaaccuguaauaauuaucaauugaucgcucuaacuuaaaaggcagguuuucuggcaaagagcaggucaccucaccauucuuccccgaaucuuugucuuggagguagaagagagcgaucacugucccagguggcgugucuucagggacugggcugcucacagaugugacagucacuucuggggcauugucauucacauccaaaacugugaucaguacuuuugccuuggucagacugccagcaccaucuugagcuugaacuuccagcucauagaagcuggauugcucauaaucuagaccuuuuaaagucgacagcucuccugucagggagcucagauggaauauuuguagaaguucuggaguuauuuuccagaaagaauaagucacuuccccauagauucccucauccaagucgauagcauuuacagugagaagucuugugccuacuggcacguucucagggacugucgcuugauacagggguagagagaagacuggcgugugaucauucacauccaccacugucacgcggaugcuggcagugccagaucggagcggguccccgccaucauaggcugugaggaccagauggugaagccccucuucuucccgaucaagagccuucuccagcaccaguucuggguacuuggugccaucaucuccacuuugcacaaccagggagaaauggugauuggggcugagcugguaucucuggagggaguucuugcccacgucugaaucuguagcuuccuuuaguggaaaccgcaccccaggagcugcauucuccauaauuuuuauguuuauuucuucuguuaagaaucugggagcguugucauuaacauccauuauuuccaccucuauaggguaaagauucaucuugucuucuaucaagauguuaaagcucacgagacaucgcgggcucugagcgcacagcuccucccgaucuauccugcccgcggugaccaggcugccgcuccgcggguucagagagaaaagcugggucuuaccuuuggugaugaugcggaccccgcgcuccgccagcucccgaggcugcagucccagauccuuggugauauuucccacaaaagaucccuugucugucucuucagacacggaguagagaaucuguccugcccaggcuucccaccgcauccccaggagaauggagagcagcacaaauccucuguagugcgagccccagccucucuguccaggcgccauugcugcccugaggaucucgcucacacccugagaggucuuggaaggugccucagaacccaguuguguccgccaggaccccagugugcggaagggaagccgggaauccagccauucgcuuuaguuuguugcugcuugguggaggacuugcuugucucagucuguccucucuuugugcuguaaacucggugguucugucugagcuccgucaccaccaucucaugguuggugaacagcggcgcgcagaguccuuacuaaguuacugcaucaucuugaagcaaaauuaacugauuuuuacagaaagauguuuaauucuucaaauuucuguuugcuuauauuucuucaucccagacaccacggauacacuuuaaagguacauuuuaagguauuggcucucugauaaauccaaauauauuuuaaaaauaucuuucaggaagcaaugcuuagguuauguucuugagcacaaauucucauuuuuaauuagagaaaauuaagccuugucaggcaaacauguaaacguuauuuaaaucucuauuguaaaacucuacugcaaauauauuccuguguauuauuuuguguucucuguaacauuuucuguugaugaaucauuuau

SEQ ID NO: 10871 - RNA, 2501 nt, Mus musculus
ugcaauauuauuuuucucugagauucuaccggcugagaaaguguuacagucauguucggcucaccauucguauauuaaagauuaaagcacgcuuaugucaacagauauuaugccucuggcgacauaauccuagaaauuugugauaaaaggcauuucugacaauacaauuuugaacguuauucaguguauggaaauuucugguuuaaaaccucaaauuugcuauuugagccuuugcuaggcugcaguuuccuacugcagacucugggcgccgcuguuggccagacuagagauucuggaagaccucuucucgcgcagccgcagagcgcuuuccaaggcuuccuuucucagccuuuacaccgcuucuuucugagcaaaagaagaaucguuucauggacuagaucugauaccaaaguucgauuggagcccggaauauccacaccacgcagcuucuucguaacccggcgucuccaggcuggugagcaaggaaaggggagcaagaaagaugcgggagggcacugcugagaggggccggggacagaggcggccaaugcuccuucccuuccugcugccuuuguucugccccacgcucucugagcagauccgcuacaagauccccgaggaaaugcccaccggcucgguaguggggaaccucgccaaggaccuggguuucaguguccaggaguuaccgacgcgaaagcuacgcaucaguucugagaagccuuacuucagugugagcucagagagcggagaguugcuaguaagcagcaggcuggacagggagcagauaugcgggaagaagcugaugugugcucuggaauuugaggcuguugcugaaaauccacugaacuuuuaucacuugaguguggagcuggaggacauuaaugaccacacgccaaaauucgcgcacacuuccuuugaauugcaaauaagugaguccucaaaaccagggacaagauuuaucuuaggauccgcccaugaugcagauaucggaaccaauucucugcagaauuaccagcuuagucccaaugaucauuuuucacuggugaauaaagagaaaucagacgguaguaaguacccugaaaugauauuaaagacagcucuagaccgggaaaagcagaaacucuaccacuugacccugacugcuuuggacuuugggcauccaccccucaacagcacugcacagauacagguccuagugaccgaugccaaugauaacccuccaguguucagccaagacauauacagggugagccuuccugaaaacguguacccaggaaccaccgugcuucgagugguggccacagaccaagacgagggugucaacuccgagaucacguuuucuuucagugaagcuggccagguuacccaauuuaaccuggauucuaauaccggagaaauuacaacucugcauacauuagauuucgaagaagucaaagaauacucccuuguuuuggaagcaaaggacgguggggggaugauugcgcaauguacgguggaaauagaaguccuagaugagaacgacaaugucccugaaguguuauuccaaucucuaccugaucucauaauggaggaugcugagccagggacauauaucgcucugcuuaaaacccgugacaaagauucuggacgcaauggagaaguuaucuguaaauuagaaggcggugcuccguuuaaaauacucacuucuucaggaaacacguauaaacuagugacggauggaguucuagaucgugagcagaacccggaauacaacauuacuauuagagcuacugacaagggugacccgccucucucuuccagcucaagugucaccuugcauauaggcgaugugaacgauaacgccccaguuuucacgaagguuucauaccugguccauguugcagaaaacaauccgccuggagccuccaucgcucaagucagcgccucagacccggauuugggggccaauggccagguuaccuauuacaucauagccagcgaccuggagccugaaucucugugguccuacgugaccauaaacgcgcaaagcggagugcuguucgcacagcgcgccuucgaccacgaacaacugcgcuccuuccagcugacacugcaggcgcgggaccacggaucgcccacacucagcgccaaugugagcaugcgcuuguuggugggugaccgcaacgacaacgcgccccgagugcuguaucccacgcucgagcccgacggcucugcgcucuucgacauggugccgcgcucugccgagcccggauaccuggucaccaaggugguggcuguggaugcagacucgggacacaaugccuggcugucuuaccaugugcugcaggccagugacccugggcucuucagccugggacugcgcacaggcgaggugcgcacagcgcgugcccugggagacagggacucagcgcggcagcgccuucuggucgcugugcgugaugguggacaaccaccgcucucggcuacagccacgcugcaccucaucuucgcugacagccugc

SEQ ID NO: 10872 - RNA, 2501 nt, Mus musculus
gcaggcugucagcgaagaugaggugcagcguggcuguagccgagagcggugguuguccaccaucacgcacagcgaccagaaggcgcugccgcgcugagucccugucucccagggcacgcgcugugcgcaccucgccugugcgcagucccaggcugaagagcccagggucacuggccugcagcacaugguaagacagccaggcauugugucccgagucugcauccacagccaccaccuuggugaccagguauccgggcucggcagagcgcggcaccaugucgaagagcgcagagccgucgggcucgagcgugggauacagcacucggggcgcguugucguugcggucacccaccaacaagcgcaugcucacauuggcgcugagugugggcgauccguggucccgcgccugcagugucagcuggaaggagcgcaguuguucguggucgaaggcgcgcugugcgaacagcacuccgcuuugcgcguuuauggucacguaggaccacagagauucaggcuccaggucgcuggcuaugauguaauagguaaccuggccauuggcccccaaauccgggucugaggcgcugacuugagcgauggaggcuccaggcggauuguuuucugcaacauggaccagguaugaaaccuucgugaaaacuggggcguuaucguucacaucgccuauaugcaaggugacacuugagcuggaagagagaggcgggucacccuugucaguagcucuaauaguaauguuguauuccggguucugcucacgaucuagaacuccauccgucacuaguuuauacguguuuccugaagaagugaguauuuuaaacggagcaccgccuucuaauuuacagauaacuucuccauugcguccagaaucuuugucacggguuuuaagcagagcgauauaugucccuggcucagcauccuccauuaugagaucagguagagauuggaauaacacuucagggacauugucguucucaucuaggacuucuauuuccaccguacauugcgcaaucauccccccaccguccuuugcuuccaaaacaagggaguauucuuugacuucuucgaaaucuaauguaugcagaguuguaauuucuccgguauuagaauccagguuaaauuggguaaccuggccagcuucacugaaagaaaacgugaucucggaguugacacccucgucuuggucuguggccaccacucgaagcacggugguuccuggguacacguuuucaggaaggcucacccuguauaugucuuggcugaacacuggaggguuaucauuggcaucggucacuaggaccuguaucugugcagugcuguugagggguggaugcccaaaguccaaagcagucagggucaagugguagaguuucugcuuuucccggucuagagcugucuuuaauaucauuucaggguacuuacuaccgucugauuucucuuuauucaccagugaaaaaugaucauugggacuaagcugguaauucugcagagaauugguuccgauaucugcaucaugggcggauccuaagauaaaucuugucccugguuuugaggacucacuuauuugcaauucaaaggaagugugcgcgaauuuuggcguguggucauuaauguccuccagcuccacacucaagugauaaaaguucaguggauuuucagcaacagccucaaauuccagagcacacaucagcuucuucccgcauaucugcucccuguccagccugcugcuuacuagcaacucuccgcucucugagcucacacugaaguaaggcuucucagaacugaugcguagcuuucgcgucgguaacuccuggacacugaaacccagguccuuggcgagguuccccacuaccgagccggugggcauuuccucggggaucuuguagcggaucugcucagagagcguggggcagaacaaaggcagcaggaagggaaggagcauuggccgccucuguccccggccccucucagcagugcccucccgcaucuuucuugcuccccuuuccuugcucaccagccuggagacgccggguuacgaagaagcugcgugguguggauauuccgggcuccaaucgaacuuugguaucagaucuaguccaugaaacgauucuucuuuugcucagaaagaagcgguguaaaggcugagaaaggaagccuuggaaagcgcucugcggcugcgcgagaagaggucuuccagaaucucuagucuggccaacagcggcgcccagagucugcaguaggaaacugcagccuagcaaaggcucaaauagcaaauuugagguuuuaaaccagaaauuuccauacacugaauaacguucaaaauuguauugucagaaaugccuuuuaucacaaauuucuaggauuaugucgccagaggcauaauaucuguugacauaagcgugcuuuaaucuuuaauauacgaauggugagccgaacaugacuguaacacuuucucagccgguagaaucucagagaaaaauaauauugca

SEQ ID NO: 10873 - RNA, 2501 nt, Mus musculus
uaaaggaagcuuuaaaucaucuuucaaagugaauuuuaucaaaagaaauauaccugucuccaugugaaugaauaccaaaguuguaagauuuuucaauacaaaauaaacauuacuauguuuuaaguuggugugcuucuguugaaaauaaaauccaaauauuaucaauuuagcuuauuauacucuccaauaagaaaccuugagaagggcucugaugcagcucacuguuggagcucuugccuacguaaaugugaagcccugcuuucaaucucacgcccucuccaaaaacaaaauaaaacagagacaccaaaggaaauuaaaguaaacuaaaauaauucaacagaaaaaugcauuugcugaaauauuauagugggugcaguaacuucuuccgacucugagcgccgcuguucaccuacgaggagcaaaaagccaccggagcacaguugggauucucaggguccaaaagcuuaaagccucacaguuccggcaaaccggcuccugggcugcaacgaaaauuacuccgcacuuuaaggugcuuccgcugcgggagacccaaggggucacagaaagaagaaaagaaccgggugaaacacacugggcgccuggcggaucgggaaaagcuuugagagaauuccguagucagaagacaauggccgcucaaaggaaucucucagagcgcaccaaacugguccuccuuuucuuauggaugcccugggaauccgcagcucggcagauccgcuauucaguuccugaggaacuagagaaaggcucuuuugugggcaacaucgccaaggaccuggggcuggagccccgccagcuggcggaacgcgggguccgcaucaucuccagagguaggucucagcuuuucucucugaacccgcgaggcggcagcuuagucaccgcgggcaggauagaccgggaggagcugugcgcccagagcgcgcccugucucgucagcuuuaacauccuuguugaagauagagugaaacuuuucgggauagaaauagagguaacggaugucaaugacaaugcgccaaaauuccaagcagaaacucuagauguaaaaauuaaugaaaaugucgccccaggaaugcguuuuccucucccggaagcuacugauccggaugugggagugaauucucugcagagcuaccagcucagcuccaauaaacacuucucccuagucguucagagcggugcuaagggcgucaaguacccggagcuagugcuggaacaggcccuagaucgugaggaagaggcgauucaccaccugguccucguggccucugacggaggaaacccucccagaucgggcacuguccucaucacugugaccgucuuugaugcaaaugacaaugcuccagucuucaccuccacugaauaccgcgugaacauuccggagaaccugccugugggcacccaacugcuaaagguaaccgccaccgacaaagacgaaggugccaauggagaagugacauaugcauuccgaaaaucgcuggacacacaauuguccaaauuccaacuagacaaacauaccggagaaauaaaaauuucugaaaaucuagauuaugaagaaaugaguuucuaugaaauagaaauccaagcugaagauggaggggccuaucuugcaacugcgaaggugcugauuacaguagaagauguaaaugacaacaguccugaggugaccaucacaucucucuucaguccagugacagaagauucgccggugggaacugucauagcccuacuaaacguccaugauuuagacuccgggcagaauggagagguagccuguuccaucucagggaaucuuccguuuaaguuagaaaaguccauugacaauuacuauaggcuagugacacaaagagcccuugaucgggaacagguacccgcuuacaacaucacaguaacagccacugaugggggaaacccaccuuugucaaccaaagcugacuucacucugcaaguggcagauaucaacgacaacccaccuaccuucucucauccguccuacuuuaccuacaucccagagaacaaucccagaggcgccuccaucuucucagugacugcccucgauccagacagcaaagagaacgcccagaucguuuacucccuggcugaagacaccauugagggggcgccacuuucuuccuacauauccaucaacucagacacuggcauccuguaugcgcucugguccuuugacuaugagcaguuucgugaacugcagguacaggugacugccagcgacagcggaaagccgccccuccacaguaaugugucguugacucuguuugugcuggaucaaaaugacaacucuccagaaaucuuguaccccaccaugcccaccgacggcuccacugggguagagcuugcuccccgcucagcagagcugggcuaucuggugacgaaggugguggcaguggacagagacucgggacagaacgccuggcuguccuaucgccuacucaaggccagcgaaccagggcucuucacuguagggc

SEQ ID NO: 10874 - RNA, 2501 nt, Mus musculus
gcccuacagugaagagcccugguucgcuggccuugaguaggcgauaggacagccaggcguucugucccgagucucuguccacugccaccaccuucgucaccagauagcccagcucugcugagcggggagcaagcucuaccccaguggagccgucggugggcauggugggguacaagauuucuggagaguugucauuuugauccagcacaaacagagucaacgacacauuacuguggaggggcggcuuuccgcugucgcuggcagucaccuguaccugcaguucacgaaacugcucauagucaaaggaccagagcgcauacaggaugccagugucugaguugauggauauguaggaagaaaguggcgcccccucaauggugucuucagccagggaguaaacgaucugggcguucucuuugcugucuggaucgagggcagucacugagaagauggaggcgccucugggauuguucucugggauguagguaaaguaggacggaugagagaagguagguggguugucguugauaucugccacuugcagagugaagucagcuuugguugacaaagguggguuucccccaucaguggcuguuacugugauguuguaagcggguaccuguucccgaucaagggcucuuugugucacuagccuauaguaauugucaauggacuuuucuaacuuaaacggaagauucccugagauggaacaggcuaccucuccauucugcccggagucuaaaucauggacguuuaguagggcuaugacaguucccaccggcgaaucuucugucacuggacugaagagagaugugauggucaccucaggacuguugucauuuacaucuucuacuguaaucagcaccuucgcaguugcaagauaggccccuccaucuucagcuuggauuucuauuucauagaaacucauuucuucauaaucuagauuuucagaaauuuuuauuucuccgguauguuugucuaguuggaauuuggacaauuguguguccagcgauuuucggaaugcauaugucacuucuccauuggcaccuucgucuuugucgguggcgguuaccuuuagcaguugggugcccacaggcagguucuccggaauguucacgcgguauucaguggaggugaagacuggagcauugucauuugcaucaaagacggucacagugaugaggacagugcccgaucugggaggguuuccuccgucagaggccacgaggaccagguggugaaucgccucuuccucacgaucuagggccuguuccagcacuagcuccggguacuugacgcccuuagcaccgcucugaacgacuagggagaaguguuuauuggagcugagcugguagcucugcagagaauucacucccacauccggaucaguagcuuccgggagaggaaaacgcauuccuggggcgacauuuucauuaauuuuuacaucuagaguuucugcuuggaauuuuggcgcauugucauugacauccguuaccucuauuucuaucccgaaaaguuucacucuaucuucaacaaggauguuaaagcugacgagacagggcgcgcucugggcgcacagcuccucccggucuauccugcccgcggugacuaagcugccgccucgcggguucagagagaaaagcugagaccuaccucuggagaugaugcggaccccgcguuccgccagcuggcggggcuccagccccagguccuuggcgauguugcccacaaaagagccuuucucuaguuccucaggaacugaauagcggaucugccgagcugcggauucccagggcauccauaagaaaaggaggaccaguuuggugcgcucugagagauuccuuugagcggccauugucuucugacuacggaauucucucaaagcuuuucccgauccgccaggcgcccaguguguuucacccgguucuuuucuucuuucugugaccccuugggucucccgcagcggaagcaccuuaaagugcggaguaauuuucguugcagcccaggagccgguuugccggaacugugaggcuuuaagcuuuuggacccugagaaucccaacugugcuccgguggcuuuuugcuccucguaggugaacagcggcgcucagagucggaagaaguuacugcacccacuauaauauuucagcaaaugcauuuuucuguugaauuauuuuaguuuacuuuaauuuccuuuggugucucuguuuuauuuuguuuuuggagagggcgugagauugaaagcagggcuucacauuuacguaggcaagagcuccaacagugagcugcaucagagcccuucucaagguuucuuauuggagaguauaauaagcuaaauugauaauauuuggauuuuauuuucaacagaagcacaccaacuuaaaacauaguaauguuuauuuuguauugaaaaaucuuacaacuuugguauucauucacauggagacagguauauuucuuuugauaaaauucacuuugaaagaugauuuaaagcuuccuuua

SEQ ID NO: 10875 - RNA, 2501 nt, Mus musculus
guaacaaugggccauugguccugugggccuucacuuucuuucacgcuuuuuaauuugaaggaaauacacuuucaaucuaaccaaaaugaguauacauguuuauauaugaaagaauauuuauuaauaaaaaauuucacuagggaaacaaaaucaaugagaaagaaaauucaaauguuuuggcuaucaacuuaacacagaaaauaaaagauucccccaaaaucugaaacgccagacugcaauuccacucagagccucugggcgccgcugucggccagugcagagcaagcucugaugccccgaucccucagucucuaagcugcaauuuccugcgcagaaacgaauacacacaccaaggggaacucucacucauacagacuaagacaccgauucccaggacaaaacuggggucccgcugucccgagccaaaaggaccuccacccucguaggcugaacucucuccuacugugaagaucugaagaccuacaggggaccugagccagcaaugggagggagcagcgcgcggaggaagcgccccggccgcccgcagguacuguuuauccugcugcugccuuuguucugucccgcgcugggccagccgguccgcuacuccaucccugaggagcuggaccgcgggucggugguggggaagcucgccaaggaccuggggcucaguguccuggaagugucggcucggaagcugcgggucagcgcugagaagcugcacuucagcguggauucggagagcggggacuuacuggugaaggaccgcauagaucgcgagcaaauaugcaaagggaggagaaagugugagcugcaguuggaagcugugcuagaaaacccuuuaaauauuuuucaugucguuguggagauugaggauguuaaugaucacgcuccucaauuuccaaaagacgaaauaaaccuagagauaagugaauccgacagcccaggggcgagaacaauucuggagucagcaaaagaucuugacauugguaugaauucucuaaguaaauaccaguuaaguccuaacgacuacuuuuuauuguuggugaaagacaauccugaugguaguaaauacccagaauuagaauugcaaaagaugcuggaccgagaagcagagagcacacaccaccugaugcugacugcuguagaugguggggacccgccccguacugguacuacucagcuccgaauccgagugguggacgccaaugauaaccgcccaguguucagccaagacguguacagaguccgccuuccagaagacuugccuccaggaaccacaguccuaaggcuaaaggcaauggaucaagacgagggcaucaaugcagaauuuacauauuccuuccuagguguggcuaacaaagcccaguucucucuggaucccauaacaggagauauuguaacucgccagucguuggauuuugaagaaguagagcaauauacgauugauguggaggcaaaggaccgaggaucucuuucuucacaguguaaaguaauuauagagguucuagaugagaacgacaaccgcccagaaauaaucaucacuucucucucugaucagauuucggaggauucuccuuccggaacuguuguggcccucuucaagguacgggaucgagauucuggggaaaacgcagaagucaugugcaguuuaagcggaaacaauccauuuaagauucauucuucuuccaacaauuacuacaaguuaguaacagauagcauccuagaccgggaacagaccccaggguacaacguuacuaucacagccacugauaggggcaagccgccccuuuccuccagcacaaccaucacucugaacgucgcugaugucaacgacaaugcaccuguuuuccaacagcaggccuaccugauaaacguagcagaaaacaaccagcccgguaccuccauaacccaagucaaagcaugggauccagaugugggauccaauggccucgucuccuacuccaucauagccagcgaccuagaaccaaaagcgcugucguccuucguguccgugaaccaggacaguggaguaguguacgcgcagcgugccuuugaccaugagcagauucgcuccuuccagcugacuuuacaagcgcgagaccaggggucgccugcgcucagcgccaacgugagcaugcgcgugcugguggacgaccgcaacgacaacgcgccacgcgugcuguaucccacgcuggagcccgauggcucugcacucuucgacaugguaccccgugccgcugagccuggauaccuggucaccaaagugguggcuguggaugcagacucaggacacaaugccuggcugucuuaccacgugcugcaggccagcgaucccggucucuucagccuggggcugcgcacgggcgaggugcgcacagcgcgugccuugagcgacaaggaugcagcucgucagcgccuucuggucgcugugcgugaugguggacagccaccucugucugccacugcuacacugcuccuaguuuuugcagacagccuac

SEQ ID NO: 10876 - RNA, 2501 nt, Mus musculus
guaggcugucugcaaaaacuaggagcaguguagcaguggcagacagagguggcuguccaccaucacgcacagcgaccagaaggcgcugacgagcugcauccuugucgcucaaggcacgcgcugugcgcaccucgcccgugcgcagccccaggcugaagagaccgggaucgcuggccugcagcacgugguaagacagccaggcauuguguccugagucugcauccacagccaccacuuuggugaccagguauccaggcucagcggcacgggguaccaugucgaagagugcagagccaucgggcuccagcgugggauacagcacgcguggcgcguugucguugcggucguccaccagcacgcgcaugcucacguuggcgcugagcgcaggcgaccccuggucucgcgcuuguaaagucagcuggaaggagcgaaucugcucauggucaaaggcacgcugcgcguacacuacuccacuguccugguucacggacacgaaggacgacagcgcuuuugguucuaggucgcuggcuaugauggaguaggagacgaggccauuggaucccacaucuggaucccaugcuuugacuuggguuauggagguaccgggcugguuguuuucugcuacguuuaucagguaggccugcuguuggaaaacaggugcauugucguugacaucagcgacguucagagugaugguugugcuggaggaaaggggcggcuugccccuaucaguggcugugauaguaacguuguacccuggggucuguucccggucuaggaugcuaucuguuacuaacuuguaguaauuguuggaagaagaaugaaucuuaaauggauuguuuccgcuuaaacugcacaugacuucugcguuuuccccagaaucucgaucccguaccuugaagagggccacaacaguuccggaaggagaauccuccgaaaucugaucagagagagaagugaugauuauuucugggcgguugucguucucaucuagaaccucuauaauuacuuuacacugugaagaaagagauccucgguccuuugccuccacaucaaucguauauugcucuacuucuucaaaauccaacgacuggcgaguuacaauaucuccuguuaugggauccagagagaacugggcuuuguuagccacaccuaggaaggaauauguaaauucugcauugaugcccucgucuugauccauugccuuuagccuuaggacugugguuccuggaggcaagucuucuggaaggcggacucuguacacgucuuggcugaacacugggcgguuaucauuggcguccaccacucggauucggagcugaguaguaccaguacggggcggguccccaccaucuacagcagucagcaucagguggugugugcucucugcuucucgguccagcaucuuuugcaauucuaauucuggguauuuacuaccaucaggauugucuuucaccaacaauaaaaaguagucguuaggacuuaacugguauuuacuuagagaauucauaccaaugucaagaucuuuugcugacuccagaauuguucucgccccugggcugucggauucacuuaucucuagguuuauuucgucuuuuggaaauugaggagcgugaucauuaacauccucaaucuccacaacgacaugaaaaauauuuaaaggguuuucuagcacagcuuccaacugcagcucacacuuucuccucccuuugcauauuugcucgcgaucuaugcgguccuucaccaguaaguccccgcucuccgaauccacgcugaagugcagcuucucagcgcugacccgcagcuuccgagccgacacuuccaggacacugagccccagguccuuggcgagcuuccccaccaccgacccgcgguccagcuccucagggauggaguagcggaccggcuggcccagcgcgggacagaacaaaggcagcagcaggauaaacaguaccugcgggcggccggggcgcuuccuccgcgcgcugcucccucccauugcuggcucagguccccuguaggucuucagaucuucacaguaggagagaguucagccuacgaggguggagguccuuuuggcucgggacagcgggaccccaguuuuguccugggaaucggugucuuagucuguaugagugagaguuccccuugguguguguauucguuucugcgcaggaaauugcagcuuagagacugagggaucggggcaucagagcuugcucugcacuggccgacagcggcgcccagaggcucugaguggaauugcagucuggcguuucagauuuugggggaaucuuuuauuuucuguguuaaguugauagccaaaacauuugaauuuucuuucucauugauuuuguuucccuagugaaauuuuuuauuaauaaauauucuuucauauauaaacauguauacucauuuugguuagauugaaaguguauuuccuucaaauuaaaaagcgugaaagaaagugaaggcccacaggaccaauggcccauuguuac

SEQ ID NO: 10877 - RNA, 2501 nt, Mus musculus
auacucacaaagacacaugcauauacucauaauuaaacuaauaagauaaaaccuugaauaaaaaguaguaagaauaauagccaugaauccuaccugaggauuucgucuggaccaugcuggcuucucauucacaaacgccgcgucucuacaguuaguaaaaccagcuggaaucacaacuaaccuguguauuuuaagucccaguguuauuuugaaacguuuuuuuaauuaaacaaguccaucuaauaacuacccuuuucauaagugcucuugguaaaauuuacaucacaucacauagcuguuguuugcuguugucggcuucacaaauguuaggauccacggaaaaggugagugugacaguuuucuccgcaacagacaccggguuuuuauuaguguugcaauaauaagauugggcucuaggcgccgcuguugaccaaucggggaacgggaggacaaagcuauugaguacuucuccggaaucucuagcacacaaagccgaaaaggauggauacucacgcaucucaacucuggaaguaaaaacaccuccguucgcuuuggaauauguuuuggaugcgggauaccuggaaccucguagacacaaaagcugacucggaaaaauaaauaaaaauuaaaccggcgcaagacccuuacggaauaacgcucacacccagccauggcgaaucagucucagcgccuggaccgccgcgcgcugaucccgcugugcauuuuccuggggaccuugcugaccuuugggacaggacagauccgauacucgguuccagaagaaacagauaaaggcuucuucguaggcaacaucuccaaagaccuggggcuggagcccugggaggucgcggaacgcggaguccgcaucaucuccaggggacaaucgcagcuuuucucucugaauccgcgaggcggcagcuuggucacugcagguaggaucgaccgugaagagcuaugugauacgaugcccuccugcaugcugaauuuggaaauucucguggaggaaacccugaagauuuacggaguugagguggaaguacuggacauuaacgauaacgcucccagcuuccgggaagaggaaguagagaucaaagucagcgagcauaccaguccugggucgcgauuuccucuuccuagcgcuagggauccagacgcagggaugaacucccuccagagcuaccagcucagcccaagcaguuauuucuccuugcaggugagaggcgggacugauggggacaagaauccagagcuagugcuggaggaaggucuggaccgggagaaagaggcaucucaccaccuccuccucacagccuuagaugggggagaucccguccgcaagggcacgguucccauucgcguggugguccucgacgucaaugaucacaucccaaaauuuacacagccuguguauagagugaguauuccugaaaaccucagcuccgggacgcgggugcucgugguaaaugccucagacccagaugaggggaucaacggggaagugauauacucuuuccggaaaaugaaaagcaaagcuucugaaauauuucaacugaauucucaaacuggggagguucuaguuggaaagccucuggauuuugaaaaauacagauucuaugagauggaaauucaaggccaggaugguggagggcugcuuagcaccacuacguuguugaucacgguugaagaugugaaugauaacgcuccagagauaacugucaccucugccaguaacucagugccggaaaauucuccuucgggcacaguaauugcucuucuaaacguucaagaucaagauucuggagaaaauggucaggucucuugcuucauuccuaguggucuuccuuuuaaguuagaaaagacguauggaaauuauuauaaauugauaacaaauagugaacuggaccgggagcagguggagagcuacaauauuacauugaucgccaaagaucagggcaguccaccguugucuacagaaacucaccuacugcucaaaguggcagaugccaacgacaacccuccaguuuucucuagcuccucuuacuuggccuacauuccugaaaacaaccccagaggcucuucuaucuucucggugaccgccauugauagggauagcagagaaaaugcccaggucacuuacucucuggcugaguacaccauccagggaacaccucuguccucuuacguuucuaucaauucagacacgggugugcuguaugcccugcaauccuucgacuaugagcaauuccagaccuuacaacugggagugaccgcuagugauaauggcgacccaccauuaagcagcaauauuucgcugacccuuuucgugcuggaccagaaugacaacacuccagagauuuuauaccccucucucccuaccgaugguuccacugguguggaauuagcaccucgcuccgcagagccggguuauuuagugaccaaggugguggcuguggacagagacuccgggcagaacgccuggcuguccuaucgccugcucaaag

SEQ ID NO: 10878 - RNA, 2501 nt, Mus musculus
cuuugagcaggcgauaggacagccaggcguucugcccggagucucuguccacagccaccaccuuggucacuaaauaacccggcucugcggagcgaggugcuaauuccacaccaguggaaccaucgguagggagagagggguauaaaaucucuggaguguugucauucugguccagcacgaaaagggucagcgaaauauugcugcuuaauggugggucgccauuaucacuagcggucacucccaguuguaaggucuggaauugcucauagucgaaggauugcagggcauacagcacacccgugucugaauugauagaaacguaagaggacagagguguucccuggaugguguacucagccagagaguaagugaccugggcauuuucucugcuaucccuaucaauggcggucaccgagaagauagaagagccucugggguuguuuucaggaauguaggccaaguaagaggagcuagagaaaacuggaggguugucguuggcaucugccacuuugagcaguaggugaguuucuguagacaacgguggacugcccugaucuuuggcgaucaauguaauauuguagcucuccaccugcucccgguccaguucacuauuuguuaucaauuuauaauaauuuccauacgucuuuucuaacuuaaaaggaagaccacuaggaaugaagcaagagaccugaccauuuucuccagaaucuugaucuugaacguuuagaagagcaauuacugugcccgaaggagaauuuuccggcacugaguuacuggcagaggugacaguuaucucuggagcguuaucauucacaucuucaaccgugaucaacaacguaguggugcuaagcagcccuccaccauccuggccuugaauuuccaucucauagaaucuguauuuuucaaaauccagaggcuuuccaacuagaaccuccccaguuugagaauucaguugaaauauuucagaagcuuugcuuuucauuuuccggaaagaguauaucacuuccccguugauccccucaucugggucugaggcauuuaccacgagcacccgcgucccggagcugagguuuucaggaauacucacucuauacacaggcuguguaaauuuugggaugugaucauugacgucgaggaccaccacgcgaaugggaaccgugcccuugcggacgggaucucccccaucuaaggcugugaggaggagguggugagaugccucuuucucccgguccagaccuuccuccagcacuagcucuggauucuuguccccaucagucccgccucucaccugcaaggagaaauaacugcuugggcugagcugguagcucuggagggaguucaucccugcgucuggaucccuagcgcuaggaagaggaaaucgcgacccaggacugguaugcucgcugacuuugaucucuacuuccucuucccggaagcugggagcguuaucguuaauguccaguacuuccaccucaacuccguaaaucuucaggguuuccuccacgagaauuuccaaauucagcaugcaggagggcaucguaucacauagcucuucacggucgauccuaccugcagugaccaagcugccgccucgcggauucagagagaaaagcugcgauuguccccuggagaugaugcggacuccgcguuccgcgaccucccagggcuccagccccaggucuuuggagauguugccuacgaagaagccuuuaucuguuucuucuggaaccgaguaucggaucuguccugucccaaaggucagcaagguccccaggaaaaugcacagcgggaucagcgcgcggcgguccaggcgcugagacugauucgccauggcugggugugagcguuauuccguaagggucuugcgccgguuuaauuuuuauuuauuuuuccgagucagcuuuugugucuacgagguuccagguaucccgcauccaaaacauauuccaaagcgaacggagguguuuuuacuuccagaguugagaugcgugaguauccauccuuuucggcuuugugugcuagagauuccggagaaguacucaauagcuuuguccucccguuccccgauuggucaacagcggcgccuagagcccaaucuuauuauugcaacacuaauaaaaacccggugucuguugcggagaaaacugucacacucaccuuuuccguggauccuaacauuugugaagccgacaacagcaaacaacagcuaugugaugugauguaaauuuuaccaagagcacuuaugaaaaggguaguuauuagauggacuuguuuaauuaaaaaaacguuucaaaauaacacugggacuuaaaauacacagguuaguugugauuccagcugguuuuacuaacuguagagacgcggcguuugugaaugagaagccagcaugguccagacgaaauccucagguaggauucauggcuauuauucuuacuacuuuuuauucaagguuuuaucuuauuaguuuaauuaugaguauaugcaugugucuuugugaguau

SEQ ID NO: 10879 - RNA, 2501 nt, Mus musculus
gugguggggcuauuuucccacgugaucuugagaaaauacuuuccugauucauccaaugugugcguuuccuuagaaaagacgagcuuuuuaaucuguugucacuggguuaauaguuauguuacagaucccaccucugaggagcuuuguucgguagcaacacuggaaaacagucaaauucuaaacucagaaauuccuuugcuccccauaucucaacauagcuguauucuuaaacccaaugagucugcgaaggguucugauugcaauuuuauaaauggccucugggcgccgcugcuguccaauucgcugcaagagcugacuccaugcucuaccgguugaaauucuguacauucacuggaggcuuaaagaguagggguacuugaauuuucugcuugguaaaucagauuagagacugugauauccucaaacguggagcguuuggguuuucuuccugguuggaaguaauucgcgaagccuccucccuucacacuggugcgggagaaggauggagcgcagcagcgugaagcuagggagcaggaccccguggaggcaaguacucuuucccuucuugcugccuuuguucugcacggggcucucagagcaaguccgguacucuauuccggaagaaauggccauggguucagucgugggaaaucucgcugaggaccuggggcugccuguucaggacuuacugacaagaaaccuuagaguuauugcagagaaaccguaucuuucugugaacccagagaacgggaacauaguugugagcgacagaauagaccgagaguuucucugcuuccaaagcccucugugcguccugcccuuagagauuguggcagaaaauccccuaaacguuuuucacgucagcguggugauagaagauauaaaugauaacccuccccguuuccuccaaaauagcauuguuuugcaaaucaaugaacuugcgauuccaggcacuagguuuggccuggaaucugccauagaugcagauguagggcugaacucucuccagaguuaccaacucaguuugaaugagcacuucucucuggugguaaaggacaacacugaaggaaaggaugcccccgaauuaguguuggagaagccucuggacagggaaaaacagagcucccagcucuugguccuaaccgcaguagaugggggagaaccaguccuaacgggcaccgcucagauucagaucgaggucacugaugccaaugauaaccccccaguguucagccaaaguacguacaaagucagucuuagagaggacauggccgcaggcacgucugugcuaacagugauagccacugaccaggaugagggugucaacgcagaagucaccuacuccuucaaaucacuaggagaagauauuagagauaaguuuauccuagaucaucaaaguggagaaauuaaauccaaaggcccuauugacuuugaaaccaagaggacuuacaccaugaacauagaggccaaggacgguggaggcauggccucagaauguaaaguuguaguggaaauucucgaugagaacgacaaugccccagaagugguuuuuacuuccguguccaauucuauaaccgaagaugcagaaccggggacagugguggcucuguucaaaacguaugauaaagauucagaagaaaauggaagagugaguugcuucguaaaagaaacgguuccuuuuaggauugaaucuucugccagcaauuacuauaagcuuguaacagaugggauccuggaccgggagcagacuccagaguacaacgucaccaucaucgccacugauaaaggcaagcccccucucucuuccagcacaagcguuacccugcauguuggggauaucaaugacaaugcuccaguuuuccaccagaccuccuauuugauccaaguggcugagaacaacccuccuggagcuuccauugcucaggucagcgccuucgacccggauuugggauccaaugguuucaucuccuacuccaucauagccagcgaccuagagccuaaaucacugugguccuacgugucggugaaccaggauaguggcgugguguucgcgcagcgcgccuucgaccacgaacagcugcgcuccuuccagcugacacugcaggcgcgcgaccagggaaagcccucgcucagcgccaacgugagcaugcgggugcuggugggugaccgcaacgacaacgcgccacgcgugcuguaucccacacucgagcccgacggcucugcgcucuucgacauggugccgcgugcugccgagcccggauaccuggucaccaaagugguggcgguggaugcagacucuggacacaaugccuggcuaucuuaccacgugcugcaggccagcgaucccgggcucuucagccugggacugcgcacaggcgaggugcgcacagcgcgugcccugggagacagggacucagcgcggcagcgccuucuggucgcugugcgugaugguggacaaccaccgcucucggcuacagccacgcugcaccucaucuucgcug

SEQ ID NO: 10880 - RNA, 2501 nt, Mus musculus
cagcgaagaugaggugcagcguggcuguagccgagagcggugguuguccaccaucacgcacagcgaccagaaggcgcugccgcgcugagucccugucucccagggcacgcgcugugcgcaccucgccugugcgcagucccaggcugaagagcccgggaucgcuggccugcagcacgugguaagauagccaggcauuguguccagagucugcauccaccgccaccacuuuggugaccagguauccgggcucggcagcacgcggcaccaugucgaagagcgcagagccgucgggcucgagugugggauacagcacgcguggcgcguugucguugcggucacccaccagcacccgcaugcucacguuggcgcugagcgagggcuuucccuggucgcgcgccugcagugucagcuggaaggagcgcagcuguucguggucgaaggcgcgcugcgcgaacaccacgccacuauccugguucaccgacacguaggaccacagugauuuaggcucuaggucgcuggcuaugauggaguaggagaugaaaccauuggaucccaaauccgggucgaaggcgcugaccugagcaauggaagcuccaggaggguuguucucagccacuuggaucaaauaggaggucugguggaaaacuggagcauugucauugauauccccaacaugcaggguaacgcuugugcuggaagagagagggggcuugccuuuaucaguggcgaugauggugacguuguacucuggagucugcucccgguccaggaucccaucuguuacaagcuuauaguaauugcuggcagaagauucaauccuaaaaggaaccguuucuuuuacgaagcaacucacucuuccauuuucuucugaaucuuuaucauacguuuugaacagagccaccacuguccccgguucugcaucuucgguuauagaauuggacacggaaguaaaaaccacuucuggggcauugucguucucaucgagaauuuccacuacaacuuuacauucugaggccaugccuccaccguccuuggccucuauguucaugguguaaguccucuugguuucaaagucaauagggccuuuggauuuaauuucuccacuuugaugaucuaggauaaacuuaucucuaauaucuucuccuagugauuugaaggaguaggugacuucugcguugacacccucauccuggucaguggcuaucacuguuagcacagacgugccugcggccauguccucucuaagacugacuuuguacguacuuuggcugaacacugggggguuaucauuggcaucagugaccucgaucugaaucugagcggugcccguuaggacugguucucccccaucuacugcgguuaggaccaagagcugggagcucuguuuuucccuguccagaggcuucuccaacacuaauucgggggcauccuuuccuucaguguuguccuuuaccaccagagagaagugcucauucaaacugaguugguaacucuggagagaguucagcccuacaucugcaucuauggcagauuccaggccaaaccuagugccuggaaucgcaaguucauugauuugcaaaacaaugcuauuuuggaggaaacggggaggguuaucauuuauaucuucuaucaccacgcugacgugaaaaacguuuaggggauuuucugccacaaucucuaagggcaggacgcacagagggcuuuggaagcagagaaacucucggucuauucugucgcucacaacuauguucccguucucuggguucacagaaagauacgguuucucugcaauaacucuaagguuucuugucaguaaguccugaacaggcagccccagguccucagcgagauuucccacgacugaacccauggccauuucuuccggaauagaguaccggacuugcucugagagccccgugcagaacaaaggcagcaagaagggaaagaguacuugccuccacgggguccugcucccuagcuucacgcugcugcgcuccauccuucucccgcaccagugugaagggaggaggcuucgcgaauuacuuccaaccaggaagaaaacccaaacgcuccacguuugaggauaucacagucucuaaucugauuuaccaagcagaaaauucaaguaccccuacucuuuaagccuccagugaauguacagaauuucaaccgguagagcauggagucagcucuugcagcgaauuggacagcagcggcgcccagaggccauuuauaaaauugcaaucagaacccuucgcagacucauuggguuuaagaauacagcuauguugagauauggggagcaaaggaauuucugaguuuagaauuugacuguuuuccaguguugcuaccgaacaaagcuccucagaggugggaucuguaacauaacuauuaacccagugacaacagauuaaaaagcucgucuuuucuaaggaaacgcacacauuggaugaaucaggaaaguauuuucucaagaucacgugggaaaauagccccaccac

SEQ ID NO: 10881 - RNA, 2501 nt, Mus musculus
ugucuuacaagcaaguuuucuucaaaucuuauuuuauggcuaucagagacugaaggguagcucaauuagaguuuauacuuaagcauggcugauagcuagaguccacuguccagcagucgucacuaaaaagugcuugcuuuuaaagacaguuucuagucacauuaaauauguacaggcagucgucuccuagaaucuuuucuacauuuugaugugcuucuaaauauauggccaguaguucuguuuucaaaauuacccaggagaaggaaaguuuacaguauuccucagauuacuaauuuucuuuuacuaagucuuucucaacaccaaauguccuuuuugcaauacaauacaucuguauaacuguauaguagaaucuccaguucaaguuaaugcagguuggaaucuuuccacuuacucuaaagguguccauaaucuucauugauugauuagagucacauaugaaucuaauaauaugcauuauaacaguucucauguuuguuuuccauaugauugugaauuuuuguuuuuucaguaauaaauuccaacuuguuacaauaguucuucccuuuagaaauuuucaagaaaucuauugaaauuuuugucuuacuggaaaauauaggaaaacaaacagcuacugaaaauaauucaaggaagugaauuuguggggggggggggguuacggacugcucacugaacugcccaguacuguugaguuuucuguuuccaucuccauuugaagaacaguagguggagcuauuuaagguucacagaccaaaaauccucucccggaguucacgacugugcaguaauugguucggacucugagcgccgcuguucaccacggggaaggaaaagcagggaagcccugcuugcuuugcaugcgccuaaaacacaaugcggacagauugagacaaaaccccucuaggagcaaacuggccuggaggaacucgucccaccuccuaacugucuugcuccaaggcuucaaaagcagauucugguucaggugaucacaggcagaauuggaaauaauccucaguuggugaugauccccaugcaacggcgggaggacugcaaagggcuggucuuccugggaguccuccucgggaugcuguggaaagcuggauccacccagauacgcuauucgguucccgaggagcuggagaaaggaucuagggugggcaacaucuccaaggaucuggggcuggagccccgcgagcuggagaagcgagggguccgcaucgucuccagagguagggcucaacuuuucgcucuaaacccucgaagcggcagccuggucaccgcgggcaggauagaccgggaggagcuguguaugggguccaucaagugucaguuaaaucuagagauucugauggaagauauagggaaaauauacggaguagaaauagaagugagggacauuaacgacaacgcucccuacuuccgugaaagugaauuagaaauaaaaaugagcgaaaacgccgccgcugggaugcgguucccucuuccccacgcuugggauccagauaucgggaagaacucgcuucagagcuaccagcucagcccgaaugcucacuucucacuggaggugcagaacggagcugaugguaacaaguacccagaauuggugcuggagagcucgcuggaucgggaggaaaaggccgcucaucuccuaguccucaccgcuuccgacgcgggagacccgguucgcacuggcacagcgcgcauccgcgugaugguuguggaugcgaacgacaacgcaccugcguuugcucgguccgaguaccgcgugagcgugcgggagaacguggcugugggcacucagcugcugcuggucaacgccaccgacccagacgaaggcgccaaugcggaagugaucuauuccuuccgguacguggacgacaaggcagcgaaaguuuucaagcuggacaguaacuuggggacaauaucaacaauaggggagcugaaucaugaagaaucgggguucuacgagauggaggugcaagcuacagauaacgcgggauauucugcacgggccaagguccuggucacaguucuggacgugaacgacaaugccccugaaguagccaucacgucccucaccaacucugucccagaaaacucuccccaagggacauuaauagcacuuuuaaacguaaaugaucaagauucuggggaaaauggacagguaaucuguuccauccaagagaaucugcccuuuaaguuagaaaagucuuacggaaacuauuauagauuagucacagaugcaguccuggaccgagaagagguuccuaguuacaacaucacaaugaccgccacugacaggggaaguccgccccugacaacagaaacucaccucgcacuggacauagcagacacgaacgauaacucgcccguuuuccuucaggccucauacugggccuacaucccagagaauaacccuagaggggccucuaucgcauccgugaccgcccacgaccccgacagugacaaaaaugcccaaguca

SEQ ID NO: 10882 - RNA, 2501 nt, Mus musculus
ugacuugggcauuuuugucacugucggggucgugggcggucacggaugcgauagaggccccucuaggguuauucucugggauguaggcccaguaugaggccugaaggaaaacgggcgaguuaucguucgugucugcuauguccagugcgaggugaguuucuguugucaggggcggacuuccccugucaguggcggucauugugauguuguaacuaggaaccucuucucgguccaggacugcaucugugacuaaucuauaauaguuuccguaagacuuuucuaacuuaaagggcagauucucuuggauggaacagauuaccuguccauuuuccccagaaucuugaucauuuacguuuaaaagugcuauuaaugucccuuggggagaguuuucugggacagaguuggugagggacgugauggcuacuucaggggcauugucguucacguccagaacugugaccaggaccuuggcccgugcagaauaucccgcguuaucuguagcuugcaccuccaucucguagaaccccgauucuucaugauucagcuccccuauuguugauauuguccccaaguuacuguccagcuugaaaacuuucgcugccuugucguccacguaccggaaggaauagaucacuuccgcauuggcgccuucgucugggucgguggcguugaccagcagcagcugagugcccacagccacguucucccgcacgcucacgcgguacucggaccgagcaaacgcaggugcguugucguucgcauccacaaccaucacgcggaugcgcgcugugccagugcgaaccgggucucccgcgucggaagcggugaggacuaggagaugagcggccuuuuccucccgauccagcgagcucuccagcaccaauucuggguacuuguuaccaucagcuccguucugcaccuccagugagaagugagcauucgggcugagcugguagcucugaagcgaguucuucccgauaucuggaucccaagcguggggaagagggaaccgcaucccagcggcggcguuuucgcucauuuuuauuucuaauucacuuucacggaaguagggagcguugucguuaaugucccucacuucuauuucuacuccguauauuuucccuauaucuuccaucagaaucucuagauuuaacugacacuugauggaccccauacacagcuccucccggucuauccugcccgcggugaccaggcugccgcuucgaggguuuagagcgaaaaguugagcccuaccucuggagacgaugcggaccccucgcuucuccagcucgcggggcuccagccccagauccuuggagauguugcccacccuagauccuuucuccagcuccucgggaaccgaauagcguaucuggguggauccagcuuuccacagcaucccgaggaggacucccaggaagaccagcccuuugcaguccucccgccguugcauggggaucaucaccaacugaggauuauuuccaauucugccugugaucaccugaaccagaaucugcuuuugaagccuuggagcaagacaguuaggaggugggacgaguuccuccaggccaguuugcuccuagagggguuuugucucaaucuguccgcauuguguuuuaggcgcaugcaaagcaagcagggcuucccugcuuuuccuuccccguggugaacagcggcgcucagaguccgaaccaauuacugcacagucgugaacuccgggagaggauuuuuggucugugaaccuuaaauagcuccaccuacuguucuucaaauggagauggaaacagaaaacucaacaguacugggcaguucagugagcaguccguaacccccccccccccacaaauucacuuccuugaauuauuuucaguagcuguuuguuuuccuauauuuuccaguaagacaaaaauuucaauagauuucuugaaaauuucuaaagggaagaacuauuguaacaaguuggaauuuauuacugaaaaaacaaaaauucacaaucauauggaaaacaaacaugagaacuguuauaaugcauauuauuagauucauaugugacucuaaucaaucaaugaagauuauggacaccuuuagaguaaguggaaagauuccaaccugcauuaacuugaacuggagauucuacuauacaguuauacagauguauuguauugcaaaaaggacauuugguguugagaaagacuuaguaaaagaaaauuaguaaucugaggaauacuguaaacuuuccuucuccuggguaauuuugaaaacagaacuacuggccauauauuuagaagcacaucaaaauguagaaaagauucuaggagacgacugccuguacauauuuaaugugacuagaaacugucuuuaaaagcaagcacuuuuuagugacgacugcuggacaguggacucuagcuaucagccaugcuuaaguauaaacucuaauugagcuacccuucagucucugauagccauaaaauaagauuugaagaaaacuugcuuguaagaca

SEQ ID NO: 10883 - RNA, 2501 nt, Mus musculus
aaacaucuugugcucccucuacugguggccagcugcagaaucaaagaauuccaagaccagaauagcuauuuuauuuuaggacugacggaaaacaaaacucuugcuuguggucuuauaccaaaacaacccaguuaaucacggccugaaagaaauguggaauguacucuuuaccaaugggggugggggaggacaccgugacgaauacaccccuagaccauuagaaaauaauaagugcuuccuuuauucccacacccuccccaccguguuguugguuguugaacuucuguuuuauauaaaguuauuggaagaaguuggcguuaaugccuaagagguaucuugggaaagaaccugagaccuagucaccagaauaaggguuuucuuuucccuccccggguaugcgacuuucacugaagcagcacgcauaaaaacauuccaaauuaacucucucuccaagucagcaugcccaggaggucaugucccacuucccagcccuugucccacuuccuaccccuugucugcgcugaauagcagucaaaacuaggaucaaaaccuaagaccgggcuguggaaauccauaccuggccaggcaguuuucuuccgcagcgcaucucagguuguacauagacaucuucuggacguacguggaagccuggauguaguaggggucgggcaccagguccgggagaccuaaagauaagacaagcugaugaccucugacuccuaaaccuguuugucaccuuucgcccaccaagucugcaggguggggcugaguguguggaagaacagggaaagucgggguuaggaaggaaagggaaaaggaaacugcuggugccaggagcgcgguuuccaucagauuccagagcuggcgggacaggcugggguuggggguuggggagggggggcguuguugagucugcgggaccggaucccgccgccgcgcccaggccgccacgucuagacagcacugaccggcggccaggguggccgguaccuacgguggaucuaggggugcuuaccguacuggaaguaaccggugccguauccaggucgguuccugcucccgggccggggccucucauacgugucauaguaguuauaauagggguugucgucggaguacuuguagggauuguaggggucgucgcccaccaugcgaucuauguggcuggguggccucagauuacugagcugcggaggcuguggcgaugcaguccgguucgccgcgcgccgugaggcuccaucgcgagcccccgacggcgagaaaccagcuuggaaccaguggcgggcggcgggccggggacgacccgcggcgaccccagacgggcuuggcguccucgcacggguagaggcggugcgguugucacgcagcagaagaaugggcgugcgcggcugcgaggcugcgucgccgucgggucuccgggcaguggcacuggggucgcggcgucgcugaggcugguacugcgccccgaggcucagcagacugaacaccugcccguuguucucccauuggauugucuggcgccaggcaccaggggcggcgggcggcucgcgcggggucugcggggcgcagcggagaaggggacaaagcugcaguggccccagaaggagcacagcccaggcgaaacgcauggugcucccggcucgucccuucucggggaggacguggcuaggagaaaaaggaagaccgggacucagaucccacgaaggagggagaccucuccgagcagggaggagaagggcgaggcgcggggaugggucgcagggagucgugccagggcgaacagcagacccugcccccagcccaggcugccgucggacguggcacgguccuccucuccccuuucccagcccuggaaggcgacggggagcugcgcacgaaggucugggaaagcgcacagagucuggaguagaaggaggaggagagauuuuaaacuuucugaccaguuugcaguuacacaagccguucuggccccgcugccccuccgcuauuuguucacguaaugugauuggaaacgugcaaggcggacagcuccuccacgcugccccucccuccccuccccgccccccuccccuccuccccagacacguugcacagggagaguuaaggggaaagaacaaaacggaacacacauccugagacacacucgacuuaaucugggccgaacaugcaggaauuucaaaagacucagacagacgaaggcagccaggccaugggcccaagccaaaauaugcaugaagaaaaaugcuauuaggucaccaacccuggagaggcgggaagcaggagguggggagaguggugggggccaaacugugugcucugggaugggggagguugugacuaaggcuuaugcuuaaaggaguuaagcagacaaauuucccaauacacacucaccccacuuuuaugggaagcgcccucagcgaauaaaccccaggauaucaaauuuuguuuuucuggcuguagguaauaugagaaauggguuacaaaucuguuuccuacaguga

SEQ ID NO: 10884 - RNA, 2501 nt, Mus musculus
ucacuguaggaaacagauuuguaacccauuucucauauuaccuacagccagaaaaacaaaauuugauauccugggguuuauucgcugagggcgcuucccauaaaaguggggugaguguguauugggaaauuugucugcuuaacuccuuuaagcauaagccuuagucacaaccucccccaucccagagcacacaguuuggcccccaccacucuccccaccuccugcuucccgccucuccaggguuggugaccuaauagcauuuuucuucaugcauauuuuggcuugggcccauggccuggcugccuucgucugucugagucuuuugaaauuccugcauguucggcccagauuaagucgagugugucucaggauguguguuccguuuuguucuuuccccuuaacucucccugugcaacgugucuggggaggaggggaggggggcggggaggggagggaggggcagcguggaggagcuguccgccuugcacguuuccaaucacauuacgugaacaaauagcggaggggcagcggggccagaacggcuuguguaacugcaaacuggucagaaaguuuaaaaucucuccuccuccuucuacuccagacucugugcgcuuucccagaccuucgugcgcagcuccccgucgccuuccagggcugggaaaggggagaggaggaccgugccacguccgacggcagccugggcugggggcagggucugcuguucgcccuggcacgacucccugcgacccauccccgcgccucgcccuucuccucccugcucggagaggucucccuccuucgugggaucugagucccggucuuccuuuuucuccuagccacguccuccccgagaagggacgagccgggagcaccaugcguuucgccugggcugugcuccuucuggggccacugcagcuuuguccccuucuccgcugcgccccgcagaccccgcgcgagccgcccgccgccccuggugccuggcgccagacaauccaaugggagaacaacgggcagguguucagucugcugagccucggggcgcaguaccagccucagcgacgccgcgaccccagugccacugcccggagacccgacggcgacgcagccucgcagccgcgcacgcccauucuucugcugcgugacaaccgcaccgccucuacccgugcgaggacgccaagcccgucuggggucgccgcgggucguccccggcccgccgcccgccacugguuccaagcugguuucucgccgucgggggcucgcgauggagccucacggcgcgcggcgaaccggacugcaucgccacagccuccgcagcucaguaaucugaggccacccagccacauagaucgcauggugggcgacgaccccuacaaucccuacaaguacuccgacgacaaccccuauuauaacuacuaugacacguaugagaggccccggcccgggagcaggaaccgaccuggauacggcaccgguuacuuccaguacgguaagcaccccuagauccaccguagguaccggccacccuggccgccggucagugcugucuagacguggcggccugggcgcggcggcgggauccggucccgcagacucaacaacgcccccccuccccaacccccaaccccagccugucccgccagcucuggaaucugauggaaaccgcgcuccuggcaccagcaguuuccuuuucccuuuccuuccuaaccccgacuuucccuguucuuccacacacucagccccacccugcagacuuggugggcgaaaggugacaaacagguuuaggagucagaggucaucagcuugucuuaucuuuaggucucccggaccuggugcccgaccccuacuacauccaggcuuccacguacguccagaagaugucuauguacaaccugagaugcgcugcggaagaaaacugccuggccagguauggauuuccacagcccggucuuagguuuugauccuaguuuugacugcuauucagcgcagacaagggguaggaagugggacaagggcugggaagugggacaugaccuccugggcaugcugacuuggagagagaguuaauuuggaauguuuuuaugcgugcugcuucagugaaagucgcauacccggggagggaaaagaaaacccuuauucuggugacuaggucucagguucuuucccaagauaccucuuaggcauuaacgccaacuucuuccaauaacuuuauauaaaacagaaguucaacaaccaacaacacgguggggagggugugggaauaaaggaagcacuuauuauuuucuaauggucuagggguguauucgucacgguguccucccccacccccauugguaaagaguacauuccacauuucuuucaggccgugauuaacuggguuguuuugguauaagaccacaagcaagaguuuuguuuuccgucaguccuaaaauaaaauagcuauucuggucuuggaauucuuugauucugcagcuggccaccaguagagggagcacaagauguuu

SEQ ID NO: 10885 - RNA, 2501 nt, Mus musculus
aacaaaaacaaaaacaaaacaacugauguugucccucaaaucccugccugcaacacuccauuugaguaaauaaguggagugagagagaaagggcccauugucacagcagaaagguccaagacacaggauauuucaaguccaaggguacaggaagaaaacucucuccuuuagauauggauuuccagcagcaauauauaucauucuuaauacuugaccagugagguagauacaugaaaacaucauccagacagacagacagacagacucaguccuccagaaccaacacucuucagacagaaaccuuuaaguuccauacaaagaggaacugaacuauacaagaaaacaauaagcacucaaauacaguuucucucucuuguuugcagcuuaaaaaauaaaauaaaauuuaaaaaaaggcagaaggaugugccuccccuucugcaaaucucuauacaauuuuauucuaaaguuauuacacucaaguuaaauagucugguuaguguccugucaaggaggggucuuagagaguagaaagccuguauuacaguggcgagucauuuguacuacaguuccuuccuugggagucaacgcuaaggcuaggcacaguaccuugacaguucacaaagccuuccaugccugggggauccucacacagcaguuccuguucucucuccugccccagcugacaaguguuuggcuccccuguguaguccguucugccguugcuauugcuagaguagccguucccauagguuuucgaagaagaccugcgaaggcacagaagcucuugaaaggcaauccugaaaucuggacuccgacaguagauaagaggauugaaggcagaguugacguagcccaaccaguuaaggaggauguaaacuuccuuagggaugagguugucccugauaacgugcacgauauugacaaugaagaagggcagccagcagagggugaaugugcccaugaugaugccuaaagucuugagggcuuugugcucuuucaagcagaacuuggaggaccuucggaguccguggccgcuccgcccauccugcuccaccuggcugagguuuugggcguggaaucuuccuucagauuugucuaucuucugcagcugccuuuuggccaccuggaagacccgggaauagacaaagaccaucaccaccaggggcacguagaaagacacaaucgaggacgcgauggcguaggccugguucgugaagaagucacagcaagucuccucgguguaacaaucgauagcuuucuuguggguggcacgguaccagugcaucuggauaggcaaaaaggagguaaggccagauacaauccauaccaucaggaugaccacucgggccuuauucuuggucagcaggcucugguacuugaagggcgaugugauagcaacauagcgauccacugcaaucacgcacagggucucgaugcuggcugugacgcacaacacaucaauggaaguccagaacucgcaccagaaguugccaaaauuccacauuuucauaaggaugugacuggccccaaacggcaccaccgcuaggcccaugacuagaucagcacacgccaaggagauuaugaaguaguuggugacgguuuguagucgcucgaacuuggcaauggcugugaugaccagcacguugccaaacacgauggccaggacgauaaccgacaugaggauggccaugcccacaacccacgcuucgucccguuccugagugacgucguggucuggcgcucggcuuccguugggugccagcaagaagucgcugucguucccguguggccccauggcuggcagguuagcaggugagcgcaccggcuuucggugcccaggcgcucucagcgggugcaccuccgacggggcgcagccggccgggggcggacuccuggaagcuucauucagcggccguagguggcugugcuggggugcguccugcacacucagcucgugggugcuccgggcucgcggugccugcagccgcagccugaaugccugagaagcagccuugcagugcgcccugcccguuaugugcaccagacuuuaggggaauugcccagugacgugcaacaacuuugggccaauggcacggccggaugcccggaggggcgaggcaccaagggccaacccucccagccuagcccgccuccuccugggguuagcccgggcggggcccagcggcuccccggaggccaggccaccgcucccuuccagcuacccuagcuggggcaccagagagagaaaucuagggcugcugugcaacccgccaaccaggcgcugucuggaggugcuaccuguccguucaggucaccugugcgggcugagaggucucuggacgccaguagcgcagggugcguuuucuuuuaggaacagaaagagcaagcucacccggacacgcacacacaggcacaaacgcacccugacgaccaggacaugcucagacuuaugccgaaccacagccacagccacggagacacacccgcgcccgcucauucug

SEQ ID NO: 10886 - RNA, 2501 nt, Mus musculus
cagaaugagcgggcgcgggugugucuccguggcuguggcugugguucggcauaagucugagcauguccuggucgucagggugcguuugugccugugugugcguguccgggugagcuugcucuuucuguuccuaaaagaaaacgcacccugcgcuacuggcguccagagaccucucagcccgcacaggugaccugaacggacagguagcaccuccagacagcgccugguuggcggguugcacagcagcccuagauuucucucucuggugccccagcuaggguagcuggaagggagcgguggccuggccuccggggagccgcugggccccgcccgggcuaaccccaggaggaggcgggcuaggcugggaggguuggcccuuggugccucgccccuccgggcauccggccgugccauuggcccaaaguuguugcacgucacugggcaauuccccuaaagucuggugcacauaacgggcagggcgcacugcaaggcugcuucucaggcauucaggcugcggcugcaggcaccgcgagcccggagcacccacgagcugagugugcaggacgcaccccagcacagccaccuacggccgcugaaugaagcuuccaggaguccgcccccggccggcugcgccccgucggaggugcacccgcugagagcgccugggcaccgaaagccggugcgcucaccugcuaaccugccagccauggggccacacgggaacgacagcgacuucuugcuggcacccaacggaagccgagcgccagaccacgacgucacucaggaacgggacgaagcguggguugugggcauggccauccucaugucgguuaucguccuggccaucguguuuggcaacgugcuggucaucacagccauugccaaguucgagcgacuacaaaccgucaccaacuacuucauaaucuccuuggcgugugcugaucuagucaugggccuagcgguggugccguuuggggccagucacauccuuaugaaaauguggaauuuuggcaacuucuggugcgaguucuggacuuccauugauguguugugcgucacagccagcaucgagacccugugcgugauugcaguggaucgcuauguugcuaucacaucgcccuucaaguaccagagccugcugaccaagaauaaggcccgaguggucauccugaugguauggauuguaucuggccuuaccuccuuuuugccuauccagaugcacugguaccgugccacccacaagaaagcuaucgauuguuacaccgaggagacuugcugugacuucuucacgaaccaggccuacgccaucgcguccucgauugugucuuucuacgugccccugguggugauggucuuugucuauucccgggucuuccagguggccaaaaggcagcugcagaagauagacaaaucugaaggaagauuccacgcccaaaaccucagccagguggagcaggaugggcggagcggccacggacuccgaagguccuccaaguucugcuugaaagagcacaaagcccucaagacuuuaggcaucaucaugggcacauucacccucugcuggcugcccuucuucauugucaauaucgugcacguuaucagggacaaccucaucccuaaggaaguuuacauccuccuuaacugguugggcuacgucaacucugccuucaauccucuuaucuacugucggaguccagauuucaggauugccuuucaagagcuucugugccuucgcaggucuucuucgaaaaccuaugggaacggcuacucuagcaauagcaacggcagaacggacuacacaggggagccaaacacuugucagcuggggcaggagagagaacaggaacugcugugugaggaucccccaggcauggaaggcuuugugaacugucaagguacugugccuagccuuagcguugacucccaaggaaggaacuguaguacaaaugacucgccacuguaauacaggcuuucuacucucuaagaccccuccuugacaggacacuaaccagacuauuuaacuugaguguaauaacuuuagaauaaaauuguauagagauuugcagaaggggaggcacauccuucugccuuuuuuuaaauuuuauuuuauuuuuuaagcugcaaacaagagagagaaacuguauuugagugcuuauuguuuucuuguauaguucaguuccucuuuguauggaacuuaaagguuucugucugaagaguguugguucuggaggacugagucugucugucugucugucuggaugauguuuucauguaucuaccucacuggucaaguauuaagaaugauauauauugcugcuggaaauccauaucuaaaggagagaguuuucuuccuguacccuuggacuugaaauauccugugucuuggaccuuucugcugugacaaugggcccuuucucucucacuccacuuauuuacucaaauggaguguugcaggcagggauuugagggacaacaucaguuguuuuguuuuuguuuuuguu

SEQ ID NO: 10887 - RNA, 2501 nt, Mus musculus
uaauuccagaccuuguagcuugcgaagaaagucauccaauuuuguagcgagcuguggugaaugcucgccaacucgguguagggcagcugcuguucacgaaaaccuucucuaaaucuugugcuuuccuucugugucucagaaacugccuaaccuacaaguccaguuauuaauggguggcagcauuaugcuuccuccacucccucgacgcgacucucuacuuaccuacccacagggaagcccuggcaccucugagaacccgaagugcugcgguuacgcguguccccagcaacuuccuccugucccccgggaacucgcuggccagccgcccagcccugggucgggcuuuggagacuccagcaugcagacagccuguuaggacacuccgcucgccccacgcacaccugcuucucuacugccaagccauaucgcugacauugaugaugucaccagucaccccagucuccagaagagaaaaacaaacugacaagagccaccaacaucaccaaauccugggguuuugggcccucgguaccguuugcgcacgaaggggcguggccccgggacccaggccagggagccagaacuauucgcugcucgcaggagcgcagccugucgccaaggucgggucaagucgucgcggggcguggcugauagggcagugauuuaagagacgcggcuuugggacaggaggacccgcaccaauggagaccgccagggacuacgcgggagcccucaucaggcgagugccgaccacguaccccugcgcccgggucacccuucuuucagaauacucugcucgucuccauuucuccucugcuccccaguuccuccugagccccaagucaccaacuccccgcgcguucccgugaaucccucucccucucacaccccaucaccuaccccgggucucugcucccugggccauagucccccgugccgggccuguuccuacccacgagcccagcagccagagguuccucccgaaaaaggccacaggugcccaguggagugcucccgaggugcgugggaguccgcaaacaagugacauuugugaacgcggggcggggggugggggguggcgggaagggugcccucauucuguugcugcuccuacaggagaugagguacugggaauucuggagugucugugcuggacagggcuucucggggguuuuuugaaucaaauuggagggcgaggaaggaguccaggcuuagguccuccgggugagugcagacucugccuaucugggcuggauucacucagguuuuggaggggcaguuuuggcucccagaccacuccccuucaguuucucucuauaugcuguuagaacauucugguucucgguaauauacuagacaguaugagggugugugucugugucuauguaagaaagagacagagacauagagagaugcuaaggcaagagacuuggagacacagauuuggagacagacacagagacagagaaugagaggcagacaaugagaaugagagacaggaagacaaagaauaagauacagagagaaggauuuggaaacagagagagaaagacucacagacauacagggccucccuauaaggcccagcuuagcuuagaaauggcuauauaguccagacuggucucaaacucacagaacucuugccucugauucuguacucuagaugacuggcuuucagagucaaggccagccagcugcagggcagcgacuuuacaaagcagguuaaacagugagaucuugauucuuuacagauggcaaaaauacuacaaaaggauguagaaacccgaguacacucacagaccucacugcguaucuuuuacagagagggaggaacagggucaccaaacuuggaugcucugacaucuuaugagacagggacauaagggaaacugugugucagaucacaggguuagaaaaguagccaccaaaaugaaaaaagagggggguggggagggaagcuggucuuccuggaugguuccugcuuuucucuugaaacaaagacuuaacucugggaguugggggauuuguaaaggcucccaaauaacaagguauccuaccucucagcagcaggagauguguggguggcgaggaccaugggcagccucacugcaggagagaagaagcccuuugccagguuucucaguuccuccugcagccuucccuuuagcuccuccaguuuccucuauucccaucugugcuuguccugggaagccuuauuuuccaucuaucuuguccugaugcucagacugguugagggaacaggggcugcuuuuugcucucuuuacagcucaacacaccaucugcccucaccaacacuugaaagcucaaggacaagagcugugguucugggguccuuuuuucauucuucaagggcugagguuuacagauguucauucucuaggcaguaucauuuugccuuggagaagggaggcaugggaacauccuugcgucugaucauaacgucaucaucauuguuuauugaaauccagcauguaccuggg

SEQ ID NO: 10888 - RNA, 2501 nt, Mus musculus
cccagguacaugcuggauuucaauaaacaaugaugaugacguuaugaucagacgcaaggauguucccaugccucccuucuccaaggcaaaaugauacugccuagagaaugaacaucuguaaaccucagcccuugaagaaugaaaaaaggaccccagaaccacagcucuuguccuugagcuuucaaguguuggugagggcagaugguguguugagcuguaaagagagcaaaaagcagccccuguucccucaaccagucugagcaucaggacaagauagauggaaaauaaggcuucccaggacaagcacagaugggaauagaggaaacuggaggagcuaaagggaaggcugcaggaggaacugagaaaccuggcaaagggcuucuucucuccugcagugaggcugcccaugguccucgccacccacacaucuccugcugcugagagguaggauaccuuguuauuugggagccuuuacaaaucccccaacucccagaguuaagucuuuguuucaagagaaaagcaggaaccauccaggaagaccagcuucccuccccaccccccucuuuuuucauuuugguggcuacuuuucuaacccugugaucugacacacaguuucccuuaugucccugucucauaagaugucagagcauccaaguuuggugacccuguuccucccucucuguaaaagauacgcagugaggucugugaguguacucggguuucuacauccuuuuguaguauuuuugccaucuguaaagaaucaagaucucacuguuuaaccugcuuuguaaagucgcugcccugcagcuggcuggccuugacucugaaagccagucaucuagaguacagaaucagaggcaagaguucugugaguuugagaccagucuggacuauauagccauuucuaagcuaagcugggccuuauagggaggcccuguaugucugugagucuuucucucucuguuuccaaauccuucucucuguaucuuauucuuugucuuccugucucucauucucauugucugccucucauucucugucucugugucugucuccaaaucugugucuccaagucucuugccuuagcaucucucuaugucucugucucuuucuuacauagacacagacacacacccucauacugucuaguauauuaccgagaaccagaauguucuaacagcauauagagagaaacugaaggggaguggucugggagccaaaacugccccuccaaaaccugagugaauccagcccagauaggcagagucugcacucacccggaggaccuaagccuggacuccuuccucgcccuccaauuugauucaaaaaacccccgagaagcccuguccagcacagacacuccagaauucccaguaccucaucuccuguaggagcagcaacagaaugagggcacccuucccgccaccccccaccccccgccccgcguucacaaaugucacuuguuugcggacucccacgcaccucgggagcacuccacugggcaccuguggccuuuuucgggaggaaccucuggcugcugggcucguggguaggaacaggcccggcacgggggacuauggcccagggagcagagacccgggguaggugauggggugugagagggagagggauucacgggaacgcgcggggaguuggugacuuggggcucaggaggaacuggggagcagaggagaaauggagacgagcagaguauucugaaagaagggugacccgggcgcagggguacguggucggcacucgccugaugagggcucccgcguagucccuggcggucuccauuggugcggguccuccugucccaaagccgcgucucuuaaaucacugcccuaucagccacgccccgcgacgacuugacccgaccuuggcgacaggcugcgcuccugcgagcagcgaauaguucuggcucccuggccugggucccggggccacgccccuucgugcgcaaacgguaccgagggcccaaaaccccaggauuuggugauguugguggcucuugucaguuuguuuuucucuucuggagacuggggugacuggugacaucaucaaugucagcgauauggcuuggcaguagagaagcaggugugcguggggcgagcggaguguccuaacaggcugucugcaugcuggagucuccaaagcccgacccagggcugggcggcuggccagcgaguucccgggggacaggaggaaguugcuggggacacgcguaaccgcagcacuucggguucucagaggugccagggcuucccuguggguagguaaguagagagucgcgucgagggaguggaggaagcauaaugcugccacccauuaauaacuggacuuguagguuaggcaguuucugagacacagaaggaaagcacaagauuuagagaagguuuucgugaacagcagcugcccuacaccgaguuggcgagcauucaccacagcucgcuacaaaauuggaugacuuucuucgcaagcuacaaggucuggaauua

SEQ ID NO: 10889 - RNA, 2501 nt, Mus musculus
uguucccuacggucccucacugcccccauuucuuccucuccaaaccuggagaugucaccccgggaaguggggagggauccgaggcugaggucagacuugguggggauggggaugagcacagagccgcagccuaaagguuggaggggguccggugggguccugggaaggggcaaguauaguggcuagacagagggcggcagucuaggaacgagggaaguggugaggcccugcggagaagugagaggcuuggucuuagggaagaaaaguggaaaagaaaguguaaagguggccagggaggguagguuucagaagccgggagcagaucuccgcgcugcgacuccuacgcggugccccaggcugguuuccccucccgccgccccucccccucccgccccuggagcugcggagcggcgaccggagcucagggcuggcaauggcgcgggcggcgggcgagcggggccgggcugcacggugcgggcgcuggcggcggggcgcgcuccucgccuucgccgcguggaccgccggcugggugcuggcagcugcgcugcugcuccgcgcacacccgagcguccucuccgagcgcugcacggaugagaagagccggcgcauccuggcugcgcugguaggucccgccgccgcauugcccagugucgcgcguccaggucggguuccagacaccuucuccggguccucggaguccacgucaccugcgaugcugcaacaucguagcggccacuccauccugggauaugggaaugggguggggguacccgccaaagggagauuagguuccuaugcgcguaugauauacccaggcaaagagcucucaguucgcuaugggcgaucgggacaucccuccuuuuucuccagaauauagucuugcgucccgggacagcauucaugccagaaaguuugcagggccauuccuggucagugaugcuuacauccaguucuaguggccagguuuggaggauauacaucuuucuuacgcuaucucgccccuuaagccaccauccuucggugaucccaugggacugccggaacaccccaaccugaucaaaccccauuguuugauuguugcuugggcuccuccuccugaugaccuaaagacaaggccuuuggcuguucggguccagaggaaccgaggcagacaccuccuaaggagcacaaggagccauggagccagccuggucgacccuguuccauggucuaccgugguccgcuaaagagagaaaaucagaggauuguguccgagcugcuccuuaaccuggccgggcuguuguagauacaaagaaacaucacuaucaggggacugcugaauggucggaguggccuuuccucuaagaaguaaaaugcucuuuuuuuauuuuuuauuuuuuuuauuuuuuuauuuuuuauuuuuuuggauucugcuuagaaauucgugcuuaggagagacuugaguacaggcaggcauggccgaccucuaaaaagucggagaaaguagccuguauuugcuccccacugugauuauucgaguccuaaaaucuugagcauuugguuugaaaccuccaagaaacucuugggggggagggguuucaguucacuugcuuuaaaagguuuuucuuuucuuuucuuuucuuuucuuuucuuuucuuuucuuuucuuuucuuuucuuuuuguuuucagauugugggaauuuagaaauggauuuaguauuaagcauugaguauuuuaaaaguauuugucuuccccuccugcuucuucaucaccucuaccaccaccuucuccuuccuuuuuccuccuacuccuucccuccuucuucccucucuccguuccucccucucucccccugccccccucccucccucuuucaaaaagauugggaaacauuaagccaccaaagcauguuuucuaacuaaauguugcuaccgucaccguguuaacuugcuuccuccacagagugacacacacguucugucuucugcucacugcuuaacugaaguuucaucaaauuuuaaaucgcaggguuuaaacucuaacagcacuugcucuucuugcagauggggacauuacuuuccccaguagccaucuaaaaauccccaaaauaaaauucccuuuuauuuuggugaaggucgcugacuaagacaacaacauuuaguaguuuggcuaagacccaggucccacuuacaaacuuaauauaaucuuguagauuaaaauaggaaacagagcccauuauuuauuuauuuaccuuuggucaugcugagagaagccuaauggaaauuaaauugccugauaggauuuaaguaauugguagucauaacuuucccugcauuccaggcuguaaauuaaaaccaauucuguuuagaagcuuuaccaauacaucuucgaugcagccauaugggaucguuuuuaguuugacagagagcugaaaagauugauucugucuuuuacagcucucaauccuaacucuugccaaauucccaaagccuguuucccaaaguuuguguuuguugggagug

SEQ ID NO: 10890 - RNA, 2501 nt, Mus musculus
cacucccaacaaacacaaacuuugggaaacaggcuuugggaauuuggcaagaguuaggauugagagcuguaaaagacagaaucaaucuuuucagcucucugucaaacuaaaaacgaucccauauggcugcaucgaagauguauugguaaagcuucuaaacagaauugguuuuaauuuacagccuggaaugcagggaaaguuaugacuaccaauuacuuaaauccuaucaggcaauuuaauuuccauuaggcuucucucagcaugaccaaagguaaauaaauaaauaaugggcucuguuuccuauuuuaaucuacaagauuauauuaaguuuguaagugggaccugggucuuagccaaacuacuaaauguuguugucuuagucagcgaccuucaccaaaauaaaagggaauuuuauuuuggggauuuuuagauggcuacuggggaaaguaauguccccaucugcaagaagagcaagugcuguuagaguuuaaacccugcgauuuaaaauuugaugaaacuucaguuaagcagugagcagaagacagaacgugugugucacucuguggaggaagcaaguuaacacggugacgguagcaacauuuaguuagaaaacaugcuuugguggcuuaauguuucccaaucuuuuugaaagagggagggaggggggcagggggagagagggaggaacggagagagggaagaaggagggaaggaguaggaggaaaaaggaaggagaagguggugguagaggugaugaagaagcaggaggggaagacaaauacuuuuaaaauacucaaugcuuaauacuaaauccauuucuaaauucccacaaucugaaaacaaaaagaaaagaaaagaaaagaaaagaaaagaaaagaaaagaaaagaaaagaaaagaaaaaccuuuuaaagcaagugaacugaaaccccucccccccaagaguuucuuggagguuucaaaccaaaugcucaagauuuuaggacucgaauaaucacaguggggagcaaauacaggcuacuuucuccgacuuuuuagaggucggccaugccugccuguacucaagucucuccuaagcacgaauuucuaagcagaauccaaaaaaauaaaaaauaaaaaaauaaaaaaaauaaaaaauaaaaaaagagcauuuuacuucuuagaggaaaggccacuccgaccauucagcaguccccugauagugauguuucuuuguaucuacaacagcccggccagguuaaggagcagcucggacacaauccucugauuuucucucuuuagcggaccacgguagaccauggaacagggucgaccaggcuggcuccauggcuccuugugcuccuuaggaggugucugccucgguuccucuggacccgaacagccaaaggccuugucuuuaggucaucaggaggaggagcccaagcaacaaucaaacaaugggguuugaucagguugggguguuccggcagucccaugggaucaccgaaggaugguggcuuaaggggcgagauagcguaagaaagauguauauccuccaaaccuggccacuagaacuggauguaagcaucacugaccaggaauggcccugcaaacuuucuggcaugaaugcugucccgggacgcaagacuauauucuggagaaaaaggagggaugucccgaucgcccauagcgaacugagagcucuuugccuggguauaucauacgcgcauaggaaccuaaucucccuuuggcggguacccccaccccauucccauaucccaggauggaguggccgcuacgauguugcagcaucgcaggugacguggacuccgaggacccggagaaggugucuggaacccgaccuggacgcgcgacacugggcaaugcggcggcgggaccuaccagcgcagccaggaugcgccggcucuucucauccgugcagcgcucggagaggacgcucgggugugcgcggagcagcagcgcagcugccagcacccagccggcgguccacgcggcgaaggcgaggagcgcgccccgccgccagcgcccgcaccgugcagcccggccccgcucgcccgccgcccgcgccauugccagcccugagcuccggucgccgcuccgcagcuccaggggcgggagggggaggggcggcgggaggggaaaccagccuggggcaccgcguaggagucgcagcgcggagaucugcucccggcuucugaaaccuacccucccuggccaccuuuacacuuucuuuuccacuuuucuucccuaagaccaagccucucacuucuccgcagggccucaccacuucccucguuccuagacugccgcccucugucuagccacuauacuugccccuucccaggaccccaccggacccccuccaaccuuuaggcugcggcucugugcucauccccauccccaccaagucugaccucagccucggaucccuccccacuucccggggugacaucuccagguuuggagaggaagaaaugggggcagugagggaccguagggaaca

SEQ ID NO: 10891 - RNA, 2501 nt, Mus musculus
aacuuuccauagacuuuauuguguaaguaggcuauauauccaggauuuguaguauagaauccuagauaucauaaauggaagaaggggauaaacccugggaacucuucuauggagaagaaucucuaguuauuggccccaauuuucuugacugagaaaagaaacaaauuucacugagauggaaagagggucuuaauucuuccauuaguuuauacuuuuggaagauucagauaaaacuucaguuuaauaggaaugaagauauagguaaguaauaagaaccaugucagagcagcgggagucaaaggcaaaguaaagaaaucuccaguccauaccuagccuuucuuggcugucagaugugggguucacagauaacaucucugugaagagcaaauggcuccuuggauaacugcuguuuuucacugggccauccccugucuuuagggggaaacaugaggcaugaucuucuuucuauucaagaaaagcccuucaaacauugucucucccuuccuugagcagguggagagcugaggugggggguggaagcuaaggauguuaacuuuguuuuccuaacuaguuuuucauuucuuguuuguuaagcuuccuugauuuaguaaucugcuuaaguuugagagggaaucacuauguccuuuggcccugucugccuucagugagaaugccaacagagacaacauaagaggcaguuagcuggcuccaucacuugccuccagcaaagguucacgauuucagaauuuuaggauaaucucccuaagauuccccuuuucuaugcauaaauuuaccaccucuauccuccucuucuuuccuuuccuuucuacaaguugcagaguucacucauccaguagaaaaauccaggaacuuuccaccuccaagcuaggauucuagaaagucucaggguaggaaauugugaacucaggaaggcagaaacaauaggcaaacccucuccuacauguacauugaguugaauuucccuuuccucuuguggccaggugaaccuggacugucaguuguggacuuggagaugccuccugcaaguuaauccgcucucauucauaucuaucagaucuggacagcuccuccccaggugucugcccauucuuuccuguucauuccaucuauaucccaggucuuuucaggacagucccuuuaaaauaccgauugaaucaccaaagaaguuuugucuuuccucucaccuccuggcguaggucuauucuguuaucucccaaguuagaccaaauaucucucaagaagaaaguaagauuccauaaacuuugccugcacagacuuuucugcaaccgugggcgagagaguacaccaaugcacacuugccuacacacugggacaaauacacauguccaggaaaacagcggcugaggcagccaaacugugggcaacuauuaagggcauguuaaagucccugcuguagccaaaggggaugcgcugcgcugaugaggcaucaaaggagaauuucgaaucgggcuuggagaaagaagaccuaaaaauggugaaucuaaacacacagagaaagacaccuuuuacaccugcugucagcacucggcaguucuccccagagucacacacuuuugagagaaaucguuguagguuacaccaaauguaauaaaucucuaugacucauauaucuuuggaacugacaaucccuguguucuacuggacuucuagcuguggucaccaugagcccagcgcacuugagaauagggaccuaggcgcuccagagcccucaccucggugugcagaguaccucaggcaggugccaagcucuggucgguucaagcaacaagcggacuaucugggcaaggcagguugcccugguacccgcgcgggucaccucuccccgcccccauccccagcagcccuccuggucgcagaagcagagaagaaggagaaagccgaguuaaccacucaccccuagcuuccugcugcggauuuucacguagcccugcuugacuaugucguuaaaguuggaggccauggccagagcggucggguuccucugcugggcgauccgcuucucggagucgacaaccgcuguccgccgcccgguccacgcaggucucgcauccagccggccgccgccagcagucgcgccgccgcugauuucuccccaggcuccugcuggcgcggacccggggucgauagcugggccgccacacacggagacaagggauccgggcccggaacugcucagcagcaccagcaccucgcgacccgucgucaccuucgcccccggccacaagcggagcaccgcgacccgcgccaccgccaguuguaccccccuccgcgccaccgcccccggcagcacccacaggcuggcgccucacucggcggcgcacagcuggccggagcgcaccaucgcggcuccccggcgcggagaagggggagggacggcggggcgggccguugcgcccgaucggcucccucccccuugcccgcgggguggcagggcuggaggaugcuggcaagaugcacuc

SEQ ID NO: 10892 - RNA, 2501 nt, Mus musculus
gagugcaucuugccagcauccuccagcccugccaccccgcgggcaagggggagggagccgaucgggcgcaacggcccgccccgccgucccucccccuucuccgcgccggggagccgcgauggugcgcuccggccagcugugcgccgccgagugaggcgccagccugugggugcugccgggggcgguggcgcggagggggguacaacuggcgguggcgcgggucgcggugcuccgcuuguggccgggggcgaaggugacgacgggucgcgaggugcuggugcugcugagcaguuccgggcccggaucccuugucuccguguguggcggcccagcuaucgaccccggguccgcgccagcaggagccuggggagaaaucagcggcggcgcgacugcuggcggcggccggcuggaugcgagaccugcguggaccgggcggcggacagcgguugucgacuccgagaagcggaucgcccagcagaggaacccgaccgcucuggccauggccuccaacuuuaacgacauagucaagcagggcuacgugaaaauccgcagcaggaagcuaggggugagugguuaacucggcuuucuccuucuucucugcuucugcgaccaggagggcugcuggggaugggggcggggagaggugacccgcgcggguaccagggcaaccugccuugcccagauaguccgcuuguugcuugaaccgaccagagcuuggcaccugccugagguacucugcacaccgaggugagggcucuggagcgccuaggucccuauucucaagugcgcugggcucauggugaccacagcuagaaguccaguagaacacagggauugucaguuccaaagauauaugagucauagagauuuauuacauuugguguaaccuacaacgauuucucucaaaagugugugacucuggggagaacugccgagugcugacagcagguguaaaaggugucuuucucuguguguuuagauucaccauuuuuaggucuucuuucuccaagcccgauucgaaauucuccuuugaugccucaucagcgcagcgcauccccuuuggcuacagcagggacuuuaacaugcccuuaauaguugcccacaguuuggcugccucagccgcuguuuuccuggacauguguauuugucccaguguguaggcaagugugcauugguguacucucucgcccacgguugcagaaaagucugugcaggcaaaguuuauggaaucuuacuuucuucuugagagauauuuggucuaacuugggagauaacagaauagaccuacgccaggaggugagaggaaagacaaaacuucuuuggugauucaaucgguauuuuaaagggacuguccugaaaagaccugggauauagauggaaugaacaggaaagaaugggcagacaccuggggaggagcuguccagaucugauagauaugaaugagagcggauuaacuugcaggaggcaucuccaaguccacaacugacaguccagguucaccuggccacaagaggaaagggaaauucaacucaauguacauguaggagaggguuugccuauuguuucugccuuccugaguucacaauuuccuacccugagacuuucuagaauccuagcuuggagguggaaaguuccuggauuuuucuacuggaugagugaacucugcaacuuguagaaaggaaaggaaagaagaggaggauagaggugguaaauuuaugcauagaaaaggggaaucuuagggagauuauccuaaaauucugaaaucgugaaccuuugcuggaggcaagugauggagccagcuaacugccucuuauguugucucuguuggcauucucacugaaggcagacagggccaaaggacauagugauucccucucaaacuuaagcagauuacuaaaucaaggaagcuuaacaaacaagaaaugaaaaacuaguuaggaaaacaaaguuaacauccuuagcuuccaccccccaccucagcucuccaccugcucaaggaagggagagacaauguuugaagggcuuuucuugaauagaaagaagaucaugccucauguuucccccuaaagacaggggauggcccagugaaaaacagcaguuauccaaggagccauuugcucuucacagagauguuaucugugaaccccacaucugacagccaagaaaggcuagguauggacuggagauuucuuuacuuugccuuugacucccgcugcucugacaugguucuuauuacuuaccuauaucuucauuccuauuaaacugaaguuuuaucugaaucuuccaaaaguauaaacuaauggaagaauuaagacccucuuuccaucucagugaaauuuguuucuuuucucagucaagaaaauuggggccaauaacuagagauucuucuccauagaagaguucccaggguuuauccccuucuuccauuuaugauaucuaggauucuauacuacaaauccuggauauauagccuacuuacacaauaaagucuauggaaaguu

SEQ ID NO: 10893 - RNA, 2501 nt, Mus musculus
gcugggguuuggcggccuuagauagggugucagagaagaugcucuugccaggcuuggaaggagucguucacauaugugugaugagaaagggcuggcccgaucaagucguugagcucagaaugcagccaguauacugauacuggugaauccagaucccggcuuucgggagucucucuggaagacagcuucaccccagcugccuuagcugcaaacaacgcugaaguuucagaggguugacuggggaugcuucucagacagacagguucccuuuucccugacucucagcucuguaacgccugagguagcccguuaguuguaccuccccccuccucugcccuucgccucucaccccagaaccccccccaccccacugcuuccugcuccagcagcccccggggagcuagcaggggagcuggcagcggccccagcccacuccuuacaaggcgugaguccgccgggcccgcccccggcccucccgccagaggccuugaucccucccccugucaagagcagcggcaggcccgagccgggccagucggggggcgucgcgaugcugcugcgccugcugcuggccuggguggccgcggugcccgcacugggccagguccccuggacgccggagccucgagccgcgugcggccccagcagcugcuacgcgcucuuuccccggcgccgcacauuccuggaagcuuggcgggcgugccgcgaauuggggggcaaccuggccacaccgcggaccccagaggaggcccagcguguggacagccuggugggggucgggccggccaacgggcugcuauggauuggguugcagcggcaggcuaggcaaugccagccgcagcgcccacugcggggcuucauauggaccacgggagaccaggacaccgccuucaccaacugggcccagccggcuacggaaggacccugcccagcccagcgcugugcagcccuugaggccagcggagagcaucgcuggcucgaaggcucgugcacacuggcugucgauggcuaccucugccaguuugguuuugagggugccugcccugccuugccgcuugaggugggucaggccggucccgcugucuacaccacacccuucaaccugguuuccagcgaguucgaauggcugcccuuuggcuccguggcagcugugcagugccaagcuggcaggggagcuucucugcugugcgugaaacagccuucagguggcgugggcuggucccagacuggcccgcugugcccagggacuggcugugguccugacaauggggguugcgaacaugaguguguggaagagguggacggugcuguguccugccgcugcagugaaggcuuccgucuagcagcagaugggcacaguugugaagaccccugugcccaggcccccugugagcagcagugugaaccuggagggccacaaggcuauagcugccacugucgccuuggcuuccggccagcugaggaugauccacaccgcugcguggacacggaugagugccagauugcuggugugugccagcagaugugugucaacuauguugguggcuuugaguguuacugcagcgagggucacgagcuugaggcagaugguaucagcuguagcccugcaggagccaugggugcccaggcuucccaggaucucagagaugaguugcuggaugauggagaagaaggggaggaugaagaggagcccugggaggacuuugauggcaccuggacagaggaacaggggauccuauggcuggcaccuacacauccaccugacuuuggccugcccuauaggcccaacuucccacaggauggagagccucagagauugcaccuggagccuaccuggccacccccacuuagugcccccaggggccccuaccacuccucaguggugucugccacacggcccauggugaucucugccacucgacccacacuaccuucugcccacaagaccucuguuauuucagcuacacgcccaccccugagcccuguccacccaccugccauggccccugccacaccuccagcuguguucucugagcaccagauccccaaaaucaaggccaauuauccagaccugccuuuuggccacaagccugggauaaccucggccacucacccagcacggucuccuccguaccagccccccauuaucucaaccaacuauccccaagucuucccuccccaccaggccccuaugucuccagauacccacacuaucacuuauuugccuccaguccccccucaccuugauccuggggauaccacuucuaaagcccaucaacacccuuugcucccagaugcuccagguaucagaacccaggccccccagcuuucugucucagcucuccagcccccucuuccuaccaacuccaggucuucuguccaugaaacuccugugccugcugccaaccagcccccagccuucccuucuucuccccuccccccucagaggcccacuaaccagaccucaucuaucagcccuacacauuccuauuccagagccc

SEQ ID NO: 10894 - RNA, 2501 nt, Mus musculus
gggcucuggaauaggaauguguagggcugauagaugaggucugguuagugggccucugaggggggaggggagaagaagggaaggcugggggcugguuggcagcaggcacaggaguuucauggacagaagaccuggaguugguaggaagagggggcuggagagcugagacagaaagcuggggggccuggguucugauaccuggagcaucugggagcaaaggguguugaugggcuuuagaagugguauccccaggaucaaggugaggggggacuggaggcaaauaagugauaguguggguaucuggagacauaggggccugguggggagggaagacuuggggauaguugguugagauaauggggggcugguacggaggagaccgugcugggugaguggccgagguuaucccaggcuuguggccaaaaggcaggucuggauaauuggccuugauuuuggggaucuggugcucagagaacacagcuggagguguggcaggggccauggcagguggguggacagggcucaggggugggcguguagcugaaauaacagaggucuugugggcagaagguagugugggucgaguggcagagaucaccaugggccguguggcagacaccacugaggagugguaggggccccugggggcacuaaguggggguggccagguaggcuccaggugcaaucucugaggcucuccauccugugggaaguugggccuauagggcaggccaaagucagguggauguguaggugccagccauaggauccccuguuccucuguccaggugccaucaaaguccucccagggcuccucuucauccuccccuucuucuccaucauccagcaacucaucucugagauccugggaagccugggcacccauggcuccugcagggcuacagcugauaccaucugccucaagcucgugacccucgcugcaguaacacucaaagccaccaacauaguugacacacaucugcuggcacacaccagcaaucuggcacucauccguguccacgcagcgguguggaucauccucagcuggccggaagccaaggcgacaguggcagcuauagccuuguggcccuccagguucacacugcugcucacagggggccugggcacaggggucuucacaacugugcccaucugcugcuagacggaagccuucacugcagcggcaggacacagcaccguccaccucuuccacacacucauguucgcaacccccauugucaggaccacagccagucccugggcacagcgggccagucugggaccagcccacgccaccugaaggcuguuucacgcacagcagagaagcuccccugccagcuuggcacugcacagcugccacggagccaaagggcagccauucgaacucgcuggaaaccagguugaagggugugguguagacagcgggaccggccugacccaccucaagcggcaaggcagggcaggcacccucaaaaccaaacuggcagagguagccaucgacagccagugugcacgagccuucgagccagcgaugcucuccgcuggccucaagggcugcacagcgcugggcugggcaggguccuuccguagccggcugggcccaguuggugaaggcgguguccuggucucccgugguccauaugaagccccgcagugggcgcugcggcuggcauugccuagccugccgcugcaacccaauccauagcagcccguuggccggcccgacccccaccaggcuguccacacgcugggccuccucugggguccgcgguguggccagguugccccccaauucgcggcacgcccgccaagcuuccaggaaugugcggcgccggggaaagagcgcguagcagcugcuggggccgcacgcggcucgaggcuccggcguccaggggaccuggcccagugcgggcaccgcggccacccaggccagcagcaggcgcagcagcaucgcgacgccccccgacuggcccggcucgggccugccgcugcucuugacagggggagggaucaaggccucuggcgggagggccgggggcgggcccggcggacucacgccuuguaaggagugggcuggggccgcugccagcuccccugcuagcuccccgggggcugcuggagcaggaagcaguggggugggggggguucuggggugagaggcgaagggcagaggaggggggagguacaacuaacgggcuaccucaggcguuacagagcugagagucagggaaaagggaaccugucugucugagaagcauccccagucaacccucugaaacuucagcguuguuugcagcuaaggcagcuggggugaagcugucuuccagagagacucccgaaagccgggaucuggauucaccaguaucaguauacuggcugcauucugagcucaacgacuugaucgggccagcccuuucucaucacacauaugugaacgacuccuuccaagccuggcaagagcaucuucucugacacccuaucuaaggccgccaaaccccagc

SEQ ID NO: 10895 - RNA, 2501 nt, Mus musculus
ggugacggaaggaucaggaguucaagggcagccucaacuagauaccugagacccugucucaaccaaccucccuccacaaaccacaagcaaagcaaacucaacuaaagaaacuucucaccccacuugagaggagcggucuuaagucaggacugcagacuugggugacaguuggaaugauucucuccagguaaauaaugaugaugauaauaauaacccauauuuauaauucacuucccagcuuucagacacucuccccguucuucuuucuaagucuuggcgcgaggccaggcggccacaggauuuuguuucgcccuguguugggaaccuuggcuagucugaacggggcggggcgcaguugcaagccccaacuucggcaaggugcgucagggggaauccucggugcaccugggcgcggcaaggaaauugcaccauguaugggcagcugcgucagaggggggcguggccgccgcggaugcuaggggacgccaagucggucgcuuucugucuguagaggcggcuugccacccgagcagagggucgugaaguuccgagcggaccgguccacagagguucaucuggagagguggguccccugcgaggugaaaggcgccgcugagacacgcccccaccccccguggugcaagugguucagcccaagaacuuuucauucauaaaaaagaccagacuccgagaggcgcgagugagucagaaccgcagccgccaacgcggacccuaccgaacauccagcccagggcauguaccgagacuacggggaaccgggaccgagcuccggggcuggcagcccguacggucgccccgcgcagcccccgcaagcucaggcacagaccgcccagcagcaggugagacuggccgaaucgucggggggggggggaccugaguuuggacagcaucagggaugcugggauuagucuaguuugcuccgggauuuggacuggggccccgagcagcaucugacucugguggucgcgaccgaggauccugcacguucuguguggucggggaaccuauguacccgguggccaaggggacgagcgcagcgggaagcgcgaauaucugcgaauuccccuucucgcucgcccguaucucccuagcugacugucuuucugccccuccgucuccguuacggucuuacauuuccuccuaucugccccuaauacgcugucccucuaaauaccugccccaucccugccuggacaggaucagagguguucuccaucuccaguuaauaacugggaccuggggucugggcacauagagacgggguccaucagaacucagccgggacagagaauucuuagcagccuguccgaggcuguccguguguugcucugguuguccgugucccuuuauccggucaaguccucaucucuuugugcgcaguauagagcccaugggccccaggcagugguuccgagggguuccuggagaccacgaaguguugggaugugcgcggggucaccugcccggccacacucgcgcuccacauucucggcacccgacgucucucacugcuggauaggggcacuugagagguugcagguguccauuuccugucgaggggccgcgagcacgugucgccaggggagggaaggagcugcguccguuucgccgagucacagcgggccgagucacugaggcugagucacccugggugccccucccuuccuggccccaaacggccccuaaggaccgacgaccugggagcgagagaugccccuggcagugcuucuagcccagaacgggggucacugagaugcugggucccccaguauugggcuggggacauagcuguccagacuugccuaagcaugugaggugcuuccuggacuggaggggccccacauccuuagcucacagagcuugaacccaguuuucucucccagaacgcugagcccccacccccaccgacacucaaucccaacacaugccucagauuucugcaagaaaaggaaggaaaggaugccagaccccuuauaggaggcuuuuacucucuucacuuuauuucauggacuuaaaaaaccccaucaauuuugaacuuucaaguuuuuaagucgacagcuaggcaugcauuuaaucccagcauucaggaggcagaggcaggcagaucucugggaguuugaagccaauuuggucuacaaagugacuuccaggucagcuagagcuacauaauagagauccugucucaaaacuuaaaaaauaaaaaacaaaaacaaaagccgauuaaaacucugauuucugagcuaugagagcuggcuucucaacagcaauggaacguugaaugauguuaauaacagggaaacugagacuaaauaacaugccccagucucaaagcccaucaauggccaagcuccaagcugaugcuggacucccaagcucuggugcuacaugucuauagucuuggugccugggagguagaggcagaggaaucgugaguuuaggucuagccugagcuaugugagauccugcccaccccacccccg

SEQ ID NO: 10896 - RNA, 2501 nt, Mus musculus
cggggguggggugggcaggaucucacauagcucaggcuagaccuaaacucacgauuccucugccucuaccucccaggcaccaagacuauagacauguagcaccagagcuugggaguccagcaucagcuuggagcuuggccauugaugggcuuugagacuggggcauguuauuuagucucaguuucccuguuauuaacaucauucaacguuccauugcuguugagaagccagcucucauagcucagaaaucagaguuuuaaucggcuuuuguuuuuguuuuuuauuuuuuaaguuuugagacaggaucucuauuauguagcucuagcugaccuggaagucacuuuguagaccaaauuggcuucaaacucccagagaucugccugccucugccuccugaaugcugggauuaaaugcaugccuagcugucgacuuaaaaacuugaaaguucaaaauugaugggguuuuuuaaguccaugaaauaaagugaagagaguaaaagccuccuauaaggggucuggcauccuuuccuuccuuuucuugcagaaaucugaggcauguguugggauugagugucggugggggugggggcucagcguucugggagagaaaacuggguucaagcucugugagcuaaggauguggggccccuccaguccaggaagcaccucacaugcuuaggcaagucuggacagcuauguccccagcccaauacugggggacccagcaucucagugacccccguucugggcuagaagcacugccaggggcaucucucgcucccaggucgucgguccuuaggggccguuuggggccaggaagggaggggcacccagggugacucagccucagugacucggcccgcugugacucggcgaaacggacgcagcuccuucccuccccuggcgacacgugcucgcggccccucgacaggaaauggacaccugcaaccucucaagugccccuauccagcagugagagacgucgggugccgagaauguggagcgcgaguguggccgggcaggugaccccgcgcacaucccaacacuucguggucuccaggaaccccucggaaccacugccuggggcccaugggcucuauacugcgcacaaagagaugaggacuugaccggauaaagggacacggacaaccagagcaacacacggacagccucggacaggcugcuaagaauucucugucccggcugaguucugauggaccccgucucuaugugcccagaccccaggucccaguuauuaacuggagauggagaacaccucugauccuguccaggcagggauggggcagguauuuagagggacagcguauuaggggcagauaggaggaaauguaagaccguaacggagacggaggggcagaaagacagucagcuagggagauacgggcgagcgagaaggggaauucgcagauauucgcgcuucccgcugcgcucguccccuuggccaccggguacauagguuccccgaccacacagaacgugcaggauccucggucgcgaccaccagagucagaugcugcucggggccccaguccaaaucccggagcaaacuagacuaaucccagcaucccugaugcuguccaaacucagguccccccccccccgacgauucggccagucucaccugcugcugggcggucugugccugagcuugcgggggcugcgcggggcgaccguacgggcugccagccccggagcucggucccgguuccccguagucucgguacaugcccugggcuggauguucgguaggguccgcguuggcggcugcgguucugacucacucgcgccucucggagucuggucuuuuuuaugaaugaaaaguucuugggcugaaccacuugcaccacggggggugggggcgugucucagcggcgccuuucaccucgcaggggacccaccucuccagaugaaccucuguggaccgguccgcucggaacuucacgacccucugcucggguggcaagccgccucuacagacagaaagcgaccgacuuggcguccccuagcauccgcggcggccacgccccccucugacgcagcugcccauacauggugcaauuuccuugccgcgcccaggugcaccgaggauucccccugacgcaccuugccgaaguuggggcuugcaacugcgccccgccccguucagacuagccaagguucccaacacagggcgaaacaaaauccuguggccgccuggccucgcgccaagacuuagaaagaagaacggggagagugucugaaagcugggaagugaauuauaaauauggguuauuauuaucaucaucauuauuuaccuggagagaaucauuccaacugucacccaagucugcaguccugacuuaagaccgcuccucucaaguggggugagaaguuucuuuaguugaguuugcuuugcuugugguuuguggagggagguugguugagacagggucucagguaucuaguugaggcugcccuugaacuccugauccuuccgucacc

SEQ ID NO: 10897 - RNA, 2501 nt, Mus musculus
ucuaagugaugaugguuuaacacuggauaaaauucugaaaggaguagaauuugaagcucugaggauuaaaugccuaguagguucugggaggcgcagaaucggguuacacggaggugcgaaugcacagcaugggauuccggaggcacagguuagauagggucuaggugggcagaauaacauuuugagugaaggcccgggguccuuaggugaguuugggggccaagcaucaaggucaguggccuaaggauccaaacuuugggaaacucuggcugggcguccgcaggcgacuccaggcagcgccgcgggggaccgggugggggccuguggccggccggggcggagaagccggggggucggggucccucccccuggcgcgggcucaggaauccgccgaagggcgggcggaggcgccggggugggccgcggccggcgggcgggcggggggcgcuuccuggggccgcgcguccagugagcugcgcgguccguccguccguccgcccgcccgcaggcacugcuggagucgacgcgugaguggccuccagcggagggagggcgcgggccguuuggcggccgagucggugcugcgcggagcggggaggccugcgcuucacgacucgcggggcgggggcggggcgguccgggauugcgggccugggccauaggccugcgaaaggauucuguccccagcccuggaagguuccagccucagcacaguccugagacgagacagcugggacccaggcuccccuuccagauagagggaauggggggugcuguggcagaaaccccugacuucugcccaccaccucccagccucaggaugcucccuuuugccuccugccuccccgggucuuugcugcucugggcguuucugcuguugcucuugggagcagcguccccacaggaucccgaggagccggacagcuacacgguggggaccguggggucaccagcuugggaugggaugggaaggacagugagaucaggauccuggggaggcugcuucugggcaagauucuccccggcuugguugguggaaagcuggaggccauuguguggagcugacccgagcaugacucugaacucuggcccuggucuuggccuggcuaguugguggagacagccaggguggucacuggccacaucggguucccuuccaggaaugcacagauggcuaugagugggaugcagacagccagcacugccggggugagucucugucugggguacuagccaucuucaggaacugggaaggggguuguuguuucccagggauaccuuaccucccagagcugcugcaggaacuugauggcccuuuucccuguccagcuugguagccagccaugcuucccuugugccacucaguuaggagcccugccccuucaagaagcuggacaaacggccucuauccugcaggagggaagggagcaccuggcuauugcccagagagaaggaaauacgcacaccuucccuggacugcacuguaccugccuagcccagcucuuuaucccaaugcagccugggagagccgugcaugccccgugggucggcaggcccgcaaaauuucucuugggcaaagguagaggcagggauuugaggaggcaggagaauggagauaccagugugaaacagggggccccacucccaguccugccaaucccuggcagggcuucugggucagcagccuuaguuugccuagcagagagaaagucuugcucuguugcucagcuuagagaaggccaaguugggcaucugccucccacuaccuccagggccagcccaggugacuggcugugcccagcaggccccucucugcagaugucaacgagugccugaccaucccggaggcuugcaagggugagaugaaaugcaucaaccacuacggggguuauuugugucugccucgcucugcugccgucaucagugaucuccauggugaaggaccuccaccgccagcggcccaugcucaacaaccaaacccuugcccgcagggcuacgagccugaugaacaggagagcuguguggguaagcaagggcugaucgggugucugggcuuccacgcgguuuaugaguuuuuuccccgagacaggguuucucuguggagcccuggcuguccuggaacucauagaccaggcuggccucgaacucagaaaucugccugccucugccucccgagugcugggauuauaggcguguguuaccauuccugacuuuuuuuuuuuuuaauuuuuaaacuaauuuuguauuuacuguacaaaguaaugcguuccaucaugguaucaucuccuggcacaugucauucuuguuuguuuucaucuucuaguagcacuuuuugguccucccuaguuuuuguuguuguuguuuuuguuuuuuauuuauuuuuuuguuuucuuuugggggcgauuuugagacaguuucuggauuugauccccaccaucacaaaaacaagaggaucucuguggguuccaagcuaguuguggucugugugguagcagacacuu

SEQ ID NO: 10898 - RNA, 2501 nt, Mus musculus
aagugucugcuaccacacagaccacaacuagcuuggaacccacagagauccucuuguuuuugugaugguggggaucaaauccagaaacugucucaaaaucgcccccaaaagaaaacaaaaaaauaaauaaaaaacaaaaacaacaacaacaaaaacuagggaggaccaaaaagugcuacuagaagaugaaaacaaacaagaaugacaugugccaggagaugauaccaugauggaacgcauuacuuuguacaguaaauacaaaauuaguuuaaaaauuaaaaaaaaaaaaagucaggaaugguaacacacgccuauaaucccagcacucgggaggcagaggcaggcagauuucugaguucgaggccagccuggucuaugaguuccaggacagccagggcuccacagagaaacccugucucggggaaaaaacucauaaaccgcguggaagcccagacacccgaucagcccuugcuuacccacacagcucuccuguucaucaggcucguagcccugcgggcaaggguuugguuguugagcaugggccgcuggcgguggagguccuucaccauggagaucacugaugacggcagcagagcgaggcagacacaaauaacccccguagugguugaugcauuucaucucacccuugcaagccuccgggauggucaggcacucguugacaucugcagagaggggccugcugggcacagccagucaccugggcuggcccuggagguagugggaggcagaugcccaacuuggccuucucuaagcugagcaacagagcaagacuuucucucugcuaggcaaacuaaggcugcugacccagaagcccugccagggauuggcaggacugggaguggggcccccuguuucacacugguaucuccauucuccugccuccucaaaucccugccucuaccuuugcccaagagaaauuuugcgggccugccgacccacggggcaugcacggcucucccaggcugcauugggauaaagagcugggcuaggcagguacagugcaguccagggaaggugugcguauuuccuucucucugggcaauagccaggugcucccuucccuccugcaggauagaggccguuuguccagcuucuugaaggggcagggcuccuaacugaguggcacaagggaagcauggcuggcuaccaagcuggacagggaaaagggccaucaaguuccugcagcagcucugggagguaagguaucccugggaaacaacaacccccuucccaguuccugaagauggcuaguaccccagacagagacucaccccggcagugcuggcugucugcaucccacucauagccaucugugcauuccuggaagggaacccgauguggccagugaccacccuggcugucuccaccaacuagccaggccaagaccagggccagaguucagagucaugcucgggucagcuccacacaauggccuccagcuuuccaccaaccaagccggggagaaucuugcccagaagcagccuccccaggauccugaucucacuguccuucccaucccaucccaagcuggugaccccacgguccccaccguguagcuguccggcuccucgggauccuguggggacgcugcucccaagagcaacagcagaaacgcccagagcagcaaagacccggggaggcaggaggcaaaagggagcauccugaggcugggagguggugggcagaagucagggguuucugccacagcaccccccauucccucuaucuggaaggggagccugggucccagcugucucgucucaggacugugcugaggcuggaaccuuccagggcuggggacagaauccuuucgcaggccuauggcccaggcccgcaaucccggaccgccccgcccccgccccgcgagucgugaagcgcaggccuccccgcuccgcgcagcaccgacucggccgccaaacggcccgcgcccucccuccgcuggaggccacucacgcgucgacuccagcagugccugcgggcgggcggacggacggacggaccgcgcagcucacuggacgcgcggccccaggaagcgccccccgcccgcccgccggccgcggcccaccccggcgccuccgcccgcccuucggcggauuccugagcccgcgccagggggagggaccccgaccccccggcuucuccgccccggccggccacaggcccccacccggucccccgcggcgcugccuggagucgccugcggacgcccagccagaguuucccaaaguuuggauccuuaggccacugaccuugaugcuuggcccccaaacucaccuaaggaccccgggccuucacucaaaauguuauucugcccaccuagacccuaucuaaccugugccuccggaaucccaugcugugcauucgcaccuccguguaacccgauucugcgccucccagaaccuacuaggcauuuaauccucagagcuucaaauucuacuccuuucagaauuuuauccaguguuaaaccaucaucacuuaga

SEQ ID NO: 10899 - RNA, 2501 nt, Mus musculus
uucaacucagcgaugaggggguucuuacaagagcuuauuuuccgcccugggcaguccugagagagggaagcaccuccuuaggacagcagucguagguggcacugacuauccaccuaaugggacaggccaugggaccaggucucuggucuucaugucccucggaucuguucaggggggcagggggaauuucuagaacccaaggaagucuuaauaauuugaacuagcugaaagucaguggacggucuguuacugacugggaugggaaguaaaacuaaaaacaacagcacucugagccuggcuuaacacaagcucaccuuuagcacaguccaaguucagguuaucagaucccaaggagcaccuaagcagcacgccaaacacgggauggggaggaggccggagcgaggaaccaacgggcugugucccucagcagcccuucuggagguggcgcaccggccagaacauacagccaggcagaaaucacaaaaucccaagcccacaccucagggcuuuuaccuccugcuccuccacauuggagauucuagggccuucuggcccauucccuccuuuaagcagccuucagaguagccauacagcuccuuaguaagguucacuuauaaaacauccuaccagccaucggauccuggacggucugacacaaaacaccauuacgcccaagacagcuuuccaagagggaaauugaggcaagaacccgcacagggccccucacucaccacccucauuuccccugcuuucuuaaaagccuggguggagccagggaaccugcagaucaagggucaaagucgguugguuaauuaccgccucccccuccccccuuggaggcgcagggcaguaggcuccugccccaccccccaagauaggggaggggaguuuuguauugggagagagggggcagaaguuuucuagggucucagaggaagaugcagcuggaagaagagacaauucuagcaacucaauucuaaguugacgugcaggcugucaaggcguccucccuaaauaaacuagguacacuggcuuccuggaguaccuuacggcucuaagaaccaucuuuugcuuaguguccuccacgagcugaaccgaggugggacugucucaaaggcaagcaagguacauuggguuuauuucccagcagcuccuggaccgucaggcaggaguccagggaaauucggugguccugaaucuggacccucauuucaauaccaccaaaguuauggggccaaguuuucucuuacaauguagcccaaguuucagcggaaacuccagcucugcuccuuuccauucccuggcccuccccuccaaaguggcaucgcuccagugcuccucuccugccucaugaaagcccggguuuucuggauuuacgacacgagagccggaggucgccugagcggugacacaccccacugcguccccuguagcgcggcgcgggcaggagaucccgggccugagagcggcaaagccucgguuuggaguccccuucccccacccacgcuccuucagcgccgggggucgaaucgcgacgagaaucugcguccccacgcucgacugaccggcgccgaccgcugguccgugcgccccgcccucccggcgccgggagcccgaggcgccucaccuggcacguagaucucgccgcgcucuucguccgggagcucgcuccaguuccucuugcacguggagacgcauggcuucuucaccaggaacgcgcgaggcaucuucaguuccuccuggcccggcgcgguucgcucugguaagucgaguucguguggucgucccaccuuuucuuccaccggaucgggguugaggcgcgggaauagggacaguucaaggaaagagucgccgaggcguguccacguucuuaggacagaguguaccagggaccacgcguggcguuuccaacuacgccgaaggucgccgguguccacagagagggugcagccaggugcaccgggaucgcagaagcgcuaagccagcguccuuuagcucgacuggcguccccgcggcugcucgcgaagucuucaagugcgagcuggacggacggguucacgcuuuauuggcucgcggcgguguguguugguggcucgggcgggggugggguagggguguugaucugaucuaauuagcuuggaguggccgagagagcgauggcgcaugcguugggaaauaacggugacaacccaccuauuuguuaccugucgaaccgguuuccauuccgcugcgggugagguggccucgcggcccgggcgggguggcacgacgggggcaggguuagggggcgugcuccgguccccacacccagaagcacccggcccgccccggaccuccccugcccagcgugcucacguuugcaaacuagaguuucggagggagcgggcacggaaagggaggggagggcaacguuauuugcaccggcgcucgcacgcucugugggcgaugacauaaaacuggcccaacagguccgggcccagccuggcgcgcccggggcgccg

SEQ ID NO: 10900 - RNA, 2501 nt, Mus musculus
cggcgccccgggcgcgccaggcugggcccggaccuguugggccaguuuuaugucaucgcccacagagcgugcgagcgccggugcaaauaacguugcccuccccucccuuuccgugcccgcucccuccgaaacucuaguuugcaaacgugagcacgcugggcaggggagguccggggcgggccgggugcuucuggguguggggaccggagcacgcccccuaacccugcccccgucgugccaccccgcccgggccgcgaggccaccucacccgcagcggaauggaaaccgguucgacagguaacaaauagguggguugucaccguuauuucccaacgcaugcgccaucgcucucucggccacuccaagcuaauuagaucagaucaacaccccuaccccacccccgcccgagccaccaacacacaccgccgcgagccaauaaagcgugaacccguccguccagcucgcacuugaagacuucgcgagcagccgcggggacgccagucgagcuaaaggacgcuggcuuagcgcuucugcgaucccggugcaccuggcugcacccucucuguggacaccggcgaccuucggcguaguuggaaacgccacgcguggucccugguacacucuguccuaagaacguggacacgccucggcgacucuuuccuugaacugucccuauucccgcgccucaaccccgauccgguggaagaaaaggugggacgaccacacgaacucgacuuaccagagcgaaccgcgccgggccaggaggaacugaagaugccucgcgcguuccuggugaagaagccaugcgucuccacgugcaagaggaacuggagcgagcucccggacgaagagcgcggcgagaucuacgugccaggugaggcgccucgggcucccggcgccgggagggcggggcgcacggaccagcggucggcgccggucagucgagcguggggacgcagauucucgucgcgauucgacccccggcgcugaaggagcgugggugggggaaggggacuccaaaccgaggcuuugccgcucucaggcccgggaucuccugcccgcgccgcgcuacaggggacgcaguggggugugucaccgcucaggcgaccuccggcucucgugucguaaauccagaaaacccgggcuuucaugaggcaggagaggagcacuggagcgaugccacuuuggaggggagggccagggaauggaaaggagcagagcuggaguuuccgcugaaacuugggcuacauuguaagagaaaacuuggccccauaacuuuggugguauugaaaugaggguccagauucaggaccaccgaauuucccuggacuccugccugacgguccaggagcugcugggaaauaaacccaauguaccuugcuugccuuugagacagucccaccucgguucagcucguggaggacacuaagcaaaagaugguucuuagagccguaagguacuccaggaagccaguguaccuaguuuauuuagggaggacgccuugacagccugcacgucaacuuagaauugaguugcuagaauugucucuucuuccagcugcaucuuccucugagacccuagaaaacuucugcccccucucucccaauacaaaacuccccuccccuaucuugggggguggggcaggagccuacugcccugcgccuccaaggggggagggggaggcgguaauuaaccaaccgacuuugacccuugaucugcagguucccuggcuccacccaggcuuuuaagaaagcaggggaaaugaggguggugagugaggggcccugugcggguucuugccucaauuucccucuuggaaagcugucuugggcguaaugguguuuugugucagaccguccaggauccgauggcugguaggauguuuuauaagugaaccuuacuaaggagcuguauggcuacucugaaggcugcuuaaaggagggaaugggccagaaggcccuagaaucuccaauguggaggagcaggagguaaaagcccugaggugugggcuugggauuuugugauuucugccuggcuguauguucuggccggugcgccaccuccagaagggcugcugagggacacagcccguugguuccucgcuccggccuccuccccaucccguguuuggcgugcugcuuaggugcuccuugggaucugauaaccugaacuuggacugugcuaaaggugagcuuguguuaagccaggcucagagugcuguuguuuuuaguuuuacuucccaucccagucaguaacagaccguccacugacuuucagcuaguucaaauuauuaagacuuccuuggguucuagaaauucccccugccccccugaacagauccgagggacaugaagaccagagaccuggucccauggccugucccauuagguggauagucagugccaccuacgacugcuguccuaaggaggugcuucccucucucaggacugcccagggcggaaaauaagcucuuguaagaacccccucaucgcugaguugaa

SEQ ID NO: 10901 - RNA, 2501 nt, Mus musculus
uuuacaccaguucaaaggaaaaaaugaauguaagagcgcucagcaccacuccugccagguggaaaguauucaguguuacuguugcaacaguguuacuagagcagggggagggguccccccucccaaguccuccuagauucuagcagcaaggaauccucuugggacacagaggucacccccugccagcauugcagcaguaggcuguacugagcagcgccugagcuacugagcaauucaagcagaacucaucaaauggccucccucagucccuccgaagcuacccaaauaaacucagccuuaaaguaaaaaaaaaaaaaaaaccaaaaaacaaaaaaaaccaccauuagcucuuuggaaaggugugccuaaagccgagcccaacccccucuucccaucagauuaccacccccugauuccccuggagagggccuggcaugaaccagacuuggcaugguucugacccuggucacccuuagcccuacuaaguucuuuugagucagacacuggauccuggggcuuccuagcacguucucacaguauuguccagauccgggacaccacagccuccccuuucagaccagugaguaagucuagcucuucuacagccuugagcaaauucaagacccuuccccaccccccugucaaccccugccccagggcccugcugggcuucuccccagcccccugagcacucaaguagcacucccuucuccggcuguuagccugggaagggggccaggcccugagcucagaccuuggcgauuccagagugucugaggcccagagccagcgccgccagccaggccagacgaggggaaggggggagguggcagggugggcaccaggaagcccucuaaggagcgggggggggggggggaacauuggcagggaagccagguuucuagcuuuguucuuucugcucuucuucuugaggccacaggguucuccccggccaguaaacccuggccagaaggugcucucuccugcuuaaauccuuuccuucgagagaagacaggaccaggaauaaggacccaugacuucagggcuucgagaaccccuacauguacaaaggccaaugggcaaaaguuaacagaccucugauccuccaagcaaggaccaucugccucgguuuccccauuuugaccagguggaaaaguaguugggcgggggaggugugcacaggccucugcaccccgcccggaggaaucuggcggaguccccaggugaggauucuucuggaaagaacccaggucgguuccugcgcggggcgggcaccuagggggcugcccccacuccaaccggcgcccucccugccgcacaucgucgcuucuccgggcagcagcgaaagacgcuugaaccagaaggaaaaagagagaggagaaaaaaaaauugucucccuggccccgggccagcgucccagccccccucgccgccggcgcgcuccagccagggaaaacaacugcucacuucucccugcguccuccccgcgcgcucccugcuucccggcggccgcgggagaggagcccggccagggggaggcgcggagcgggcuggccgcccggccuuccucuccccucgcuccuccucuccgccuccacuugcuccggccuccucgcugcggccucaguucggggccuggcuggguuucucccggccagggaaguuucuucgcucuacccucagugcagcuuccaucgcucucccucgcaacggggaucccggccgcuccugcuguccccucccuacccuuggcuucucgccccgcucugcccucugcuaccaacacucgauccccugcucgggcucgaccuccaaucuccgagggucgugcggccccggaugcccgggccccgaggggcugcccacggccuggccccugcgaugcgccaggccggggcauuggggcugcuggcacuacuccugcuggcgcugcugggccccggcggcggggccgagggugggccggccggcgagcggggcacaggcgggggcggggcgcuggcccgcgaacgcuucaagguggucuuugcgccagugaucugcaagcggaccugucugaagggccagugucgggacagcugucagcagggcuccaacaugacgcucaucggagagaacggccacagcaccgacacgcucaccgguucuggcuuccgcgugggugagggccagggggcucuggcuggggacauaaggaagggcaggcaacagcaccaggcaggaaacagaguggagcauuggggauaagagauggggagcugggauacaucgaucgcggaucuggggccagggcucugagaggcugcgguccauggaagacagagugaggugcugggcuuuuaaguauuggauaaggguugaggcuuaagcucgggucucggaugacacagaacuccugggaggugcucaguuugaagagggagcguacaagggguuggagagaugagagcaaggguaggaauucacgcagaaggggguaaauauuucaccccccaaacaga

SEQ ID NO: 10902 - RNA, 2501 nt, Mus musculus
ucuguuuggggggugaaauauuuacccccuucugcgugaauuccuacccuugcucucaucucuccaaccccuuguacgcucccucuucaaacugagcaccucccaggaguucugugucauccgagacccgagcuuaagccucaacccuuauccaauacuuaaaagcccagcaccucacucugucuuccauggaccgcagccucucagagcccuggccccagauccgcgaucgauguaucccagcuccccaucucuuauccccaaugcuccacucuguuuccugccuggugcuguugccugcccuuccuuauguccccagccagagcccccuggcccucacccacgcggaagccagaaccggugagcgugucggugcuguggccguucucuccgaugagcgucauguuggagcccugcugacagcugucccgacacuggcccuucagacagguccgcuugcagaucacuggcgcaaagaccaccuugaagcguucgcgggccagcgccccgcccccgccugugccccgcucgccggccggcccacccucggccccgccgccggggcccagcagcgccagcaggaguagugccagcagccccaaugccccggccuggcgcaucgcaggggccaggccgugggcagccccucggggcccgggcauccggggccgcacgacccucggagauuggaggucgagcccgagcaggggaucgaguguugguagcagagggcagagcggggcgagaagccaaggguagggaggggacagcaggagcggccgggauccccguugcgagggagagcgauggaagcugcacugaggguagagcgaagaaacuucccuggccgggagaaacccagccaggccccgaacugaggccgcagcgaggaggccggagcaaguggaggcggagaggaggagcgaggggagaggaaggccgggcggccagcccgcuccgcgccucccccuggccgggcuccucucccgcggccgccgggaagcagggagcgcgcggggaggacgcagggagaagugagcaguuguuuucccuggcuggagcgcgccggcggcgaggggggcugggacgcuggcccggggccagggagacaauuuuuuuuucuccucucucuuuuuccuucugguucaagcgucuuucgcugcugcccggagaagcgacgaugugcggcagggagggcgccgguuggagugggggcagcccccuaggugcccgccccgcgcaggaaccgaccuggguucuuuccagaagaauccucaccuggggacuccgccagauuccuccgggcggggugcagaggccugugcacaccucccccgcccaacuacuuuuccaccuggucaaaauggggaaaccgaggcagaugguccuugcuuggaggaucagaggucuguuaacuuuugcccauuggccuuuguacauguagggguucucgaagcccugaagucauggguccuuauuccugguccugucuucucucgaaggaaaggauuuaagcaggagagagcaccuucuggccaggguuuacuggccggggagaacccuguggccucaagaagaagagcagaaagaacaaagcuagaaaccuggcuucccugccaauguucccccccccccccccgcuccuuagagggcuuccuggugcccacccugccaccuccccccuuccccucgucuggccuggcuggcggcgcuggcucugggccucagacacucuggaaucgccaaggucugagcucagggccuggcccccuucccaggcuaacagccggagaagggagugcuacuugagugcucagggggcuggggagaagcccagcagggcccuggggcagggguugacagggggguggggaagggucuugaauuugcucaaggcuguagaagagcuagacuuacucacuggucugaaaggggaggcuguggugucccggaucuggacaauacugugagaacgugcuaggaagccccaggauccagugucugacucaaaagaacuuaguagggcuaagggugaccagggucagaaccaugccaagucugguucaugccaggcccucuccaggggaaucagggggugguaaucugaugggaagaggggguugggcucggcuuuaggcacaccuuuccaaagagcuaauggugguuuuuuuuguuuuuugguuuuuuuuuuuuuuuuacuuuaaggcugaguuuauuuggguagcuucggagggacugagggaggccauuugaugaguucugcuugaauugcucaguagcucaggcgcugcucaguacagccuacugcugcaaugcuggcagggggugaccucugugucccaagaggauuccuugcugcuagaaucuaggaggacuugggaggggggaccccucccccugcucuaguaacacuguugcaacaguaacacugaauacuuuccaccuggcaggaguggugcugagcgcucuuacauucauuuuuuccuuugaacugguguaaa

SEQ ID NO: 10903 - RNA, 2501 nt, Mus musculus
ccccaugaaaccaggagugaucaacaagccugaacucucaaagagacaagggcugcaggauucgaaguucaaggucaucuugacuacacagggaucugaaggccagcuugggcuacaugagauggcuacaggaagaguuaaacaggggaccaucgagagggcucagcagagagagugccggcaaucugagauggaucucagaacccaugcaaagguggaaggauauuguuaaugucacagaaucugacccacacaugugcucuggcacauaugcacauacacacaccacacaugcacaaaauaaaagcaaguaagaagggacucaagaagggccaccaaagguacccugcauugagaaguccugugcacaggccccaaggcgcccaggagugugaacaaaaagccccauuucagaggucuugguaacugaggucugaggucaccacuuaaggaaguccgaugaagguuagccuagguuccuguuggaggaaagccccuuccagaagguucuggagcagaagacccuuccagguagugcugucucaagcaguucuuucaagguccccgcccaggccaccccugaaacaggaagccccucauuagguucagggcagucccaggagagcagccaaaaggcagggccgucucuuaccuugugcagguguuccagggccagcacaaucucgcccccauacacucgaaccucagccuccuugaaguacuggcgcugguagaggugagugaacaucucaccaccgcucacguagucugggagugaggagacguugaaauguuucccuacaagguagccuaaucuaacucccgucccucuccaaagcugagaugugacaggcccucacccaggaugaggugcagcuuggcauccgucuggaaggcguagugcagugugaccaggaagggugcuuggcgaaccagcuccagcaccgagcguucggugcggguaugcuccugugucuucgcgcgcugcaccaacgccgccuugcguagcaccuucauggcauagagcuugcccgcgucgugcccacccgucuuccgcaccaggaacaccuucccauaggcugugggagcagcaagcaagcgguuggaaggugggcuguaagugcgagggcggugcagacuggugggaaggggggugcaaaaggcugacagagccuucuaaggagaaggugagcccucccuggagggugcucgguuaagccugaaaagcaauuugcagugcaaacuagccuggggagcuugcaacuccagaaggccugcggggcggggaaggggcggggcacgugcaaaccugggaugaucaagagagcugagaaaagaugaaaacgcuggcaccggaggcagaggcgcgcucccagucagcggagggaugugcaaacccggacuggggaauuugcaaaauacaagaguggggcucgcaagggaagauggggagagaagcugugcaaagcucuugggagggagucaaaaccccaaagaggcuaggaaaucgcggcagggggcacgcacgcauaggacuuugcagagaagaguccugucaacguggacgcccggcaaguaggcucggaacccugguacgguagggcggggcgggcaaggggagcuaugccgggaaaggguggggggaccuccccagcaaccaggcccaggcccagguccaggcgagugggcgggcagaaggcccaaagcaccaugccagugaaagcgguuucucaccucccgugcccagcaccuugagcagcgcgaaguucuccacgcucaccuucuccucaugcccggugagguuggcugcggacacaggggggcgagugagcccagagggucgcugacucuugccacccguccgggagagccgccucgggauccggcacccaccuucggugaucugcagcuccacggcgcagcccucguccucauccucgucucccauggcgggcgggucgcuggggcccgcgcggcuggggcuacgggcggcgccgguuacauggcggcuccggccggggcgggugcuuccuggugccgccucuggggccgagcgggcgccggcaccgccucccggcucccagcccgccccgugcggccugagucaggcggcuggaacgugacggagcggggcugcgggugggaagcaucagacgguggcagggucuccuggccccgggaccagugagagccgugcagggccuuugggugacauguggcugcagcuggaguaagccuccuagccaggugucuguccagcaggauauggaggacacuagaggucugugucccaggauuugaggagggcugcccacccaggcugauggagcccucccucccacguggcagccuugccucuucugcuccucuuagccaacagacacaaaucacagcccacuuccuucuuuaggaccacucguuacacucguuaagcucagcaaauacacuggagaucuuuauauucccuggacacaggagcccuaggcucuugaugcugggcc

SEQ ID NO: 10904 - RNA, 2501 nt, Mus musculus
ggcccagcaucaagagccuagggcuccuguguccagggaauauaaagaucuccaguguauuugcugagcuuaacgaguguaacgagugguccuaaagaaggaagugggcugugauuugugucuguuggcuaagaggagcagaagaggcaaggcugccacgugggagggagggcuccaucagccugggugggcagcccuccucaaauccugggacacagaccucuaguguccuccauauccugcuggacagacaccuggcuaggaggcuuacuccagcugcagccacaugucacccaaaggcccugcacggcucucacuggucccggggccaggagacccugccaccgucugaugcuucccacccgcagccccgcuccgucacguuccagccgccugacucaggccgcacggggcgggcugggagccgggaggcggugccggcgcccgcucggccccagaggcggcaccaggaagcacccgccccggccggagccgccauguaaccggcgccgcccguagccccagccgcgcgggccccagcgacccgcccgccaugggagacgaggaugaggacgagggcugcgccguggagcugcagaucaccgaaggugggugccggaucccgaggcggcucucccggacggguggcaagagucagcgacccucugggcucacucgccccccuguguccgcagccaaccucaccgggcaugaggagaaggugagcguggagaacuucgcgcugcucaaggugcugggcacgggaggugagaaaccgcuuucacuggcauggugcuuugggccuucugcccgcccacucgccuggaccugggccugggccugguugcuggggagguccccccacccuuucccggcauagcuccccuugcccgccccgcccuaccguaccaggguuccgagccuacuugccgggcguccacguugacaggacucuucucugcaaaguccuaugcgugcgugcccccugccgcgauuuccuagccucuuugggguuuugacucccucccaagagcuuugcacagcuucucuccccaucuucccuugcgagccccacucuuguauuuugcaaauuccccaguccggguuugcacaucccuccgcugacugggagcgcgccucugccuccggugccagcguuuucaucuuuucucagcucucuugaucaucccagguuugcacgugccccgccccuuccccgccccgcaggccuucuggaguugcaagcuccccaggcuaguuugcacugcaaauugcuuuucaggcuuaaccgagcacccuccagggagggcucaccuucuccuuagaaggcucugucagccuuuugcaccccccuucccaccagucugcaccgcccucgcacuuacagcccaccuuccaaccgcuugcuugcugcucccacagccuaugggaagguguuccuggugcggaagacgggugggcacgacgcgggcaagcucuaugccaugaaggugcuacgcaaggcggcguuggugcagcgcgcgaagacacaggagcauacccgcaccgaacgcucggugcuggagcugguucgccaagcacccuuccuggucacacugcacuacgccuuccagacggaugccaagcugcaccucauccugggugagggccugucacaucucagcuuuggagagggacgggaguuagauuaggcuaccuuguagggaaacauuucaacgucuccucacucccagacuacgugagcgguggugagauguucacucaccucuaccagcgccaguacuucaaggaggcugagguucgaguguaugggggcgagauugugcuggcccuggaacaccugcacaagguaagagacggcccugccuuuuggcugcucuccugggacugcccugaaccuaaugaggggcuuccuguuucagggguggccugggcggggaccuugaaagaacugcuugagacagcacuaccuggaagggucuucugcuccagaaccuucuggaaggggcuuuccuccaacaggaaccuaggcuaaccuucaucggacuuccuuaaguggugaccucagaccucaguuaccaagaccucugaaauggggcuuuuuguucacacuccugggcgccuuggggccugugcacaggacuucucaaugcaggguaccuuugguggcccuucuugagucccuucuuacuugcuuuuauuuugugcaugugugguguguguaugugcauaugugccagagcacaugugugggucagauucugugacauuaacaauauccuuccaccuuugcauggguucugagauccaucucagauugccggcacucucucugcugagcccucucgaugguccccuguuuaacucuuccuguagccaucucauguagcccaagcuggccuucagaucccuguguagucaagaugaccuugaacuucgaauccugcagcccuugucucuuugagaguucaggcuuguugaucacuccugguuucaugggg

SEQ ID NO: 10905 - RNA, 2501 nt, Mus musculus
cucccuuuucccuucuucaggacaagcucuucagcuggaagggggugccuuaggguccugggggaguaccccccuacccuccuccagggccaggggaccagcaucuucaggcaggaaauacucagaucauugugaggcucgggccucgaggccuggaaagagucgcauccccggcagggaccaccggcgcuauuaccacgaccacuggcggcuggaguaccugauggacuucauccccucccggcauggcaugguguguaugguguguggcagcucccuggccacccucaagcucagcaccaucaagaggcacauucgccagaaacaccccuacucccugcacuggagucccagggagaaggaagugaucagcaacagcugggacgcccaucuggggcugggggccgguggugaggcugagagccugggggcccagggggcagaggaggaggaggaagaagaugaagaggaggaggagggggccaaccugcaagcuugcccacccaagggcucagguaauacagaauauggagaggcaaggguuugugugauauggggcucagggagggggcagcuuuucuacuuucuuuucuuuuuuuuuuuuuuagggaaucucuguuucuuuuuggguggagucuguuuacugcccuuccuuuugagaguggggagagauaguggugugggguaguuuccagcaucccugaggccuagacacuguaguagaaggagcaagaguuguaugggugggagggucaaguugaggaagugguugugaguuggugaggggagugggugugguguuggcacaaagaagcccagggacggggcugaaaucagggucuagggaggcugggugggacuugagugagugaacaggaggauuagggagagggguuaagauaaaggaagugggugugguggcauaugccugucauccuagcaccaggaaaguggaggcaggaggaccauuaauuagauaaacguugcuacauagguagguagggcuuuugaacccagccuagguuguaugaguuucugucuuauaaaaacagaacagaaaaagauguaagaggagaggaaaagcuaggcagagaucagccacgggaccugagucaguugagugagaaagagacuguguggagcaccuggcugugguggggacuccccagagggucagagacucaguugcuucccuccaacccuuucaggcaaagccccagcuggugggggcugccggcgccagcggcgagggguccgagggggcucaguggcaccucggcgccggcgccucgcagccucccgaagggcugggggcagcagggggcugggggcccggcgccuggagcggaggcugaaggagucacugcagaacugguuccgggcugagugucucauggacuacgacccacgggggaaucggcuggugugcauggccugcggccgggcacugcccagccugcacuuggacgacauccgugcucacgugcuggaagugcaccccagcucccuagggcucaguggcccccagcgcagugcccugcugcaggccuggggugaccagccugaggcucuguccgagcucacccagcccucaccaggugcgaggcugucccagggcugagaucccuucaauauuagggcggcagcaugggaacugaaaacaaaauugggaggcagggauauuugguugagggcugcaggccuauuuucccuucacacacagacauucaacuuuccacccaucucucucuggcuggggccggcuagcuuggggcuggggugaggagcaaggauggaacccucuuguguggguaaggacaacacagccagaaggcugagcccuucuccuucaccccuuccccaacagacgaugaccucgucccccaggaccugaccagaaagagccgggacuccgcccccgcugcuggagcccccuccucucaggaucucagccccccagacguaaaggaagaggcuggcugggugccugagaggcccgggccggcggaggaggaggagggcgagggcgagggcgagagggagggcaucccgaaccggccucggaggggccgagaccaucgccgccacuaccaggagcgcuggcggcuggaguaccucauggagcuggacggcugccgacgcggccuggugugcauggugugcgggggcgcgcuggccucgcucaagaugagcaccaucaagcgacacauccgccagcgccaccccggcuccaacagccucagcgggccagucaaagcucucaucgcccaggaguggagcgaaaaggccgcacaccugcuggcccuggggcugcccaggccggagucgcccagcgucccugucgcccccagcacagcuucagccucugaggaggggggaggggcagaggaggcggagccagaggaggagugguggggugagccuguggaugggucggagcaacuggcaagggagagagggcagggcucggagggaaggguggugaggauggaaggcuguag

SEQ ID NO: 10906 - RNA, 2501 nt, Mus musculus
cuacagccuuccauccucaccacccuucccuccgagcccugcccucucucccuugccaguugcuccgacccauccacaggcucaccccaccacuccuccucuggcuccgccuccucugccccuccccccuccucagaggcugaagcugugcugggggcgacagggacgcugggcgacuccggccugggcagccccagggccagcaggugugcggccuuuucgcuccacuccugggcgaugagagcuuugacuggcccgcugaggcuguuggagccgggguggcgcuggcggaugugucgcuugauggugcucaucuugagcgaggccagcgcgcccccgcacaccaugcacaccaggccgcgucggcagccguccagcuccaugagguacuccagccgccagcgcuccugguaguggcggcgauggucucggccccuccgaggccgguucgggaugcccucccucucgcccucgcccucgcccuccuccuccuccgccggcccgggccucucaggcacccagccagccucuuccuuuacgucuggggggcugagauccugagaggagggggcuccagcagcgggggcggagucccggcucuuucuggucagguccugggggacgaggucaucgucuguuggggaaggggugaaggagaagggcucagccuucuggcuguguuguccuuacccacacaagaggguuccauccuugcuccucaccccagccccaagcuagccggccccagccagagagagauggguggaaaguugaaugucugugugugaagggaaaauaggccugcagcccucaaccaaauaucccugccucccaauuuuguuuucaguucccaugcugccgcccuaauauugaagggaucucagcccugggacagccucgcaccuggugagggcugggugagcucggacagagccucaggcuggucaccccaggccugcagcagggcacugcgcugggggccacugagcccuagggagcuggggugcacuuccagcacgugagcacggaugucguccaagugcaggcugggcagugcccggccgcaggccaugcacaccagccgauucccccgugggucguaguccaugagacacucagcccggaaccaguucugcagugacuccuucagccuccgcuccaggcgccgggcccccagcccccugcugcccccagcccuucgggaggcugcgaggcgccggcgccgaggugccacugagcccccucggaccccucgccgcuggcgccggcagcccccaccagcuggggcuuugccugaaaggguuggagggaagcaacugagucucugacccucuggggaguccccaccacagccaggugcuccacacagucucuuucucacucaacugacucaggucccguggcugaucucugccuagcuuuuccucuccucuuacaucuuuuucuguucuguuuuuauaagacagaaacucauacaaccuaggcuggguucaaaagcccuaccuaccuauguagcaacguuuaucuaauuaaugguccuccugccuccacuuuccuggugcuaggaugacaggcauaugccaccacacccacuuccuuuaucuuaaccccucucccuaauccuccuguucacucacucaagucccacccagccucccuagacccugauuucagccccgucccugggcuucuuugugccaacaccacacccacuccccucaccaacucacaaccacuuccucaacuugacccucccacccauacaacucuugcuccuucuacuacagugucuaggccucagggaugcuggaaacuaccccacaccacuaucucuccccacucucaaaaggaagggcaguaaacagacuccacccaaaaagaaacagagauucccuaaaaaaaaaaaaaagaaaagaaaguagaaaagcugcccccucccugagccccauaucacacaaacccuugccucuccauauucuguauuaccugagcccuugggugggcaagcuugcagguuggcccccuccuccuccucuucaucuucuuccuccuccuccucugcccccugggcccccaggcucucagccucaccaccggcccccagccccagaugggcgucccagcuguugcugaucacuuccuucucccugggacuccagugcagggaguagggguguuucuggcgaaugugccucuugauggugcugagcuugaggguggccagggagcugccacacaccauacacaccaugccaugccgggaggggaugaaguccaucagguacuccagccgccaguggucgugguaauagcgccgguggucccugccggggaugcgacucuuuccaggccucgaggcccgagccucacaaugaucugaguauuuccugccugaagaugcugguccccuggcccuggaggaggguagggggguacucccccaggacccuaaggcacccccuuccagcugaagagcuuguccugaagaagggaaaagggag

SEQ ID NO: 10907 - RNA, 2501 nt, Mus musculus
gagagccugaaggcgaggaacggggcgaggcugcaagaagccugggaacugggagaggaggcuggggccugggauuaauguaucugagcuugagagaaagcucaaaggucuguguggaggcuggaggucgagguugaaucaucugagcuucuuggcucuucugcagacuagguugacucuggauuccgacugugaaucugugccccugcgugcuuccaggaauuucuugccggugaacacacacacacuguuuaaaauggggugggaagauccagagccgggacaggagcaauagaugggauaggggaggggaaaaggcgacgccuccucgucccugagcccccucaaccuucucccuucaccggcccauuccaggguggcuucaguguuagucgugcucucggguccuugcccuauucgggccccgcccggccccgcccucuccccacagcuccgggcagacccgcccgaguuacaagagccgccuccgcgcacgggggcccggccacuuggagcagcucugccgcggggacugcacuguccgcccugccagacccgccccgacuggggcucgccgucgccagcagucagcacugcgaccucgggcccuucgccggcuauggcugcguccuggggcugagcccgcagguagggaagcggagcgcugggcgguaagguguggggccaggguucgggcgaccaggggagagagggacucggacaaggugcauuugcgguagugucacuacgaggguuccgacuguugggagcaaaccuggccgcuugcggccgccggggcaggcgacgcgucacgcuucgggaguaaagcucuuucuccggaguuggggccaaguuuaacuaaguuagaaaaucgcuucgaagugugcuuugcugcgcuuuuaguuuuuucccgcggauguauugucguuccaacugcagugcagggcguuccugaucugguggucccugaccgauuccaucucuuuggggcggcggcucagagcgcuacuugguuccuauaccauguuuacuggagaaguuuccaagagccccaucgccccucccgcgccccugcaccgcgugcccccucugcugucuuucgcggcuccccacaccuccaucucgaacuucgcguccggauuccccucggccccacccugcucuguaccaccagccucucccuuucuggcuccuagcggcgacuuuaacagcuccccuucaacugccccgcccuagucuugccccucuguguuuccagauccagaaaacucccuucuuucuccagggcgucggagccuggaaguuugcagcgugccucccugugggaugggugggagugggagggggggugggggacauaauuagggagauuccugcgcugggugggcggggagggggcugugcaaucgacacaguccccagaaccucccuugcuccuucuaggggcggugcuuucuccccaccccaccccacucccaaacucguccgggcgggauggcccccgccccagcgccuggcuggauuccagcagccugaggaauguagugguuggagccggugacuaauucaaaccagaauucgggggugggggugggggugaggggcaaagcggagggggaaagaggccguguguaggcggugggggccggagcgcagggcguaggugaaggacuucccugcucuccuuuggaacccuucacuuuugcagugcgcgccagcggagagggcggggggcaagauccuacugugggguuggaaaggcaacaugcuuagggugugugcagagagcuguguuauguaaggcuuucccaugcagggaggggaugugcagugugcgggagccugggccuccucuggcuggagccccuuucagugccgaggcagauuugggggacgcagaaccuugguggcguuggguugacaucagggcuagcuguacauggcgaugagcacugaagacucuuggggugacccggggauauccuacaagucaaauggaguggagccuugacaacguagugucccugguaugugugugugugugugugugugugugugugugugugugugugugcuugccugcucacucuauugucacuucugcacaaugugaccacagaagauugugcgcaugaugucuggguuggcacccugguuuggcaggguguggcccuaggcugucucugaggacacacguguccagggguacuugucucaaugucccuguucuguggaggggauuugcagaaaagcuucuggagguaguuggggggaugggggugggggauccuuggaaagugaccuggaauucccaggagaaaaaggacucccaacaaaugguuuugaaacaguuugcccuuaaacuuuagcaauggcaggaaccaucuuacuguaccuaacguauacuagaugggaugaauucacaagauccaaugauucauguccucauaucaaugauacuguccucauaggugacugggagaggggagggcacacaggaa

SEQ ID NO: 10908 - RNA, 2501 nt, Mus musculus
uuccugugugcccuccccucucccagucaccuaugaggacaguaucauugauaugaggacaugaaucauuggaucuugugaauucaucccaucuaguauacguuagguacaguaagaugguuccugccauugcuaaaguuuaagggcaaacuguuucaaaaccauuuguugggaguccuuuuucuccugggaauuccaggucacuuuccaaggaucccccacccccauccccccaacuaccuccagaagcuuuucugcaaauccccuccacagaacagggacauugagacaaguaccccuggacacguguguccucagagacagccuagggccacacccugccaaaccagggugccaacccagacaucaugcgcacaaucuucuguggucacauugugcagaagugacaauagagugagcaggcaagcacacacacacacacacacacacacacacacacacacacacacauaccagggacacuacguugucaaggcuccacuccauuugacuuguaggauauccccgggucaccccaagagucuucagugcucaucgccauguacagcuagcccugaugucaacccaacgccaccaagguucugcgucccccaaaucugccucggcacugaaaggggcuccagccagaggaggcccaggcucccgcacacugcacauccccucccugcaugggaaagccuuacauaacacagcucucugcacacacccuaagcauguugccuuuccaaccccacaguaggaucuugccccccgcccucuccgcuggcgcgcacugcaaaagugaaggguuccaaaggagagcagggaaguccuucaccuacgcccugcgcuccggcccccaccgccuacacacggccucuuucccccuccgcuuugccccucacccccacccccacccccgaauucugguuugaauuagucaccggcuccaaccacuacauuccucaggcugcuggaauccagccaggcgcuggggcgggggccaucccgcccggacgaguuugggaguggggugggguggggagaaagcaccgccccuagaaggagcaagggagguucuggggacugugucgauugcacagcccccuccccgcccacccagcgcaggaaucucccuaauuaugucccccacccccccucccacucccacccaucccacagggaggcacgcugcaaacuuccaggcuccgacgcccuggagaaagaagggaguuuucuggaucuggaaacacagaggggcaagacuagggcggggcaguugaaggggagcuguuaaagucgccgcuaggagccagaaagggagaggcuggugguacagagcaggguggggccgaggggaauccggacgcgaaguucgagauggagguguggggagccgcgaaagacagcagagggggcacgcggugcaggggcgcgggaggggcgauggggcucuuggaaacuucuccaguaaacaugguauaggaaccaaguagcgcucugagccgccgccccaaagagauggaaucggucagggaccaccagaucaggaacgcccugcacugcaguuggaacgacaauacauccgcgggaaaaaacuaaaagcgcagcaaagcacacuucgaagcgauuuucuaacuuaguuaaacuuggccccaacuccggagaaagagcuuuacucccgaagcgugacgcgucgccugccccggcggccgcaagcggccagguuugcucccaacagucggaacccucguagugacacuaccgcaaaugcaccuuguccgagucccucucuccccuggucgcccgaacccuggccccacaccuuaccgcccagcgcuccgcuucccuaccugcgggcucagccccaggacgcagccauagccggcgaagggcccgaggucgcagugcugacugcuggcgacggcgagccccagucggggcgggucuggcagggcggacagugcaguccccgcggcagagcugcuccaaguggccgggcccccgugcgcggaggcggcucuuguaacucgggcgggucugcccggagcuguggggagagggcggggccgggcggggcccgaauagggcaaggacccgagagcacgacuaacacugaagccacccuggaaugggccggugaagggagaagguugagggggcucagggacgaggaggcgucgccuuuuccccuccccuaucccaucuauugcuccugucccggcucuggaucuucccaccccauuuuaaacaguguguguguguucaccggcaagaaauuccuggaagcacgcaggggcacagauucacagucggaauccagagucaaccuagucugcagaagagccaagaagcucagaugauucaaccucgaccuccagccuccacacagaccuuugagcuuucucucaagcucagauacauuaaucccaggccccagccuccucucccaguucccaggcuucuugcagccucgccccguuccucgccuucaggcucuc

SEQ ID NO: 10909 - RNA, 2501 nt, Mus musculus
auugcuuuagauggcuuccucgcguggauauugaggguuuacugggggaugagguccauuguuugguggcuguugacagucaccccaagguaguguccucauuucuagcuaccugggaugccugguuaaagaccggugacgucccuaacuacauuucucagccuuucagggcucagacuugggcucauuucgggccccugcgggugugccugggcgcagcggccugcaggacucccgugcgcgcuggguccccaucccccgccuucucaguugagccgagaguccgagaaacugggggggggggggggcagugccccgggggcagugccgggcgugguggccccaggcccucgaggguggggcaagccccuucgcgacaccgcccuccccgggcagccaauagauguggaggcgccgcgccuggauuggagcgagagcgggacuggccagcgcgggggccgggacgaggggcgggcgaggcgagcgcugucagcgcgguuauaagggagggaaaaguucccugcgcggagagccgggcaggcgcacgcucuuacggcggccgcagcggcagggcggggccgguggggcgggcggaggaagaccccugauugccaccucgccucccucagugucucucuuagaccuuggucacguaccgggguccggaggacuuguguacagcggcaaugggcggugucggggagcccggagggggacccgggccgcgggaggggcccgcaccgcugggggcgccccuacccaucuuccgcugggagcagauccgccagcaugaccuaccaggcgacaaguggcuggucaucgagcgccgugucuacgacaucagccgcugggcacagcggcacccaggggguagccgccucaucggccaccacggugcggaggacgccacgguaagcuaacccacagccggcgggguggagccuggcacuagcgguggagagggagacguuguucauaggcuuggcgucucauuccaccugcggaccuuagcauccuuuuugcucuuucugaccuuugaccccuucccuggcuccagaguugagauggagccugagggaaggaggucucuuucuuucacggaggaugggcuguuugggucagucuguggaauaaauagaucucagggaagaaugggcccccagaggugggugugccgugaggggcagauucugccccagguaaguacccucacuguuguacugaggguuucuuuucugcucugagugucacagacuauuuucuggugcuuccaagagccuggggcagggcugggucccuagcgauagggacgugccaucagaaacugggggcugggcagcagagcuugggcagggccuggaggucuguggcuuauccagcacuuguguagacuguucugagggccagugacucaccucugcugggcuggcagcuacacgugggaagacuuugccaggcugggugggccuccacgggaagcacagucaccccagucaccgacuagccccuggggacucuggcuucccauucucaguccgugucuagacaagaagggauggaacuggccugaaggacuaucuggcuagagcccaguggugaagcaauuucccagacccuuccuccuucagucccacuccauggacaaagguugaggccauggugcucugcccucgacuauccaaaauuguagguuagucacauuggguacccggaaggucuuuaagacuggagggaaugauucucuaguggaagaacuugguggcagcagaggagguucucugugucccaggacugucauugucccucuccucccggauucacuccaggcaacugagagggauaagaaugagacaauuccugaaaaucaucaaccugugggccagugugugugugugugugugugugugugugugugugugugagccuuccuucuuucuaccagagcaugaugggcaugaggugccacagccccucccacugagcccuggcaguccugugaggaucguguuguagcguaggacagaaugcugggcaggagaggaggacaacagagagcacugacugcuuuuucuugcucagggccagccaggaggccccuccuacaugggauuucuaacuuuauauuuagcucagugccccgagaccuccaucuaaugguuuugcuccagccaccauuuugauucacagccaguaaggucuguaaagaaaacaucacucuacaucuuguaguaggguucuagcucugccauugaaggcacucagagguaauuccucugaaccuuagcuuugucauuggacggguggggagagcuaggcuauauagcaagccagccaagggcaagaccacaccuucuccaccaugcugcuguguuguagauguuuguucaguagcugcucuuuagacuauauguaugcagacuggagagugcagugggacagucauagcacucccaagccuuuucugggagagcuugucucugacccugccaguaauaggaaaa

SEQ ID NO: 10910 - RNA, 2501 nt, Mus musculus
uuuuccuauuacuggcagggucagagacaagcucucccagaaaaggcuugggagugcuaugacugucccacugcacucuccagucugcauacauauagucuaaagagcagcuacugaacaaacaucuacaacacagcagcaugguggagaagguguggucuugcccuuggcuggcuugcuauauagccuagcucuccccacccguccaaugacaaagcuaagguucagaggaauuaccucugagugccuucaauggcagagcuagaacccuacuacaagauguagagugauguuuucuuuacagaccuuacuggcugugaaucaaaaugguggcuggagcaaaaccauuagauggaggucucggggcacugagcuaaauauaaaguuagaaaucccauguaggaggggccuccuggcuggcccugagcaagaaaaagcagucagugcucucuguuguccuccucuccugcccagcauucuguccuacgcuacaacacgauccucacaggacugccagggcucagugggaggggcuguggcaccucaugcccaucaugcucugguagaaagaaggaaggcucacacacacacacacacacacacacacacacacacacacuggcccacagguugaugauuuucaggaauugucucauucuuaucccucucaguugccuggagugaauccgggaggagagggacaaugacaguccugggacacagagaaccuccucugcugccaccaaguucuuccacuagagaaucauucccuccagucuuaaagaccuuccggguacccaaugugacuaaccuacaauuuuggauagucgagggcagagcaccauggccucaaccuuuguccauggagugggacugaaggaggaagggucugggaaauugcuucaccacugggcucuagccagauaguccuucaggccaguuccaucccuucuugucuagacacggacugagaaugggaagccagaguccccaggggcuagucggugacuggggugacugugcuucccguggaggcccacccagccuggcaaagucuucccacguguagcugccagcccagcagaggugagucacuggcccucagaacagucuacacaagugcuggauaagccacagaccuccaggcccugcccaagcucugcugcccagcccccaguuucugauggcacgucccuaucgcuagggacccagcccugccccaggcucuuggaagcaccagaaaauagucugugacacucagagcagaaaagaaacccucaguacaacagugaggguacuuaccuggggcagaaucugccccucacggcacacccaccucugggggcccauucuucccugagaucuauuuauuccacagacugacccaaacagcccauccuccgugaaagaaagagaccuccuucccucaggcuccaucucaacucuggagccagggaaggggucaaaggucagaaagagcaaaaaggaugcuaagguccgcagguggaaugagacgccaagccuaugaacaacgucucccucuccaccgcuagugccaggcuccaccccgccggcuguggguuagcuuaccguggcguccuccgcaccgugguggccgaugaggcggcuacccccugggugccgcugugcccagcggcugaugucguagacacggcgcucgaugaccagccacuugucgccugguaggucaugcuggcggaucugcucccagcggaagauggguaggggcgcccccagcggugcgggccccucccgcggcccgggucccccuccgggcuccccgacaccgcccauugccgcuguacacaaguccuccggaccccgguacgugaccaaggucuaagagagacacugagggaggcgagguggcaaucaggggucuuccuccgcccgccccaccggccccgcccugccgcugcggccgccguaagagcgugcgccugcccggcucuccgcgcagggaacuuuucccucccuuauaaccgcgcugacagcgcucgccucgcccgccccucgucccggcccccgcgcuggccagucccgcucucgcuccaauccaggcgcggcgccuccacaucuauuggcugcccggggagggcggugucgcgaaggggcuugccccacccucgagggccuggggccaccacgcccggcacugcccccggggcacugcccccccccccccccaguuucucggacucucggcucaacugagaaggcgggggauggggacccagcgcgcacgggaguccugcaggccgcugcgcccaggcacacccgcaggggcccgaaaugagcccaagucugagcccugaaaggcugagaaauguaguuagggacgucaccggucuuuaaccaggcaucccagguagcuagaaaugaggacacuaccuuggggugacugucaacagccaccaaacaauggaccucaucccccaguaaacccucaauauccacgcgaggaagccaucuaaagcaau

SEQ ID NO: 10911 - RNA, 2501 nt, Mus musculus
ccccgccguaacagcgaguuuauucccggugucguuuucuuguccauuuuccugaccacggaaauaaugagacaaaacaugcuccuucccuuaccaucgaaggcaaguuuuccucaaaaggcaggcggcugcggacuccgggggacugaagccugggcucugaaguccauuucugucacucuguugggcuucucccggauuaggucguccagguccugcuccagaaaagaggugaacccuacuuccucuuugccuaaaauuaguuuucacugaccacguuugcuccucucucccauaacuuaccgacuuuuauuacaauagaaacucuuaccugaaaaugggcuuucauuaauuaaucugauuuacaagauaguauaaacacagacaccaggaaguuacauuuauucagaccagugcagcauuuagcucaaugccaaguuugcugaccuuccuggagcacccucucggucugggaccauugucucagucucucgacaggcgccuucucaccggucgcgggguccccuaagaaugcaccaacaccgaguguagggagcuccccuugcugucagcccugccggcugcggugggcuccaagagaggggcugugggugaggcggcggccgcgcacacgguggagggagcaggcagcugcugcgacgccguggggacagacaacgccggcggcagcguggucacgggugguagcgcaggcgugggcuugaugggcaccgguacagcuggcaggcucugguuugccgaguggcacagagccuugacuggcaccccgaaugccccauacuccgggccuaccgggaccccagcugcggcggcagcagcggcagccgcggcuaccgaauccaucacgccaacaugaggccacacggagccgacaacauugcugagcuggcccggcacgggguagcccaaguggugcaugaccgacgccaaaggcaacccuccagccugcagcacgcccuuguagucccgcccgaugauguucucuauggcgaacggauguuugaagccugugguggacgcggcggcugcagcggcggcggcggcggccgagcccagcccguagggugggaacugagacagacgccccacgcugcccaccgcugcggccgccgccgcugcugcggccgccgccacggccgccgccuccugcaucuugccgggaugggacgucugcggaggcugcgacugcggcuguggcugcugcgcgggcugcgacgggagguguggaggcugcggagccggagccggcugcugguggaaauagggcaccaugugcggcggcggcggcgggggcggcugcggcggguggugaugguggugauggugugcggcgugguggugauggugguggugguggugugcgugguggggaugguggggaugcaggugaccuccuggccccgugccgggcgcgcccuugcugcuuccugaguguaggugagcguggucugcgcguagcaccuugaagcgcuugcggcgccgcaggaagcugccguucucgaacaugucaccgcagucaggguguagcgcccagaagcugcccuuaccggguugguccggccuccgagggaucuugaugaaacagucguugaaggagagguuguggcgcaggcuguucugccagcgcugcgugugcucgcgguaguaggggaagcgcuccaugaugaacuuguagaugucgcucagaggcagcaucuucucagccgaaugcuggauggccauggcggucagugagauguaagaguagggcggcuuuuggucgcuguaggaacucuucccuggccguggcaucuucccaggcucuuccacuuccguccggcccacagugggccuuaacgccucucggaaagccggauaccaggcuuaaguguccccacuaauucucucuccaccugcgcagccugauccccagcuuucuugguccccagaccccuuuugccuugguccuccuccuucggggagcugccccggguccccgcaauuggcuuuuugagccaauacaguuuuauggcgcucacaacuucuggucuugacugucgugggcaggcccucacaguagccagagagacucgccagcuuuaccuugcuuuucuccgucucguccuccucuuggaugacuagacuugagcucuggagcgaaaggcuguggaaugaguuucuuuuuggucucuuuucccuuuaucgguacaaaggcagcucagaucaaaccaacuggauaaugaagacuggcuuuuuaagcucgaguccacacuagcugucccgaggccacuggugaccgaucuuucgacccuggaagcugaccugguacugggucuguccgcgcuggaguucaaaucuuacaaaaagggguagacaggguaagaagagagagagggagcgcgcacuuuccuauccgcuacuguacguacguacccucuuuuuucaggagaucugcaggcaagcugaaaauggaagaggcaccgagcucuagguggugguuc

SEQ ID NO: 10912 - RNA, 2501 nt, Mus musculus
gaaccaccaccuagagcucggugccucuuccauuuucagcuugccugcagaucuccugaaaaaagaggguacguacguacaguagcggauaggaaagugcgcgcucccucucucucuucuuacccugucuaccccuuuuuguaagauuugaacuccagcgcggacagacccaguaccaggucagcuuccagggucgaaagaucggucaccaguggccucgggacagcuaguguggacucgagcuuaaaaagccagucuucauuauccaguugguuugaucugagcugccuuuguaccgauaaagggaaaagagaccaaaaagaaacucauuccacagccuuucgcuccagagcucaagucuagucauccaagaggaggacgagacggagaaaagcaagguaaagcuggcgagucucucuggcuacugugagggccugcccacgacagucaagaccagaaguugugagcgccauaaaacuguauuggcucaaaaagccaauugcggggacccggggcagcuccccgaaggaggaggaccaaggcaaaaggggucuggggaccaagaaagcuggggaucaggcugcgcagguggagagagaauuaguggggacacuuaagccugguauccggcuuuccgagaggcguuaaggcccacugugggccggacggaaguggaagagccugggaagaugccacggccagggaagaguuccuacagcgaccaaaagccgcccuacucuuacaucucacugaccgccauggccauccagcauucggcugagaagaugcugccucugagcgacaucuacaaguucaucauggagcgcuuccccuacuaccgcgagcacacgcagcgcuggcagaacagccugcgccacaaccucuccuucaacgacuguuucaucaagaucccucggaggccggaccaacccgguaagggcagcuucugggcgcuacacccugacugcggugacauguucgagaacggcagcuuccugcggcgccgcaagcgcuucaaggugcuacgcgcagaccacgcucaccuacacucaggaagcagcaagggcgcgcccggcacggggccaggaggucaccugcauccccaccauccccaccacgcacaccaccaccaccaccaucaccaccacgccgcacaccaucaccaccaucaccacccgccgcagccgcccccgccgccgccgccgcacauggugcccuauuuccaccagcagccggcuccggcuccgcagccuccacaccucccgucgcagcccgcgcagcagccacagccgcagucgcagccuccgcagacgucccaucccggcaagaugcaggaggcggcggccguggcggcggccgcagcagcggcggcggccgcagcggugggcagcguggggcgucugucucaguucccacccuacgggcugggcucggccgccgccgccgccgcugcagccgccgcguccaccacaggcuucaaacauccguucgccauagagaacaucaucgggcgggacuacaagggcgugcugcaggcuggaggguugccuuuggcgucggucaugcaccacuugggcuaccccgugccgggccagcucagcaauguugucggcuccguguggccucauguuggcgugauggauucgguagccgcggcugccgcugcugccgccgcagcuggggucccgguaggcccggaguauggggcauucggggugccagucaaggcucugugccacucggcaaaccagagccugccagcuguaccggugcccaucaagcccacgccugcgcuaccacccgugaccacgcugccgccggcguugucuguccccacggcgucgcagcagcugccugcucccuccaccgugugcgcggccgccgccucacccacagccccucucuuggagcccaccgcagccggcagggcugacagcaaggggagcucccuacacucgguguuggugcauucuuaggggaccccgcgaccggugagaaggcgccugucgagagacugagacaauggucccagaccgagagggugcuccaggaaggucagcaaacuuggcauugagcuaaaugcugcacuggucugaauaaauguaacuuccuggugucuguguuuauacuaucuuguaaaucagauuaauuaaugaaagcccauuuucagguaagaguuucuauuguaauaaaagucgguaaguuaugggagagaggagcaaacguggucagugaaaacuaauuuuaggcaaagaggaaguaggguucaccucuuuucuggagcaggaccuggacgaccuaauccgggagaagcccaacagagugacagaaauggacuucagagcccaggcuucagucccccggaguccgcagccgccugccuuuugaggaaaacuugccuucgaugguaagggaaggagcauguuuugucucauuauuuccguggucaggaaaauggacaagaaaacgacaccgggaauaaacucgcuguuacggcgggg

SEQ ID NO: 10913 - RNA, 2501 nt, Mus musculus
caggcacccgggauuggaggugaggacggugcgcgagccaaccagcggccgccccgggucccccgugagccccgggccaacgcgcggagcagucgagccccuggagccauccggauggcggcggcgacagccccagccccagccacucacgcacgcacgcugccacuugcccccgcacccuccucacugcgcgcgggagagcggugcgugccugagcugcugggcugagcucccccgcugggguccccgcgccgcucggccgcgcuccugcggccgcccgggugguugcccccaaaccgcucacuugagcuguccucgguggcgaacgggcuccccgcccccuccucccgcgccguucccuccccucucccuccccuucucugcaacgccugcauuauuuuccgcccgcaggguccgcgcgcacaccgcggccgcggcgggggaggugaccgggugggugguuggguggguggcuggcggggaguagagugugcaaguugcagggaaagggugcccgcuccuugcgugcucuccgugcucccggcucuucacuccuucccccuccuccucgucuccucccuccccgcccccaccuccuucuuccucuccgaagggcugguaacuuguugugcggagcgaacggcgacaacgacggcgcgacggaggcaccauccgggcgggcagcaugggcacguccgcgcgcugggcgcuguggcugcugcucgcgcugugcugggcgccccgggacagcggcgccacugcaagcggugaguggggacgcgccccuccgcacucggcccgaaacaagccgaggcguccgcgaucgccgcguucugggggaccccggggcuccucuugcccauccccuccuagcaggcgccucuccacgcuccucuccugccuccccuccccacccggguggcgccucugagcugucagagccgagguuacugggagccaggcccgggggacggugggguuuaggguguccuaaagcgucccuugaacuuguugucauucuucugugucccccuucuucccagaaccucuguuuuacaugguuuucaccccccauugacaagggcuaggggaugugggcuuuggagccacugaacaaugguucugccuccucugccaggcgggcuguuaggaccguggcagagcacggggccuggaagcccgagugcgccccucagacuuaagcaggguugagagcgcacagugggugaaggugggcgucuccgaggacaccgggcgccaggugccggccgagccgggaguccucgcgcugccgugagcaagcgcacguucggugggcggcagccuggaggccgagccaugacaaguacgcagccugcgcccgggacugagacuccccaggcgccgggccgucucucgggcuccaagaguggcuuucaacuggacuguccuccgagugcuuuucuuucucccauccccggggauuccgcagcuacugcggcuuuuaaaaaccucuggggucucugagauaacugaacgggggaggggagugggaucaagacuuaaucagguuacuuugccgagccucauucugggcaacacuuucccccagagaaacugagucccaguguagugacuguaauuagccuuuauucugcacaauacggcccgaagguguggagcuggagcgugugacuggagcuuggggagggcggggugacuacugucgagucccagggggucggcacacuggcuuuggagcccuguguguuuccagcaccccaucuugggucacacaacuuuccagagcaggugauaagaugccuuccuaacaagguccgcgucugauccuuggcgggccacugaagaggucuuagaggucuuaagaggugacaccaaagugcuugcuugccaaccagcucuagguaauuagggcagaacgcugucccagcucuaaauaguccacaauccacaucuccugucgccggguagcuuagaaggcccgccugcgugcggucacguguguccuggagugagagcgaacuuucaaguguguggucaagcugucugucgagcuaugcugggguguuuaagucucccagcgccccugggccuuugguuccgcuguccggagcgugagaagcugggcagggcuuuucugccccaugcgauuggcugguagcuggauugcguuuagcuuggucacgugucuacgcggaguuaauugagcugccccagcuggguuaccuuuaagaucagccaggcucagaggggccuuucccucuggcgcuuucuccagcugcacucugaaaagggcccagguaucgugacgcuagaauccuuccugugacaaaccucugugcccagagaagcccugcuuaacagaacauuucagacgcugacauuaaucauuaauggaugaguaauguuaacuuauuaaaccaucucucagaagagugacuugacucgggcuauauauuuuguaguauuucaaaacacgaaugcauaaaauccauuacuga

SEQ ID NO: 10914 - RNA, 2501 nt, Mus musculus
ucaguaauggauuuuaugcauucguguuuugaaauacuacaaaauauauagcccgagucaagucacucuucugagagaugguuuaauaaguuaacauuacucauccauuaaugauuaaugucagcgucugaaauguucuguuaagcagggcuucucugggcacagagguuugucacaggaaggauucuagcgucacgauaccugggcccuuuucagagugcagcuggagaaagcgccagagggaaaggccccucugagccuggcugaucuuaaagguaacccagcuggggcagcucaauuaacuccgcguagacacgugaccaagcuaaacgcaauccagcuaccagccaaucgcauggggcagaaaagcccugcccagcuucucacgcuccggacagcggaaccaaaggcccaggggcgcugggagacuuaaacaccccagcauagcucgacagacagcuugaccacacacuugaaaguucgcucucacuccaggacacacgugaccgcacgcaggcgggccuucuaagcuacccggcgacaggagauguggauuguggacuauuuagagcugggacagcguucugcccuaauuaccuagagcugguuggcaagcaagcacuuuggugucaccucuuaagaccucuaagaccucuucaguggcccgccaaggaucagacgcggaccuuguuaggaaggcaucuuaucaccugcucuggaaaguugugugacccaagauggggugcuggaaacacacagggcuccaaagccagugugccgacccccugggacucgacaguagucaccccgcccuccccaagcuccagucacacgcuccagcuccacaccuucgggccguauugugcagaauaaaggcuaauuacagucacuacacugggacucaguuucucugggggaaaguguugcccagaaugaggcucggcaaaguaaccugauuaagucuugaucccacuccccucccccguucaguuaucucagagaccccagagguuuuuaaaagccgcaguagcugcggaauccccggggaugggagaaagaaaagcacucggaggacaguccaguugaaagccacucuuggagcccgagagacggcccggcgccuggggagucucagucccgggcgcaggcugcguacuugucauggcucggccuccaggcugccgcccaccgaacgugcgcuugcucacggcagcgcgaggacucccggcucggccggcaccuggcgcccgguguccucggagacgcccaccuucacccacugugcgcucucaacccugcuuaagucugaggggcgcacucgggcuuccaggccccgugcucugccacgguccuaacagcccgccuggcagaggaggcagaaccauuguucaguggcuccaaagcccacauccccuagcccuugucaauggggggugaaaaccauguaaaacagagguucugggaagaagggggacacagaagaaugacaacaaguucaagggacgcuuuaggacacccuaaaccccaccgucccccgggccuggcucccaguaaccucggcucugacagcucagaggcgccacccggguggggaggggaggcaggagaggagcguggagaggcgccugcuaggaggggaugggcaagaggagccccggggucccccagaacgcggcgaucgcggacgccucggcuuguuucgggccgagugcggaggggcgcguccccacucaccgcuugcaguggcgccgcugucccggggcgcccagcacagcgcgagcagcagccacagcgcccagcgcgcggacgugcccaugcugcccgcccggauggugccuccgucgcgccgucguugucgccguucgcuccgcacaacaaguuaccagcccuucggagaggaagaaggaggugggggcggggagggaggagacgaggaggagggggaaggagugaagagccgggagcacggagagcacgcaaggagcgggcacccuuucccugcaacuugcacacucuacuccccgccagccacccacccaaccacccacccggucaccucccccgccgcggccgcggugugcgcgcggacccugcgggcggaaaauaaugcaggcguugcagagaaggggagggagaggggagggaacggcgcgggaggagggggcggggagcccguucgccaccgaggacagcucaagugagcgguuugggggcaaccacccgggcggccgcaggagcgcggccgagcggcgcggggaccccagcgggggagcucagcccagcagcucaggcacgcaccgcucucccgcgcgcagugaggagggugcgggggcaaguggcagcgugcgugcgugaguggcuggggcuggggcugucgccgccgccauccggauggcuccaggggcucgacugcuccgcgcguuggcccggggcucacgggggacccggggcggccgcugguuggcucgcgcaccguccucaccuccaaucccgggugccug

SEQ ID NO: 10915 - RNA, 2501 nt, Mus musculus
gagacaauucuaaaugcacuucugauauauuaaaugggaaaggcugagccugaaagccccuuuacuaccuuuggugugauauauuuuugaagucagugugguucuucugggauauccaucccccgcggcggcguuguggucauuaccaagguuuucaaugaugcuuuccucaauuuccccucgaggaaaauggcuguggucagagggcaugcauauuccuaagaaaaccagaaauagugauuaauccucaggcuguaguuuguugcugcuaauagccaagacaggagcaguggguuauacagacaccacugugaguuaccucacugcuguugcugccuuucuauuuaccaaaacuccccagagaaagcaguaucaaugaguguacugucgaaucguauggaacgccucagguauagccauuuuaaaugcuuuccuacuaauuguaguggaggcaguagagacuuuucugucuauuuuaauauuacccuuugggcuaggaaaaagaaauccagucacuuaaaagaaauuaaucuuaaaaaauaacuucucugcucugggugcuagcugcgcaaugcaguuccggcugccuggaagacugcgaucucacccgcuaguuacuuuacuguauaauuuugauauuacggagauuuuagugaguugacucuggaaugcugcuguaaccuaggaaguuagccaccccucaaguuuauuucuggagacuucuuugagacauuaacauuuuguggaucugugguugugugugugugugugugggggcaguacuucuuugaagguaguugaggguggagggaaaggggagaagggauggagagcuagggguguaagcgguacagagaucucuuuuaaaagcuggccagcagagauuaaucauucuagcuccccguugacaacaguuguaauagccuuagaggaaagagagacuggcaaagccacgcagaguccaccuuaagaaaaaaacgucuggcuccccuuucagaacgaccucucccccuuucucaagugccccaaggcucccugaagauaauuguuugauggaaggguccacuuucaggucuuguuguuagaucacagagggaggcaaggaaagauaaacuuucaagugcucaaacacaagccagugacgaugugucaggagaacccuugcaugagcacgcguuugcagguggcgccaccuuagcuuugacagaaccagagcauuucauuugauuccuggguccucaaaggcaaggugguucuaauuuaaaaaggaguccaagacucaccauuuuugcaguaguucccggggcagcacauagcgugccucaugcagcgcuuccugcgcuuucggcaagccagacagaucuguacaccuccgacgccggcugccccgcggcuggggcuggagcaguacucgucagagccgcacuccucaucuucagcgcaaggguagggcugugggaagggagcggacuggugagcaacucaagcauccugguacccacaccuucaagguccccaucugccucuucaaaagccccuuaagcgcgcugcucuuaaugcagugauuccaaacacaccccaaaucucacacaccuagaucuuucugagacccccgucgggaucacagcaccccucuuaccugguaguugucaagagucugguacuuguucccgcccucauagagaacucccggcgccacacugacagcagagcccggcugccccccagcaccacccagcggugggggcagguucuugaucgcguuggaauugaugagaacugaguucaagguggcacuggcuccuagcagagggaggcugcagagagccaucauuguaaacacggccaagaaccggacagcugccgcugcacacacaaccaucaucuccgaaggacgcaaacaggcaaaggucaggaaaagagaggucacuuugcacggcggcuggcugcagagucuggacugcggaaccucaacuucgggaccuccgcugguggagucucuggcugccaggcgcacagcucugcaccgccaccgccaccucuggcugccuuuauacucaggcucccagcccucccagcuccucagggaagacaacaaagccgggaugggauuucaaagcuuugggaggagcugggagggggaguguuugugugucggaagcagggaggacuuugacacucuccccucgccccucccuugcacugugguccccuuguccagcucaccuuagagugugggucacuagagcacuagagcauuagagccuagcccaaacuuauaaauaaauaaauaaauaaauaaauaaauggcgggagggugcacucugugagcuugaguguucugcuguggggcuggguuaguucugucugaaauccuugucagaguuaaaagugauagaauauacaaaaccacguuucuucucuuccccauaugaguacccucgcuuucugcgcacgcaaauaauauucaguauuaaauacaaugcgagcagccauucauc

SEQ ID NO: 10916 - RNA, 2501 nt, Mus musculus
gaugaauggcugcucgcauuguauuuaauacugaauauuauuugcgugcgcagaaagcgaggguacucauauggggaagagaagaaacgugguuuuguauauucuaucacuuuuaacucugacaaggauuucagacagaacuaacccagccccacagcagaacacucaagcucacagagugcacccucccgccauuuauuuauuuauuuauuuauuuauuuauaaguuugggcuaggcucuaaugcucuagugcucuagugacccacacucuaaggugagcuggacaaggggaccacagugcaagggaggggcgaggggagagugucaaaguccucccugcuuccgacacacaaacacucccccucccagcuccucccaaagcuuugaaaucccaucccggcuuuguugucuucccugaggagcugggagggcugggagccugaguauaaaggcagccagagguggcgguggcggugcagagcugugcgccuggcagccagagacuccaccagcggaggucccgaaguugagguuccgcaguccagacucugcagccagccgccgugcaaagugaccucucuuuuccugaccuuugccuguuugcguccuucggagaugaugguugugugugcagcggcagcuguccgguucuuggccguguuuacaaugauggcucucugcagccucccucugcuaggagccagugccaccuugaacucaguucucaucaauuccaacgcgaucaagaaccugcccccaccgcuggguggugcuggggggcagccgggcucugcugucaguguggcgccgggaguucucuaugagggcgggaacaaguaccagacucuugacaacuaccagguaagaggggugcugugaucccgacgggggucucagaaagaucuaggugugugagauuugggguguguuuggaaucacugcauuaagagcagcgcgcuuaaggggcuuuugaagaggcagauggggaccuugaagguguggguaccaggaugcuugaguugcucaccaguccgcucccuucccacagcccuacccuugcgcugaagaugaggagugcggcucugacgaguacugcuccagccccagccgcggggcagccggcgucggagguguacagaucugucuggcuugccgaaagcgcaggaagcgcugcaugaggcacgcuaugugcugccccgggaacuacugcaaaaauggugagucuuggacuccuuuuuaaauuagaaccaccuugccuuugaggacccaggaaucaaaugaaaugcucugguucugucaaagcuaagguggcgccaccugcaaacgcgugcucaugcaaggguucuccugacacaucgucacuggcuuguguuugagcacuugaaaguuuaucuuuccuugccucccucugugaucuaacaacaagaccugaaaguggacccuuccaucaaacaauuaucuucagggagccuuggggcacuugagaaagggggagaggucguucugaaaggggagccagacguuuuuuucuuaagguggacucugcguggcuuugccagucucucuuuccucuaaggcuauuacaacuguugucaacggggagcuagaaugauuaaucucugcuggccagcuuuuaaaagagaucucuguaccgcuuacaccccuagcucuccaucccuucuccccuuucccuccacccucaacuaccuucaaagaaguacugcccccacacacacacacacacaaccacagauccacaaaauguuaaugucucaaagaagucuccagaaauaaacuugagggguggcuaacuuccuagguuacagcagcauuccagagucaacucacuaaaaucuccguaauaucaaaauuauacaguaaaguaacuagcgggugagaucgcagucuuccaggcagccggaacugcauugcgcagcuagcacccagagcagagaaguuauuuuuuaagauuaauuucuuuuaagugacuggauuucuuuuuccuagcccaaaggguaauauuaaaauagacagaaaagucucuacugccuccacuacaauuaguaggaaagcauuuaaaauggcuauaccugaggcguuccauacgauucgacaguacacucauugauacugcuuucucuggggaguuuugguaaauagaaaggcagcaacagcagugagguaacucacaguggugucuguauaacccacugcuccugucuuggcuauuagcagcaacaaacuacagccugaggauuaaucacuauuucugguuuucuuaggaauaugcaugcccucugaccacagccauuuuccucgaggggaaauugaggaaagcaucauugaaaaccuugguaaugaccacaacgccgccgcgggggauggauaucccagaagaaccacacugacuucaaaaauauaucacaccaaagguaguaaaggggcuuucaggcucagccuuucccauuuaauauaucagaagugcauuuagaauugucuc

SEQ ID NO: 10917 - RNA, 2501 nt, Mus musculus
uuaauuuucaccuccuccuuuucauacuauuuucauacuaucuccuuuugcagaagacaaaacgggaagucuaagacugaaaguuacucucacccucuguuaagaagaggcuauaugcuuggcaugugugucuucauuaagaaaauaaacuauaggaaaacuccaggcugcaggggcagccuuuuaagggucaguugugcuagccaagaauagacucuaccuuaaaauggagcuuaguuuaucagcuucccuaaugcacuaacuuggcuuaucaaggcguuacucugauucuaaguuacccuacgcauagcacuccaacaauacagaagagacuggucuuaauccccuagaaaaguaaccuacagagcaaguuuuucacgugcuucuuaugucaaaaccagacaaaaagcagugugaauaagcagucagcuagccccuagccuucuucccaaaguuacucccuagccccccugcccaauaccugacaccaaauugcucuugccauggcaagacugguagaugcuucaaagaacacugagaagccacagacacacacacacacacacacacacacacacacacacacacacacacacuuccuuuuuaguuuuuuuuuuaauucaucaggcccaccaggagcuaaugcuuguuuaguucauguucuuuuuauuuuuaaaauacaaauaaaacuuuuuucaauauaaauauaucauuucauucaaaaguagaaaaaauauacuauaaccuuggucacugcccagcaggaacaaauuugauuauuuaaagagucagaaaucaggucuucucucaacaugugagguuagagcccaguuccagugcgauuucauacauaggaaagucuugguucuagaaacaaaucauuucagagaucauaaugauucaaauacaccacgcugaaugucuaccuuguguccuggagucaaugacacugggauaaguugaaauuuaacaccaagaccacaauuaaauucacauagaaacauuauauaaauuacuuugucaggcugcagaaacaacauuagauuuuauagcagugugcaucacuuuaaaaguuacaaacuucuaauaaaguaacucaagucuguuucuucuucuggaucaaguguacagcgcaucgcucucuggaguucacgcagcgcucaccgcaggcgcaaaggcucucuggcaggggcgcggaccgcagagugcccagcauuuugucccagugugugaaguaaggagcaaaauugcaguuaaacugagagugaugcaugucguggugagccacgcccccguaccagccaaagggcacaagucugugaguggaccacgggaagucauagcccgagugguccuccaccgacagccagauguuaaucacgugaaagguaaagauggugagugggugacaccgaagcaccgcgacguucagcacgucgaagaaggucagcgaaagcagcucccagaagcucauguauugggucgccagcgcgaaggaggacgaguucuggugaugcaccuuguggaaggugcgguacagccagggcaccuuauggugcagcaggugccacgcgaagaucucggugucgaagagcagcaggcagaucaggacgugacuuaggagcuggacgagcucaggggccuccugggggaggagcgccgggcugcgcacccagugcagcagcgucaccgggaacacgaacaccaggugcugguagagugucagccccaggcaaggcagaagcugcuuuacggaaggcgagaaguccggguggaucuuguagcgucgcaggauggggacccagggauacaggacguccagcaccacgaacgguaggcagaagcccacguaagugaugauagaaaaggugacugggaagaugggugagcgcgugaacgccucccuuguccuuauggugucccagaggggcugcaggagcagcuggcuggaacagcccaggucuuggagcuccgaaccguuguagcagcccaugcugagacuaugucccacaauuguggucuccccagccccgccgacuuuucuuaagacuguggccacuccccccagugacgucacccuuccgucuccuucccaccucccuuucccugcuaaagaauuuugcuuaaauaacccgaauuuuguuccugucuauguccugguuuauagcugcaucaaaucuccccuucacgcaagcagcggcccuuaaagcccuuucccagacguaaagaacuguuugcuugccuuucagcugauguacuaaugacacaggagagagcgauucugccuugggacaguucacccgccaucaccgcuaaaaacuaaugaguucuucgcucucagaaggcgcuguuucucaaccaaagcagaauucccuggguuuuaaaauaucuguuuuugacuguuuaaagacuuauucuacaccuugggggacucugagugugcguaccucacgccacagugcugguacuggguccguugcagacagggauugaguccugua

SEQ ID NO: 10918 - RNA, 2501 nt, Mus musculus
uacaggacucaaucccugucugcaacggacccaguaccagcacuguggcgugagguacgcacacucagagucccccaagguguagaauaagucuuuaaacagucaaaaacagauauuuuaaaacccagggaauucugcuuugguugagaaacagcgccuucugagagcgaagaacucauuaguuuuuagcggugauggcgggugaacugucccaaggcagaaucgcucucuccugugucauuaguacaucagcugaaaggcaagcaaacaguucuuuacgucugggaaagggcuuuaagggccgcugcuugcgugaaggggagauuugaugcagcuauaaaccaggacauagacaggaacaaaauucggguuauuuaagcaaaauucuuuagcagggaaagggaggugggaaggagacggaagggugacgucacuggggggaguggccacagucuuaagaaaagucggcggggcuggggagaccacaauugugggacauagucucagcaugggcugcuacaacgguucggagcuccaagaccugggcuguuccagccagcugcuccugcagccccucugggacaccauaaggacaagggaggcguucacgcgcucacccaucuucccagucaccuuuucuaucaucacuuacgugggcuucugccuaccguucguggugcuggacguccuguaucccuggguccccauccugcgacgcuacaagauccacccggacuucucgccuuccguaaagcagcuucugccuugccuggggcugacacucuaccagcaccugguguucguguucccggugacgcugcugcacugggugcgcagcccggcgcuccucccccaggaggccccugagcucguccagcuccuaagucacguccugaucugccugcugcucuucgacaccgagaucuucgcguggcaccugcugcaccauaaggugcccuggcuguaccgcaccuuccacaaggugcaucaccagaacucguccuccuucgcgcuggcgacccaauacaugagcuucugggagcugcuuucgcugaccuucuucgacgugcugaacgucgcggugcuucggugucacccacucaccaucuuuaccuuucacgugauuaacaucuggcugucgguggaggaccacucgggcuaugacuucccgugguccacucacagacuugugcccuuuggcugguacgggggcguggcucaccacgacaugcaucacucucaguuuaacugcaauuuugcuccuuacuucacacacugggacaaaaugcugggcacucugcgguccgcgccccugccagagagccuuugcgccugcggugagcgcugcgugaacuccagagagcgaugcgcuguacacuugauccagaagaagaaacagacuugaguuacuuuauuagaaguuuguaacuuuuaaagugaugcacacugcuauaaaaucuaauguuguuucugcagccugacaaaguaauuuauauaauguuucuaugugaauuuaauuguggucuugguguuaaauuucaacuuaucccagugucauugacuccaggacacaagguagacauucagcgugguguauuugaaucauuaugaucucugaaaugauuuguuucuagaaccaagacuuuccuauguaugaaaucgcacuggaacugggcucuaaccucacauguugagagaagaccugauuucugacucuuuaaauaaucaaauuuguuccugcugggcagugaccaagguuauaguauauuuuuucuacuuuugaaugaaaugauauauuuauauugaaaaaaguuuuauuuguauuuuaaaaauaaaaagaacaugaacuaaacaagcauuagcuccuggugggccugaugaauuaaaaaaaaaacuaaaaaggaagugugugugugugugugugugugugugugugugugugugugugugugucuguggcuucucaguguucuuugaagcaucuaccagucuugccauggcaagagcaauuuggugucagguauugggcaggggggcuagggaguaacuuugggaagaaggcuaggggcuagcugacugcuuauucacacugcuuuuugucugguuuugacauaagaagcacgugaaaaacuugcucuguagguuacuuuucuaggggauuaagaccagucucuucuguauuguuggagugcuaugcguaggguaacuuagaaucagaguaacgccuugauaagccaaguuagugcauuagggaagcugauaaacuaagcuccauuuuaagguagagucuauucuuggcuagcacaacugacccuuaaaaggcugccccugcagccuggaguuuuccuauaguuuauuuucuuaaugaagacacacaugccaagcauauagccucuucuuaacagagggugagaguaacuuucagucuuagacuucccguuuugucuucugcaaaaggagauaguaugaaaauaguaugaaaaggaggaggugaaaauuaa

SEQ ID NO: 10919 - RNA, 2501 nt, Mus musculus
gucaaguccauugaacgaugauucuugaacgcgcuuuccaagccaauggaaaagagcccacgaggcgccugugaauggugagcugggaaggcuucgggcucgggcagcugguucgacccggcucgagggacagcagagagacagcuaggaaacccaggacuccaaauucccacuucuuggaaccccgauccacaacccacuccccccgcccccucccccgcccgaagccgcaccgugguaacucggagcucugcacaccuaggacaaggaaagagguguuccuagucccgcacccccaggaggcgcgcucagagggaagccgccagugcgccgccucugccucggcgcggaacaaacgguuaaagauuuuuuugggcagcgccucgaggggggaggagccaggggcccgauccgcaauuaaagaugaacuuugggugaacuaauuugucugaccaagguaacgugggcaguaaccugggcggccuuauaaagagggcgcgcggcgggguucggagcuagggcggcggcggcagguggcgcgggaggcugaagcgugccauggggcucccggcgcugcuggccagugcgcucugcaccuucgugcugccgcugcugcucuuccuggcggcgcucaagcucugggaccuguacugugugagcagccgcgaucgcagcugcgcccuccccuugccccccgguaccaugggcuucccauucuuuggggaaacauugcagauggugcuucagguaagggagcucgggaagggaccugacgcuucccccggaguccgccucagcucugggccugggcugaaggugggauaaguguccucgcgagggaggcgaccacggcuuggaagaggggcuagacggagaccagaugcuccccggcgcccccucaugcggguugcgggucucucuccuccaccucccucucagcggaggaaguuucugcagaugaagcgcaggaaauacggcuucaucuacaagacgcaucuguuugggcggcccacggugcgggugaugggcgcggauaaugugcggcgcaucuugcugggagagcaccgguuggugucggugcacuggcccgcgucggugcgcaccauccugggcgcuggcugccucuccaaccugcacgauuccucgcacaagcagcgaaagaaggugagggugagcuggcaacuccuuggcuggcagggagaccucauccuauggcuugguucaggcaaauagaugcggggcgagggcuaguccuaugugguggggaccaggacccucucuaucugagauccacuuuagcuuuucugcuagcacguggguuaguccuggggggacugaaauucuugaaaggguacucggaaaggcgaaggggggggggcugagggaaaguagaggauuguaacacucucugcuccuggggggugcucaggugauuaugcaggccuucagccgcgaggcacuccagugcuacgugcccgugaucgcugaggaagucagcaguugucuggagcaguggcuaagcugcggcgagcgcggccuccuggucuaccccgaggugaagcgccucauguuccgcaucgccaugcgcauccugcugggcugcgagccggguccagcgggcggcggggaggacgagcagcagcucguggaggcuuucgaggagaugacccgcaaucucuucucucuucccauugacgugcccuuuagcggccuguaccggguaagggcgguuugcggagucggaguaggggaacgcaagcucgggcauccgcucaccgccacgcucucuccgcgcucagggcgugaaggcgcggaaccuuauacacgcgcgcaucgaggagaacauucgcgccaagauccgccggcuucaggcuacagagccggauggggguugcaaggacgcgcugcagcuccugauugagcacucgugggagaggggagagaggcuggauaugcaggugagaagcaauuucaaaaggugccaagggccggggagugccucugacuuuccagacacacuuucugggggucuccaaagcccugucaaggccccagcuacuuccaagugggcggcgaugcuaggucuagagcuuuucaaccugugggucgugaccccuucacggagccaaacaacccuuucagaagggucgccuaagagcaucugcauauccgauauuuacaucaagaaacauaacaguagcaaaauuaccguuaugaaguagcaacaaagauaauuuuaucguugggggucaccacaacacgaggaaccguauuaaaggguggcauuggucuagagagcuguggaaggggguggcugagcaauggggaagaucccaaaguucaaagggcaaggcucaucuacaaagguuaaagcggaagagcaggauuaagggaguuuugcguuuuuguuuguggucuuugacuuucuaugaacaaaacggauuuuacccuugaagucuuccgugcaauauucucaggucaggucuuuguaacagugcuau

SEQ ID NO: 10920 - RNA, 2501 nt, Mus musculus
auagcacuguuacaaagaccugaccugagaauauugcacggaagacuucaaggguaaaauccguuuuguucauagaaagucaaagaccacaaacaaaaacgcaaaacucccuuaauccugcucuuccgcuuuaaccuuuguagaugagccuugcccuuugaacuuugggaucuuccccauugcucagccacccccuuccacagcucucuagaccaaugccacccuuuaauacgguuccucguguuguggugacccccaacgauaaaauuaucuuuguugcuacuucauaacgguaauuuugcuacuguuauguuucuugauguaaauaucggauaugcagaugcucuuaggcgacccuucugaaaggguuguuuggcuccgugaaggggucacgacccacagguugaaaagcucuagaccuagcaucgccgcccacuuggaaguagcuggggccuugacagggcuuuggagacccccagaaagugugucuggaaagucagaggcacuccccggcccuuggcaccuuuugaaauugcuucucaccugcauauccagccucucuccccucucccacgagugcucaaucaggagcugcagcgcguccuugcaacccccauccggcucuguagccugaagccggcggaucuuggcgcgaauguucuccucgaugcgcgcguguauaagguuccgcgccuucacgcccugagcgcggagagagcguggcggugagcggaugcccgagcuugcguuccccuacuccgacuccgcaaaccgcccuuacccgguacaggccgcuaaagggcacgucaaugggaagagagaagagauugcgggucaucuccucgaaagccuccacgagcugcugcucguccuccccgccgcccgcuggacccggcucgcagcccagcaggaugcgcauggcgaugcggaacaugaggcgcuucaccucgggguagaccaggaggccgcgcucgccgcagcuuagccacugcuccagacaacugcugacuuccucagcgaucacgggcacguagcacuggagugccucgcggcugaaggccugcauaaucaccugagcaccccccaggagcagagaguguuacaauccucuacuuucccucagccccccccccuucgccuuuccgaguacccuuucaagaauuucaguccccccaggacuaacccacgugcuagcagaaaagcuaaaguggaucucagauagagaggguccugguccccaccacauaggacuagcccucgccccgcaucuauuugccugaaccaagccauaggaugaggucucccugccagccaaggaguugccagcucacccucaccuucuuucgcugcuugugcgaggaaucgugcagguuggagaggcagccagcgcccaggauggugcgcaccgacgcgggccagugcaccgacaccaaccggugcucucccagcaagaugcgccgcacauuauccgcgcccaucacccgcaccgugggccgcccaaacagaugcgucuuguagaugaagccguauuuccugcgcuucaucugcagaaacuuccuccgcugagagggagguggaggagagagacccgcaacccgcaugagggggcgccggggagcaucuggucuccgucuagccccucuuccaagccguggucgccucccucgcgaggacacuuaucccaccuucagcccaggcccagagcugaggcggacuccgggggaagcgucaggucccuucccgagcucccuuaccugaagcaccaucugcaauguuuccccaaagaaugggaagcccaugguaccggggggcaaggggagggcgcagcugcgaucgcggcugcucacacaguacaggucccagagcuugagcgccgccaggaagagcagcagcggcagcacgaaggugcagagcgcacuggccagcagcgccgggagccccauggcacgcuucagccucccgcgccaccugccgccgccgcccuagcuccgaaccccgccgcgcgcccucuuuauaaggccgcccagguuacugcccacguuaccuuggucagacaaauuaguucacccaaaguucaucuuuaauugcggaucgggccccuggcuccuccccccucgaggcgcugcccaaaaaaaucuuuaaccguuuguuccgcgccgaggcagaggcggcgcacuggcggcuucccucugagcgcgccuccugggggugcgggacuaggaacaccucuuuccuuguccuaggugugcagagcuccgaguuaccacggugcggcuucgggcgggggagggggcggggggaguggguuguggaucgggguuccaagaagugggaauuuggaguccuggguuuccuagcugucucucugcugucccucgagccgggucgaaccagcugcccgagcccgaagccuucccagcucaccauucacaggcgccucgugggcucuuuuccauuggcuuggaaagcgcguucaagaaucaucguucaauggacuugac

SEQ ID NO: 10921 - RNA, 2501 nt, Mus musculus
uuuguugcuacuucauaacuguaauuuuugcuacugcuaugaaucauaauguaaguaaacgucuguguuuuuagacagcuugagcuggcucccgugaaaaggucauuugacccccaagggucucagaacgcaggucuagagccauugccuuagggcugagauuaguuccuucuuucugagaucucacaauacuucuucccacccuaaauuauuccuuaguuaucaaguagcuuucggaucuauaauuuaagugaaaugggcugggggagucaaagaacaugucaauuguguguccugagaagaaucccaaacuuuagggaacuuuguugggaguucucaaaauccugccuugcauaugaguauuuaaggaaaggagacuauugcuuccagaacacugccuggcugggaguccaccgggaggggccugggcugugacccagcucagacacauaguucccuccucuuggauaucggucucuagcucugccgauguuccagauuguccuacugucucagagauuccacuccaagagacagaguggagugguaaugugugagacagcgugaaguaagucacaguggaugaucagggaaaugguacccgauaagcccaaaggcccuuccgaacuuggauuagguauuuuaggcugagaauccagucgcuucuaaucccacauccccuaaauucagacagggcugaggguucugccucucgaagcccuucccaacggugccgcugaacagaaacgcagugauuuggccauguaugccccacuacucacuuccucgcuggagaaaggaggcuacaccccaguacuucaucuugaacuuggcaggaucuucagugucugugaaagugcccaccaugucugcacacacuucccaguugcugcaaaagccaagagaauccugagccaagccaggaaagggcuucuaccucauccaagguacucuuuucccaucccagugaggguugggcucccagggagccaaaggcaaggugggaggcacuuuggaacgccgcacacagcccaccagaggccacugaccucagaagacggacucgucccuuggcuguggcgcucauaugacccuucucguccacagaaaacucagcgaugauguugucuugcaaaaagagacccucgggguccuuuuuggcgauggcauaccagagcccagagaacugagaaagagaugagagagcuagggacuggagucugggcuccaccucugacccgcaggaaucggggaacccgggcugauaccuacacgagccuugucgaaguucuccuugacucggaagcugcucacccugcagucgcgcucggcgcugccgccucccagagccgccagcagcacgagcgcccacacccacuccaucucaccccggagucugcccugcgggacaggcgcaggguaaacgcggggccggaggaccgaggccgcccgucgcccccucccgccccaccccgcccugcagguccccgggggagcgcgcggcggcucaccagcaggagccgcgugcaagccuggccgccgcguucgcgcgcgcguggagcgacggagccgagcggccgucgguccuuuauagcuccggggggagggggucgcgcuuucguaaccgcgcggggugaaagaccgcggggaggugccgggggcgggaggggggggggcggccgagcuugcauaacgcucccugacucacuccugaacgcacgcggggccccuccgucagccuugccgucccacgucgccuaugcuccgagcuccgcucaggguggucucgguggagccaaacucuccagcccagaggauccaucggggccaagagcuggcccggggacccagcggcagccagcugcagucuuggguggccuccagguccuguugcccuggcuggaggccuacguggccaugguguggugaugguggccucacugagcgaaaagggaccuaugauguagccuggaacauuagcguccaggcccuggcuuucccaaguggccccugcuucuacugaggagcuguugugagaagcuuuuuggcauauuuuggcuguuuuuuuuucccccuuugagaaagggcauauuuuacucuuugaugaguuguggugcuguuugggucaauauuuauucuuucauuucaucaucuuuagaaggacuaaaccgcucccuguuaaauauucucuagaaacgcaaccuggucaggacaggaaauauuuucucagcgccaauggccgagugguugaucguccacuucucuugccacacuccccugaaaccacacugaaaaacauaauugccaaguguuuaccaugcauuuuuauuucuaagccauauuaggauuuauuuauuuccagaacagcgaggaaaacuggcucaggaagagaaaaaggagagggaaagaauuccauaaccuuaaugguaguagccaaaaaaagcuguugaaggguugauuuuuuuuuuuuuuuuuuuuuuuuuuuuuuuuuuuuuuuuuuu

SEQ ID NO: 10922 - RNA, 2501 nt, Mus musculus
aaaaaaaaaaaaaaaaaaaaaaaaaaaaaaaaaaaaaaaaaaaucaacccuucaacagcuuuuuuuggcuacuaccauuaagguuauggaauucuuucccucuccuuuuucucuuccugagccaguuuuccucgcuguucuggaaauaaauaaauccuaauauggcuuagaaauaaaaaugcaugguaaacacuuggcaauuauguuuuucagugugguuucaggggaguguggcaagagaaguggacgaucaaccacucggccauuggcgcugagaaaauauuuccuguccugaccagguugcguuucuagagaauauuuaacagggagcgguuuaguccuucuaaagaugaugaaaugaaagaauaaauauugacccaaacagcaccacaacucaucaaagaguaaaauaugcccuuucucaaagggggaaaaaaaaacagccaaaauaugccaaaaagcuucucacaacagcuccucaguagaagcaggggccacuugggaaagccagggccuggacgcuaauguuccaggcuacaucauaggucccuuuucgcucagugaggccaccaucaccacaccauggccacguaggccuccagccagggcaacaggaccuggaggccacccaagacugcagcuggcugccgcuggguccccgggccagcucuuggccccgauggauccucugggcuggagaguuuggcuccaccgagaccacccugagcggagcucggagcauaggcgacgugggacggcaaggcugacggaggggccccgcgugcguucaggagugagucagggagcguuaugcaagcucggccgccccccccccucccgcccccggcaccuccccgcggucuuucaccccgcgcgguuacgaaagcgcgacccccuccccccggagcuauaaaggaccgacggccgcucggcuccgucgcuccacgcgcgcgcgaacgcggcggccaggcuugcacgcggcuccugcuggugagccgccgcgcgcucccccggggaccugcagggcgggguggggcgggagggggcgacgggcggccucgguccuccggccccgcguuuacccugcgccugucccgcagggcagacuccggggugagauggagugggugugggcgcucgugcugcuggcggcucugggaggcggcagcgccgagcgcgacugcagggugagcagcuuccgagucaaggagaacuucgacaaggcucguguagguaucagcccggguuccccgauuccugcgggucagagguggagcccagacuccagucccuagcucucucaucucuuucucaguucucugggcucugguaugccaucgccaaaaaggaccccgagggucucuuuuugcaagacaacaucaucgcugaguuuucuguggacgagaagggucauaugagcgccacagccaagggacgaguccgucuucugaggucaguggccucuggugggcugugugcggcguuccaaagugccucccaccuugccuuuggcucccugggagcccaacccucacugggaugggaaaagaguaccuuggaugagguagaagcccuuuccuggcuuggcucaggauucucuuggcuuuugcagcaacugggaagugugugcagacauggugggcacuuucacagacacugaagauccugccaaguucaagaugaaguacugggguguagccuccuuucuccagcgaggaagugaguaguggggcauacauggccaaaucacugcguuucuguucagcggcaccguugggaagggcuucgagaggcagaacccucagcccugucugaauuuaggggaugugggauuagaagcgacuggauucucagccuaaaauaccuaauccaaguucggaagggccuuugggcuuaucggguaccauuucccugaucauccacugugacuuacuucacgcugucucacacauuaccacuccacucugucucuuggaguggaaucucugagacaguaggacaaucuggaacaucggcagagcuagagaccgauauccaagaggagggaacuaugugucugagcugggucacagcccaggccccucccgguggacucccagccaggcaguguucuggaagcaauagucuccuuuccuuaaauacucauaugcaaggcaggauuuugagaacucccaacaaaguucccuaaaguuugggauucuucucaggacacacaauugacauguucuuugacucccccagcccauuucacuuaaauuauagauccgaaagcuacuugauaacuaaggaauaauuuagggugggaagaaguauugugagaucucagaaagaaggaacuaaucucagcccuaaggcaauggcucuagaccugcguucugagacccuugggggucaaaugaccuuuucacgggagccagcucaagcugucuaaaaacacagacguuuacuuacauuaugauucauagcaguagcaaaaauuacaguuaugaaguagcaacaaa

SEQ ID NO: 10923 - RNA, 2501 nt, Mus musculus
agcuaccuuaaaguuugggauggcaccugaggugccccucgggguucacaagaggaaaagccagcauuuucuccucugggagucacauuuuaaaaaaguuucagucacucaccaagaacugacagguuuagcaggagaggcgcccuccaacucugcagagggucaaaagagcagaaaagugugcccacugcuuuccccccuacacacacacacacacacacacacacacacacaccacaaacacaauggccgcagggagaucaggagguugcuuaugaccauuucugagaaagcuggagcuauggccaaagaguggccuagcagaaguaguucuggaaaagcaaagcacagaaaccgcaaauaacucuuccuacaaggauggccaugucggccguguccucgggagacuccacgcgguggcaaagggacacuccggucugugcuuggcuccagaaaaagacacuggggugagcgcucccaagaaucccacaacacuccacucuaccaaccugaccuugaguucaaguuggcaaggucgaaucaauugcauguccccauuuaaacucaucucuccccaccuucaagaauucaccaaccagguccccaaccuucauaaucacaaauuaagcaggggaaagcaagcguugucaacccaccaacauaaaucugccaacuuauguucuucacccuagaaccgcucugcucugcaauuguagcaccauauucagaaagcuucuguacccgaaaauaacgagaucauaucuacuauugguuuuucaaguauuguuagaagcccucccgauucccgccccugcgagccacaucuauaaacaauccaagcacacgauaagggcuaagucagguccaaguggauuaaguagcugccacaguucaaccgguagaucccagguccucggcugcuggugcuacucaguagaguccguuuucucuaacagccucucgcggccgguaacuuugaggcuguagcccgagggauggacgacagcuccugcuccgcacagucccgggcaagacacuguuggaucagcguagcggcguccucuuccuccuccagggauccccugucagagccaggcgcccgagggcugcagagugacugaguccgguccgcuucggccacccccggaccccggagcgcucgcggggcucguggccgcaaccgcggcgaccgcucgcuggagucugcgcaccgccuccuugaugagguuuccggagagcacgagcugcugcaggagccggugcgggucgucgucggccgcgcgcgcuccgccugcuguccaccgccgcugcuggauucggugagaagccacggagccggggagccacccucgccgccccggcccgggaagcgcgcuggcacccggggcgaucuccgcaacgcaguagggcgccgaucggccccgcacacgcccgcgcucccccagcacgcagcgcacggcccccggaggcgcaggguccccggucucugcugaccccgucggccgcagcagccgccucgcuggggucccggucuuguccgccgacagcgccgccaggacccgcggaggcgcgggugggggacccggggcggcacacggcgaggccgggcgaucgugcgccguguccagcugcagcgucucgccgaucuggacgaugagccgauccacgucggucgagccgcccagagucaccgacugcugcagcaggaggaagcugucgucguccuccucccccucugccucgucgccggcuuccuccuccuccucucuccggcaaggcauggccccccgcccgggcccccgcggcugugcgggcgucgcuggcagcucgguuggccgcgggcucggcgagccgcggcuggggcgggagcgcggcggaggcccaagccgggccaggagggggccgagccuggggaugcggaagccgggaccaccgggcagagguaccgcgcgccuuagagccgcgggagccggaacgcugccggcuuggguugauuuguaaacaaugggugacgucgcgcggcuccuaccaccgcgcgcgaccguggggggagacguucgcuagaagacuuaggggcgcgggacggcgcaaaccgugcgagaccacugcccacacugucugcccagagauaguuuauaugguugcgagcgauuccggggacggggcaccgacuucgccgagcccagguccuaggaccucucgguccuaggaggcacccucggcgacugccaauuggcugcucccacucgcggacacacccccagcacacccagccccuccucugccgcgcccgcuccagccccacguguggguaacgccugcgcuggcccggggaggggcgaccccgacgguugggaagccgacccuguggucagagcuucucagacuugcuccgguuucucagagcuacaucgaauugacuuuuuuuguaguucaaacgaaaauguucucguaaccauaggauucaaacgagauuaacaggcuuccccccccccccuuca

SEQ ID NO: 10924 - RNA, 2501 nt, Mus musculus
ugaaggggggggggggaagccuguuaaucucguuugaauccuaugguuacgagaacauuuucguuugaacuacaaaaaaagucaauucgauguagcucugagaaaccggagcaagucugagaagcucugaccacagggucggcuucccaaccgucggggucgccccuccccgggccagcgcaggcguuacccacacguggggcuggagcgggcgcggcagaggaggggcugggugugcuggggguguguccgcgagugggagcagccaauuggcagucgccgagggugccuccuaggaccgagagguccuaggaccugggcucggcgaagucggugccccguccccggaaucgcucgcaaccauauaaacuaucucugggcagacagugugggcaguggucucgcacgguuugcgccgucccgcgccccuaagucuucuagcgaacgucuccccccacggucgcgcgcggugguaggagccgcgcgacgucacccauuguuuacaaaucaacccaagccggcagcguuccggcucccgcggcucuaaggcgcgcgguaccucugcccgguggucccggcuuccgcauccccaggcucggcccccuccuggcccggcuugggccuccgccgcgcucccgccccagccgcggcucgccgagcccgcggccaaccgagcugccagcgacgcccgcacagccgcgggggcccgggcggggggccaugccuugccggagagaggaggaggaggaagccggcgacgaggcagagggggaggaggacgacgacagcuuccuccugcugcagcagucggugacucugggcggcucgaccgacguggaucggcucaucguccagaucggcgagacgcugcagcuggacacggcgcacgaucgcccggccucgccgugugccgccccgggucccccacccgcgccuccgcggguccuggcggcgcugucggcggacaagaccgggaccccagcgaggcggcugcugcggccgacggggucagcagagaccggggacccugcgccuccgggggccgugcgcugcgugcugggggagcgcgggcgugugcggggccgaucggcgcccuacugcguugcggagaucgccccgggugccagcgcgcuucccgggccggggcggcgaggguggcuccccggcuccguggcuucucaccgaauccagcagcggcgguggacagcaggcggagcgcgcgcggccgacgacgacccgcaccggcuccugcagcagcucgugcucuccggaaaccucaucaaggaggcggugcgcagacuccagcgagcggucgccgcgguugcggccacgagccccgcgagcgcuccgggguccggggguggccgaagcggaccggacucagucacucugcagcccucgggcgccuggcucugacaggggaucccuggaggaggaagaggacgccgcuacgcugauccaacagugucuugcccgggacugugcggagcaggagcugucguccaucccucgggcuacagccucaaaguuaccggccgcgagaggcuguuagagaaaacggacucuacugaguagcaccagcagccgaggaccugggaucuaccgguugaacuguggcagcuacuuaauccacuuggaccugacuuagcccuuaucgugugcuuggauuguuuauagauguggcucgcaggggcgggaaucgggagggcuucuaacaauacuugaaaaaccaauaguagauaugaucucguuauuuucggguacagaagcuuucugaauauggugcuacaauugcagagcagagcgguucuagggugaagaacauaaguuggcagauuuauguugguggguugacaacgcuugcuuuccccugcuuaauuugugauuaugaagguuggggaccugguuggugaauucuugaagguggggagagaugaguuuaaauggggacaugcaauugauucgaccuugccaacuugaacucaaggucagguugguagaguggaguguugugggauucuugggagcgcucaccccagugucuuuuucuggagccaagcacagaccggagugucccuuugccaccgcguggagucucccgaggacacggccgacauggccauccuuguaggaagaguuauuugcgguuucugugcuuugcuuuuccagaacuacuucugcuaggccacucuuuggccauagcuccagcuuucucagaaauggucauaagcaaccuccugaucucccugcggccauuguguuugugguguguguguguguguguguguguguguguguguaggggggaaagcagugggcacacuuuucugcucuuuugacccucugcagaguuggagggcgccucuccugcuaaaccugucaguucuuggugagugacugaaacuuuuuuaaaaugugacucccagaggagaaaaugcuggcuuuuccucuugugaaccccgaggggcaccucaggugccaucccaaacuuuaagguagcu

SEQ ID NO: 10925 - RNA, 2501 nt, Mus musculus
aaugugguagccuagucagcagagcuuagggcucaggacuguggccccugcucuaugaccaggguggauauuauuugcaggggucaggcacaagccagcauuaacuuucucgaagaaaguccaaacgacucauuuuuaugugaaacauucuaaugucaucuguuggccacucacacuuuucuacaaccugccuuuggguucucuugugugcuggccuccaggugacaagccucgcugugagaaggggagucauggguagcaagguagggccaggacaggguucugagccugaguuuguccugcuguucauguuugggcuccaaagaaacuauaaaaggaaccuggaggauucugggaaccguggauuucuugcuuagcugacucuauuccugccugccacucucagccuucaagauagagacuuuucccucccagaaucccccagagagggagaaggagaaggugggaggcuccuaagaccaagcugauuaauuugagagggguuagggcgauacaaagaggagcucagaugcuuugggaggagugguggggcggggggggggggagauuugaauguuccagcugugggggcucacgggagcgcucacuaucccaguuaacaggcaaagguugccugcugggagcuauggguguguauguggggggcgggggagaugcuaggggcucaggccaguuuggaagaggacaggcauucuuggagaaaggaggaggggguguggcccccagauaugggacagcuuugaggaccugcacaaugaaaaggaagaugaaucagaaaucaggucuaauggcaguauaacgagccagugggaagcagggcuugggagcucaagaugcuggacuucacugcugggcaaagaagguucagaaaaguaaaguacccaaaagccuaggaauugggaggaggggaaguuaggguuacaggccuugaaacgagggcccucagggcuucccuaaccacccgccucuucucaaaguucccgaggucagggaaggaguagcgcuugucugggugucggcaguucaggucaaagaaacugccuagcgaccccaagcauccuugagaugaggaaaggaauacggcauuuaugagggacgucuccaaggcuuccagggauuccgcagcucggaaaaccgagcgugcugugaguugcacaagguacaggucagaguugggagagaacuagugggaauacccagagcuucaaguuuauaaagguuggaaggaaaaaggagacagugccagggcgcuguguauaggggcuuggcaccuaucggggaguacagaugaggguuuggggagaggaucaguccgaggcgcucugggcgcaaaggcgcuaccuggaggcgcgguggcaggcaggugcccgaacugcaccgcgaugcagaggucguuguccagggggaacuuguggcagugcagcaucucgggccaagggaaaccguaggccuccaugagcggagcgcagccggcgcgcacggcuucgcacagcgagcggcagggguagaugggucgguccaggcagacgggagcgaagagcgagcagaggaagaccugggugucugaguggcagcgcuuggccagcaguggcagccagcugcuugccugcugcuucaccucggccaggcucucgugcuccagcagguugggcagccgcaugcgcuuguagcccaccgugugacagagcggcagaucggcggggaugucgaggcacugcgguggcuuggaguaggagcggccgugcagcggcucggccugccaaccguaguagucguacuccuggccgcguguuggcgccccaugcagcgccccgagcagcaacgccagugcggccguccgugcgcuccaggccacccacauggcuggauguugcggccugccccgacggcucggugcucggcgccccgcugcccggcgugcgccccggcugggauguucccugaagccggcugcuacuagggucguccaaguagguggcagucucugcuccgcuccgcugccggagugauccaggcgccucccaccacggggcuccagcccaggcuucgccguucccuagccaaucugcagccgcuggucccccucaccucccacccccgccccggguuggcggaccugggaggaacccugagucuuucccgcccggcucgggucccucgggucccgccucgccucgcgacccugacccgucaacuauucugcugcccagaccucuccuugugccuuuuccugggggcucagcauuuuuuucacccuugcccccugcuucgucuuuuuaucucucuccaccacagucucucuccuguuccuuuucucacucacuucaccugcuuaucucugugccucggccuuucccugcucggcucugguuucccuucuccaacaccuccaucgcucuucucagauaauggagucucuuggccauccacgcccuccuggccaggcaagcagagcuucacccugaggucuuuaaguaugc

SEQ ID NO: 10926 - RNA, 2501 nt, Mus musculus
gcauacuuaaagaccucagggugaagcucugcuugccuggccaggagggcguggauggccaagagacuccauuaucugagaagagcgauggagguguuggagaagggaaaccagagccgagcagggaaaggccgaggcacagagauaagcaggugaagugagugagaaaaggaacaggagagagacugugguggagagagauaaaaagacgaagcagggggcaagggugaaaaaaaugcugagcccccaggaaaaggcacaaggagaggucugggcagcagaauaguugacgggucagggucgcgaggcgaggcgggacccgagggacccgagccgggcgggaaagacucaggguuccucccagguccgccaacccggggcgggggugggaggugagggggaccagcggcugcagauuggcuagggaacggcgaagccugggcuggagccccguggugggaggcgccuggaucacuccggcagcggagcggagcagagacugccaccuacuuggacgacccuaguagcagccggcuucagggaacaucccagccggggcgcacgccgggcagcggggcgccgagcaccgagccgucggggcaggccgcaacauccagccauguggguggccuggagcgcacggacggccgcacuggcguugcugcucggggcgcugcauggggcgccaacacgcggccaggaguacgacuacuacgguuggcaggccgagccgcugcacggccgcuccuacuccaagccaccgcagugccucgacauccccgccgaucugccgcucugucacacggugggcuacaagcgcaugcggcugcccaaccugcuggagcacgagagccuggccgaggugaagcagcaggcaagcagcuggcugccacugcuggccaagcgcugccacucagacacccaggucuuccucugcucgcucuucgcucccgucugccuggaccgacccaucuaccccugccgcucgcugugcgaagccgugcgcgccggcugcgcuccgcucauggaggccuacgguuucccuuggcccgagaugcugcacugccacaaguucccccuggacaacgaccucugcaucgcggugcaguucgggcaccugccugccaccgcgccuccagguagcgccuuugcgcccagagcgccucggacugauccucuccccaaacccucaucuguacuccccgauaggugccaagccccuauacacagcgcccuggcacugucuccuuuuuccuuccaaccuuuauaaacuugaagcucuggguauucccacuaguucucucccaacucugaccuguaccuugugcaacucacagcacgcucgguuuuccgagcugcggaaucccuggaagccuuggagacgucccucauaaaugccguauuccuuuccucaucucaaggaugcuuggggucgcuaggcaguuucuuugaccugaacugccgacacccagacaagcgcuacuccuucccugaccucgggaacuuugagaagaggcgggugguuagggaagcccugagggcccucguuucaaggccuguaacccuaacuuccccuccucccaauuccuaggcuuuuggguacuuuacuuuucugaaccuucuuugcccagcagugaaguccagcaucuugagcucccaagcccugcuucccacuggcucguuauacugccauuagaccugauuucugauucaucuuccuuuucauugugcagguccucaaagcugucccauaucugggggccacacccccuccuccuuucuccaagaaugccuguccucuuccaaacuggccugagccccuagcaucucccccgccccccacauacacacccauagcucccagcaggcaaccuuugccuguuaacugggauagugagcgcucccgugagcccccacagcuggaacauucaaaucuccccccccccccgccccaccacuccucccaaagcaucugagcuccucuuuguaucgcccuaaccccucucaaauuaaucagcuuggucuuaggagccucccaccuucuccuucucccucucugggggauucugggagggaaaagucucuaucuugaaggcugagaguggcaggcaggaauagagucagcuaagcaagaaauccacgguucccagaauccuccagguuccuuuuauaguuucuuuggagcccaaacaugaacagcaggacaaacucaggcucagaacccuguccuggcccuaccuugcuacccaugacuccccuucucacagcgaggcuugucaccuggaggccagcacacaagagaacccaaaggcagguuguagaaaagugugaguggccaacagaugacauuagaauguuucacauaaaaaugagucguuuggacuuucuucgagaaaguuaaugcuggcuugugccugaccccugcaaauaauauccacccuggucauagagcaggggccacaguccugagcccuaagcucugcugacuaggcuaccacauu

SEQ ID NO: 10927 - RNA, 2501 nt, Mus musculus
gaaacgccgcauuuccaaucuuccggauaaagcccgcacagccaaugcaaaugcgccccgccacggcuucuuccccgaaaagcugccuuccagaauuuuucugcagcaggcaaauauuuagcgcgaacaagcugacauuuuuuaaaggaggaggaggaagaaaaaacucggaggagucgcgcagcuggagcaaagcaaugcaaguggggcgugcauuuaggaaaagcccuguugcaccccacauuuggaugaauucagagaagcguucugcugcacagaaaagcuuucaaggaugaaacccgguagugcagcgcuguucccgcccucccaacaacuguaccuucuggaaccccaaaacggccuccgcauugguggcgacgaccuccgagucuuuggcuaagcuacccugaccuggauggagcgcucggcgcagcgccuacagcuaccugcugcguccgcagaccugaggcugagcgcuaaggggcgggugcacccggaaaagcaaaacucuaagggugaaaaaugcucaauaacgaugugagucggaucuggaaugggauggagagcacucuagacucuuuggaggagcccaaacuaaggguccaacuugaagggaauuuucagaaacuuaacacuuggauauucaauauugcagagguuuauccucccuuucuuuuucuucuguguguuuucuuuuuauuuccaacgccccccucuuugcaaccgccccugaugggaaggggaucgcgguugcuuaacugccugaauaguaacaacccgggaagagggugaacccaacuagacugucagcgagacucaaccuucagguuuguuaauccaccacugcuuugggguucaaaacucccaacgcuuccccugagaguuccuaggaccuuuauggaucgcguaugaugcacacuacgacccgagcaacgauuuuuuuuccccacuguaaaaaauuaaacuaugcaguuaccaaggaaaacuaaagaggaggguggagggggaagggcuucaucuauaaaaagugucuuacaaagucaaggcugauaaugacagcggaggauacaaaauaaaaaauuuuaacuccaauccaacuugcucaccgcucaggacucuccuuaaauucguuuucugucugggagugagaacugaugaaaccaucuuuccguggcaaauuccacuuucaugcaaucucccaacugaacacucggacacacgcacacugcuuucucucucacacacaaccacuccucuggagucuuuguuguuccagaucuucccuuuuguaacuucccugaaccucuuguuucuuuuucagaaggggagacuaauuguggauauauguaagcacaacauuuuuucagucauaacugauaaguuucugaaaugccuucugcauugcaaacaugugcaucuuaauagaaaacacugcuuuccucaaucaccaguuacagccucacagcaaauaguccaggaggggggaaaccuccuuuuuuucucuuggaaagacagaucgguuugcugcugcugcuguugcugcugcugcugcugcugcugcugcugcugcuguaccuccucuucuucuccuccuccuucuuauucuucuuuuuucuccucuuuuuucuucccccuuuggagcaggggauaggaagagaauggggguggggguacuuaaauuuuuaaaugacucaucgaagccccugccuuaccuuaagaaaucgagccagccaucaugaaugauggagggauccagcugcagagagaggaaguucucauugacuguccugacuggguucuuggugcucacaucaaguagaaucagggucuuuuccuucaaaccuguagcucugucuacaggcaaaggucuccuguuuccagcguggaaggagagggagagauggagcaacagagccaagaagagagccaccagggcuaggcacgagggggggcgggagcugcuggaggccauggcuucagggaaagcacagagcacccucauuaaaucccucugauuuaaacuucuuucccuacugggucucgauggugacuaauuguccuuaucuaaagugugugucucucugccccccuucucucccccccccuauucucuuucgcccucgcucccucgcucuugcucgcuugcucgcauuuuuuuuucaguguuuuggugcugguggagcgaacucacgccccuagccagccuucucagcaacucgugccaagaguacuguucaccagcaccgccccuuuaagagauuugacugcagacauuuuuuaacuuuuuaaagguaagggaugggggaggggggagaagggggagggguggccguugugcccuacugauuuaacccgcuagggucaggaagcggccagugggacugaaacuguacugugguaccaucuugaguaagagcuuauuuucaaguccccuccccaguaggcuauggggaaggcccuucacugccugaggggcagucuguccugacuauuucuugcuu

SEQ ID NO: 10928 - RNA, 2501 nt, Mus musculus
aagcaagaaauagucaggacagacugccccucaggcagugaagggccuuccccauagccuacuggggaggggacuugaaaauaagcucuuacucaagaugguaccacaguacaguuucagucccacuggccgcuuccugacccuagcggguuaaaucaguagggcacaacggccaccccucccccuucuccccccucccccaucccuuaccuuuaaaaaguuaaaaaaugucugcagucaaaucucuuaaaggggcggugcuggugaacaguacucuuggcacgaguugcugagaaggcuggcuaggggcgugaguucgcuccaccagcaccaaaacacugaaaaaaaaaugcgagcaagcgagcaagagcgagggagcgagggcgaaagagaauagggggggggagagaaggggggcagagagacacacacuuuagauaaggacaauuagucaccaucgagacccaguagggaaagaaguuuaaaucagagggauuuaaugagggugcucugugcuuucccugaagccauggccuccagcagcucccgcccccccucgugccuagcccugguggcucucuucuuggcucuguugcuccaucucucccucuccuuccacgcuggaaacaggagaccuuugccuguagacagagcuacagguuugaaggaaaagacccugauucuacuugaugugagcaccaagaacccagucaggacagucaaugagaacuuccucucucugcagcuggaucccuccaucauucaugauggcuggcucgauuucuuaagguaaggcaggggcuucgaugagucauuuaaaaauuuaaguacccccacccccauucucuuccuauccccugcuccaaagggggaagaaaaaagaggagaaaaaagaagaauaagaaggaggaggagaagaagaggagguacagcagcagcagcagcagcagcagcagcagcagcaacagcagcagcagcaaaccgaucugucuuuccaagagaaaaaaaggagguuuccccccuccuggacuauuugcugugaggcuguaacuggugauugaggaaagcaguguuuucuauuaagaugcacauguuugcaaugcagaaggcauuucagaaacuuaucaguuaugacugaaaaaauguugugcuuacauauauccacaauuagucuccccuucugaaaaagaaacaagagguucagggaaguuacaaaagggaagaucuggaacaacaaagacuccagaggagugguugugugugagagagaaagcagugugcguguguccgaguguucaguugggagauugcaugaaaguggaauuugccacggaaagaugguuucaucaguucucacucccagacagaaaacgaauuuaaggagaguccugagcggugagcaaguuggauuggaguuaaaauuuuuuauuuuguauccuccgcugucauuaucagccuugacuuuguaagacacuuuuuauagaugaagcccuucccccuccacccuccucuuuaguuuuccuugguaacugcauaguuuaauuuuuuacaguggggaaaaaaaaucguugcucgggucguagugugcaucauacgcgauccauaaagguccuaggaacucucaggggaagcguugggaguuuugaaccccaaagcagugguggauuaacaaaccugaagguugagucucgcugacagucuaguuggguucacccucuucccggguuguuacuauucaggcaguuaagcaaccgcgauccccuucccaucaggggcgguugcaaagaggggggcguuggaaauaaaaagaaaacacacagaagaaaaagaaagggaggauaaaccucugcaauauugaauauccaaguguuaaguuucugaaaauucccuucaaguuggacccuuaguuugggcuccuccaaagagucuagagugcucuccaucccauuccagauccgacucacaucguuauugagcauuuuucacccuuagaguuuugcuuuuccgggugcacccgccccuuagcgcucagccucaggucugcggacgcagcagguagcuguaggcgcugcgccgagcgcuccauccaggucaggguagcuuagccaaagacucggaggucgucgccaccaaugcggaggccguuuugggguuccagaagguacaguuguugggagggcgggaacagcgcugcacuaccggguuucauccuugaaagcuuuucugugcagcagaacgcuucucugaauucauccaaauguggggugcaacagggcuuuuccuaaaugcacgccccacuugcauugcuuugcuccagcugcgcgacuccuccgaguuuuuucuuccuccuccuccuuuaaaaaaugucagcuuguucgcgcuaaauauuugccugcugcagaaaaauucuggaaggcagcuuuucggggaagaagccguggcggggcgcauuugcauuggcugugcgggcuuuauccggaagauuggaaaugcggcguuuc

SEQ ID NO: 10929 - RNA, 2501 nt, Mus musculus
gaccucuaggugaggugaucuggcggaguuuccuuggagguauuuaagcuuuuccucggagaacagcuuuccacuguggaaaugagggugggaaaggcacuccagguggcgaggacagcuagagcaaaggugagguggaauuugacacgucgcucauauuuccacagauacaacacuccucuccuuagaaauccgcagucuggccucucagaacugccccuggucgggaaggugcagccagguggagcgggaaucggugauucggacacccgguuuuuugcagcuuuucccaccgcgacuuggaucucaggacccuauucuagucccugucuauuucugguagcgcagcaacaucccacuggguggacgcagagggcguggcccacauacacaagaaccaauugggaaggaggccaggaugccgaccccgccccuugacgugacgcagggcccccggacagaggcuucacagccccggccccaguccuugcaguggcuguaacaaaacccagacccccaggucccggccaauggaggggauuuagacuggaccgcgucugucaaaagcucgacuccgcaccaccgcggaguccagaagaagagcuggagccaccgcacucccuccccgcccccgccgggauuuauugaguauuuggacuggacaauuaaguggcccugaugauguuaccaagcccggucaccuccaccccuuucucagucaaagacauuuugaaucuggagcagcagcggcacuuccacggagcucacuugcaggcggaauuggagcagcacuuccacucggcacccugcaugcuggccacggcugaagggacgcaguuuuccgaugcaggggaggaggacgaggaagaagagggagagaaacuguccuauuugaacucacuagcugcugccgagggccauggagauucgggucucuguccucagagcuauguccauacaguucuccgagacgcuugcagcgggcccaaggaacaagaagaggagguugugagcgaacggagccaaagugaguagagggggaaggaaacgcguccgcacaccuggggcaauggcucagcgccuauaaacccacaaaccgugccugcauggccacccgccccuuucacauucggcuagggucaugccuaugccagguucaaggacagcucugcaaagcacagguaccugagauggugcuggggcggggauaaaagagaaagagagaacagcucuugcccggagcagggacccggagcaguccccgagggaaggaaaagugauuauugcaauccugguuccuugaguaaugagugacgggggcccagagccugggucguaacuuguccguuguguguguguucucucgcacacccaucuucucaaaaaaaaaggggggggucaguuuucugccauuuuucugucuuucuucuaacgugaggugaauucagcgaggccagggcagucaccccggcugucccgaaaaggcagugcaagaauguuguguuugggccauccuuucgggcaagacuuugagagacaccagcuuacuucggagcuugcaguucuuacguucgaacugcaaggaggagaggugguggccaaugugugggagcucgauccauaucagaugacggcagcaagucacacccaggaggugaaggccucugaaaaaaaauaucguaaugcucgcuuuguuucuuauacugcaggcggaguggaaugguuaaaguuccugaauuaguucugagugggauucuggccauucagcagaucagagguggggcaggcaggagaaucagauaauugaauaagcccauaaggaaaugucugaaagggaaacaggaucaaauaaucucuucuccgaguggagauuugaucuggcugagaccaaaaucuuuucucuaacaauucuccaggccuaacacagacaugaaacugucuaaaucgguccauccaacuguuuuuccucuguaagguaacauacagauacugucacagacgcguucucaguaguuuugaaaauuaaaaaaaaaaucaauucuugagcugcacauacgccuuucacuuagauauuuccaaagagaaacaauuuuugcaaucaacccaugcauccaggccuccaguccccaauaccaacucguuccacaccuucaggggaguggaaggcaaacgaguuugcagauacgggguccuguuccgcggucgccugaaaauuguuauuagccccuggaccggcacauuuaaucuauuuucucgcugaugcucaaauuuaauaaaugcgagcuaauuacucucaccgaauacgccuucucccgguggaggugcuccgccugacgcgggggggauggggggggcggaauugggcuccagaaacuaugaacuuuccccaaaacuagcauuuacuacgggaguguuuugugccucuggggcgcaggggugguauccugagaacuagaaaggcuaaugucuugcuucucccuuagaaagcugucaguugaaga

SEQ ID NO: 10930 - RNA, 2501 nt, Mus musculus
ucuucaacugacagcuuucuaagggagaagcaagacauuagccuuucuaguucucaggauaccaccccugcgccccagaggcacaaaacacucccguaguaaaugcuaguuuuggggaaaguucauaguuucuggagcccaauuccgccccccccaucccccccgcgucaggcggagcaccuccaccgggagaaggcguauucggugagaguaauuagcucgcauuuauuaaauuugagcaucagcgagaaaauagauuaaaugugccgguccaggggcuaauaacaauuuucaggcgaccgcggaacaggaccccguaucugcaaacucguuugccuuccacuccccugaagguguggaacgaguugguauuggggacuggaggccuggaugcauggguugauugcaaaaauuguuucucuuuggaaauaucuaagugaaaggcguaugugcagcucaagaauugauuuuuuuuuuaauuuucaaaacuacugagaacgcgucugugacaguaucuguauguuaccuuacagaggaaaaacaguuggauggaccgauuuagacaguuucaugucuguguuaggccuggagaauuguuagagaaaagauuuuggucucagccagaucaaaucuccacucggagaagagauuauuugauccuguuucccuuucagacauuuccuuaugggcuuauucaauuaucugauucuccugccugccccaccucugaucugcugaauggccagaaucccacucagaacuaauucaggaacuuuaaccauuccacuccgccugcaguauaagaaacaaagcgagcauuacgauauuuuuuuucagaggccuucaccuccugggugugacuugcugccgucaucugauauggaucgagcucccacacauuggccaccaccucuccuccuugcaguucgaacguaagaacugcaagcuccgaaguaagcuggugucucucaaagucuugcccgaaaggauggcccaaacacaacauucuugcacugccuuuucgggacagccggggugacugcccuggccucgcugaauucaccucacguuagaagaaagacagaaaaauggcagaaaacugaccccccccuuuuuuuuugagaagaugggugugcgagagaacacacacacaacggacaaguuacgacccaggcucugggcccccgucacucauuacucaaggaaccaggauugcaauaaucacuuuuccuucccucggggacugcuccgggucccugcuccgggcaagagcuguucucucuuucucuuuuauccccgccccagcaccaucucagguaccugugcuuugcagagcuguccuugaaccuggcauaggcaugacccuagccgaaugugaaaggggcggguggccaugcaggcacgguuuguggguuuauaggcgcugagccauugccccaggugugcggacgcguuuccuucccccucuacucacuuuggcuccguucgcucacaaccuccucuucuuguuccuugggcccgcugcaagcgucucggagaacuguauggacauagcucugaggacagagacccgaaucuccauggcccucggcagcagcuagugaguucaaauaggacaguuucucucccucuucuuccucguccuccuccccugcaucggaaaacugcgucccuucagccguggccagcaugcagggugccgaguggaagugcugcuccaauuccgccugcaagugagcuccguggaagugccgcugcugcuccagauucaaaaugucuuugacugagaaagggguggaggugaccgggcuugguaacaucaucagggccacuuaauuguccaguccaaauacucaauaaaucccggcgggggcggggagggagugcgguggcuccagcucuucuucuggacuccgcgguggugcggagucgagcuuuugacagacgcgguccagucuaaauccccuccauuggccgggaccugggggucuggguuuuguuacagccacugcaaggacuggggccggggcugugaagccucuguccgggggcccugcgucacgucaaggggcggggucggcauccuggccuccuucccaauugguucuuguguaugugggccacgcccucugcguccacccagugggauguugcugcgcuaccagaaauagacagggacuagaauaggguccugagauccaagucgcggugggaaaagcugcaaaaaaccggguguccgaaucaccgauucccgcuccaccuggcugcaccuucccgaccaggggcaguucugagaggccagacugcggauuucuaaggagaggaguguuguaucuguggaaauaugagcgacgugucaaauuccaccucaccuuugcucuagcuguccucgccaccuggagugccuuucccacccucauuuccacaguggaaagcuguucuccgaggaaaagcuuaaauaccuccaaggaaacuccgccagaucaccucaccuagagguc

SEQ ID NO: 10931 - RNA, 2501 nt, Mus musculus
gagagaggugagcggaccggugcauucgccacaugcagaaaaaaauuaaaacagcuucuagaccgcaggaguuaguaguguucgccgcucucgaguccgccucaccgucagccgacccggcagcacccgggcuuugaaaacaucgaaaucucugagauuaaaaaaaaauaauaaucauaauaaaagaaagaaaauaaucaagcuguggugggaggaacccacuauauaggcuuaaauauuuauacagaagccauacagaauugcacggcgagggcuuccggggcggcggaggccucguguggcggccggccccgccggccggcccggauuuauugcuucgaaaaggaagaggcggcuaucaggggccaagcccggccccgggacaaggguggaggcgggaggugcagaggaggucccagcuccccuuagcgguccgauccgggaggcggcgggcaugcgggcacugggggcccgggcggcaggagguccagggcgcagcucaaucguccacgucgaucucuucaucuuccucauccucugagcaguccuggcugcuggcccgcugguccgugaguggagaggcgggcgagagcugcaaggguccuccgcccggggccugcggggcgccugggggcagcgcaggagaacccggccuagacuuagcccugccgcagccaccgccgccgccaccgcccgaagccuccgaguucugcucgaguucggccagcgccacgauguccaucugcccgcuggggcccaguuucuuggcagacuccacgucggccuucaucuccucuaggucccgcuugagcuuggcgcgccgguucuggaaccaggugaugaccugugcauuggugaggcccagcugcugcgcaauuuggucgcgaucugccggggacagguacuucugguauagaaagcguuucuccaacucguagaucuggugguuggugaaggccgugcgugauuuucgccguuucuugggcgucugccucugcccaaagauggucaucccaucgcggccuggaaagaaaugacaguguaugcucgcgacgagagagucaagaccccacccagacucucucccauaacucuccaaccgacucaggcccggggucccgcucuuguuucuucuccaauucgauuccacucucuaaaccugagcaaacugggccaugggacaccuccugucucuggucuccugaaaguccuaggaaaaaaauguuuuaauuucugcucccuaacaguuggucugaaagagcuaaagucucacagagugcaaggaaaccacacagagacucccuaaauguguugugaacaccgauucuccaccccuuuccaauggccggacuccacccuacccaggaguugucaggggaaaaaaaauuucgcccucuucccaguccaggaguaagucuaggagaguccaagcggacgggaagccuagguagccggccagacuccgggaagagcuuggguucucacaccucucucagaucaccucagaggucccuaggaacuaggcuccugcgccccuguccccagucucagcugcagaagccaggacuggaggggccuggcagccggcgugggcagaggcaggggguacgaagggcaggacacugcgugugggcgacugggcgcaggggaaucuagacuugugccuaccuucggcugccugcaggacgcugaccuccagccccuuaaaggucuugcuggcgagcuccuccaaggcgcagagaggcgaggucugcgagagcagagcgcggcccgccaggggcaagccgcccggcgcgugcuuguccgcggccgccagcaggugcgccgccccacacagcgaguaacuucuccgcacggacggcuuguugaggauguccucgaugcugaacggcgucagcggcuuguuggaguuggcgggcggcggcaggugguccagagggcugcgucgccgcuccuccccuggcgccgccuugccguccuccuuggaagucaucucggccucguuugggggcccggccggggcggcucgggccggggggacccagcccgcgggcagcucggacgcuggacggugcgagaggaaggcgagaggcgggcaggaggccgcgccgggcagggcgcggaugggcaagcggccgauuagcgcggcgacccgggcgagcggaguggcgcggggccccgggaggaaagcgcugacgcgggcgccgccacugccaccgccgccgccgccgccaccgccgggguuuccagcaagcccgggccggagccgggaagcgccgcgccgggcuccaguuucgccagccccggugcuauuuaaaggugucagguggcuccgccgcggcggcuccuggcccgggguccuggcggcggcaguuggaagaaccgaggcgagggcgccgaucccggacugcgaggggaggcggagagacggggcaauugacuauugcuaacaaguuagccuugaucgaggaguaaucaauuaucugcagcugaacuucucu

SEQ ID NO: 10932 - RNA, 2501 nt, Mus musculus
agagaaguucagcugcagauaauugauuacuccucgaucaaggcuaacuuguuagcaauagucaauugccccgucucuccgccuccccucgcaguccgggaucggcgcccucgccucgguucuuccaacugccgccgccaggaccccgggccaggagccgccgcggcggagccaccugacaccuuuaaauagcaccggggcuggcgaaacuggagcccggcgcggcgcuucccggcuccggcccgggcuugcuggaaaccccggcgguggcggcggcggcggcgguggcaguggcggcgcccgcgucagcgcuuuccucccggggccccgcgccacuccgcucgcccgggucgccgcgcuaaucggccgcuugcccauccgcgcccugcccggcgcggccuccugcccgccucucgccuuccucucgcaccguccagcguccgagcugcccgcgggcuggguccccccggcccgagccgccccggccgggcccccaaacgaggccgagaugacuuccaaggaggacggcaaggcggcgccaggggaggagcggcgacgcagcccucuggaccaccugccgccgcccgccaacuccaacaagccgcugacgccguucagcaucgaggacauccucaacaagccguccgugcggagaaguuacucgcuguguggggcggcgcaccugcuggcggccgcggacaagcacgcgccgggcggcuugccccuggcgggccgcgcucugcucucgcagaccucgccucucugcgccuuggaggagcucgccagcaagaccuuuaaggggcuggaggucagcguccugcaggcagccgaagguaggcacaagucuagauuccccugcgcccagucgcccacacgcaguguccugcccuucguacccccugccucugcccacgccggcugccaggccccuccaguccuggcuucugcagcugagacuggggacaggggcgcaggagccuaguuccuagggaccucugaggugaucugagagaggugugagaacccaagcucuucccggagucuggccggcuaccuaggcuucccguccgcuuggacucuccuagacuuacuccuggacugggaagagggcgaaauuuuuuuuccccugacaacuccuggguaggguggaguccggccauuggaaagggguggagaaucgguguucacaacacauuuagggagucucugugugguuuccuugcacucugugagacuuuagcucuuucagaccaacuguuagggagcagaaauuaaaacauuuuuuuccuaggacuuucaggagaccagagacaggaggugucccauggcccaguuugcucagguuuagagaguggaaucgaauuggagaagaaacaagagcgggaccccgggccugagucgguuggagaguuaugggagagagucuggguggggucuugacucucucgucgcgagcauacacugucauuucuuuccaggccgcgaugggaugaccaucuuugggcagaggcagacgcccaagaaacggcgaaaaucacgcacggccuucaccaaccaccagaucuacgaguuggagaaacgcuuucuauaccagaaguaccuguccccggcagaucgcgaccaaauugcgcagcagcugggccucaccaaugcacaggucaucaccugguuccagaaccggcgcgccaagcucaagcgggaccuagaggagaugaaggccgacguggagucugccaagaaacugggccccagcgggcagauggacaucguggcgcuggccgaacucgagcagaacucggaggcuucgggcgguggcggcggcgguggcugcggcagggcuaagucuaggccggguucuccugcgcugcccccaggcgccccgcaggccccgggcggaggacccuugcagcucucgcccgccucuccacucacggaccagcgggccagcagccaggacugcucagaggaugaggaagaugaagagaucgacguggacgauugagcugcgcccuggaccuccugccgcccgggcccccagugcccgcaugcccgccgccucccggaucggaccgcuaaggggagcugggaccuccucugcaccucccgccuccacccuugucccggggccgggcuuggccccugauagccgccucuuccuuuucgaagcaauaaauccgggccggccggcggggccggccgccacacgaggccuccgccgccccggaagcccucgccgugcaauucuguauggcuucuguauaaauauuuaagccuauauaguggguuccucccaccacagcuugauuauuuucuuucuuuuauuaugauuauuauuuuuuuuuaaucucagagauuucgauguuuucaaagcccgggugcugccgggucggcugacggugaggcggacucgagagcggcgaacacuacuaacuccugcggucuagaagcuguuuuaauuuuuuucugcauguggcgaaugcaccgguccgcucaccucucuc

SEQ ID NO: 10933 - RNA, 2501 nt, Mus musculus
cuggaaauuggccccauuucaagacaagaauauugaauguuguagaaaucaaucaguucucagccccugccccaguagcucccuguacucagcagcccugcgggaagccgccagccgacucaguccccugggguauccacaguggagcccggagucuaacuugcaggccgagucucccugugcaauugacccuucugaucaguuagcaguucugucccuuuuucaaacugggcgaacugggggauuucucuacuuucuuuuucccacucuccuuuugugggcccuggcgacauauccucuuucaagaacuccccuuaaauuugggccucuccucugaacccucugccuccaccugcagccggguagaggugugugaagauuguaagggagacuccuggauucauucauuugcggagcagggaagagagggcaccuguuggccucguccuccccagggucccuuccccacuauucucuccagcugaccccaaggcaccuuuucgucuuaacuccuucccuucucagguggagagcccgcaggccuuucuggcugaugcagcuggggcuggcaaggggcggcgagguccaagcuaccucuccucuccaggguccgggaaugcaccuuaccgaaggggucuccgucuucugccauggcguugaugcgcuuguuggccaggaccugcacgugcuucccgcuggugcggcuguagagcugguagguccggaugaggcggcggcugagcugauccgucaccaggcucugcucccucacaugcuguguaaaauuaggugaggacugaacaguuaccuuuaggaaauugaaaaauacacagcacgccauuauaacgcuacuccgcccaggggccccgaguugguccccauugcccuuguacccgccucccgccgcgccaggcagccagcggggacugggggcauccccacaacaugccggcucaggccaccaacccccucggggaagucgcgcagacccagcccaggauggauggaugaacccgggaaugagggagucuggacccaccuguugggaaacacccuggggcucccggccagcucggagcagggaagugggcucccugcccagcgcaggccccccgcccgggccuuccuagaggagcagggugcuuuuaaguagcgaggcaacgcuacccgacccgugacauuuauaaagacaaauuuacggagcaaauguugagaaugcaaagggccuagguuaacacgaucguuggcccaaaccggccacaggucuccccagagagcagcggcgaggauauucgcugcaacuacaucccaacuacccuugacaaggaacacccgcugacuccagcucccgccuuccuaggaggccagguguggcuacagguagccuucccauccacccgaacuggccagucgcugggcucaagacccuuggguucuagucucuccacucacucgcugugugacuuuaggcaggacacugucucucuguuccuuagaucccuccucgggguaguuuggggcuggauuuguaaaguucuuuccagcccugcugcgcuggccgaagggucgguccucgugucccugcccgagagugucagcuggguuccccgcgcccggcccccgcuucugcgcagcgcuccuuaccugggcuuggaggcagagaaccagcaagugcaacagccugugggagacaaaagcgggcaggaaagaggcgcggggugagcggagagggcucggcgggcgcuggccgacggggacgcgggggcgaccgcgguacucacaggcagcucagcgcggagcgggggcugcccauggcgcgcggccccgggagcacugagagcccgagcggggucacgccgucccacuggaggccgcggggggacaagccgaaggugcggaggcugagggaggucggggugcgggaggccagcggcuaucccgacgcggcucguggaaugucgugcucgccgcgcgcgccgaaccccucugagccgcugcuggagccgguggccgcuggcugcucaggagcccgagcaggcgggaggguaacgggccugugggguggguggggaggugggaagggagggggagggcaggggcggggggcgccgcaccggccgcgaggggggagcgcggggcgggcggccggagcccgcacccccggcugggcgcuggggccgggucgccgcccggggcgggggcggggcggccgggggcggggcggcgggcagagcagggauuggggggucuggcccaggggaggggucuagggacccgcgggaggggcgggggcggcuggugugggcgccucccacuacccuugccugucucuuccagcguuccgggggcgggaucguccagggauuggggggcgucugggacaacauguuuaguggggucccguacacuugaguccugcaggacuguugaucugcuuagggucgggucugcuuaucucuggccuccuagaaggucucugggucgccuaaugugugcugcgg

SEQ ID NO: 10934 - RNA, 2501 nt, Mus musculus
ccgcagcacacauuaggcgacccagagaccuucuaggaggccagagauaagcagacccgacccuaagcagaucaacaguccugcaggacucaaguguacgggaccccacuaaacauguugucccagacgccccccaaucccuggacgaucccgcccccggaacgcuggaagagacaggcaaggguagugggaggcgcccacaccagccgcccccgccccucccgcgggucccuagaccccuccccugggccagaccccccaaucccugcucugcccgccgccccgcccccggccgccccgcccccgccccgggcggcgacccggccccagcgcccagccgggggugcgggcuccggccgcccgccccgcgcuccccccucgcggccggugcggcgccccccgccccugcccucccccucccuucccaccuccccacccaccccacaggcccguuacccucccgccugcucgggcuccugagcagccagcggccaccggcuccagcagcggcucagagggguucggcgcgcgcggcgagcacgacauuccacgagccgcgucgggauagccgcuggccucccgcaccccgaccucccucagccuccgcaccuucggcuuguccccccgcggccuccagugggacggcgugaccccgcucgggcucucagugcucccggggccgcgcgccaugggcagcccccgcuccgcgcugagcugccugugaguaccgcggucgcccccgcguccccgucggccagcgcccgccgagcccucuccgcucaccccgcgccucuuuccugcccgcuuuugucucccacaggcuguugcacuugcugguucucugccuccaagcccagguaaggagcgcugcgcagaagcgggggccgggcgcggggaacccagcugacacucucgggcagggacacgaggaccgacccuucggccagcgcagcagggcuggaaagaacuuuacaaauccagccccaaacuaccccgaggagggaucuaaggaacagagagacaguguccugccuaaagucacacagcgagugaguggagagacuagaacccaagggucuugagcccagcgacuggccaguucggguggaugggaaggcuaccuguagccacaccuggccuccuaggaaggcgggagcuggagucagcggguguuccuugucaaggguaguugggauguaguugcagcgaauauccucgccgcugcucucuggggagaccuguggccgguuugggccaacgaucguguuaaccuaggcccuuugcauucucaacauuugcuccguaaauuugucuuuauaaaugucacgggucggguagcguugccucgcuacuuaaaagcacccugcuccucuaggaaggcccgggcggggggccugcgcugggcagggagcccacuucccugcuccgagcuggccgggagccccaggguguuucccaacagguggguccagacucccucauucccggguucauccauccauccugggcugggucugcgcgacuuccccgaggggguugguggccugagccggcauguuguggggaugcccccaguccccgcuggcugccuggcgcggcgggaggcggguacaagggcaauggggaccaacucggggccccugggcggaguagcguuauaauggcgugcuguguauuuuucaauuuccuaaagguaacuguucaguccucaccuaauuuuacacagcaugugagggagcagagccuggugacggaucagcucagccgccgccucauccggaccuaccagcucuacagccgcaccagcgggaagcacgugcagguccuggccaacaagcgcaucaacgccauggcagaagacggagaccccuucgguaaggugcauucccggacccuggagaggagagguagcuuggaccucgccgccccuugccagccccagcugcaucagccagaaaggccugcgggcucuccaccugagaagggaaggaguuaagacgaaaaggugccuuggggucagcuggagagaauaguggggaagggacccuggggaggacgaggccaacaggugcccucucuucccugcuccgcaaaugaaugaauccaggagucucccuuacaaucuucacacaccucuacccggcugcagguggaggcagaggguucagaggagaggcccaaauuuaaggggaguucuugaaagaggauaugucgccagggcccacaaaaggagagugggaaaaagaaaguagagaaaucccccaguucgcccaguuugaaaaagggacagaacugcuaacugaucagaagggucaauugcacagggagacucggccugcaaguuagacuccgggcuccacuguggauaccccaggggacugagucggcuggcggcuucccgcagggcugcugaguacagggagcuacuggggcaggggcugagaacugauugauuucuacaacauucaauauucuugucuugaaauggggccaauuuccag

SEQ ID NO: 10935 - RNA, 2501 nt, Mus musculus
cuccugcuuuggaaagcuuccaggggcuccucuucuucugucugggagcccugagcaucacuuuauggugaaagagcaagcuaauucagcucauggaguuguguucuggggcagccgggaacucucucuuggguggaggcuggaaucuuaucuucuggaugauagaggccauguauccucuacaguuccacuuaugggggacccucacuuagaauaggagaaaccaugcuucuuugaaggagagggaagaaaaaggggguugcaugggggugauggaguguugagagggaagaggagagaaggaagggucugaagaggccuuaacaucgguccauagauugcugaguggggaauagauauucuauucuccauaccaguacaugcacacacacacacacacacccauguauaaacacacacaagaauucauauacacacaugcagaaggacaaaguaucaguaguuaacacauucauaggcaacacccuccaguacacacgcaguacugcucauagacacacccucauacaaucacagucauaacaaauauguguaugauggaaaagcacaugcuuaucuuacacacacacacacacacacacacacacacacaucaccaaauaauagcacacaaagagguucccaaaauucaggcucucguucucugaugcacacagaaacagguguaucagagaccuccucgucacaaucauaaacacaaaugcauauuugcucacagaaucagagacacacauucucuccuccccacaccaguaaccaagucugggugggugagggggcugcaccacaucccucucccucaacuccagggauaugaaauaucuugcccagcccagaagagaccauaaaggaaaaccgggccucugauggcaaagcagcagcauagagaaagcugucaggagcagcaccccagccagacagguucuuaaagcucaacaggagccuggaccuccccugugaaggcccuccuccaaggcaccccaguacucaccgcugcucgucaggagcuggaaucgaagagaggcagagaggcugggccccgcucagcuguaaaagcagcaaggcucccgcucgcuccaggcccgcccgcccgccucucagucccuccuccaccccuccccacgcucugcucaagcaacgcuaaucccccccccccaaccucccuccauucccagggcccuaagucccaaagaaugucaccaccuagucacuaccuaagacucacaccagaggaaagggagaauguggaagaccccauucuguucccuaaacccucauaugccccaccccacucguguucaguucucucucguccaucaucugaaccacacguaggguccagaugcauacgccuguccugcuccagaccccacgcgugucccuaggaggcugccacaugaccuguuacaugccacacgcgcucccgcccccacaagcacgcggccacgcaaagcacacgguacggaguagaucggacccgcccccuaaaaccagaagacccaacuauggaagggacauuaagcgaaugcagucauaaacacuuugggguucugaaccucagacccaggaguccuguccugaaccccaacccggagugcagaggaaggauaaaucagacuccaggaggaacuuccuuacugccuagguuaaucgucccgccuuuucagggacgagaguuuagaagggaugaccccgagacugggacaagaagcacaggcaaaccuugugcccuuggccaggguggaaaagggucuggcucuuuuaggaaaacgccacacgaguuacuaugguaacuauucuccuuuggaaggccaagaccggcaaguuaugaccugggaagaaagagagggucgauucggguggccagagggugcgaggacguucgaagcgggggugcgcggggcucaccgcggggagggguggcgcgaguuccgcgaggugcugaaggggacagcgccagauuugucguaaugcgcaagcgcagaggcgcgaacaaagggggggguguggaggcgcgcgcccggagguggugcgcgcccacaucaaucuugcagagauccuuccaggcuaccccuuccccaaguagacugagacgaggaagcaauccccucauccaccuucacccucuugugucuuuccggugcuaguuggcuuuucucuuuaugcuacaauucaguaaugagguaguguagaaggaauucugggaaaaccaggauuucuggguucuuuauccuugcuucguuugauccugguuagggagcuuucucccuagagccucgauuugccugucuuuaaaauggacgguccuuccuaccuuugcugauguacccaaaccccugauaaggaugggaagcaguuuucguuacgaagcggcugaaauguuugcauaagggcacgcaaucauguagauaggaugcagcggucuuacagucuuucgcaugccccacacccaccucagauguuggaggaaaauauuacgc

SEQ ID NO: 10936 - RNA, 2501 nt, Mus musculus
gcguaauauuuuccuccaacaucugagguggguguggggcaugcgaaagacuguaagaccgcugcauccuaucuacaugauugcgugcccuuaugcaaacauuucagccgcuucguaacgaaaacugcuucccauccuuaucagggguuuggguacaucagcaaagguaggaaggaccguccauuuuaaagacaggcaaaucgaggcucuagggagaaagcucccuaaccaggaucaaacgaagcaaggauaaagaacccagaaauccugguuuucccagaauuccuucuacacuaccucauuacugaauuguagcauaaagagaaaagccaacuagcaccggaaagacacaagagggugaagguggaugaggggauugcuuccucgucucagucuacuuggggaagggguagccuggaaggaucucugcaagauugaugugggcgcgcaccaccuccgggcgcgcgccuccacaccccccccuuuguucgcgccucugcgcuugcgcauuacgacaaaucuggcgcuguccccuucagcaccucgcggaacucgcgccaccccuccccgcggugagccccgcgcacccccgcuucgaacguccucgcacccucuggccacccgaaucgacccucucuuucuucccaggucauaacuugccggucuuggccuuccaaaggagaauaguuaccauaguaacucguguggcguuuuccuaaaagagccagacccuuuuccacccuggccaagggcacaagguuugccugugcuucuugucccagucucggggucaucccuucuaaacucucgucccugaaaaggcgggacgauuaaccuaggcaguaaggaaguuccuccuggagucugauuuauccuuccucugcacuccggguugggguucaggacaggacuccugggucugagguucagaaccccaaaguguuuaugacugcauucgcuuaaugucccuuccauaguugggucuucugguuuuagggggcggguccgaucuacuccguaccgugugcuuugcguggccgcgugcuugugggggcgggagcgcguguggcauguaacaggucauguggcagccuccuagggacacgcguggggucuggagcaggacaggcguaugcaucuggacccuacgugugguucagaugauggacgagagagaacugaacacgagugggguggggcauaugaggguuuagggaacagaauggggucuuccacauucucccuuuccucuggugugagucuuagguagugacuagguggugacauucuuugggacuuagggcccugggaauggagggagguugggggggggggauuagcguugcuugagcagagcguggggagggguggaggagggacugagaggcgggcgggcgggccuggagcgagcgggagccuugcugcuuuuacagcugagcggggcccagccucucugccucucuucgauuccagcuccugacgagcagcggugaguacuggggugccuuggaggagggccuucacaggggagguccaggcuccuguugagcuuuaagaaccugucuggcuggggugcugcuccugacagcuuucucuaugcugcugcuuugccaucagaggcccgguuuuccuuuauggucucuucugggcugggcaagauauuucauaucccuggaguugagggagagggauguggugcagcccccucacccacccagacuugguuacugguguggggaggagagaaugugugucucugauucugugagcaaauaugcauuuguguuuaugauugugacgaggaggucucugauacaccuguuucugugugcaucagagaacgagagccugaauuuugggaaccucuuugugugcuauuauuuggugauguguguguguguguguguguguguguguguguaagauaagcaugugcuuuuccaucauacacauauuuguuaugacugugauuguaugagggugugucuaugagcaguacugcguguguacuggaggguguugccuaugaauguguuaacuacugauacuuuguccuucugcauguguguauaugaauucuuguguguguuuauacaugggugugugugugugugugugcauguacugguauggagaauagaauaucuauuccccacucagcaaucuauggaccgauguuaaggccucuucagacccuuccuucucuccucuucccucucaacacuccaucacccccaugcaacccccuuuuucuucccucuccuucaaagaagcaugguuucuccuauucuaagugagggucccccauaaguggaacuguagaggauacauggccucuaucauccagaagauaagauuccagccuccacccaagagagaguucccggcugccccagaacacaacuccaugagcugaauuagcuugcucuuucaccauaaagugaugcucagggcucccagacagaagaagaggagccccuggaagcuuuccaaagcaggag

SEQ ID NO: 10937 - RNA, 2501 nt, Mus musculus
gcucucugaaguggucccacuuucuccgaagagaaccaggagccgccuaagccaggagauaaagaggggguugcccgcucccccuguaaagaguggagaggaacagggccuuacccuugggaacucugggaugcggaugagaauagaggacaccuuucagaaaaaccuccucuccgugggggauaagagcagaaaaaaaaggacaggcucuaacgccaucaaagagcugagagcgcucggccgggaagccaagguuguuugggcacucccuccccuccggucauucccaaggcagauucuugggguacaggcgcagcggacagggacggcccaggacgguggcgcgcagcugcgguggcacugcgcucccccgcccccgcaggccccccuuccucuccccgcucgaucugaagaugaagcuccaccccuagcgcgucgccccaaccccgcgccuuaaaagccccgcacaccgccccgccgcacccagccuugccgcaccuucgcguccucgccaggucccgccgcagccgcgcacccggccccgaccccggcaccaugagcuucggaucggagcacuauuugugcuccgccuccuccuaccgcaagguguucggggacagcucgcgccucuccgcgcgccuguccgggccgggaggcucgggcagcuuccgcucgcagucgcugucccgcagcaauguggccuccacggccgccugcuccucggccucgucccucggccugggccuggccuaccgccgccugccggccuccgacgggcuggaccugagccaggcggcggcgcgcaccaacgaguacaagaucauccgcacuaacgagaaggagcagcugcagggccucaacgaccgcuucgccguguucaucgagaaggugcaccagcuggagacgcagaaccgugcgcucgaggccgagcuggccgcgcugcgccagcgccacgccgagccgucgcgcgucggcgagcucuuccagcgcgagcugcgcgagcugcgcgcgcagcuggaggaggcgagcucggcgcgcgcgcaggcccugcuggagcgcgaugggcuggccgaggaggugcagcgacugcgggcgcgcugcgaggaggagagccgcgggcgcgaaggcgccgagcgcgcccugaaggcgcagcagcgcgacguggacggcgccacccuggcccgccuggaucuggagaagaagguggagucgcugcuggacgagcuggcuuucgugcgccagguccacgacgaggagguggccgagcuccuggccacguugcaggcgucuucgcaagccgccgccgagguggacguggccguggcuaaaccagaccugacuucggcgcugagggagauccgcgcgcaguaugagucccuggccgcuaagaaccugcaguccgccgaggagugguacaaguccaaguucgccaaccuaaacgagcaggcugcgcgcagcaccgaagccauccgagccagccgagaggagauccacgaguaccggcgccagcuccaggcacguaccauugagauagagggucugcgcggagccaaugagucccuggagaggcagaucuuggaacuggaggagcggcacagcgcugagguggccggcuaccagguaagggcugggaugcugcauaggaaagagugcccuguccuuuuccguacagagauagcuucacucccuguaaacuggugcccuaggaaaccacgggagggaaaggggagagaggggagcguugacuagaggcgucagucaacaaacaaacaaacaaauuaaaaaaaaaaccacgaagucucacgcaugcagccgcaaauguggacuguaugugccuggaagcuagcucuucaagcccuugaugucuucgcccucuauuuuggagggugggggaguuugaggcacagagcccaagucuucaugcauauacuaggcauaugcaguaacacggagccacaaccccacccccagucgcuugucugaacucuucuaacaaaggagucuuuaaucuuucuaggagucaaaaaaaaaaaaaaaaguaaccaugccuuccugucaccaagaguacagacacacuaacagaacagugccgacccaaaguguccccagagggcgcaggucauggcuucugugggcggguacuuaagaaucugguuuguuuaguugacuuugagaagucuuuucugagucuuacugagaauugauauuuacagaguaucguccgcuuuaggauugggaagaaggcucacuuucuugaguuuugcucuaaaaaaggagugggauguagcauauuuaagcuaaugacaacugccuugccccacccuugcgcgcgcgggcgcacacacacacacacacacacacacacacacacacacacacacacacacacacacacgaaacccgcgagacacacgcgcaguuuccuuguccaucuacuaaacaagcuuugagcccguucagcuugagaccggucagggcgcuguccgaggugcugaucuccu

SEQ ID NO: 10938 - RNA, 2501 nt, Mus musculus
aggagaucagcaccucggacagcgcccugaccggucucaagcugaacgggcucaaagcuuguuuaguagauggacaaggaaacugcgcgugugucucgcggguuucgugugugugugugugugugugugugugugugugugugugugugugugugugugugugcgcccgcgcgcgcaaggguggggcaaggcaguugucauuagcuuaaauaugcuacaucccacuccuuuuuuagagcaaaacucaagaaagugagccuucuucccaauccuaaagcggacgauacucuguaaauaucaauucucaguaagacucagaaaagacuucucaaagucaacuaaacaaaccagauucuuaaguacccgcccacagaagccaugaccugcgcccucuggggacacuuugggucggcacuguucuguuagugugucuguacucuuggugacaggaaggcaugguuacuuuuuuuuuuuuuuuugacuccuagaaagauuaaagacuccuuuguuagaagaguucagacaagcgacugggggugggguuguggcuccguguuacugcauaugccuaguauaugcaugaagacuugggcucugugccucaaacucccccacccuccaaaauagagggcgaagacaucaagggcuugaagagcuagcuuccaggcacauacaguccacauuugcggcugcaugcgugagacuucgugguuuuuuuuuuaauuuguuuguuuguuuguugacugacgccucuagucaacgcuccccucucuccccuuucccucccgugguuuccuagggcaccaguuuacagggagugaagcuaucucuguacggaaaaggacagggcacucuuuccuaugcagcaucccagcccuuaccugguagccggccaccucagcgcugugccgcuccuccaguuccaagaucugccucuccagggacucauuggcuccgcgcagacccucuaucucaaugguacgugccuggagcuggcgccgguacucguggaucuccucucggcuggcucggauggcuucggugcugcgcgcagccugcucguuuagguuggcgaacuuggacuuguaccacuccucggcggacugcagguucuuagcggccagggacucauacugcgcgcggaucucccucagcgccgaagucaggucugguuuagccacggccacguccaccucggcggcggcuugcgaagacgccugcaacguggccaggagcucggccaccuccucgucguggaccuggcgcacgaaagccagcucguccagcagcgacuccaccuucuucuccagauccaggcgggccaggguggcgccguccacgucgcgcugcugcgccuucagggcgcgcucggcgccuucgcgcccgcggcucuccuccucgcagcgcgcccgcagucgcugcaccuccucggccagcccaucgcgcuccagcagggccugcgcgcgcgccgagcucgccuccuccagcugcgcgcgcagcucgcgcagcucgcgcuggaagagcucgccgacgcgcgacggcucggcguggcgcuggcgcagcgcggccagcucggccucgagcgcacgguucugcgucuccagcuggugcaccuucucgaugaacacggcgaagcggucguugaggcccugcagcugcuccuucucguuagugcggaugaucuuguacucguuggugcgcgccgccgccuggcucagguccagcccgucggaggccggcaggcggcgguaggccaggcccaggccgagggacgaggccgaggagcaggcggccguggaggccacauugcugcgggacagcgacugcgagcggaagcugcccgagccucccggcccggacaggcgcgcggagaggcgcgagcuguccccgaacaccuugcgguaggaggaggcggagcacaaauagugcuccgauccgaagcucauggugccggggucggggccgggugcgcggcugcggcgggaccuggcgaggacgcgaaggugcggcaaggcugggugcggcggggcggugugcggggcuuuuaaggcgcgggguuggggcgacgcgcuagggguggagcuucaucuucagaucgagcggggagaggaaggggggccugcgggggcgggggagcgcagugccaccgcagcugcgcgccaccguccugggccgucccuguccgcugcgccuguaccccaagaaucugccuugggaaugaccggaggggagggagugcccaaacaaccuuggcuucccggccgagcgcucucagcucuuugauggcguuagagccuguccuuuuuuuucugcucuuaucccccacggagaggagguuuuucugaaagguguccucuauucucauccgcaucccagaguucccaaggguaaggcccuguuccucuccacucuuuacagggggagcgggcaacccccucuuuaucuccuggcuuaggcggcuccugguucucuucggagaaagugggaccacuucagagagc

SEQ ID NO: 10939 - RNA, 2501 nt, Mus musculus
ugcguguccguccgugauucagucccaucagcuccagcgccgcaggcuuaggauccagggguccgcagcaaaggcagcgcagccccgagacucugcagggacccgggugccccggugggaguggugugggugcaguaggaggcgguggcugagggggaggaggagggggaaagaggaggaggaggaagaggaggaggagaggaacgaggaagaggaggagaagagggaagcggaggaggcgaaggaggaggagagaagccgcagcgggcgccgcaggagcgagggagcuagcccggagcgcagggcgaagacaccaagaggucggcggccgggcgggcggcuggaggcacagccggggcaguagcgccgacuccguuccauucugggcccggauccaggccuccggguucccaggcguucgccucccucugacgcacuuuaaagagucuccccccuuccaccucagggcgaguaauagcgaccaaucaucaagccauuuaccaggcuucggaggaagcuguuuaugugauccccgcacuaauuaggcucaugaacuaacaaaucguuugcacuacuagugaagaagcgaacacuuccauggauuguccuuggacuuagggcgcccugcccgccuuuugcaaaggagagaaaacuuuuuuuuugccuccccgaaaacccccucccugccucuaacuccaaucucccccccccccacgccaccucgcucaaaaaaauauuaccccaauccacgccugcaaauucuucuggaaggauuuuccccccucucuccagguugggcgcguuuggugcaagauucucgggaucuucggcuuugccucuccucccccucccccuccuuuccuuuuuccuuuccuuucuuccuuccuuccuuuccuuacccccacccccaccccaaacaaacgagucccccauucuccucgguccucgccgcgggcagcgggcggcggaggcagcgcgccgcggucgccgggagcagggagcccagcgcgcccgcuccucggcgcagcauguuucagccggcgcccaagcgcugcuucaccaucgagucgcugguggccaaggacaguccccugccugccucgcgcuccgaggaucccauccgucccgcggcacucagcuacgccaauuccagucccauaaauccguuccucaacggcuuccacucggccgccgccgccgccgccgccggcaggggcgucuacuccaacccggacuugguguucgccgaggcggucucgcacccgcccaaccccgccgugccggugcacccggugccgccgccgcacgcccuggccgcccacccccugcccuccucgcauucgccacacccccucuucgccucgcagcagcgggacccguccaccuucuaccccuggcucauccaccgcuaccgauaucugggucaucgcuuccaagguacgugccacgucgcggaacugaagcacgccgcuccggucgccuccuucauugcgcccggccugcuccgggugggcgcuccucgaggccuggacgggcggaggucagcccggguucuugguucugaaacugggcagcuaggggcccgagaggcuuugguccccagucucugaagcucguuuggguuacuggcuugcccacuccuugacccuuuguaaaagggugcaaacgaggugucccgugguucgggccggggucgggcuggcugggacacgaugcugggcgacgaagcccgcugucaagaagcucugagcccgcgaggucuuugaauccuguuucccuggaccguguucccggccggucuaucacucagggacucggacagggccacauggccagguucacuggacuucaacucugcucuacacucacucuauguccccccagcccagacccgcaacuucuaggucuucaaccccuuuaaggagacaaggagaccuuggaaaccucagagcaaacuguuuccuuccuccugcucuggaggcccagggaggggcgggaagagagcgaauagaaaccuccacagcuccacuaguucucucagcgaccuguuuaacccgggcacccgcuggacguggcgggaagucggguuccguuuggucuuugguugcugauuuuuguuuuuguuuuuguucuuccugagagaaagaaagaaagaaagaaauuaagaaagaaauuuaagaaaagaaaagagaaaauccagucgagagaaggcccgacaagggaagaucuguuuggauaucuucauuuuuuuccccgauuuaguaauuuuguaugcuucuggguugggguugguaagaaaguuaaaacuuuaggaaaaggguucgaauuaguuugccgacugcaguccauaaaagaccuaccuccgccgggcgcgaucgauaacgacgggcuuuuccauucaauaacacuucgcauuccugucagucuagacucggguguaugccagcucgccauuuuauauauuuauauauuauuuuaaaacaccccaacaaaacaaacaa

SEQ ID NO: 10940 - RNA, 2501 nt, Mus musculus
uuguuuguuuuguugggguguuuuaaaauaauauauaaauauauaaaauggcgagcuggcauacacccgagucuagacugacaggaaugcgaaguguuauugaauggaaaagcccgucguuaucgaucgcgcccggcggagguaggucuuuuauggacugcagucggcaaacuaauucgaacccuuuuccuaaaguuuuaacuuucuuaccaaccccaacccagaagcauacaaaauuacuaaaucggggaaaaaaaugaagauauccaaacagaucuucccuugucgggccuucucucgacuggauuuucucuuuucuuuucuuaaauuucuuucuuaauuucuuucuuucuuucuuucucucaggaagaacaaaaacaaaaacaaaaaucagcaaccaaagaccaaacggaacccgacuucccgccacguccagcgggugcccggguuaaacaggucgcugagagaacuaguggagcuguggagguuucuauucgcucucuucccgccccucccugggccuccagagcaggaggaaggaaacaguuugcucugagguuuccaaggucuccuugucuccuuaaagggguugaagaccuagaaguugcgggucugggcuggggggacauagagugaguguagagcagaguugaaguccagugaaccuggccauguggcccuguccgagucccugagugauagaccggccgggaacacgguccagggaaacaggauucaaagaccucgcgggcucagagcuucuugacagcgggcuucgucgcccagcaucgugucccagccagcccgaccccggcccgaaccacgggacaccucguuugcacccuuuuacaaagggucaaggagugggcaagccaguaacccaaacgagcuucagagacuggggaccaaagccucucgggccccuagcugcccaguuucagaaccaagaacccgggcugaccuccgcccguccaggccucgaggagcgcccacccggagcaggccgggcgcaaugaaggaggcgaccggagcggcgugcuucaguuccgcgacguggcacguaccuuggaagcgaugacccagauaucgguagcgguggaugagccagggguagaagguggacgggucccgcugcugcgaggcgaagaggggguguggcgaaugcgaggagggcagggggugggcggccagggcgugcggcggcggcaccgggugcaccggcacggcgggguugggcgggugcgagaccgccucggcgaacaccaaguccggguuggaguagacgccccugccggcggcggcggcggcggcggccgaguggaagccguugaggaacggauuuaugggacuggaauuggcguagcugagugccgcgggacggaugggauccucggagcgcgaggcaggcaggggacuguccuuggccaccagcgacucgauggugaagcagcgcuugggcgccggcugaaacaugcugcgccgaggagcgggcgcgcugggcucccugcucccggcgaccgcggcgcgcugccuccgccgcccgcugcccgcggcgaggaccgaggagaaugggggacucguuuguuugggguggggguggggguaaggaaaggaaggaaggaagaaaggaaaggaaaaaggaaaggagggggagggggaggagaggcaaagccgaagaucccgagaaucuugcaccaaacgcgcccaaccuggagagaggggggaaaauccuuccagaagaauuugcaggcguggauugggguaauauuuuuuugagcgagguggcgugggggggggggagauuggaguuagaggcagggaggggguuuucggggaggcaaaaaaaaaguuuucucuccuuugcaaaaggcgggcagggcgcccuaaguccaaggacaauccauggaaguguucgcuucuucacuaguagugcaaacgauuuguuaguucaugagccuaauuagugcggggaucacauaaacagcuuccuccgaagccugguaaauggcuugaugauuggucgcuauuacucgcccugagguggaaggggggagacucuuuaaagugcgucagagggaggcgaacgccugggaacccggaggccuggauccgggcccagaauggaacggagucggcgcuacugccccggcugugccuccagccgcccgcccggccgccgaccucuuggugucuucgcccugcgcuccgggcuagcucccucgcuccugcggcgcccgcugcggcuucucuccuccuccuucgccuccuccgcuucccucuucuccuccucuuccucguuccucuccuccuccucuuccuccuccuccucuuucccccuccuccucccccucagccaccgccuccuacugcacccacaccacucccaccggggcacccgggucccugcagagucucggggcugcgcugccuuugcugcggaccccuggauccuaagccugcggcgcuggagcugaugggacugaaucacggacggacacgca

SEQ ID NO: 10941 - RNA, 2501 nt, Mus musculus
aguccacauauaggugucucugaggucgacaauugaaauaccuuccacacaagcaauucuguuagcaaaauccaguaccguguacaggucggucucucccgguggugguguccguuuccaaugccacagaagugucagauggcuagaaauacccaagucugucugcucaccacccaccaccuucuggggugggcuauuuccucauuuuuuuuccucccgguccauuuuaaaguauuuuuuuuccguccaaggaacuaaccuuagaaccaaauagcaguacucaucccuagcauucucucaauaagggugcgcagggaggggguuacaguuaaaaccccggucugucuagucuagacgcaaccaggcaggacgaauaccuauuugaggcgcgcugguuucuuuuuaagguuuguuuuuaaauaaacauaacccuccuccaguuccuucuucgcuuuucuauucccccaacccccacccuuuagacgccggcggcgcgcgucuucgcgcgcggguauucagagucuagcuggaggucgcagacuuucuggaaaagauucauuaacagcaaauuaagccuggcucggccucggccuacaaggggacagguucggucgucuucgggacguggguacguguuccauugagccgccgggcagccagaaguccgccgggacuacacgugccacgagccgcccuacuccguucagggcgcucggaggcucucuucgaaaauagcaggcucucuucgccgcagcccgcagcccccgaguuuguggcggcuccguagcgcagccucccgccugcuucaagcgcuggcccugugccgccucgcccuccccgccucagccgaggaucgcgcccggugcgcgaguuccucuucgccuggagccuccgcgucgcccucccuccgagugggaccaacuucccggggccgcagacuuucacacgcccaucggggcuucccaccaggcuccguacagccaagcggagagccgagggcucugcucgcucccccacgccgucccuaaacaagcagucuacaagggcuccaggaggcuccgaacuuaaaaccugccuugggacgccucccgaagggaagggauggagguggggggggucgaauuagaaucuuaaaagaacauuuacaaaacaaugcaucugaccugacgggucgccggacuggcccauuccgaaucuccggcucuccgcuguuuccuaguaggcccccccccccgcccccguuauuccacgugauucacgcuuuggggcaagccaaggaaaaacccgggacuccccuccggaguugagcgacgacggcaggucgagcucggcucgguccgaggcgcccgccgcacacacuagcgcacgcucaagccggcguuccacucggaggcaccgccgggccccaggagaggccagacgaagcggcggcggcuggggguuuuuacaguucuuuuccgagucgaaaaagaaagcagacgggaacccgccgcccuccccuuccugcuagcgagguaacgccgagacgagguucccagcuuccagcccagcacccccccccccgccugacucccgacgcucggcgacgaccgcgcucccgcgcagacacacagaggcugcaaacuuccacucguucaacucccgauccucccaaccccucgggaggcggcagguccuccgucgagucccucccucccuggugcccaugcgggggccgcuuagguuggcugcauuuuuaauaacuugcagcucugauguaaaaccgaaagcgagcaagguagcuaagccucccaacgggggucuaccgaagucggaggagaaacccucggagggaggaggucggcugcaguccccggcgcgccagcccgcccgcggcccccggggaaagguguuccgggcacugaccugaaauccccagucgggaaguaggcagggagcccugcgauccggcgcuuugaaguuuuccccggagcggaguccaggcggcgaggaagauccgggggcggcuggcugggugaaugugugcggggucgggagagggcggcuacgugaaggagcccggccgggaaagcgcagcgagcagcaaaguuuggcuuccucuggugcccgcaguccacucccagcgccgcgcucgcucgccgccgacugcagccgcucugcugcccucggggucggcccggcggaggggugggcucugggccgcguggggguggggcggggcggggcgggcugcgagcuucagggcagguggcgacggccccgcgcgauccucuccucccgcagcuggcccgagcucugucacccucagcagcucccgcgccgccgcugccgcccgcgcucgggcaagagccccagcgccauguugacgguucgccgagagcgcccgcucgggcugggugugugugugagugugugugagcgaguguguuggccaagucgucccuccgcggcgacagcgcggcucgggcucuccgcccggcggcucgcgugcucccccuccg

SEQ ID NO: 10942 - RNA, 2501 nt, Mus musculus
cggagggggagcacgcgagccgccgggcggagagcccgagccgcgcugucgccgcggagggacgacuuggccaacacacucgcucacacacacucacacacacacccagcccgagcgggcgcucucggcgaaccgucaacauggcgcuggggcucuugcccgagcgcgggcggcagcggcggcgcgggagcugcugagggugacagagcucgggccagcugcgggaggagaggaucgcgcggggccgucgccaccugcccugaagcucgcagcccgccccgccccgccccacccccacgcggcccagagcccaccccuccgccgggccgaccccgagggcagcagagcggcugcagucggcggcgagcgagcgcggcgcugggaguggacugcgggcaccagaggaagccaaacuuugcugcucgcugcgcuuucccggccgggcuccuucacguagccgcccucucccgaccccgcacacauucacccagccagccgcccccggaucuuccucgccgccuggacuccgcuccggggaaaacuucaaagcgccggaucgcagggcucccugccuacuucccgacuggggauuucaggucagugcccggaacaccuuuccccgggggccgcgggcgggcuggcgcgccggggacugcagccgaccuccucccuccgaggguuucuccuccgacuucgguagacccccguugggaggcuuagcuaccuugcucgcuuucgguuuuacaucagagcugcaaguuauuaaaaaugcagccaaccuaagcggcccccgcaugggcaccagggagggagggacucgacggaggaccugccgccucccgagggguugggaggaucgggaguugaacgaguggaaguuugcagccucugugugucugcgcgggagcgcggucgucgccgagcgucgggagucaggcgggggggggggugcugggcuggaagcugggaaccucgucucggcguuaccucgcuagcaggaaggggagggcggcggguucccgucugcuuucuuuuucgacucggaaaagaacuguaaaaacccccagccgccgccgcuucgucuggccucuccuggggcccggcggugccuccgaguggaacgccggcuugagcgugcgcuagugugugcggcgggcgccucggaccgagccgagcucgaccugccgucgucgcucaacuccggaggggagucccggguuuuuccuuggcuugccccaaagcgugaaucacguggaauaacgggggcgggggggggggccuacuaggaaacagcggagagccggagauucggaaugggccaguccggcgacccgucaggucagaugcauuguuuuguaaauguucuuuuaagauucuaauucgaccccccccaccuccaucccuucccuucgggaggcgucccaaggcagguuuuaaguucggagccuccuggagcccuuguagacugcuuguuuagggacggcgugggggagcgagcagagcccucggcucuccgcuuggcuguacggagccuggugggaagccccgaugggcgugugaaagucugcggccccgggaaguuggucccacucggagggagggcgacgcggaggcuccaggcgaagaggaacucgcgcaccgggcgcgauccucggcugaggcggggagggcgaggcggcacagggccagcgcuugaagcaggcgggaggcugcgcuacggagccgccacaaacucgggggcugcgggcugcggcgaagagagccugcuauuuucgaagagagccuccgagcgcccugaacggaguagggcggcucguggcacguguagucccggcggacuucuggcugcccggcggcucaauggaacacguacccacgucccgaagacgaccgaaccuguccccuuguaggccgaggccgagccaggcuuaauuugcuguuaaugaaucuuuuccagaaagucugcgaccuccagcuagacucugaauacccgcgcgcgaagacgcgcgccgccggcgucuaaaggguggggguugggggaauagaaaagcgaagaaggaacuggaggaggguuauguuuauuuaaaaacaaaccuuaaaaagaaaccagcgcgccucaaauagguauucguccugccugguugcgucuagacuagacagaccgggguuuuaacuguaacccccucccugcgcacccuuauugagagaaugcuagggaugaguacugcuauuugguucuaagguuaguuccuuggacggaaaaaaaauacuuuaaaauggaccgggaggaaaaaaaaugaggaaauagcccaccccagaaggugguggguggugagcagacagacuuggguauuucuagccaucugacacuucuguggcauuggaaacggacaccaccaccgggagagaccgaccuguacacgguacuggauuuugcuaacagaauugcuuguguggaagguauuucaauugucgaccucagagacaccuauauguggacu

SEQ ID NO: 10943 - RNA, 2501 nt, Mus musculus
cccaggagcuucagcaggggcacuuaacgcucuucuagggaacaaaugaggacuucuugggugucccuaggugccuuugcagacaucagccaucgcccccuggaggggagccuggcauuccagcaacuucugugacuggagccgauagggaccggccucucucgggcggggggacuccaacaagcggcuggcagagcggaccuguuugcagacuacuuuugaggugggauggcaaagaguuuagagcuggaaaagcguggaagaagagguuguguaccucuccccaguccagaaaggacccaaaaucacaagugagaaagaaagaguaaaugcaaacaaccucaaaaaacaagccaagaaaagccaagccaaaagaagcaagcgcaaagcuguuacaaaacugucugguuuuguaacaauuuccccgcugccggccaaugagcagcgugguaggagucacgugguugcguuuuauauaacgcuucgcugagacaagacaguuauuaggcagcgcggggcagccggcauggagcucgggaggcgaggcagacucgcgcgcgcggcgaucccgccuucucgcucgcgcagcccgcucccagccgccgcucuuuccugcuaguucccuguuccuagacgccucuccucacuccaaccuccgcaguuccuucucucaauggauucccuucagaccgcacagauggugagcuuguccgccgagcucggcagcaacaacuuggagcuggcggagccggaggagccggggacaucagcggccgcagggcagucagccgcccacccggaggaggugacacccgagggcucccaagcucucggggcucaagagcccgagcaaagccugccucuggcggucccgacaccgcuggagugcaaaguccugcucacgcaggcggaugccuuggcaucugaggggcaccuucgggaagcccucgagguguaccgacagcucuccgagaggcagcagcucguagcggagcagcuggagcagcuagugcgcugcuuggccgacagugucccgcaagaggagcuggccuccgacucgagcggcacuucgagcugcugcgccgcggcgcugaaagaggcaggggaggccgcggccguggcccccgagguaugggauggcuuuaagugcaagaagugucacggguuucucucagacccggugucccuguggugcggccacaccuuuuguaaacugugccuggagcgcgggcgagccgccgaucggcgcugcgcucugugcggggucaagcucuccgcucugauggcggccagugggagggcacgcgggccgcggcgcgcggggcagccggcgccccugcaacugcgaguuaacgugguacucagcggccuccugggcaaguuguucccgggccccgcgcgggcgucgcaacuccggcacgagggcaaccggcuguuccgcgagcaccagguggaggcagcucugcucaaguacaacgaggcuguucgucuaggugagucccccccaccccccaugcgccgccacaggggccgugcgggcuugcucgccacgcgaggggggcgggggagcgaucccugcugggaggcgggggcggggggacggaccggacugauuugguuucgcgcgcgcgcgcgcgcgcgcgggcuggggggugggguggcgagggaagagcccguggcccacgaggaggagggagggggcauugcaaggaguuugucuucccuacuuuagcuuuuuuuuaaaagcugugucucagucuucugauugguccuauagcuuuuuuuuucuuuucucgugcucuuucccucucuccugcuugcuuuccugcuccuauaccuccugguuccaguuucuuaguuuaucccguucgucucuuuuuugcgcauuuuuuuucucaguuuugucgcuguuucggucuugcucagugucacugucucuaguucacggucuuuccuggacacuuuggagcucgcucuuacaccugccgguaccuccccuaucagcagaagaacuuggcacuauuuuccaaacucccgcgcgguccuccuggcuuuuaccaaccggagguggcuugcgggcgccugaguccguggcucccgccucugggaguugucccuuccggggccgaggcucccuguggggugggucccgccuggaauuaggucaggagagcacugguugcauaaggcccucgagccagcccgggccggcggccccucccccgcgcgggcgggcgggcaggcaagcgggcgggcgggcgggcggggauuguguaacgcugagguaacugaagugggccacgcucgccucagaaaccaucccgcgagcgugugcggggggcggagggggggggggcucgcuccccgcugcccugugacucauugucaccguuuccuaucacacgauuccuuggcugaaauagaugcacuugccccgcccccuccacccgcugcaguuagacagccaguuccccgacaucgaacccuuugaccccucuaac

SEQ ID NO: 10944 - RNA, 2501 nt, Mus musculus
guuagaggggucaaaggguucgaugucggggaacuggcugucuaacugcagcggguggagggggcggggcaagugcaucuauuucagccaaggaaucgugugauaggaaacggugacaaugagucacagggcagcggggagcgagcccccccccccuccgccccccgcacacgcucgcgggaugguuucugaggcgagcguggcccacuucaguuaccucagcguuacacaauccccgcccgcccgcccgcccgcuugccugcccgcccgcccgcgcgggggaggggccgccggcccgggcuggcucgagggccuuaugcaaccagugcucuccugaccuaauuccaggcgggacccaccccacagggagccucggccccggaagggacaacucccagaggcgggagccacggacucaggcgcccgcaagccaccuccgguugguaaaagccaggaggaccgcgcgggaguuuggaaaauagugccaaguucuucugcugauaggggagguaccggcagguguaagagcgagcuccaaaguguccaggaaagaccgugaacuagagacagugacacugagcaagaccgaaacagcgacaaaacugagaaaaaaaaugcgcaaaaaagagacgaacgggauaaacuaagaaacuggaaccaggagguauaggagcaggaaagcaagcaggagagagggaaagagcacgagaaaagaaaaaaaaagcuauaggaccaaucagaagacugagacacagcuuuuaaaaaaaagcuaaaguagggaagacaaacuccuugcaaugcccccucccuccuccucgugggccacgggcucuucccucgccaccccaccccccagcccgcgcgcgcgcgcgcgcgcgcgaaaccaaaucaguccgguccguccccccgcccccgccucccagcagggaucgcucccccgccccccucgcguggcgagcaagcccgcacggccccuguggcggcgcauggggggugggggggacucaccuagacgaacagccucguuguacuugagcagagcugccuccaccuggugcucgcggaacagccgguugcccucgugccggaguugcgacgcccgcgcggggcccgggaacaacuugcccaggaggccgcugaguaccacguuaacucgcaguugcaggggcgccggcugccccgcgcgccgcggcccgcgugcccucccacuggccgccaucagagcggagagcuugaccccgcacagagcgcagcgccgaucggcggcucgcccgcgcuccaggcacaguuuacaaaagguguggccgcaccacagggacaccgggucugagagaaacccgugacacuucuugcacuuaaagccaucccauaccucgggggccacggccgcggccuccccugccucuuucagcgccgcggcgcagcagcucgaagugccgcucgagucggaggccagcuccucuugcgggacacugucggccaagcagcgcacuagcugcuccagcugcuccgcuacgagcugcugccucucggagagcugucgguacaccucgagggcuucccgaaggugccccucagaugccaaggcauccgccugcgugagcaggacuuugcacuccagcggugucgggaccgccagaggcaggcuuugcucgggcucuugagccccgagagcuugggagcccucgggugucaccuccuccgggugggcggcugacugcccugcggccgcugauguccccggcuccuccggcuccgccagcuccaaguuguugcugccgagcucggcggacaagcucaccaucugugcggucugaagggaauccauugagagaaggaacugcggagguuggagugaggagaggcgucuaggaacagggaacuagcaggaaagagcggcggcugggagcgggcugcgcgagcgagaaggcgggaucgccgcgcgcgcgagucugccucgccucccgagcuccaugccggcugccccgcgcugccuaauaacugucuugucucagcgaagcguuauauaaaacgcaaccacgugacuccuaccacgcugcucauuggccggcagcggggaaauuguuacaaaaccagacaguuuuguaacagcuuugcgcuugcuucuuuuggcuuggcuuuucuuggcuuguuuuuugagguuguuugcauuuacucuuucuuucucacuugugauuuuggguccuuucuggacuggggagagguacacaaccucuucuuccacgcuuuuccagcucuaaacucuuugccaucccaccucaaaaguagucugcaaacagguccgcucugccagccgcuuguuggaguccccccgcccgagagaggccggucccuaucggcuccagucacagaaguugcuggaaugccaggcuccccuccagggggcgauggcugaugucugcaaaggcaccuagggacacccaagaaguccucauuuguucccuagaagagcguuaagugccccugcugaagcuccuggg

SEQ ID NO: 10945 - RNA, 2501 nt, Mus musculus
gcugcugugguagcuuuauucauaguuuuugcucccuuccggccauugccuggcuggcaggaauuucugaggagaaagucuuuaccgcucuuccucaaaaggagacugucuugccucggugcuagggucuugcaggaaaucaccuggaggcaggaggcaucaaccaggccaauguacuuuccugagaagcccgacaguguucugaguucggggcaaugccaaagaacaaaagagcagaaaggagguggcuacacagaggcaggcagaguuggccagaaccccagaggcuucugggcagugugccauccuccuguucuuggguuggggagaggggguguucaaacuaagaaaguuccugggcccuuccucuaggaaacucgcuguccuguucacucccucucuccacucucaccucccugugacuccagcccuggcacuaguaacuguccaccuggucuuggccuucccuuucugcugugccaggcaggcuacugugacagccagaucacaggacuggggcagcugaaggugggagcuggcagccccaggaggcucugacccacagaggacaggcagaccgggcaggggcuguugggacacugaggacccggggacugaaguagacaagggauuaucuauugguguggagaauuuccagguaggggguuaauacagguagaggugaagggauuccguuucccagagcugcaccgagguuaucagaucaaguuccuguguuuccuggguuuugguaccgggagacuggggaccgaaguuauaccugagacaagaguggaaggggaagccagaauaaagaagaagcaagucuccggagagaugaacgcuguggggccaggugucccacaauggagcagagaacaaaaucauccaggaccuuggaguacagaagauaagccuggcucuguccaguccagaucugccuuaaggacgcugccucugcuuacacauaggcuaaaggagcaacagcugggauccacuagccacugcggucgcccccgcccccgcucccgcagcgugcuccugacuaugcaacaagugucacgucuacauguuggcacaucaucuccaguagcuugagccccuggacuggccagcggccccuaaacucuaagacccagagaccuucaacauggaguccugaccccacucagcucaggucagccaccuccacugauucacgaggugagcuggacauaccgccauccucuccccccacccccacuuggggugcagggugcaggacauaagguguaaguuugugguccuaaguacuuuaaacuacgaggggcauggggcugggggcuaaguggugauaugcaagguaaucaugaaacaccccccccucccgcgcgcgcuguccuaggaagcaaagccuacauggcaugucgccccguggccccagaugcccugucaauaggccucccgguguggcuggcgcguggcugcuccugcaaggcucgcaccauguuucccuggaggcgggaagagcgcgcguggggcggaaagagaggaccgcgcaggcugcaccucgggagagccccaagcgagcaggagggcacgcacucaccuccacaaacugcagucaaggagagccagagcagcagcagcgccugcacgcagagccucagauucaugcugcaacucgguccgcggcagcccagaggagccggcgagugggcggagaggcagggcacccggacgcaaagaaaggcgcgagccggggcuggcgcgugcgggcacggagcucgcguggcucccggaccgcgggagggugagcgccccagccgcaccgcuggcugccugccccacuccugcucgcugccucugcucuuggugcagccuucucugccgccgcggggcagcgccgcgaagcuggccuugguggcuucgggucggcggcaaaaacucucuaaguggcugacgcugcucugcccgcgacucccaacuacccguugguccaggcuguuagagagaaugcuucccugcucacuucggggucugcauuuuguagcuugugguuuggccgcgagcccacuuggucauguggucauuaggaggcggggggguuggggggggggggaagagaggcaggaagagggagagggagugagccucccgcaccgccccccucccgggaagcaugcugcagcccuauccagggcgcgagagagaacccagagguggccccacaacaaaggccgagcggcugcucggacaacccacaacugcuccccggacaaugccugccuggccgggguccagaggguuuguagagaccugaaggauuucaaacacguaaaccauuugaaacagugaggggcacucuuaacccuuucucaccuggguuuccuuaacagcugucaggauaccugggcguuugcagaaggacccuauuugggcugcccacaacacccucccuccauuuccgaaucuaacuauguuuuuuuuucuuuccuugacacugcauucgcaaguauggg

SEQ ID NO: 10946 - RNA, 2501 nt, Mus musculus
cccauacuugcgaaugcagugucaaggaaagaaaaaaaaacauaguuagauucggaaauggagggaggguguugugggcagcccaaauaggguccuucugcaaacgcccagguauccugacagcuguuaaggaaacccaggugagaaaggguuaagagugccccucacuguuucaaaugguuuacguguuugaaauccuucaggucucuacaaacccucuggaccccggccaggcaggcauuguccggggagcaguuguggguuguccgagcagccgcucggccuuuguuguggggccaccucuggguucucucucgcgcccuggauagggcugcagcaugcuucccgggaggggggcggugcgggaggcucacucccucucccucuuccugccucucuuccccccccccccaacccccccgccuccuaaugaccacaugaccaagugggcucgcggccaaaccacaagcuacaaaaugcagaccccgaagugagcagggaagcauucucucuaacagccuggaccaacggguaguugggagucgcgggcagagcagcgucagccacuuagagaguuuuugccgccgacccgaagccaccaaggccagcuucgcggcgcugccccgcggcggcagagaaggcugcaccaagagcagaggcagcgagcaggaguggggcaggcagccagcggugcggcuggggcgcucacccucccgcgguccgggagccacgcgagcuccgugcccgcacgcgccagccccggcucgcgccuuucuuugcguccgggugcccugccucuccgcccacucgccggcuccucugggcugccgcggaccgaguugcagcaugaaucugaggcucugcgugcaggcgcugcugcugcucuggcucuccuugacugcaguuuguggaggugagugcgugcccuccugcucgcuuggggcucucccgaggugcagccugcgcgguccucucuuuccgccccacgcgcgcucuucccgccuccagggaaacauggugcgagccuugcaggagcagccacgcgccagccacaccgggaggccuauugacagggcaucuggggccacggggcgacaugccauguaggcuuugcuuccuaggacagcgcgcgcgggagggggggguguuucaugauuaccuugcauaucaccacuuagcccccagccccaugccccucguaguuuaaaguacuuaggaccacaaacuuacaccuuauguccugcacccugcaccccaaguggggguggggggagaggauggcgguauguccagcucaccucgugaaucaguggagguggcugaccugagcugaguggggucaggacuccauguugaaggucucugggucuuagaguuuaggggccgcuggccaguccaggggcucaagcuacuggagaugaugugccaacauguagacgugacacuuguugcauagucaggagcacgcugcgggagcgggggcgggggcgaccgcaguggcuaguggaucccagcuguugcuccuuuagccuauguguaagcagaggcagcguccuuaaggcagaucuggacuggacagagccaggcuuaucuucuguacuccaagguccuggaugauuuuguucucugcuccauugugggacaccuggccccacagcguucaucucuccggagacuugcuucuucuuuauucuggcuuccccuuccacucuugucucagguauaacuucgguccccagucucccgguaccaaaacccaggaaacacaggaacuugaucugauaaccucggugcagcucugggaaacggaaucccuucaccucuaccuguauuaacccccuaccuggaaauucuccacaccaauagauaaucccuugucuacuucaguccccggguccucagugucccaacagccccugcccggucugccuguccucugugggucagagccuccuggggcugccagcucccaccuucagcugccccaguccugugaucuggcugucacaguagccugccuggcacagcagaaagggaaggccaagaccagguggacaguuacuagugccagggcuggagucacagggaggugagaguggagagagggagugaacaggacagcgaguuuccuagaggaagggcccaggaacuuucuuaguuugaacacccccucuccccaacccaagaacaggaggauggcacacugcccagaagccucugggguucuggccaacucugccugccucuguguagccaccuccuuucugcucuuuuguucuuuggcauugccccgaacucagaacacugucgggcuucucaggaaaguacauuggccugguugaugccuccugccuccaggugauuuccugcaagacccuagcaccgaggcaagacagucuccuuuugaggaagagcgguaaagacuuucuccucagaaauuccugccagccaggcaauggccggaagggagcaaaaacuaugaauaaagcuaccacagcagc

SEQ ID NO: 10947 - RNA, 2501 nt, Mus musculus
gucccacuucggcgcccgggcuaggacugcgccugagcgcggccucagugcuggagcgccagaaccacgcgcggaggucgccaaggguggggaaguggggggcccggaggaagggcggggugucuggcgggggcguuccccucgggcgagacccccgcccuccuacauagaccgagucaaaaaaagaaaaaaaagaaaagaaagaaagaaagaaaagaaaagaaaaaaaaccaacaacaaaacggggagagcguguuacacaucaaccaggagcgaaaacgaucgcucuccgaccccgaacggcguugcggcacccccccccccuuccuggagcggaggacuggcuggggaaagguggcuccguucuuccccguggccagugcggggucugcggcugcccagcgagguuccggcuucccuggggcugguaggggggagccccgagaagugcaggcccgcccccuucuuccuccuccuuccccuccucccccacguguccuccgggagcccagcggccugaucccagcacccccccucccgccaccucccuccuacucccgcuucgcccgcuucccgggcgguguggagaagagcaaaguugcgacagcagccggggggcucugcccaggugaagggggcgcugugacgggggcgggaacggcguggcccugcggcgggggcggggggggggaggauaaagaaacuugcuuuucgcagcccccacccugcgcggguucggaucuugcgugauccgagcccucguggagacgcugcaccgccgccaggaccgaggccggcaccccgagccggacucagauagggaccgcgcguuccggcgggcugccgagggcaggcaggccggcacccgggcaagggcggggugggugaccgugcaccggaccgaaccgcggacucuggcggcgugggcgcgggacgaaccgggaccgggccgaguuggguggcgaaguaggacguggauucggggggcggggcgcagcgggaggggggagagcaggcccggcccggcuggccugggcguggggguggggggcgaguucggggcacuugcugggcucuggaccgagcgcuagggcggggcggcgcuaggggcugggcccgaccgggaggagagggcgaggggagggagagcaggggguggaguaggggcguggaguugcaagcggggucuggccucggccgggggcgaagguagaucugcggggccgaaagcggagggagggaggcccgaggcagcgcggcggcagcggcggcggcggcggcggcggcggcggcggcgguggcggcgaaggccagcuuccgcggaguuugugcccgggcuucccagcugggcuccggucgccucccgcgcacaaaugggguuaggggacugacugguaagcaacucccgguguuggacgggcuucccaggcgauucccggaaaaccgagggaagacgccgucugcaauaugccgcaccccaccacuccaccucuuagcaucuggauucugcucuucggggucgguggacccuuccccaccacaauccuuccaaucuuccagcaccccuuccgucucccucuuauccuuggccaucuaaaucuccuagugguaugcuuuggagggguggaaggcgucgagggcugcacuuucccucccuugggggcagccuaguuugugucuuauuccugccagguaauguugcuuggcaugguguggaccugggguuuagauaauuuaagccccggauccaagcuuuuuugauggcuuuuaaggaaagggacggaucccuggauuuucaugaccagaaugggguuugaggacuggaguuacucucagcucacuuccaguaccaaccucuuuacuaugaaccauuucugugggggcucgaacguggagggugggauacgggagcauuaaugugcuuugcuucucuguguuuccacagggucagcguggugaaggacagcuagugucagagggaaaguagacacuaguccaacuacggccgcccccacuaauacuucgguaagggggacacgacuaaggggaugcugguggguuggggcccaguauaagaguagagguggguagucgcccccaggacucuuuccuggcggggagagaaaggcgagccccuacuucggggaggguuccggggaaggagauggaggguggcgacuggggggggugcgggaagaauggaagagucacacccugcuugcaaggggagccucccuuaggcuccugggaaaaggggacugaauacgugugcucugugguaccagggcaggggagaucuggggaugguucaaagagugauuugcacacugguucuggcacuaguggccugagaaagucagguuggggcauaagguggagaauguuggaaggaaggcagacaaccaagccucuggccccagugcccagaucauuucccuuccucaaccucccuccuaaggggcaucgggguggggggcguggagcucuuggagccccgcgga

SEQ ID NO: 10948 - RNA, 2501 nt, Mus musculus
uccgcggggcuccaagagcuccacgccccccaccccgaugccccuuaggagggagguugaggaagggaaaugaucugggcacuggggccagaggcuugguugucugccuuccuuccaacauucuccaccuuaugccccaaccugacuuucucaggccacuagugccagaaccagugugcaaaucacucuuugaaccauccccagaucuccccugcccugguaccacagagcacacguauucaguccccuuuucccaggagccuaagggaggcuccccuugcaagcagggugugacucuuccauucuucccgcaccccccccagucgccacccuccaucuccuuccccggaacccuccccgaaguaggggcucgccuuucucuccccgccaggaaagaguccugggggcgacuacccaccucuacucuuauacugggccccaacccaccagcauccccuuagucgugucccccuuaccgaaguauuagugggggcggccguaguuggacuagugucuacuuucccucugacacuagcuguccuucaccacgcugacccuguggaaacacagagaagcaaagcacauuaaugcucccguaucccacccuccacguucgagcccccacagaaaugguucauaguaaagagguugguacuggaagugagcugagaguaacuccaguccucaaaccccauucuggucaugaaaauccagggauccgucccuuuccuuaaaagccaucaaaaaagcuuggauccggggcuuaaauuaucuaaaccccagguccacaccaugccaagcaacauuaccuggcaggaauaagacacaaacuaggcugcccccaagggagggaaagugcagcccucgacgccuuccaccccuccaaagcauaccacuaggagauuuagauggccaaggauaagagggagacggaaggggugcuggaagauuggaaggauugugguggggaaggguccaccgaccccgaagagcagaauccagaugcuaagagguggagugguggggugcggcauauugcagacggcgucuucccucgguuuuccgggaaucgccugggaagcccguccaacaccgggaguugcuuaccagucaguccccuaaccccauuugugcgcgggaggcgaccggagcccagcugggaagcccgggcacaaacuccgcggaagcuggccuucgccgccaccgccgccgccgccgccgccgccgccgccgccgcugccgccgcgcugccucgggccucccucccuccgcuuucggccccgcagaucuaccuucgcccccggccgaggccagaccccgcuugcaacuccacgccccuacuccacccccugcucucccuccccucgcccucuccucccggucgggcccagccccuagcgccgccccgcccuagcgcucgguccagagcccagcaagugccccgaacucgccccccacccccacgcccaggccagccgggccgggccugcucuccccccucccgcugcgccccgccccccgaauccacguccuacuucgccacccaacucggcccggucccgguucgucccgcgcccacgccgccagaguccgcgguucgguccggugcacggucacccaccccgcccuugcccgggugccggccugccugcccucggcagcccgccggaacgcgcggucccuaucugaguccggcucggggugccggccucgguccuggcggcggugcagcgucuccacgagggcucggaucacgcaagauccgaacccgcgcagggugggggcugcgaaaagcaaguuucuuuauccuccccccccccgcccccgccgcagggccacgccguucccgcccccgucacagcgcccccuucaccugggcagagccccccggcugcugucgcaacuuugcucuucuccacaccgcccgggaagcgggcgaagcgggaguaggagggagguggcgggagggggggugcugggaucaggccgcugggcucccggaggacacgugggggaggaggggaaggaggaggaagaagggggcgggccugcacuucucggggcuccccccuaccagccccagggaagccggaaccucgcugggcagccgcagaccccgcacuggccacggggaagaacggagccaccuuuccccagccaguccuccgcuccaggaagggggggggggugccgcaacgccguucggggucggagagcgaucguuuucgcuccugguugauguguaacacgcucuccccguuuuguuguugguuuuuuuucuuuucuuuucuuucuuucuuucuuuucuuuuuuuucuuuuuuugacucggucuauguaggagggcgggggucucgcccgaggggaacgcccccgccagacaccccgcccuuccuccgggccccccacuuccccacccuuggcgaccuccgcgcgugguucuggcgcuccagcacugaggccgcgcucaggcgcaguccuagcccgggcgccgaagugggac

SEQ ID NO: 10949 - RNA, 2501 nt, Mus musculus
guuguagcuuggaucuccaauagcuuaaaggaaaucauuuuacaucaugcucccccccccgcccccgcccaggucugcaaacucaguuauaaaacuaagacuauccccauucccaacccgcacuucaaauuucggacccgcaaaauuaucaggacuccagcauauugguuauaaaauuuauugaucucucacuuagcaauuaagaacaaaacuuugaaaaaaccuggaacaaaauaaccccuuccccaccacccgaacgaaaugcguacacgaaauagcaaauagaucacugcagaaaucacaaacucaacagccuaaacgcgcacuggacagagcugucccgcggccaggggcggcaaggcgggaaacacacgcacaccuggcuauaaauuaacauuggcuuuagcugucgcgccaauuggcgcggccagcaccccccccccaaaaaaaagccagaggaaaacagaagcaauacgacuggggguggaggcauugcaguucuugggggcgggcaaccucacucaguucucgauuaauagcaaacuaacaagacauuuucaacugcaacagaagaaccuaggaauccgggaagaggaaggggccgcgguuucuccgcaaacaccacagcgauucccagccagagggggagggaggggcaguggucagaagccagcggcucuagcaagucccauuuccgcugcucgggacuucucgcuuuuguacaaaaccccgacaguuacggccaaacuuucgguccuccucaucuucgguacaaggcaacggucccaggcgagcaaagcuaaacagcaaggcgucccaacgugggggguguggggcggggugggggcgaagagcugggagcgcgggccggagcucagaugugggucagcggcaccguuccauugaccgcagucccggcgcccugguagugcuggugcacgccgugcagccggccgccugggagcggagaagcggcgucggccgcguccccgccagguggcagguacaugcugaucaugucgcgcaggucgccgaggcacgcgcgcugcgagugcgaagcgauggcgggcggcggagagcugggcuccgacuucaccacggagcccauggggcccaggcucauggcggcggcggcggcggccgcggcggcagcgguggcgggcugcugcccguaggcggcggcggcggcggccgcggcggagggcgccaugcccccguagcccgaggcggcggcagcggcggcggcggcguucauguagcucugggcgccggguggcaucauggggcuguacugcaggccggccaugucguagcggugcaucugaggcagcgcggguggcggcggcgggcugcucaugcucgggggcugcgcguagcccagcugcuccugcacgagcgaguaggcgccguuggcccagccguucacgugcguguacguguccaggcgcuggcccacgcccaccgggcugcuggcggcggcggcugcggcggcagcggcggcggcugcggcggcgcccgggggcaggaggccgccgggcagcgaguacuuguccuucuugagcagcgucuuggucuugcggcggggccgguacuuguaguccggguacuccuucaugugcaccgcacgcagucgcuuggccucgucgaugaacggccgcuucuccgcaucggucagcaguuuccagucggcgcccaagcgcuugcugaucucggaguugugcaucuugggguucuccagggccaucuugcgccgcugcccgcgggaccacaccaugaacgcguucaugggucgcuugacgcgguccuggucgcugcccccgccgccaccaccaccaccgccgccguucgcgcccccgcugcccccguugccugcguucgcuccgccggcuggguucgcgccacucuugccugcagcgccgggagcugcggggacgccggugcccgcggcuggggugggcggccccacgggguucuugaguucagucuccagcaggcuguacaucgccggggcgggaaggaggugcgccagcguggcgggaggagacggcgcuccgggggcuggagcggccaccgugaaaaggccgggggacuccgucggaguggugcucaggggccggcgggccggcagcucaggcgggaagggcaggcuagccgaagggcuccgcgcaaagucggcgggaacucgcgggcuucucucaccugaugcguucucucgagcuggucgcauucgcagcuugcccgggaagccugcccggucccuuauauaccugcucagauccgggaggguuggggcucgguccgcccccucaccacccgugggccucgugauugacaggcucgccgugaugaguccuggccaaucaacaccgagcccccuguggcccagcuuggaaaaaaaaguucggggagcccuuucguucacccuccagaccccucuugggucgagugacgugaugagagcuuuuucaggaggcgggaguccacgagacccgcucugagac

SEQ ID NO: 10950 - RNA, 2501 nt, Mus musculus
gucucagagcgggucucguggacucccgccuccugaaaaagcucucaucacgucacucgacccaagaggggucuggagggugaacgaaagggcuccccgaacuuuuuuuuccaagcugggccacagggggcucgguguugauuggccaggacucaucacggcgagccugucaaucacgaggcccacggguggugagggggcggaccgagccccaacccucccggaucugagcagguauauaagggaccgggcaggcuucccgggcaagcugcgaaugcgaccagcucgagagaacgcaucaggugagagaagcccgcgaguucccgccgacuuugcgcggagcccuucggcuagccugcccuucccgccugagcugccggcccgccggccccugagcaccacuccgacggagucccccggccuuuucacgguggccgcuccagcccccggagcgccgucuccucccgccacgcuggcgcaccuccuucccgccccggcgauguacagccugcuggagacugaacucaagaaccccguggggccgcccaccccagccgcgggcaccggcguccccgcagcucccggcgcugcaggcaagaguggcgcgaacccagccggcggagcgaacgcaggcaacgggggcagcgggggcgcgaacggcggcggugguggugguggcggcgggggcagcgaccaggaccgcgucaagcgacccaugaacgcguucaugguguggucccgcgggcagcggcgcaagauggcccuggagaaccccaagaugcacaacuccgagaucagcaagcgcuugggcgccgacuggaaacugcugaccgaugcggagaagcggccguucaucgacgaggccaagcgacugcgugcggugcacaugaaggaguacccggacuacaaguaccggccccgccgcaagaccaagacgcugcucaagaaggacaaguacucgcugcccggcggccuccugcccccgggcgccgccgcagccgccgccgcugccgccgcagccgccgccgccagcagcccggugggcgugggccagcgccuggacacguacacgcacgugaacggcugggccaacggcgccuacucgcucgugcaggagcagcugggcuacgcgcagcccccgagcaugagcagcccgccgccgccacccgcgcugccucagaugcaccgcuacgacauggccggccugcaguacagccccaugaugccacccggcgcccagagcuacaugaacgccgccgccgccgcugccgccgccucgggcuacgggggcauggcgcccuccgccgcggccgccgccgccgccgccuacgggcagcagcccgccaccgcugccgccgcggccgccgccgccgccgccaugagccugggccccaugggcuccguggugaagucggagcccagcucuccgccgcccgccaucgcuucgcacucgcagcgcgcgugccucggcgaccugcgcgacaugaucagcauguaccugccaccuggcggggacgcggccgacgccgcuucuccgcucccaggcggccggcugcacggcgugcaccagcacuaccagggcgccgggacugcggucaauggaacggugccgcugacccacaucugagcuccggcccgcgcucccagcucuucgcccccaccccgccccacaccccccacguugggacgccuugcuguuuagcuuugcucgccugggaccguugccuuguaccgaagaugaggaggaccgaaaguuuggccguaacugucgggguuuuguacaaaagcgagaagucccgagcagcggaaaugggacuugcuagagccgcuggcuucugaccacugccccucccucccccucuggcugggaaucgcugugguguuugcggagaaaccgcggccccuuccucuucccggauuccuagguucuucuguugcaguugaaaaugucuuguuaguuugcuauuaaucgagaacugagugagguugcccgcccccaagaacugcaaugccuccacccccagucguauugcuucuguuuuccucuggcuuuuuuuuggggggggggugcuggccgcgccaauuggcgcgacagcuaaagccaauguuaauuuauagccaggugugcguguguuucccgccuugccgccccuggccgcgggacagcucuguccagugcgcguuuaggcuguugaguuugugauuucugcagugaucuauuugcuauuucguguacgcauuucguucgggugguggggaagggguuauuuuguuccagguuuuuucaaaguuuuguucuuaauugcuaagugagagaucaauaaauuuuauaaccaauaugcuggaguccugauaauuuugcggguccgaaauuugaagugcggguugggaauggggauagucuuaguuuuauaacugaguuugcagaccugggcgggggcgggggggggagcaugauguaaaaugauuuccuuuaagcuauuggagauccaagcuacaac

SEQ ID NO: 10951 - RNA, 2501 nt, Mus musculus
acugaggagcaacagcacgcccaggagagucccugguuccagguucucgccccugcaccuccuccugcccgccccucacccugugugugguguuagaaaugaaaagaugaaaaggcagcuaggguuucaguagucgaaagcaaaacaaaagcuaaaagaaaacaaaaagaaaauagcccaguucuuauuugcaccugcuucaguggacuuugaauuuggaaggcagaggauuuccccuuuucccucccgucaagguuugagcaucuuuuaaucuguucuucaaguauuuagagacaaacuguguaaguagcagggcagauccugucuugcgcgugccuuccuuuacuggagacuuugagguuaucugggcacuccccccacccacccccccuccugcaaguuuucuuccccggagcuucccgcaggugggcagcuagcugcagauacuacaucaucagucaggagaacucuucagagcaagagacgaggaggcaggauaagggaauucgguggaagcuacagacaagcucaaggauggaggugcaguuagggcugggaagggucuacccacggcccccauccaagaccuaucgaggagcguuccagaaucuguuccagagcgugcgcgaagcgauccagaacccgggccccaggcacccugaggccgcuaacauagcaccucccggcgccuguuuacagcagaggcaggagacuagcccccggcggcggcggcggcagcagcacacugaggaugguucuccucaagcccacaucagaggccccacaggcuaccuggcccuggaggaggaacagcagccuucacagcagcaggcagccuccgagggccacccugagagcagcugccuccccgagccuggggcggccaccgcuccuggcaaggggcugccgcagcagccaccagcuccuccagaucaggaugacucagcugccccauccacguugucccugcugggccccacuuucccaggcuuaagcagcugcuccgccgacauuaaagacauuuugaacgaggccggcaccaugcaacuucuucagcagcagcaacaacagcagcagcaccaacagcagcaccaacagcaccaacagcagcaggagguaaucuccgaaggcagcagcgcaagagccagggaggccacgggggcucccucuuccuccaaggauaguuaccuagggggcaauucaaccauaucugacagugccaaggaguuguguaaagcagugucuguguccaugggauuggguguggaagcauuggaacaucugaguccaggggaacagcuucggggagacugcauguacgcgucgcuccugggagguccacccgcggugcgucccacuccuugugcgccgcugcccgaaugcaaaggucuuccccuggacgaaggcccaggcaaaagcacugaagagacugcugaguauuccucuuucaagggagguuacgccaaaggauuggaaggugagagcuuggggugcucuggcagcagugaagcagguagcucugggacacuugagaucccguccucucugucucuguauaaaucuggagcacuagacgaggcagcagcauaccagaaucgcgacuacuacaacuuuccgcuggcucuguccgggccgccgcaccccccgcccccuacccauccacacgcccguaucaagcuggagaacccauuggacuacggcagcgccugggcugcggcggcagcgcaaugccgcuauggggacuuggguagucuacauggagggaguguagccgggcccagcacuggaucgcccccagccaccaccucuucuuccuggcauacucucuucacagcugaagaaggccaauuauaugggccaggaggcgggggcggcagcagcagcccaagcgaugccgggccuguagcccccuauggcuacacucggcccccucaggggcugacaagccaggagagugacuacucugccuccgaagugugguauccugguggaguugugaacagaguacccuaucccagucccaauugugucaaaagugaaaugggaccuuggauggagaacuacuccggaccuuauggggacaugcgguaaguuuauacuaaaaaugccuccuuuugaccaagggcacagaguaagcaguuugcauuuugugggaucuagggacucccgcccaauagaacaaucggaaggauccuaagucagcucagacuaguucuauaggaaggucuguccuacaucuggagcccucguggggacugucaucuugugaaauguuccgccuaagcccagggaaucuuugcugcgcuccggggugcuaauacgugcucuuugagauuccccuccaauuccccuagcuuucuaaacuccuccauuaagaucuuucugauauuucaaauccuaugaguuccaaacuuaaaucaauugcaugggccauuuucagaaaugacgccuguaagcucuucacgguuuuucauucuuuuccucaaaguucuggaaacacg

SEQ ID NO: 10952 - RNA, 2501 nt, Mus musculus
cguguuuccagaacuuugaggaaaagaaugaaaaaccgugaagagcuuacaggcgucauuucugaaaauggcccaugcaauugauuuaaguuuggaacucauaggauuugaaauaucagaaagaucuuaauggaggaguuuagaaagcuaggggaauuggaggggaaucucaaagagcacguauuagcaccccggagcgcagcaaagauucccugggcuuaggcggaacauuucacaagaugacaguccccacgagggcuccagauguaggacagaccuuccuauagaacuagucugagcugacuuaggauccuuccgauuguucuauugggcgggagucccuagaucccacaaaaugcaaacugcuuacucugugcccuuggucaaaaggaggcauuuuuaguauaaacuuaccgcauguccccauaagguccggaguaguucuccauccaaggucccauuucacuuuugacacaauugggacugggauaggguacucuguucacaacuccaccaggauaccacacuucggaggcagaguagucacucuccuggcuugucagccccugagggggccgaguguagccauagggggcuacaggcccggcaucgcuugggcugcugcugccgcccccgccuccuggcccauauaauuggccuucuucagcugugaagagaguaugccaggaagaagaggugguggcugggggcgauccagugcugggcccggcuacacucccuccauguagacuacccaaguccccauagcggcauugcgcugccgccgcagcccaggcgcugccguaguccaauggguucuccagcuugauacgggcguguggauggguagggggcggggggugcggcggcccggacagagccagcggaaaguuguaguagucgcgauucugguaugcugcugccucgucuagugcuccagauuuauacagagacagagaggacgggaucucaagugucccagagcuaccugcuucacugcugccagagcaccccaagcucucaccuuccaauccuuuggcguaaccucccuugaaagaggaauacucagcagucucuucagugcuuuugccugggccuucguccaggggaagaccuuugcauucgggcagcggcgcacaaggagugggacgcaccgcggguggaccucccaggagcgacgcguacaugcagucuccccgaagcuguuccccuggacucagauguuccaaugcuuccacacccaaucccauggacacagacacugcuuuacacaacuccuuggcacugucagauaugguugaauugcccccuagguaacuauccuuggaggaagagggagcccccguggccucccuggcucuugcgcugcugccuucggagauuaccuccugcugcuguuggugcuguuggugcugcuguuggugcugcugcuguuguugcugcugcugaagaaguugcauggugccggccucguucaaaaugucuuuaaugucggcggagcagcugcuuaagccugggaaaguggggcccagcagggacaacguggauggggcagcugagucauccugaucuggaggagcugguggcugcugcggcagccccuugccaggagcgguggccgccccaggcucggggaggcagcugcucucaggguggcccucggaggcugccugcugcugugaaggcugcuguuccuccuccagggccagguagccuguggggccucugaugugggcuugaggagaaccauccucagugugcugcugccgccgccgccgccgggggcuagucuccugccucugcuguaaacaggcgccgggaggugcuauguuagcggccucagggugccuggggcccggguucuggaucgcuucgcgcacgcucuggaacagauucuggaacgcuccucgauaggucuuggaugggggccguggguagacccuucccagcccuaacugcaccuccauccuugagcuugucuguagcuuccaccgaauucccuuauccugccuccucgucucuugcucugaagaguucuccugacugaugauguaguaucugcagcuagcugcccaccugcgggaagcuccggggaagaaaacuugcaggaggggggguggguggggggagugcccagauaaccucaaagucuccaguaaaggaaggcacgcgcaagacaggaucugcccugcuacuuacacaguuugucucuaaauacuugaagaacagauuaaaagaugcucaaaccuugacgggagggaaaaggggaaauccucugccuuccaaauucaaaguccacugaagcaggugcaaauaagaacugggcuauuuucuuuuuguuuucuuuuagcuuuuguuuugcuuucgacuacugaaacccuagcugccuuuucaucuuuucauuucuaacaccacacacagggugaggggcgggcaggaggaggugcaggggcgagaaccuggaaccagggacucuccugggcgugcuguugcuccucagu

SEQ ID NO: 10953 - RNA, 2501 nt, Mus musculus
acgggguccaacagaguguagguagugacuggacugggagcaggcaggcugacagaagugggcaccgagugggauucuggggcugguacgcgaguaugcgcaugugggguguguuuguguguauaaaaagaacacaaggacggugcuuucuggagguacuugggacaggguuugucugcucuaggucagugggccgggugcugaccgggugugcaugagagcaggccagcagcuuuugggaagcgccaacuucccuagaacucccugggaaccagacuaagcgggacagaggcauaaccgcaagagccgcacauucagauucgugccaucgagagagcagcguccuuaugagcuccccgaagccccaccccuuccugcucugugggcgugguauggggcaaggaccccgucacagagcuuucuauugguucgaaggagcaggguuggccuugugcucgccugagcaggagaguagaaagcucagcggcagcggagggagucuaugcgcgcuggacagcaguggggggugugugugauucgcacugacugcagacacucgggcucaaucgccggggauuaaggacuuggcgaccgggcugccgggcuacccggccgaggcuucagaggugcaaaucgacgggacugauuugcucggcagggccguacuagccuuuuaaguauacugagaagggccggugcuaaaguagaagcugucgugggacgcgccggcgcggagucccacuguggcccggaggaacggaguccguguuagggggacccagucgggagccuggggaccgagcucgcauuguugggagacaacccgccucuucuucccagaggcgucaaucccaggacggucgaggcgucggggcagccacugagcgcucuucagggagacccgaucggggagaggacuugcagucucaaacaaucugggagagccgagcggaauccggcgggaucacucgggggcggcgagcccccgucgcgccucgugcggcggagaggccagggaagaaaguccucggaggccgcagcccaugcgcggguuggggacgccugcccagugaguccuccuggccagccgggcgaaggagagcgaccccgaggccagcgggaggggagugcuucaaggccggcggcugcggaggaugggcgccugaguggcuccgagcgcugcgcggcacgggcaggcgaggcgagcuuugcugaggaggcgcuaggggauccugaagugcauucugccccggggaaaauggcccggccugggcagcguuggcucagcaaguggcuuguggcuauggucgugcugacgcugugccggcuugccacgccguuggccaagaaccuggagcccguguccuggagcucucuuaacccuaagugaguaacuuaucuacucuggucccugggggugggaggcacuucuucggggugaggucgugcacccccaagugcgugggggggguuguccguaggaggugcggcgcccuauuuuauaucuggccuuuucuaguguuuucuugcgggcagucgggguagggugcggaaggguggggugggggcacuuagcugcguuucgauccuucgguuuggcccuacucucaaguccggaucgcgucuguuggucacaccaggcagauauagaaugucugggcgcuccagagcgcacccgagagcugggugggggcgaguaagcagcccacuccagggccucugggaacguggugguuuucacucacagccacuccaggggugagaucgaccugagcaagggaccaggccagaacacagguuccucauuugcuuaggugucagggcggcucaggaccuagcgccccggggcgaguggcagcaucuguauaucuucuccagcuucucccauuuucauuugucuuucuucccugucuguuugccucccugucuuucucuuugccgucucuucuugcacacuccccccccccccccauuucucucugccggggagguagaaaggcgggcgcugcuuccaggcucacaaaggcggcggguggagaagggcggaguggaagaggguuuguuugagaaggggguucgauccagugcccgucggggguccaguugagcuaggcaccagagcuucuagagcuaucagggcugagaaugguaguggagccagcgagggagguggguggggaacgugugauuccuguccaggcagguccaacccccccccccccaaggacuggagagccaugcuuagauuucuccuaugguuggggguagugauauaaaggaggcccuuuucuuucuucuccuucuccuuccuaacucugcccccucccaucucuaaacaacacacaccuuucagggcgguggcucagugguuucugggcuguugguggggaguagcuuaggcuguugugaccucuggaccuuuuucucuuuuggcaucuaggacucaccguggaacucaggguuguaaucucucuucucauuuucuggcaguccaguugugg

SEQ ID NO: 10954 - RNA, 2501 nt, Mus musculus
ccacaacuggacugccagaaaaugagaagagagauuacaacccugaguuccacggugaguccuagaugccaaaagagaaaaagguccagaggucacaacagccuaagcuacuccccaccaacagcccagaaaccacugagccaccgcccugaaagguguguguuguuuagagaugggagggggcagaguuaggaaggagaaggagaagaaagaaaagggccuccuuuauaucacuacccccaaccauaggagaaaucuaagcauggcucuccaguccuuggggggggggggguuggaccugccuggacaggaaucacacguuccccacccaccucccucgcuggcuccacuaccauucucagcccugauagcucuagaagcucuggugccuagcucaacuggacccccgacgggcacuggaucgaacccccuucucaaacaaacccucuuccacuccgcccuucuccacccgccgccuuugugagccuggaagcagcgcccgccuuucuaccuccccggcagagagaaauggggggggggggggagugugcaagaagagacggcaaagagaaagacagggaggcaaacagacagggaagaaagacaaaugaaaaugggagaagcuggagaagauauacagaugcugccacucgccccggggcgcuagguccugagccgcccugacaccuaagcaaaugaggaaccuguguucuggccuggucccuugcucaggucgaucucaccccuggaguggcugugagugaaaaccaccacguucccagaggcccuggagugggcugcuuacucgcccccacccagcucucgggugcgcucuggagcgcccagacauucuauaucugccuggugugaccaacagacgcgauccggacuugagaguagggccaaaccgaaggaucgaaacgcagcuaagugcccccaccccacccuuccgcacccuaccccgacugcccgcaagaaaacacuagaaaaggccagauauaaaauagggcgccgcaccuccuacggacaaccccccccacgcacuugggggugcacgaccucaccccgaagaagugccucccacccccagggaccagaguagauaaguuacucacuuaggguuaagagagcuccaggacacgggcuccagguucuuggccaacggcguggcaagccggcacagcgucagcacgaccauagccacaagccacuugcugagccaacgcugcccaggccgggccauuuuccccggggcagaaugcacuucaggauccccuagcgccuccucagcaaagcucgccucgccugcccgugccgcgcagcgcucggagccacucaggcgcccauccuccgcagccgccggccuugaagcacuccccucccgcuggccucggggucgcucuccuucgcccggcuggccaggaggacucacugggcaggcguccccaacccgcgcaugggcugcggccuccgaggacuuucuucccuggccucuccgccgcacgaggcgcgacgggggcucgccgcccccgagugaucccgccggauuccgcucggcucucccagauuguuugagacugcaaguccucuccccgaucgggucucccugaagagcgcucaguggcugccccgacgccucgaccguccugggauugacgccucugggaagaagaggcggguugucucccaacaaugcgagcucgguccccaggcucccgacugggucccccuaacacggacuccguuccuccgggccacagugggacuccgcgccggcgcgucccacgacagcuucuacuuuagcaccggcccuucucaguauacuuaaaaggcuaguacggcccugccgagcaaaucagucccgucgauuugcaccucugaagccucggccggguagcccggcagcccggucgccaaguccuuaauccccggcgauugagcccgagugucugcagucagugcgaaucacacacaccccccacugcuguccagcgcgcauagacucccuccgcugccgcugagcuuucuacucuccugcucaggcgagcacaaggccaacccugcuccuucgaaccaauagaaagcucugugacgggguccuugccccauaccacgcccacagagcaggaagggguggggcuucggggagcucauaaggacgcugcucucucgauggcacgaaucugaaugugcggcucuugcgguuaugccucugucccgcuuagucugguucccagggaguucuagggaaguuggcgcuucccaaaagcugcuggccugcucucaugcacacccggucagcacccggcccacugaccuagagcagacaaacccugucccaaguaccuccagaaagcaccguccuuguguucuuuuuauacacacaaacacaccccacaugcgcauacucgcguaccagccccagaaucccacucggugcccacuucugucagccugccugcucccaguccagucacuaccuacacucuguuggaccccgu

SEQ ID NO: 10955 - RNA, 2501 nt, Mus musculus
guagaaggaugaauuggucccgggaaggcccuccagaagugggacucgauucuggcuccucugucugcuagaaugcauuacagaaggggauacccccagguaauuuucagcaugguagccuauggcggagcuaauggucuggguugacgugucaacaaggacagguucguccaucaccaugagcucuccauguaggccgugguggugggcagcaagugugugcacaugggcguguaugugcucgugcacauacacaugcucgugcucuaucuccucccucucuugcuccugcucuggcuccaggacccuaacgauaacuucaucuucuucuucauacuuauucucaucgcuauccucauucuucaucuccuccuccuugucuuccuccuccucuuccuccuccucuuccuccucgucgucgucgucuucauccuccuccucaaauucauaauccucauccucguccucauccuccucauccuccaucucgucuuccucuuuccucaucuccuccucuuccucccucaucucuugugggaaagcugucaugugcugccucugauccuucagauaaagccuguacccgccugccucuucacccucacccucauuuucacuguagaacuccacaccuucauuuucauccucauuaggaauuagugcaaaggggcagcagcuauuuugaacuccagugagcgaggcugucuuggggacacgcacuuuccuuucuaucuugacacacucaagaaucagcucauccaggucggccacuucaguugaccauaagaguuccuuucgaaaaauuucugacaagccuuugagaaauugguuuuggaggcgacagucaucccaagacaagaacugggccaagaacugaaaagcaucugcauagcugcccaggguacaguuucccugcuugagcuugcguauggccuuuuuagccacgcgugaggggauggggccacagaauuccuuacggauuucauccaggaagcgcgggaaguuggcaugcaaggagcuuccuuccugagugacugagauagcccagucucucgcuuccccugugaaaaaggagaugagaaaugccacccguuccgcgcccccagggaagugauccucgugaucugcuaugaaagucucuagcugcaucagaaauucagccagguacacugggucgccugaaaaggguucuaugucuggccgcuccagcgguggcaaaaggaacucaaagguuggcuccuuuaacaugggggagugcaguuccggcugggacgggcugggugacagaggagggucacuggacccgucgggguugguauaguccuggaccacauuaaucaaaagaucaucugagacguacucgggaucugugcguggaggaggccagcacaggaaaggcaccuccuccuccuccucuuccuccuccucaggagugggaucagucucauugagcaggaacucaaaguucuccucggcaaggaccgguacuaugggcaugggccagcggauguagcucgagacauugccccgcaaggaauuaaccucggccaaggcucuuccgagcugcaggcccagcuggacauucucuccucgaagggcauuuaacuccucucgcagggccacauucgccaagcggaggcuauugagauuucccgccgcuucagacauugugacaaguuccuggggcuuugagugcugggcacuuggggguagggaguuauggggagugcaggaggaggcagaaaugaggaggugggcgugggaggagaccaacgugcggcgacagggcgacccggcgcaagcgagcccgggccacacccacaggggcucgguccgggacgcguuaccucguggcaggggucggagagagagcaggcagcagcucgggaccuggaggcggcaggcgcaggagacagacgagacgcuggcagaggugacgccaacagaggcaggcagaguaggagggaagggacugcggcaggaucugucgaggaaaaaucuugcagacagcgaucccucucgccuuuuaagcucagcuacgcgcgccccccgcaggggcgggccuucgggaaccgagggagcccacuggcucccgcggcugcgcucucacucacucucuccuucccuagcugcagcuaacucgggucgggaaaaugcgacagcgacugcccacucgaggucgucauggcgacagccagugaacguguuccucuccucgggcaggcccccgaguguagaggaacugcuucgcgaggcgcagcucaaucuccagagccuguugcaagguacugcgaggguggggggcugccuuagaggcagcugcgcagcaggagggaggcaaagaagaaauggggagcagcaaaagaaaagaaaacaguuccaaaccaucucucuuuucaccuuccagacugaugaugcuaacauucuguuuccagugcuguugcucccuuccucccucccuuuuugguucaguaguccauaaagggagaaaggauacaggc

SEQ ID NO: 10956 - RNA, 2501 nt, Mus musculus
gccuguauccuuucucccuuuauggacuacugaaccaaaaagggagggaggaagggagcaacagcacuggaaacagaauguuagcaucaucagucuggaaggugaaaagagagaugguuuggaacuguuuucuuuucuuuugcugcuccccauuucuucuuugccucccuccugcugcgcagcugccucuaaggcagccccccacccucgcaguaccuugcaacaggcucuggagauugagcugcgccucgcgaagcaguuccucuacacucgggggccugcccgaggagaggaacacguucacuggcugucgccaugacgaccucgagugggcagucgcugucgcauuuucccgacccgaguuagcugcagcuagggaaggagagagugagugagagcgcagccgcgggagccagugggcucccucgguucccgaaggcccgccccugcggggggcgcgcguagcugagcuuaaaaggcgagagggaucgcugucugcaagauuuuuccucgacagauccugccgcagucccuucccuccuacucugccugccucuguuggcgucaccucugccagcgucucgucugucuccugcgccugccgccuccaggucccgagcugcugccugcucucucuccgaccccugccacgagguaacgcgucccggaccgagccccuguggguguggcccgggcucgcuugcgccgggucgcccugucgccgcacguuggucuccucccacgcccaccuccucauuucugccuccuccugcacuccccauaacucccuacccccaagugcccagcacucaaagccccaggaacuugucacaaugucugaagcggcgggaaaucucaauagccuccgcuuggcgaauguggcccugcgagaggaguuaaaugcccuucgaggagagaauguccagcugggccugcagcucggaagagccuuggccgagguuaauuccuugcggggcaaugucucgagcuacauccgcuggcccaugcccauaguaccgguccuugccgaggagaacuuugaguuccugcucaaugagacugaucccacuccugaggaggaggaagaggaggaggaggaggugccuuuccugugcuggccuccuccacgcacagaucccgaguacgucucagaugaucuuuugauuaaugugguccaggacuauaccaaccccgacggguccagugacccuccucugucacccagcccgucccagccggaacugcacucccccauguuaaaggagccaaccuuugaguuccuuuugccaccgcuggagcggccagacauagaacccuuuucaggcgacccaguguaccuggcugaauuucugaugcagcuagagacuuucauagcagaucacgaggaucacuucccugggggcgcggaacggguggcauuucucaucuccuuuuucacaggggaagcgagagacugggcuaucucagucacucaggaaggaagcuccuugcaugccaacuucccgcgcuuccuggaugaaauccguaaggaauucuguggccccauccccucacgcguggcuaaaaaggccauacgcaagcucaagcagggaaacuguacccugggcagcuaugcagaugcuuuucaguucuuggcccaguucuugucuugggaugacugucgccuccaaaaccaauuucucaaaggcuugucagaaauuuuucgaaaggaacucuuauggucaacugaaguggccgaccuggaugagcugauucuugagugugucaagauagaaaggaaagugcguguccccaagacagccucgcucacuggaguucaaaauagcugcugccccuuugcacuaauuccuaaugaggaugaaaaugaagguguggaguucuacagugaaaaugagggugagggugaagaggcaggcggguacaggcuuuaucugaaggaucagaggcagcacaugacagcuuucccacaagagaugagggaggaagaggaggagaugaggaaagaggaagacgagauggaggaugaggaggaugaggacgaggaugaggauuaugaauuugaggaggaggaugaagacgacgacgacgaggaggaagaggaggaggaagaggaggaggaagacaaggaggaggagaugaagaaugaggauagcgaugagaauaaguaugaagaagaagaugaaguuaucguuaggguccuggagccagagcaggagcaagagagggaggagauagagcacgagcauguguaugugcacgagcacauacacgcccaugugcacacacuugcugcccaccaccacggccuacauggagagcucauggugauggacgaaccuguccuuguugacacgucaacccagaccauuagcuccgccauaggcuaccaugcugaaaauuaccuggggguauccccuucuguaaugcauucuagcagacagaggagccagaaucgagucccacuucuggagggccuucccgggaccaauucauccuucuac

SEQ ID NO: 10957 - RNA, 2501 nt, Mus musculus
gauuacauuuuucuacauugguaaggguugggacugugcagugaaaauuucuagcuagcuacagguuuccuaaguagaacuaaaucccagcccuuuggagaaggggcaguaauuugagagguauuagagguuucgauagagaaaaugacagaggagacaagggaggggaugaaagcugcacccuuccaugcgccacgcacauuuuccccaaugcauccuuaggaugcaauuuugaaaaucuaucaaguaccugacacuuggguagaaaccuucuaguagguacccugacucuugagaaauagcuaguauuaccuccauuuacccaucugcuccaagcuccuugucuccuaucaaagccucccuccugccauugcgcaguuuuggugcagaaucaccagguccacuuucgcaaacccacgggagaggcuggguugggcggggucgccuugucgcagagcccaacugcgccugcgcggacugcggcagaaggcggggugugagaggcgagcauucugagacuagcguucacagucggcuagaaccuucguucuugcccaccaccucuaauuucugcuccugcgacuugcucgggccuggcagcagcagcauuccugcucuagcggcaguuccgugcagaggcgccuacauaccucucccccucgucugugagaucgcgggccugucagugucagcuuccacacgucggucgacaggaccaugucgcugguaagccagaauucgcgccgccgccgcgguggaagggccaaugcgcgcagaaacaacgggaagggucacccugcugcugugccaggcccagacgucccucgggaucgcaacgauccuaagauccuccagggccuccgcgccucugagggcccuggcaccuccaugcugcccaccccccgggagggcccaagcgccucugugccgcccaccgccucagagggcucaagcgccccuaggcaguucaucauuucccaggggccgaacaccuccgagaugcccaccuccaggaagggucggggcgccucccggccuccugcaguuuccgcagggcugaacaccgcuaugucaaucaccgccucggagggcccgaauagcccugugccgcccacugcuccuaaaggcucaaaggccuaugagcaucucccugucucagaagggcuggccaucucugagcagcgucacucugaugggggcccuaacauggagcccacccugggugagggcccgggaaucucggugccgcccaccuucucugaggaaucgggcauuucugaugagggcuugagcaucuuuaugucgcccaacaucucggagggaccggguaucaacgagcccuacuccguuagugaggacccaagcacuucggugccgcccacugacucuaauggacugggcaucaaccugccgcccaccuucggugagggccugagcaucucuaugcuguucuccgcuuuggaggaacccgacaucuuugcgccgccccccuccgcugagggacuguucgccuccaugucgccccccuccggugagauccagagcuccugggugucgcccaucauaauggagggauguaacgucaacgugccgcccaccuccaaaaagggacugcgcaccucggugccaucagcugcuugugagagcccgagcaccucagccgagggccugagcucgucccugucauccauuucugcugagggcuucugcagcucgcuggcgccaugcgcugcggagggauccugugagcugcuucccugcggggagggccggagcaccucggagcugcacugccugggggaggggucgagcaccucgcagaugucccuagcugccgagggcccuagcgcuucugggaugcccacugaagcuaauaaccccgaggaagcacugagcugcugugcuucugagcgcaggaacaagagcaccucccgugcucugcaaaaggccaaggauccaucuguacgcccaaagcgugaagaccgcuuccuggauuuccagguccugagagacaguaagaauuccaacuccaucaccauuaugggccugggcaccucccgcguugcucuuaccuugaagccucaggaucccauggagcaaaacguagcagaauuguugcaguuucugcugcugaaggaucagaccaaguacccuaucaaggaaucugauaugagggaauucauugacaaagacuaucgccaccaguucccggagauccucagacgagcagcaguccaccuggagugcauuuuucgguuugaacugaaggagcucgacacugaggagcacaucuacauccugcucaacaaacugggaccagugcccuuugaaggguuagaagacgucccaaaugggccaaagaugggccucuugaugaugauucugggacacauauuacuaaauggcaaccaagcgagagaagcugauaucugggagaugcucuggagauucggagugcagcgugaaagaaggcuuucuguuuuugggaacgugaagagacu

SEQ ID NO: 10958 - RNA, 2501 nt, Mus musculus
agucucuucacguucccaaaaacagaaagccuucuuucacgcugcacuccgaaucuccagagcaucucccagauaucagcuucucucgcuugguugccauuuaguaauaugugucccagaaucaucaucaagaggcccaucuuuggcccauuugggacgucuucuaacccuucaaagggcacuggucccaguuuguugagcaggauguagaugugcuccucagugucgagcuccuucaguucaaaccgaaaaaugcacuccagguggacugcugcucgucugaggaucuccgggaacugguggcgauagucuuugucaaugaauucccucauaucagauuccuugauaggguacuuggucugauccuucagcagcagaaacugcaacaauucugcuacguuuugcuccaugggauccugaggcuucaagguaagagcaacgcgggaggugcccaggcccauaauggugauggaguuggaauucuuacugucucucaggaccuggaaauccaggaagcggucuucacgcuuugggcguacagauggauccuuggccuuuugcagagcacgggaggugcucuuguuccugcgcucagaagcacagcagcucagugcuuccucgggguuauuagcuucagugggcaucccagaagcgcuagggcccucggcagcuagggacaucugcgaggugcucgaccccucccccaggcagugcagcuccgaggugcuccggcccuccccgcagggaagcagcucacaggaucccuccgcagcgcauggcgccagcgagcugcagaagcccucagcagaaauggaugacagggacgagcucaggcccucggcugaggugcucgggcucucacaagcagcugauggcaccgaggugcgcagucccuuuuuggaggugggcggcacguugacguuacaucccuccauuaugaugggcgacacccaggagcucuggaucucaccggaggggggcgacauggaggcgaacagucccucagcggaggggggcggcgcaaagaugucggguuccuccaaagcggagaacagcauagagaugcucaggcccucaccgaaggugggcggcagguugaugcccaguccauuagagucagugggcggcaccgaagugcuuggguccucacuaacggaguagggcucguugauacccggucccuccgagauguugggcgacauaaagaugcucaagcccucaucagaaaugcccgauuccucagagaaggugggcggcaccgagauucccgggcccucacccagggugggcuccauguuagggcccccaucagagugacgcugcucagagauggccagcccuucugagacagggagaugcucauaggccuuugagccuuuaggagcagugggcggcacagggcuauucgggcccuccgaggcggugauugacauagcgguguucagcccugcggaaacugcaggaggccgggaggcgccccgacccuuccuggaggugggcaucucggagguguucggccccugggaaaugaugaacugccuaggggcgcuugagcccucugaggcggugggcggcacagaggcgcuugggcccucccggggggugggcagcauggaggugccagggcccucagaggcgcggaggcccuggaggaucuuaggaucguugcgaucccgagggacgucugggccuggcacagcagcagggugacccuucccguuguuucugcgcgcauuggcccuuccaccgcggcggcggcgcgaauucuggcuuaccagcgacaugguccugucgaccgacguguggaagcugacacugacaggcccgcgaucucacagacgagggggagagguauguaggcgccucugcacggaacugccgcuagagcaggaaugcugcugcugccaggcccgagcaagucgcaggagcagaaauuagagguggugggcaagaacgaagguucuagccgacugugaacgcuagucucagaaugcucgccucucacaccccgccuucugccgcaguccgcgcaggcgcaguugggcucugcgacaaggcgaccccgcccaacccagccucucccguggguuugcgaaaguggaccuggugauucugcaccaaaacugcgcaauggcaggagggaggcuuugauaggagacaaggagcuuggagcagauggguaaauggagguaauacuagcuauuucucaagagucaggguaccuacuagaagguuucuacccaagugucagguacuugauagauuuucaaaauugcauccuaaggaugcauuggggaaaaugugcguggcgcauggaagggugcagcuuucauccccucccuugucuccucugucauuuucucuaucgaaaccucuaauaccucucaaauuacugccccuucuccaaagggcugggauuuaguucuacuuaggaaaccuguagcuagcuagaaauuuucacugcacagucccaacccuuaccaauguagaaaaauguaauc

SEQ ID NO: 10959 - RNA, 2501 nt, Mus musculus
cucaucucauuauaaagguagcucuacagauucacuuugauuacagcuaguacuugcgggauucagagaccuuuuugaaaauuacauuaauuuuaaaguuuuauguauuuguaccauaucugcagcacccccucccuccgacuucuuccaugucuugaggguuuuuuuuuaaauuagcauugucuuuuuuaaaagugaugaggaauuaagaaaaagggaagaggcgauaaagcaguuaaaacuucugaaacacauuuaaaacaaaaacaaaaacauucagacacagaaacuucuucacuauguugcccaggcaggccuugaaaucuuggguucaaaugaucuuccugccucaacaccuucaguagcugggacucugcauaugcucuuuccuuccccccaccccacccccacagcuaccauauucagccuauagucaauauagaaaucaccaccacccaauuuccaaacaucaucuccaaacaaaaaaauagacaguucccugucuauccaguagugggucucaaggcugggaucuuugagacaagagucuugagcuacugauuaacaaacuuuauuaccugccuguaagauuccccaagguuacagagcuagggaugacuggcccugaaugaagcauacauacauugcaguaauaacugaaccaauauaagagaugcauuugggauuauuaaggcuaagcaacuaguaaugauuauccaagccagauguccaaagcacuaauacucagaccauugggauggcaauuagggggacaggaaaacaagaacaccauaccccugggaccauagaucuuccuuucccauugaaccuucccuccccuucaguccauucuaugccacaauagugucucccuaauagcccgcugaaggaaaagaugucugaggucucuucgugcucuuugucucuguccccaaggcaacagaaagcuugagcugcugcagcgggccuggcagugauggcuaaccccauuagcugugcagacugagcaguccuuggcagccccuggagcagcugccaguuaaacggccccagaguucugcuagacuucguugcuucgauucaaugccaaguguuggacgugcuggauucuguucccagaaggcuagagcaugguguuggggcuggcugaagacaagaaagcagaggcaguuuaauucgguuggauaugcgggguaggggugccugccggcauggaagggaggggagagagaagguggucgggugugaguaaggcgcugcuucuucuuccagggccuugccuugaaggguucugaccucucaucaucuucugggccucggguaaagcgagcucuggaacggcaguaaaagcgcgggagccaggcccagggauaagcaaaaugaggaggacagcggaucuagacccucucagcgcccugagccagcgcaggcagcgccccugcugcgagcugguggccgcccucagccagcaagcccuggccauucuccgggucggcagaugcgauggcagcggggacccauuccugcucagcaacacaggccagggguggcucauccuuggccucgacgagcuugcgggagcggguguaggccaggaugaggccuccggcuaggcaggcauagaagaucaugaugaguaggauguagagauaagcgucguuacccuuggcgcuggucgccucgcggcccacgaaagggucagggacgacccccaugcccaugcucgggccgguuccgaugcccaggccgcuggcguugccacgauggugcagcuccagcagcaagcgguucaagaggguuugcagccguuggcucucgcugcaguucauagcuguuggagaguggcacggaggcuccaggacgcaguugaccuuucccccuggacaaggggaagcaagcgagcaaggggagcaagcagagcaggcagggugcagagacuucgacagcgagguggcacccagcuccccggcaggcgcucagugacuggggccucaggccgggccuuccuuauccccucaccccugcuccuccuccccuuccccaccacgcccccuccagcccgccgccgccucuuuccaggcucagacugucuggccacuuaggggaaaggggacagcugguagggggaggagaaggggacaagggauggggcgagcccagaggaggggcggagagggugggggcucggaaugcgcgaggccccaggcagcagagguuggcaaggcugcauacuggggccaagccuggacccugggcugcggaagagaauuccuuccaaguucuagccaccagcccugcaggccuggcuuuggcccagauacagcagccgccugccuccccuaagacagaaccugcccuggagcaugcccaagcaagauuucagaugucuuccaucagcacuagcuggauuauggcagcugagaccccuuguucacauccuaccccuguuagucaaggccuauuuccuuucuaguccucacacauuuuucucacauuuuccc

SEQ ID NO: 10960 - RNA, 2501 nt, Mus musculus
gggaaaaugugagaaaaaugugugaggacuagaaaggaaauaggccuugacuaacagggguaggaugugaacaaggggucucagcugccauaauccagcuagugcugauggaagacaucugaaaucuugcuugggcaugcuccagggcagguucugucuuaggggaggcaggcggcugcuguaucugggccaaagccaggccugcagggcugguggcuagaacuuggaaggaauucucuuccgcagcccaggguccaggcuuggccccaguaugcagccuugccaaccucugcugccuggggccucgcgcauuccgagcccccacccucuccgccccuccucugggcucgccccaucccuuguccccuucuccucccccuaccagcuguccccuuuccccuaaguggccagacagucugagccuggaaagaggcggcggcgggcuggagggggcgugguggggaaggggaggaggagcaggggugaggggauaaggaaggcccggccugaggccccagucacugagcgccugccggggagcugggugccaccucgcugucgaagucucugcacccugccugcucugcuugcuccccuugcucgcuugcuuccccuuguccagggggaaaggucaacugcguccuggagccuccgugccacucuccaacagcuaugaacugcagcgagagccaacggcugcaaacccucuugaaccgcuugcugcuggagcugcaccaucguggcaacgccagcggccugggcaucggaaccggcccgagcaugggcaugggggucgucccugacccuuucgugggccgcgaggcgaccagcgccaaggguaacgacgcuuaucucuacauccuacucaucaugaucuucuaugccugccuagccggaggccucauccuggccuacacccgcucccgcaagcucgucgaggccaaggaugagccaccccuggccuguguugcugagcaggaauggguccccgcugccaucgcaucugccgacccggagaauggccagggcuugcuggcugagggcggccaccagcucgcagcaggggcgcugccugcgcuggcucagggcgcugagagggucuagauccgcuguccuccucauuuugcuuaucccugggccuggcucccgcgcuuuuacugccguuccagagcucgcuuuacccgaggcccagaagaugaugagaggucagaacccuucaaggcaaggcccuggaagaagaagcagcgccuuacucacacccgaccaccuucucucuccccucccuuccaugccggcaggcaccccuaccccgcauauccaaccgaauuaaacugccucugcuuucuugucuucagccagccccaacaccaugcucuagccuucugggaacagaauccagcacguccaacacuuggcauugaaucgaagcaacgaagucuagcagaacucuggggccguuuaacuggcagcugcuccaggggcugccaaggacugcucagucugcacagcuaaugggguuagccaucacugccaggcccgcugcagcagcucaagcuuucuguugccuuggggacagagacaaagagcacgaagagaccucagacaucuuuuccuucagcgggcuauuagggagacacuauuguggcauagaauggacugaaggggagggaagguucaaugggaaaggaagaucuauggucccagggguaugguguucuuguuuuccugucccccuaauugccaucccaauggucugaguauuagugcuuuggacaucuggcuuggauaaucauuacuaguugcuuagccuuaauaaucccaaaugcaucucuuauauugguucaguuauuacugcaauguauguaugcuucauucagggccagucaucccuagcucuguaaccuuggggaaucuuacaggcagguaauaaaguuuguuaaucaguagcucaagacucuugucucaaagaucccagccuugagacccacuacuggauagacagggaacugucuauuuuuuuguuuggagaugauguuuggaaauugggugguggugauuucuauauugacuauaggcugaauaugguagcugugggggugggguggggggaaggaaagagcauaugcagagucccagcuacugaagguguugaggcaggaagaucauuugaacccaagauuucaaggccugccugggcaacauagugaagaaguuucugugucugaauguuuuuguuuuuguuuuaaauguguuucagaaguuuuaacugcuuuaucgccucuucccuuuuucuuaauuccucaucacuuuuaaaaaagacaaugcuaauuuaaaaaaaaacccucaagacauggaagaagucggagggagggggugcugcagauaugguacaaauacauaaaacuuuaaaauuaauguaauuuucaaaaaggucucugaaucccgcaaguacuagcuguaaucaaagugaaucuguagagcuaccuuuauaaugagaugag

SEQ ID NO: 10961 - RNA, 841 nt, Mus musculus
ccauggagggccagcgcguggaggagcugcuggccaaggcagagcaggaggaggcggagaagcugcagcgcaucacggugcacaaggagcuggagcuggaguucgaccugggcaaccugcuggcuucggaccgcaaccccccgaccgugcugcgccaggccgggccgucgccggaggccgagcugcgggcccuggcgcgggacaacacgcagcugcucaucaaccagcuguggcggcugccgaccgagcgcguggaggaggcgguggucgcgcgcuugccggagcccgccacucgccugccccgcgagaagccgcugccccgaccacggccgcucacccgcuggcagcaguucgcgcgccuuaagggaauccgucccaagaagaagaccaaccucgugugggacgaggcgaguggccaguggcggcgccguuggggcuacaagcgcgcccgggaugacacuaaagaauggcugaucgaggugccugggagcgccgaccccauggaagaccaguucgccaagaggacucaggccaagaaagaacgcguggccaagaaugagcugaaccgucugcggaaccuggcucgcgcgcacaagaugcagaugcccagcucagccggccugcacccuacuggacaccagaguaaggaagagcugggccgcgccaugcaaguggccaagguuuccaccgcuucggugggacgcuuccaggagcgccuucccaaggagaaagcuccccggggcuccggcaagaagaggaaguuucagccccucuuuggggacuucgcagccgagaaaaagaaccaguuggagcuacuucgagucaugaacagcaagaaacc

SEQ ID NO: 10962 - RNA, 841 nt, Mus musculus
gguuucuugcuguucaugacucgaaguagcuccaacugguucuuuuucucggcugcgaaguccccaaagaggggcugaaacuuccucuucuugccggagccccggggagcuuucuccuugggaaggcgcuccuggaagcgucccaccgaagcgguggaaaccuuggccacuugcauggcgcggcccagcucuuccuuacucugguguccaguagggugcaggccggcugagcugggcaucugcaucuugugcgcgcgagccagguuccgcagacgguucagcucauucuuggccacgcguucuuucuuggccugaguccucuuggcgaacuggucuuccauggggucggcgcucccaggcaccucgaucagccauucuuuagugucaucccgggcgcgcuuguagccccaacggcgccgccacuggccacucgccucgucccacacgagguuggucuucuucuugggacggauucccuuaaggcgcgcgaacugcugccagcgggugagcggccguggucggggcagcggcuucucgcggggcaggcgaguggcgggcuccggcaagcgcgcgaccaccgccuccuccacgcgcucggucggcagccgccacagcugguugaugagcagcugcguguugucccgcgccagggcccgcagcucggccuccggcgacggcccggccuggcgcagcacggucgggggguugcgguccgaagccagcagguugcccaggucgaacuccagcuccagcuccuugugcaccgugaugcgcugcagcuucuccgccuccuccugcucugccuuggccagcagcuccuccacgcgcuggcccuccaugg

SEQ ID NO: 10963 - RNA, 3014 nt, Mus musculus
uugugaccacaauaccuuggggaaacaugaacagaaguaguuacaguagcaguccaagaggccucccuguaccuauacuauguuggaagcuugaagguguauuggguggccagggguggggguggggaauuuaauugcccggagaaauucuuuauucaauaaaaucgucccucguuuacagauaguuacaaguuaagggcacauguugaaguaaauccuaacccagaccgcagaggauccuguuugggacacaacaaaggaucugagaaguaagcccaagaaguauuugagguuugguucagagaaggcuaaaggcugacugugugugucgccgccacgcuuugcugccucugggaacacagagcugagccgcggacuggcucccuacgccaaacgcgguccgccacccaacuccuucuguaacgccauugcagguggcauuguguuggauucugaguguguagcaucugagucucggaauuuaggggaaacaagaauuucccgggcuccgcggaguuucccuccggcagaggcagcgcgcccugaagggagggcgcuccuugcuccgggugugacacacccgcagccccgcacgaaggugcguggggcgggagggaggugcggacugggagaggggcggcaggguugcguggcaccuuaacuuugaucgcgcggccgcggggcugcgagccaccgccgccccgcccgagcugggugccgcgguccucggcucugcgccgcgcgucuccgcggcugccucuuuaaucaggaacacagaaggggcgggcccugagcgggcgcguaaucggaucgcucugccgcggcucugacauccacaugcugcucggccugaaaaggcgaggggggagccggaggggaggcagaggaggcgagcaaggcaccagccugcagcccgcccccggcacauccucugaagcacagacacucggccgggcgcugggcgagguggaggugagggcgggcgccagcgaacucggagagccgcucgcacacucgcgggcgaucccagccgccgcacccgcagcaacaccagcagcaccggccgcagcagcuuccugccucgcacuccccuccagagacuggccaagcggguguaaccgccgggggaggcuccagcuuaggggaacccagaaaggacaagagccggacgucugacugcuuaccacuccgccuguccagcggucggugccucugcccgcgugugugucccgggugccgggggaccugugucaguuagcgcuucugagaucacacagcugccuaggggccgugugaugcccagggcaauucuuggcuuugauuuuuauuauuauuacuauuauuuugcguucagcuuucgggaaacccucgugauguuguaggauaaaggaaaugacacuuugaggaacuggagagaacauacacgcguuuggguuugaagaggaaaccggucuccgcuuccuuagcuugcucccucuuugcugauuucaagagcuaucuccuagugagguggagauauuccagcaagaauaaaggugaagacagacugacugccaggacccaggaggaaaacguugaucguuagagaccuuugcagaagacaccaccaggaagaaaauuagagaggaaaaacacaaagacauaauuauaggagaucccacaaaccuagccccggagagagccucucugucaaaaauggauauguuuccucuuaccuggguuuucuuagcucuguacuuuucaggacacgaagugagaagccagcaagguaagcccuucaaaguuuuucuauucauuuuuacacgguuuccccuuuaaaggcgacagcuaauggagagaagccacugagaagcgcucaugaggaggcucccucaauacucaaucauuuaaagggagaucucagcggccuucuuuacaccaccagggcugcuaaacccaacuuuucucucuugcaaagggaguguguguguguguguguguguguguguguguguguguguguuuuguaacagaauuuggcgguguucagaugucacauauggacugaaucaaagguuuaaaaauacuacaaagccuuugcauuacaguuuuggggauuuuuuuuuccucccugucuugaagcagaacacaucucccuugaguuuccucaaccuagccagugaaauauaaaucauuugcauucccuccacuuagcuacauugagcaauguuagcugaagggcuugggaaaaaaaaaaaaaagcaagagucuagcuuugcuuuucagauguguggauucuuugcagacuggguggauacaucucagaaccagagggcugaagcuggugaagcaagccagcuugugaccgagaugggagcuuucccgugggcaguugaugguccccacucucucccgaauccguguguuuucugggaaagcgaaucauguucuuuaaauuuuuuucuuaaaagauaaaacaaacuguaugacccucggcagucucuccucuugugaagugguuagaaacuuuugaguggaauuuauucucaagcacugccaaaaaggguguguggacacgggcugcagagauaggcacagcagggccuaggagaggccgggggccagcucuuguggauugcgacaagggcuaccucucugaaaacaggucucuggucucugggaaugcgguucuuccacccugggacugcuucugggggugcuucccucugcucuaagacagugucuggaaccugaaaaaaaacuauuagccuauuagcguuugcuccuacaggugacuggggauaggguaccaucuaccaaggaaaugggggaagagagaaggagagaggaaagacagagacaaaaacucggagaagugcuauugccuugaggcacuuggcggagucaggcagccgcaguggugggucuccuuccucacagccacccuggcgcccccgcaccgugcuuagcggguggguccugaggcaaaagcuuagcugcuaccaagcuucuugucccuuccccaacacauaccu

SEQ ID NO: 10964 - RNA, 3014 nt, Mus musculus
agguauguguuggggaagggacaagaagcuugguagcagcuaagcuuuugccucaggacccacccgcuaagcacggugcgggggcgccaggguggcugugaggaaggagacccaccacugcggcugccugacuccgccaagugccucaaggcaauagcacuucuccgaguuuuugucucugucuuuccucucuccuucucucuucccccauuuccuugguagaugguacccuauccccagucaccuguaggagcaaacgcuaauaggcuaauaguuuuuuuucagguuccagacacugucuuagagcagagggaagcacccccagaagcagucccaggguggaagaaccgcauucccagagaccagagaccuguuuucagagagguagcccuugucgcaauccacaagagcuggcccccggccucuccuaggcccugcugugccuaucucugcagcccguguccacacacccuuuuuggcagugcuugagaauaaauuccacucaaaaguuucuaaccacuucacaagaggagagacugccgagggucauacaguuuguuuuaucuuuuaagaaaaaaauuuaaagaacaugauucgcuuucccagaaaacacacggauucgggagagaguggggaccaucaacugcccacgggaaagcucccaucucggucacaagcuggcuugcuucaccagcuucagcccucugguucugagauguauccacccagucugcaaagaauccacacaucugaaaagcaaagcuagacucuugcuuuuuuuuuuuuuucccaagcccuucagcuaacauugcucaauguagcuaaguggagggaaugcaaaugauuuauauuucacuggcuagguugaggaaacucaagggagauguguucugcuucaagacagggaggaaaaaaaaauccccaaaacuguaaugcaaaggcuuuguaguauuuuuaaaccuuugauucaguccauaugugacaucugaacaccgccaaauucuguuacaaaacacacacacacacacacacacacacacacacacacacacacucccuuugcaagagagaaaaguuggguuuagcagcccuggugguguaaagaaggccgcugagaucucccuuuaaaugauugaguauugagggagccuccucaugagcgcuucucaguggcuucucuccauuagcugucgccuuuaaaggggaaaccguguaaaaaugaauagaaaaacuuugaagggcuuaccuugcuggcuucucacuucguguccugaaaaguacagagcuaagaaaacccagguaagaggaaacauauccauuuuugacagagaggcucucuccggggcuagguuugugggaucuccuauaauuaugucuuuguguuuuuccucucuaauuuucuuccugguggugucuucugcaaaggucucuaacgaucaacguuuuccuccuggguccuggcagucagucugucuucaccuuuauucuugcuggaauaucuccaccucacuaggagauagcucuugaaaucagcaaagagggagcaagcuaaggaagcggagaccgguuuccucuucaaacccaaacgcguguauguucucuccaguuccucaaagugucauuuccuuuauccuacaacaucacgaggguuucccgaaagcugaacgcaaaauaauaguaauaauaauaaaaaucaaagccaagaauugcccugggcaucacacggccccuaggcagcugugugaucucagaagcgcuaacugacacaggucccccggcacccgggacacacacgcgggcagaggcaccgaccgcuggacaggcggagugguaagcagucagacguccggcucuuguccuuucuggguuccccuaagcuggagccucccccggcgguuacacccgcuuggccagucucuggaggggagugcgaggcaggaagcugcugcggccggugcugcugguguugcugcgggugcggcggcugggaucgcccgcgagugugcgagcggcucuccgaguucgcuggcgcccgcccucaccuccaccucgcccagcgcccggccgagugucugugcuucagaggaugugccgggggcgggcugcaggcuggugccuugcucgccuccucugccuccccuccggcuccccccucgccuuuucaggccgagcagcauguggaugucagagccgcggcagagcgauccgauuacgcgcccgcucagggcccgccccuucuguguuccugauuaaagaggcagccgcggagacgcgcggcgcagagccgaggaccgcggcacccagcucgggcggggcggcgguggcucgcagccccgcggccgcgcgaucaaaguuaaggugccacgcaacccugccgccccucucccaguccgcaccucccucccgccccacgcaccuucgugcggggcugcgggugugucacacccggagcaaggagcgcccucccuucagggcgcgcugccucugccggagggaaacuccgcggagcccgggaaauucuuguuuccccuaaauuccgagacucagaugcuacacacucagaauccaacacaaugccaccugcaauggcguuacagaaggaguuggguggcggaccgcguuuggcguagggagccaguccgcggcucagcucuguguucccagaggcagcaaagcguggcggcgacacacacagucagccuuuagccuucucugaaccaaaccucaaauacuucuugggcuuacuucucagauccuuuguugugucccaaacaggauccucugcggucuggguuaggauuuacuucaacaugugcccuuaacuuguaacuaucuguaaacgagggacgauuuuauugaauaaagaauuucuccgggcaauuaaauuccccacccccaccccuggccacccaauacaccuucaagcuuccaacauaguauagguacagggaggccucuuggacugcuacuguaacuacuucuguucauguuuccccaagguauuguggucacaa

SEQ ID NO: 10965 - RNA, 586 nt, Mus musculus
guguguuacgugggggagagaauaaaacuccagcgagauccgggccgcgaacgaaagcagugacggaggagcuuguaccaccgguaagaggagcaggaggaggaggcaggagccggagagagccggggggacagaggggggccggggaggcgccggacacccgcgcucggggccuuccccucgcaggaggggccgcgguaaagauggagccuccgcccgagccccacaacaccgccgccgcucgcagcgaacaaagaauaauggcggcggacuggagccagcggcggccgggcggcagcgacucugccugcagccagcggcggcgcucauggcggggggcggccgggccggggcggggugcgagcgagcgggcggccggccgcggcaagcuggcgcccgcguucccgccgccgggccgggccgggcccggccgugccgggcgcggagccggagccggcgcggagcggagccgccccgggggaggccgcccgccgccgccccccguuccucgccgccgccgcccgccugcucgcacgcucgcucgccccggcugugccgggcuggccgcccgggccgccgccugggu

SEQ ID NO: 10966 - RNA, 586 nt, Mus musculus
acccaggcggcggcccgggcggccagcccggcacagccggggcgagcgagcgugcgagcaggcgggcggcggcggcgaggaacggggggcggcggcgggcggccucccccggggcggcuccgcuccgcgccggcuccggcuccgcgcccggcacggccgggcccggcccggcccggcggcgggaacgcgggcgccagcuugccgcggccggccgcccgcucgcucgcaccccgccccggcccggccgccccccgccaugagcgccgccgcuggcugcaggcagagucgcugccgcccggccgccgcuggcuccaguccgccgccauuauucuuuguucgcugcgagcggcggcgguguuguggggcucgggcggaggcuccaucuuuaccgcggccccuccugcgaggggaaggccccgagcgcggguguccggcgccuccccggccccccucuguccccccggcucucuccggcuccugccuccuccuccugcuccucuuaccggugguacaagcuccuccgucacugcuuucguucgcggcccggaucucgcuggaguuuuauucucucccccacguaacacac

SEQ ID NO: 10967 - RNA, 1061 nt, Mus musculus
guguaaacugguagagacgguuagacagccgccuaggauagcuugcucugccagggauucaagugugaggugcaaggacccaccccaucuacucucaggagcuacuagggucuaagccacuugcugcgcgcgcaaagcgcgcggguucccaaucgguccccgguccccacccauccaaggugccucccuccccagcuccugugccgugcaacugaaaccccaguagcgcucaccuaucuugguuugcucgccguagcucuuuucguugaggcaaaccccgcggccgugcagcagggcgugcagcggcuucuccucauccugccgggggaggcagcgcaaacccugggcgcagcgcuccguguagacgccacacgacugucccuccgccagggcgcaagucaugcagcagccacagccgggcucuuugaccagcucacagcccagagggcuggggggacacauggacagagcuuucucgucgcaggguucacagugcacgaaagaacccaggccuugagccgguacggcauaggcggccagcagcaggaggaccacgcugaucaccauuuucucggagucuggcuuuaccucggggcggggcaggagagcgagaguguguggagaaagagggagccuggagauuuuuuuccuuuuaaaucucuugcagguagagcaggugcucucccccaaacacuugcaaaauaugaggcaaggaggauucagaugccugcacgcaagucccaauugcgaggauuaaagacuugcaacagguugggggugaaaaaaagaggcgcgccaggugcacgcagagcgagcggagaccguagaaacccccaggcgggaucgggucagaauuggggguggugguggagagaaccacagaauugcucacuccaaagcaacagaaauaauuagcuuggaggccuugaaaagggaggaggugaagaaaaaaauggauugggcuuaauuuuccccccuuugcuuaaaaucuaaaacgcaaccccacuccgcucggucucagcggccagcugcgcugcugccgcagaacagguaagaggcgu

SEQ ID NO: 10968 - RNA, 1061 nt, Mus musculus
acgccucuuaccuguucugcggcagcagcgcagcuggccgcugagaccgagcggagugggguugcguuuuagauuuuaagcaaaggggggaaaauuaagcccaauccauuuuuuucuucaccuccucccuuuucaaggccuccaagcuaauuauuucuguugcuuuggagugagcaauucugugguucucuccaccaccacccccaauucugacccgaucccgccuggggguuucuacggucuccgcucgcucugcgugcaccuggcgcgccucuuuuuuucacccccaaccuguugcaagucuuuaauccucgcaauugggacuugcgugcaggcaucugaauccuccuugccucauauuuugcaaguguuugggggagagcaccugcucuaccugcaagagauuuaaaaggaaaaaaaucuccaggcucccucuuucuccacacacucucgcucuccugccccgccccgagguaaagccagacuccgagaaaauggugaucagcgugguccuccugcugcuggccgccuaugccguaccggcucaaggccuggguucuuucgugcacugugaacccugcgacgagaaagcucuguccauguguccccccagcccucugggcugugagcuggucaaagagcccggcuguggcugcugcaugacuugcgcccuggcggagggacagucguguggcgucuacacggagcgcugcgcccaggguuugcgcugccucccccggcaggaugaggagaagccgcugcacgcccugcugcacggccgcgggguuugccucaacgaaaagagcuacggcgagcaaaccaagauaggugagcgcuacugggguuucaguugcacggcacaggagcuggggagggaggcaccuuggauggguggggaccggggaccgauugggaacccgcgcgcuuugcgcgcgcagcaaguggcuuagacccuaguagcuccugagaguagaugggguggguccuugcaccucacacuugaaucccuggcagagcaagcuauccuaggcggcugucuaaccgucucuaccaguuuacac

SEQ ID NO: 10969 - RNA, 673 nt, Mus musculus
gccagcaguguucucagcccgugccgcguucgcuaggcguuuauaagcugcgggagugagugucaccgacgagucugcgcgcccggcaggaagugccuccugccuugcccaaccugagagcuccgggucuccggagcuaugagcaccgggggcaauuguaauacgguucccaggggaccgcgacacaccaagggugaacgcgcugaccaggcuuuguagucgugguacagauaguaacgagccuaacacaaaggcaacgcggcgaguuguuuccuggguuuuagggaagacgcacucaaucagcaaugcccaggaaagaugaacaagaaacuuaccguaggugggagaacugugaacaaggugggagggaaucuguugaaucuuuaugccccuuagaaguuugaaacuguaacacucgaauacauacuguauucuguaugguuacuccagcaauuaaaugaucucaaaagauauaaagccucaauguacgauguuaaacaggucuccccaaagcaaacagcgccuggauguuuuauuuccaaacacuccuuccacacaauuugcggcugagagauuuugggaagagagagggccgacgcuccaagaaggaagaaacaacuuuucgaaguuggugaagcugcuuugaagucauuaaagucacgcgcugguguuu

SEQ ID NO: 10970 - RNA, 673 nt, Mus musculus
aaacaccagcgcgugacuuuaaugacuucaaagcagcuucaccaacuucgaaaaguuguuucuuccuucuuggagcgucggcccucucucuucccaaaaucucucagccgcaaauuguguggaaggaguguuuggaaauaaaacauccaggcgcuguuugcuuuggggagaccuguuuaacaucguacauugaggcuuuauaucuuuugagaucauuuaauugcuggaguaaccauacagaauacaguauguauucgaguguuacaguuucaaacuucuaaggggcauaaagauucaacagauucccucccaccuuguucacaguucucccaccuacgguaaguuucuuguucaucuuuccugggcauugcugauugagugcgucuucccuaaaacccaggaaacaacucgccgcguugccuuuguguuaggcucguuacuaucuguaccacgacuacaaagccuggucagcgcguucacccuuggugugucgcgguccccugggaaccguauuacaauugcccccggugcucauagcuccggagacccggagcucucagguugggcaaggcaggaggcacuuccugccgggcgcgcagacucgucggugacacucacucccgcagcuuauaaacgccuagcgaacgcggcacgggcugagaacacugcuggc

SEQ ID NO: 10971 - RNA, 1060 nt, Mus musculus
gcuaucuuaaacgaaagacucaauauaugcccaucuuucaccuuggugcgcauguggggaaguggagcuauaaaguucaaggaaagcucugagucgaauguucaacaaaauggagauugugugguuuuagguguugugaacaguguuuccuagcacuagaacauaacaguggucugccucaggauuaaguuuaauaagugccaaaggcauacagauauuuacaacaggcauaaagaccaagagagauccuaucccugcgaucccaacaauaacaagaggcaccgacaugagcugcauauaaugucuggaauacaguuguucugaaaguagaguucccuugaaaacgcguuuaaacaaaaaaguccugauaguccuuaaaagacacuuuagucuuuacugaguauugaugcgaagcagcugcucuuugccauuaauuaucagggacuuuaacucuccaucuucuuccacuuccacccuuucuugaccauucucaacgauucucuugguggugauuuuuuugccauuaauuauuucgguggagguugacaccgacuuguaguugccugccgccccaccgccgcaagacauggagaaagaagaaaggcccgaguuuccuggagaaccgaaggaugugaauccaguaucuaacgaagcgaagccacccccaaauccugggaauucgguaaaggagguagagaaggguacagccccucggcuucugcuuccacgggugcuccuccgauccccaaaaaaguucucaagggggucucccccgaagaagucgaaggagaaagggucguggcccccgaagaacucccugaagaccuccgcggggucucggaaggagaagacguacuggaaggcaucguggaacgggcugcccgccgcgccgccuccgcccaccucgcccacuucgccgcagcggucguacaccucgcgcuugcggacguccgauaagaccucguaggccugcgccaccugcuugaaccgccucucggccuccuccuugugcucgggguucuuguccgggugccacuugagcgcaagcuugcgguacgcc

SEQ ID NO: 10972 - RNA, 1060 nt, Mus musculus
ggcguaccgcaagcuugcgcucaaguggcacccggacaagaaccccgagcacaaggaggaggccgagaggcgguucaagcagguggcgcaggccuacgaggucuuaucggacguccgcaagcgcgagguguacgaccgcugcggcgaagugggcgaggugggcggaggcggcgcggcgggcagcccguuccacgaugccuuccaguacgucuucuccuuccgagaccccgcggaggucuucagggaguucuucgggggccacgacccuuucuccuucgacuucuucgggggagacccccuugagaacuuuuuuggggaucggaggagcacccguggaagcagaagccgaggggcuguacccuucucuaccuccuuuaccgaauucccaggauuuggggguggcuucgcuucguuagauacuggauucacauccuucgguucuccaggaaacucgggccuuucuucuuucuccaugucuugcggcgguggggcggcaggcaacuacaagucggugucaaccuccaccgaaauaauuaauggcaaaaaaaucaccaccaagagaaucguugagaauggucaagaaaggguggaaguggaagaagauggagaguuaaagucccugauaauuaauggcaaagagcagcugcuucgcaucaauacucaguaaagacuaaagugucuuuuaaggacuaucaggacuuuuuuguuuaaacgcguuuucaagggaacucuacuuucagaacaacuguauuccagacauuauaugcagcucaugucggugccucuuguuauuguugggaucgcagggauaggaucucucuuggucuuuaugccuguuguaaauaucuguaugccuuuggcacuuauuaaacuuaauccugaggcagaccacuguuauguucuagugcuaggaaacacuguucacaacaccuaaaaccacacaaucuccauuuuguugaacauucgacucagagcuuuccuugaacuuuauagcuccacuuccccacaugcgcaccaaggugaaagaugggcauauauugagucuuucguuuaagauagc

SEQ ID NO: 10973 - RNA, 3051 nt, Mus musculus
ggcgggccgcaaaugggcuaccggcgccacgguuggagcgugcuggccugggagcuggagccuuugcaccgcgcggagcaaacuuaagagggacccuugcuaccuacccgacucagacccuagagucccuggcaucccuguggaggccucaugagaggcggcuuggaacuggcacccgccaccgaugggccgggaguguuuuacuacagcagaacccugugugaugcucaccuuaaccaggggcgcucugguugugccaaggguccgggcaaggucuccggauagcguuuaaggucuugccucugcaggucugcucccagaggugcgccugggccugucagcccuugcucacacgacacggaagcugaaugguugcuugcggcccgcugguggcagcggggcggccggcgguggucucccucauuccugguugggcccuccgugagcgaucccugcucauuuuucaugacauucuuaaucaucgcaccuauuuacccacuuugccagcguacaccaaaauaacagccacgauaauuaugauaauaaagcgagucuuuuaucugcuccaucuucagggaggaauggggggggggguugcgacgccucuggauuguauaacgugagauuauccugaugaaagcuuuaugauguuugcucaaauaaaagcugcguuuuguaaauaggcacuaauuaagcacguuggcaacggagggagcucucacccuggcucugcgcagcgcgaggacuccugggcacgcgguuccccuuugcggacugcuggauggagcugagucccucaagauauuuccccuguucucgacaaugguaaaaagccgggaauuuggggguuaggagauuggagggauugcggcgaaaggaaaguaggcauuucuggucaucuuuucuuauguugaaacaaacuuucaaaucuuguguuccuuuuaaaaugggauccuuucguggcgaaggcagauccugccaagcgcguugggcuuccucgggucccccugccuguucuucagauuccuuggucuagacguccuuucggaacugcugacagcaccaggccaaggagcaaaggagggcauuguuauauaggucauuaaaaaaucaguucacccggaagagcucuggcuggggaguuggcucauguuggacguguguuauguaucacaagcacauuuaauugggagauaaagauaaaucgaucuuuaugaauuuaucgacccgauucuuugaagcucuucuuucucggucuuccucuuucucccgcucuaaccccaaggucccccggggacgucucaauccuagagaucuucucgggccaagaaucuugccagagagcaacugcccacccagagagguaagaggggacgaugaguccuuugcaucucuuggccagaagaaaacucgcuggcccggcugccagccguccuccucccccaccaguguccccuccccuccccuccaucacccggacaaagacaucucaaacgccuuuccccucuccgggccgcaguaauagaugguuucggcagcaggcgguuugaaaggaauucauuagggcgcugccuguguugcaucccuucacuucacgcccagaacucgagauggcuuaggcagugugaggggaaauuaauucucuuugggauacacgggaaggaggugucugugggauacccaagcucuagucccuguuugcccacaaaagaaguuaaucgaagcccaaggcaaaaggcugguuucuucaugagcauaauaaauacucccucuuauuaugagauaccuacagugacagucuucaaugccacuaccuuguuguuauccccucuccucaacuucuagaauaaccgcuuccuugauuuacgcaaccgcagccagggaccuucgugcuugccugcaagaggacugggugagcaguuacucauucaccugacucuccugccuuccauuuugcacuuucacuguaaaaaaaaaaaaaauuauuguagagacuucugucgccuggccacagggagagacaaggaucccuuuggcuauuuuaguaauuccauacuuaaaguucagcaacaagauugaggucccuugaauuauagacacacuugaaguaauuugauggcauauuauuuguguccauaaauugccacgaaaaguauugacugcaggaguuauaaugcuaaucuuuuauuagugaguucagauaauuuuucaucaauacgaauuuuauuuacuagugggcuuuucucgaaugcuugcaguaauauuuuucucaucuaaugcuuauuaacugcuuagaaaaugacuguuugcaucguaaaaggauccuuauguuuugacgugauugacaagauccauuccgggacacuucaguuacgugcaaaaaaaaaaaaaaccaccaaaaaaccaaaccaaaacaaaaacaaaaacccgcugcgcgccugggggcugcggacggacgacagaagcuuucggagucccgacugcgcugaagagauuaaugcacuaggaacgacagguacgcgcaucuguccuucgaauuccuaccugccuagcuccgaacagucucaaccgcagagucaacucggccccgcugcgcgggaaaaccacccugcucagaucuuaguaacuaggcucagagagccccgccccccuccaauuaggaaaaagguugggcgcgcgggaagggagagcuggguucccccaacuccaguuaacuucugcgaacuuuuucucuggaagcauccuucacagaugaagauaguccagucccggagguauuuuacugcugccaagagagugucaguaucguauuaagccacuuacagaguggcugagacguucaauaaaagugaugguaauuaaguugccccacgcuugugggcuguccgauucagccuuugcacacaggugugugaaagcuaagcaagaaauaggaaccgcacaaguaaaugaguauuauuauuaccuggaggugggagcguagugcggcuuccagggggcagcgagggcccucuggucucuguggacgucguguggagaaaccugugggcc

SEQ ID NO: 10974 - RNA, 3051 nt, Mus musculus
ggcccacagguuucuccacacgacguccacagagaccagagggcccucgcugcccccuggaagccgcacuacgcucccaccuccagguaauaauaauacucauuuacuugugcgguuccuauuucuugcuuagcuuucacacaccugugugcaaaggcugaaucggacagcccacaagcguggggcaacuuaauuaccaucacuuuuauugaacgucucagccacucuguaaguggcuuaauacgauacugacacucucuuggcagcaguaaaauaccuccgggacuggacuaucuucaucugugaaggaugcuuccagagaaaaaguucgcagaaguuaacuggaguugggggaacccagcucucccuucccgcgcgcccaaccuuuuuccuaauuggaggggggcggggcucucugagccuaguuacuaagaucugagcagggugguuuucccgcgcagcggggccgaguugacucugcgguugagacuguucggagcuaggcagguaggaauucgaaggacagaugcgcguaccugucguuccuagugcauuaaucucuucagcgcagucgggacuccgaaagcuucugucguccguccgcagcccccaggcgcgcagcggguuuuuguuuuuguuuugguuugguuuuuuggugguuuuuuuuuuuuuugcacguaacugaagugucccggaauggaucuugucaaucacgucaaaacauaaggauccuuuuacgaugcaaacagucauuuucuaagcaguuaauaagcauuagaugagaaaaauauuacugcaagcauucgagaaaagcccacuaguaaauaaaauucguauugaugaaaaauuaucugaacucacuaauaaaagauuagcauuauaacuccugcagucaauacuuuucguggcaauuuauggacacaaauaauaugccaucaaauuacuucaagugugucuauaauucaagggaccucaaucuuguugcugaacuuuaaguauggaauuacuaaaauagccaaagggauccuugucucucccuguggccaggcgacagaagucucuacaauaauuuuuuuuuuuuuuacagugaaagugcaaaauggaaggcaggagagucaggugaaugaguaacugcucacccaguccucuugcaggcaagcacgaaggucccuggcugcgguugcguaaaucaaggaagcgguuauucuagaaguugaggagaggggauaacaacaagguaguggcauugaagacugucacuguagguaucucauaauaagagggaguauuuauuaugcucaugaagaaaccagccuuuugccuugggcuucgauuaacuucuuuugugggcaaacagggacuagagcuuggguaucccacagacaccuccuucccguguaucccaaagagaauuaauuuccccucacacugccuaagccaucucgaguucugggcgugaagugaagggaugcaacacaggcagcgcccuaaugaauuccuuucaaaccgccugcugccgaaaccaucuauuacugcggcccggagaggggaaaggcguuugagaugucuuuguccgggugauggaggggaggggaggggacacuggugggggaggaggacggcuggcagccgggccagcgaguuuucuucuggccaagagaugcaaaggacucaucguccccucuuaccucucugggugggcaguugcucucuggcaagauucuuggcccgagaagaucucuaggauugagacguccccgggggaccuugggguuagagcgggagaaagaggaagaccgagaaagaagagcuucaaagaaucgggucgauaaauucauaaagaucgauuuaucuuuaucucccaauuaaaugugcuugugauacauaacacacguccaacaugagccaacuccccagccagagcucuuccgggugaacugauuuuuuaaugaccuauauaacaaugcccuccuuugcuccuuggccuggugcugucagcaguuccgaaaggacgucuagaccaaggaaucugaagaacaggcagggggacccgaggaagcccaacgcgcuuggcaggaucugccuucgccacgaaaggaucccauuuuaaaaggaacacaagauuugaaaguuuguuucaacauaagaaaagaugaccagaaaugccuacuuuccuuucgccgcaaucccuccaaucuccuaacccccaaauucccggcuuuuuaccauugucgagaacaggggaaauaucuugagggacucagcuccauccagcaguccgcaaaggggaaccgcgugcccaggaguccucgcgcugcgcagagccagggugagagcucccuccguugccaacgugcuuaauuagugccuauuuacaaaacgcagcuuuuauuugagcaaacaucauaaagcuuucaucaggauaaucucacguuauacaauccagaggcgucgcaacccccccccccauuccucccugaagauggagcagauaaaagacucgcuuuauuaucauaauuaucguggcuguuauuuugguguacgcuggcaaaguggguaaauaggugcgaugauuaagaaugucaugaaaaaugagcagggaucgcucacggagggcccaaccaggaaugagggagaccaccgccggccgccccgcugccaccagcgggccgcaagcaaccauucagcuuccgugucgugugagcaagggcugacaggcccaggcgcaccucugggagcagaccugcagaggcaagaccuuaaacgcuauccggagaccuugcccggacccuuggcacaaccagagcgccccugguuaaggugagcaucacacaggguucugcuguaguaaaacacucccggcccaucgguggcgggugccaguuccaagccgccucucaugaggccuccacagggaugccagggacucuagggucugagucggguagguagcaagggucccucuuaaguuugcuccgcgcggugcaaaggcuccagcucccaggccagcacgcuccaaccguggcgccgguagcccauuugcggcccgcc

SEQ ID NO: 10975 - RNA, 833 nt, Mus musculus
agucucuggccucagguucaacuucaauaagaccuaguuagcccuugaucacagggcuucucugacagccaugcucaagccuggccuaguugagcccgggucaccugggaauagguucaaaggcaaggaagcuguaaaccaccuccaggccccagcuagagcggccuggcgaacaaagagaccccaagcacuucaaacgcgcuggcuggcgcucggcgcucagaguccagauggcaaagggccgggauccgugaugucuguucaccaaggccuggcccaauguucugcaauccugagcccuccugcccugcccaucagugcccagggcaggggacuucagacagguucagccucucccuagucucaguguucugggcccaccacccgccugcaagugaagcacaguacagaggcugaggcugaaccccaaaccgggauccaacacucagggcaaggucagguaggcaggcauggcgggcacaugggcgcucccgcagaggcucgcugugaugccuaagcuauaaagcauuuagggggcagguucugaaaacguguccaggcugaaguagcccagaaaaucgggauugaaaaaggaucuccaacuugcauacuggcccgagccgggcggcgucucuauagauccuagaggcgagaucguggggguggacaucucugccaacaggcgaguaucugcccugccccgggucguggcacucugccugcacagcuccacucacugcgggcaggaucgcguugcagacgccggaggucucagugcgcgccccaagaggcucccagcugcguccuugguccacggagcacaucugggcuug

SEQ ID NO: 10976 - RNA, 833 nt, Mus musculus
caagcccagaugugcuccguggaccaaggacgcagcugggagccucuuggggcgcgcacugagaccuccggcgucugcaacgcgauccugcccgcagugaguggagcugugcaggcagagugccacgacccggggcagggcagauacucgccuguuggcagagauguccacccccacgaucucgccucuaggaucuauagagacgccgcccggcucgggccaguaugcaaguuggagauccuuuuucaaucccgauuuucugggcuacuucagccuggacacguuuucagaaccugcccccuaaaugcuuuauagcuuaggcaucacagcgagccucugcgggagcgcccaugugcccgccaugccugccuaccugaccuugcccugaguguuggaucccgguuugggguucagccucagccucuguacugugcuucacuugcaggcggguggugggcccagaacacugagacuagggagaggcugaaccugucugaaguccccugcccugggcacugaugggcagggcaggagggcucaggauugcagaacauugggccaggccuuggugaacagacaucacggaucccggcccuuugccaucuggacucugagcgccgagcgccagccagcgcguuugaagugcuuggggucucuuuguucgccaggccgcucuagcuggggccuggaggugguuuacagcuuccuugccuuugaaccuauucccaggugacccgggcucaacuaggccaggcuugagcauggcugucagagaagcccugugaucaagggcuaacuaggucuuauugaaguugaaccugaggccagagacu

SEQ ID NO: 10977 - RNA, 1395 nt, Mus musculus
cguggacagucugggcaccagugaggaagagcuggagaggcagcccaagcgcuucggccggaagcggcgcuacagcaagaaaucgagcgaagauggcagcccgaccccggguaagcgcggcaagaagggcagcccgagcgcgcagucuuucgaggagcugcagagccagcgcauccuggccaacgugcgcgagcgccagcgcacccagucgcucaacgaggccuucgccgcgcugcgcaagaucauccccacgcuccccucugacaagcucagcaagauccagacgcucaagcuggccgccagguacauagacuuccucuaccagguucuccagagcgacgagauggacaauaagaugaccagcugcagcuacguggcucacgagcgucucagcuacgccuucuccguguggcgcauggagggcgcgugguccauguccgccucccacuagcgccgcgccgugccauccaccuccggagccgcaagccaggguaggugcugcguguggugggcauccacgacgcacgggugggugggcggacgggccaguguaucucuccucgugaagguaccucaggcaaccgcacagggauggggugagcuuccucacccugcaaggguuggcgcgaccugagaaaacucuccuaccccgggggcacgcccaaggucuuuugccaaggguauccguucggaauccacccgccugugguuccccaucaggguccaaauacacuuauuggacaaauggucacuuuucauuuuugguggauggguaucugugggugacucuguggggagcgguugucaaaacgucuuccuuaggccagcggaggccaggagaugcgaugcccgcuggguuguggccgaccuguugccucgcgcucauucuauggagcugaggagcccacgcgugguacagacaauccgcucuuucugauccgcaguuccggcccgcgccuuggaugcuagggcguucaagcccuagccggcucaguacguaagaugaugcuggccccuggcgcggcagagagguuucuguucagcgcuggggcuccagguucacagaggagcaaaucucugggcgccaagaaugcaguagacccuugucgccccaaaaguauggaacccucaagcgcccaggccuggguggauguagcggcuuggagucucuggcugccugcaagcagguggaucguauuuagaguugugugcuuaaguaccaccauccuugaacuuggaaagacacagaggcaagggauucaggcuggguaacaggucugagugugcgguggguguggaugaagaagcagugugagcagggccuugccugggaagaaggcagcucagcacagcugagcaccggauugguguuucagagagcguuuaucauguccu

SEQ ID NO: 10978 - RNA, 1395 nt, Mus musculus
aggacaugauaaacgcucucugaaacaccaauccggugcucagcugugcugagcugccuucuucccaggcaaggcccugcucacacugcuucuucauccacacccaccgcacacucagaccuguuacccagccugaaucccuugccucugugucuuuccaaguucaaggauggugguacuuaagcacacaacucuaaauacgauccaccugcuugcaggcagccagagacuccaagccgcuacauccacccaggccugggcgcuugaggguuccauacuuuuggggcgacaagggucuacugcauucuuggcgcccagagauuugcuccucugugaaccuggagccccagcgcugaacagaaaccucucugccgcgccaggggccagcaucaucuuacguacugagccggcuagggcuugaacgcccuagcauccaaggcgcgggccggaacugcggaucagaaagagcggauugucuguaccacgcgugggcuccucagcuccauagaaugagcgcgaggcaacaggucggccacaacccagcgggcaucgcaucuccuggccuccgcuggccuaaggaagacguuuugacaaccgcuccccacagagucacccacagauacccauccaccaaaaaugaaaagugaccauuuguccaauaaguguauuuggacccugauggggaaccacaggcggguggauuccgaacggauacccuuggcaaaagaccuugggcgugcccccgggguaggagaguuuucucaggucgcgccaacccuugcagggugaggaagcucaccccaucccugugcgguugccugagguaccuucacgaggagagauacacuggcccguccgcccacccacccgugcgucguggaugcccaccacacgcagcaccuacccuggcuugcggcuccggagguggauggcacggcgcggcgcuagugggaggcggacauggaccacgcgcccuccaugcgccacacggagaaggcguagcugagacgcucgugagccacguagcugcagcuggucaucuuauuguccaucucgucgcucuggagaaccugguagaggaagucuauguaccuggcggccagcuugagcgucuggaucuugcugagcuugucagaggggagcguggggaugaucuugcgcagcgcggcgaaggccucguugagcgacugggugcgcuggcgcucgcgcacguuggccaggaugcgcuggcucugcagcuccucgaaagacugcgcgcucgggcugcccuucuugccgcgcuuacccggggucgggcugccaucuucgcucgauuucuugcuguagcgccgcuuccggccgaagcgcuugggcugccucuccagcucuuccucacuggugcccagacuguccacg

SEQ ID NO: 10979 - RNA, 799 nt, Mus musculus
ggugcccaggagggacccuuccacccuaauuacucugcaguccucggagccuguggccgcgcgugggcaggagagagggcaucgcagcucauccggccuuuuuucucucccggagccacacaggcuacaaggauugcaccuuguccccgccugcccaagcaggcaccaggauucaccuguuccccagccucuggaucugcugcccuuaaauggcuuuaacucucaucucaguuucucucuugcaccaacuuagauugaggugcugcuggaaccguggcuugucccccccucccccagaccucccauuacgacuauccuugggccuuucccauccaucugucaaccucucuaagcguucaggauccguccccuugcugcggaugcucaccccuguucuucaucucugaccauaacaacuucccacacuugggcagugagccuggucuccccagcgaagcugcaaccugguccacagggccggcuggggaagacccacaggcgaaccggccgccuaacggauuggggacccgauugauugcauuuacauccgagcucuagagagucuagauuuuaucaauagguugguaucagucucuaaauuucaucugaguacucuaacaugccaauuccuucauuuaaaggaauccacccuguuuucuuuugagaguaaccgguuuccuuucuugguuuccgcucugccagggaacauagaagucaggauaugauuuaaaugucucugugggguuccagagaugagaagggagucacauuuuguugggaucagaucugagugaucucg

SEQ ID NO: 10980 - RNA, 799 nt, Mus musculus
cgagaucacucagaucugaucccaacaaaaugugacucccuucucaucucuggaaccccacagagacauuuaaaucauauccugacuucuauguucccuggcagagcggaaaccaagaaaggaaaccgguuacucucaaaagaaaacaggguggauuccuuuaaaugaaggaauuggcauguuagaguacucagaugaaauuuagagacugauaccaaccuauugauaaaaucuagacucucuagagcucggauguaaaugcaaucaaucggguccccaauccguuaggcggccgguucgccugugggucuuccccagccggcccuguggaccagguugcagcuucgcuggggagaccaggcucacugcccaagugugggaaguuguuauggucagagaugaagaacaggggugagcauccgcagcaaggggacggauccugaacgcuuagagagguugacagauggaugggaaaggcccaaggauagucguaaugggaggucugggggagggggggacaagccacgguuccagcagcaccucaaucuaaguuggugcaagagagaaacugagaugagaguuaaagccauuuaagggcagcagauccagaggcuggggaacaggugaauccuggugccugcuugggcaggcggggacaaggugcaauccuuguagccuguguggcuccgggagagaaaaaaggccggaugagcugcgaugcccucucuccugcccacgcgcggccacaggcuccgaggacugcagaguaauuaggguggaagggucccuccugggcacc

SEQ ID NO: 10981 - RNA, 561 nt, Mus musculus
gcaauagcaagcagagccaggauggagcucugggugaggaugaggacaggacaggccaccaugaggcagguguggaaguaggucuguggcccaauguugauaaggauggccagugggaugaccagggcgccaacagccacaucagcuaccgccagggauacgaugaagcagaagguagcaucgcgaagugccugguucaccuucacagcccaaaucaccaguacauuuccgggcacagagaccaaggcaaugagcaccucgaugccaauguaggcagccuggaaggccgagauguacggcggcauggugggcaggagcugggcacaucagcagacaggcgcccuggggcgcgaggccagcaccuguggucaggaagccugcgguggggaugccagccugggaaggagggggacauaggcagcccugcgaagaugugccccaguaaagugaugcagugccugcccaagcuggccagacacucaggcucacuaucugcuuaaccucuguccccuccccuuguccuuagagguuccauucagcaacuuaaaauagcagcacuca

SEQ ID NO: 10982 - RNA, 561 nt, Mus musculus
ugagugcugcuauuuuaaguugcugaauggaaccucuaaggacaaggggaggggacagagguuaagcagauagugagccugagugucuggccagcuugggcaggcacugcaucacuuuacuggggcacaucuucgcagggcugccuaugucccccuccuucccaggcuggcauccccaccgcaggcuuccugaccacaggugcuggccucgcgccccagggcgccugucugcugaugugcccagcuccugcccaccaugccgccguacaucucggccuuccaggcugccuacauuggcaucgaggugcucauugccuuggucucugugcccggaaauguacuggugauuugggcugugaaggugaaccaggcacuucgcgaugcuaccuucugcuucaucguaucccuggcgguagcugauguggcuguuggcgcccuggucaucccacuggccauccuuaucaacauugggccacagaccuacuuccacaccugccucaugguggccuguccuguccucauccucacccagagcuccauccuggcucugcuugcuauugc

SEQ ID NO: 10983 - RNA, 556 nt, Mus musculus
ccagggcuagccaguuauguccaaggggugguagccagccgagacuccacucuggcgccggcgccuucgucgcccccggcgcgggagcugagugacaaucgggcuccgcacaccgggagggggagggggcgggggcgggggcggcggcggcacccgcgggccccucccucgucgcccuccgucuccuccccuacccccuccucuaaacaaaggaagugauucagugugagaaaagcugggaaaacgugagcgucucgaauggugugauguauggauccggccucgggacagggacaguaccgaggugccgauucccguguucccucuuucccuuacucccucccucccuucucaaugcagcaggcggacagcccaagcccuaaucaccugcgggacucaagagggccccucucuggucucccaccgccaccaaccauuggcaucugggcgccuccccuaaucuuaaaaccuacucucuucaggaaagcagucccagcacugucaggagcgcacaggcuucccgcacacacguuacuuugcaggcagucuccugagu

SEQ ID NO: 10984 - RNA, 556 nt, Mus musculus
acucaggagacugccugcaaaguaacgugugugcgggaagccugugcgcuccugacagugcugggacugcuuuccugaagagaguagguuuuaagauuaggggaggcgcccagaugccaaugguugguggcggugggagaccagagaggggcccucuugagucccgcaggugauuagggcuugggcuguccgccugcugcauugagaagggagggagggaguaagggaaagagggaacacgggaaucggcaccucgguacugucccugucccgaggccggauccauacaucacaccauucgagacgcucacguuuucccagcuuuucucacacugaaucacuuccuuuguuuagaggaggggguaggggaggagacggagggcgacgagggaggggcccgcgggugccgccgccgcccccgcccccgcccccucccccucccggugugcggagcccgauugucacucagcucccgcgccgggggcgacgaaggcgccggcgccagaguggagucucggcuggcuaccaccccuuggacauaacuggcuagcccugg

SEQ ID NO: 10985 - RNA, 670 nt, Mus musculus
uucugcucuauaacuuaaagauaguggaagagccgggcggugguggcgcacgucuuuaaucccagcucuugggaggcagaggcaggcgaauuucugagcucgaggccagccuggucuacaaagugaguuccaggacagccagggcuauacagagaaacccugucucaaacaaacaaacaaaagauaguggaaggauaaugagcaggguuuccuaagaugugcaaggcacuugucuaaauguuugacaacauccggugaacgucuaaaccuaggcaccugauacgggccaggcaugauggcacacugccaggagucccagcacccaggaagcugaggcaggaggauuacaaacucaaaauagauucuguuguuaacuuugacaacuuuagaguaugcaaauuuagggaggguuuaauuuuccaauccuguuuaauuucuagcucccacugaaaauuaggacucaaaauauagcagaggaaccaaagauauuucccaauguccagcuuccgcccaggcaccgacgggaacuuggcuuugcuuuuggugcuagguuaaaccauggugcuuucaguuucccaacaaguucuaucgcaaggcucgcuuauuccuccaaucaaaggaggaagucaagugcucuuugggucaguaaaggggaacuguuagcuggaua

SEQ ID NO: 10986 - RNA, 670 nt, Mus musculus
uauccagcuaacaguuccccuuuacugacccaaagagcacuugacuuccuccuuugauuggaggaauaagcgagccuugcgauagaacuuguugggaaacugaaagcaccaugguuuaaccuagcaccaaaagcaaagccaaguucccgucggugccugggcggaagcuggacauugggaaauaucuuugguuccucugcuauauuuugaguccuaauuuucagugggagcuagaaauuaaacaggauuggaaaauuaaacccucccuaaauuugcauacucuaaaguugucaaaguuaacaacagaaucuauuuugaguuuguaauccuccugccucagcuuccugggugcugggacuccuggcagugugccaucaugccuggcccguaucaggugccuagguuuagacguucaccggauguugucaaacauuuagacaagugccuugcacaucuuaggaaacccugcucauuauccuuccacuaucuuuuguuuguuuguuugagacaggguuucucuguauagcccuggcuguccuggaacucacuuuguagaccaggcuggccucgagcucagaaauucgccugccucugccucccaagagcugggauuaaagacgugcgccaccaccgcccggcucuuccacuaucuuuaaguuauagagcagaa

SEQ ID NO: 10987 - RNA, 561 nt, Mus musculus
uaaugcacuauuaaggggggagggguggcgggagagggauggugcgcauuuuuccguaaggcacuucaucccgauacaugagucucucaucccuuggacgagaaaucuuucucccuuccuugauuauuauuccucuaagauaauuuccuuucggucuucccacaaagcuccuucccaaaccgguauccgagacaacgccucuaugccaaagccgcaggaagagagaaaagagugaaaaggggccuuggcacguucgcucgccaggagcuuugcaagugggagaguugaccugaguuccccaagauuccauccucccggagcaacuaggccagguucgaaauguucagaugcgaagucgguccaugcucuccuccggcgggugccggagcacagaggcggcgaaggcuuugccuggccucugacgcugggaugcggcuggaagagagugcgcaccggccagcccucaagugcccaggaucgcugggacugcccaaaacgcgguuccccggcccgcagcaggccugcagugacccaccuuuaccuggaaggugaugcucagga

SEQ ID NO: 10988 - RNA, 561 nt, Mus musculus
uccugagcaucaccuuccagguaaaggugggucacugcaggccugcugcgggccggggaaccgcguuuugggcagucccagcgauccugggcacuugagggcuggccggugcgcacucucuuccagccgcaucccagcgucagaggccaggcaaagccuucgccgccucugugcuccggcacccgccggaggagagcauggaccgacuucgcaucugaacauuucgaaccuggccuaguugcuccgggaggauggaaucuuggggaacucaggucaacucucccacuugcaaagcuccuggcgagcgaacgugccaaggccccuuuucacucuuuucucucuuccugcggcuuuggcauagaggcguugucucggauaccgguuugggaaggagcuuugugggaagaccgaaaggaaauuaucuuagaggaauaauaaucaaggaagggagaaagauuucucguccaagggaugagagacucauguaucgggaugaagugccuuacggaaaaaugcgcaccaucccucucccgccaccccuccccccuuaauagugcauua

SEQ ID NO: 10989 - RNA, 934 nt, Mus musculus
cugacuacuggucaggugucaugggaggcaacagugggaccaacagggggccagccuuggaguauaacaaagaggaccgugagagcuucaggcacaggugacggccaugagugggaagggaccacuguguaucuguucuucuguuucuauagacuauggaauaucucuuacauauauuacacccuugugauacugugugugagaaguaaccaguuaagccuuuuugaaaugagugucuugggucccguaaugagacacucucuccauauguuuuauccuagaaccuuuaaagaacccacuaucuucaccacccugaucauuugucauaagaaugaugaucaugccaccaucucuuguaauuaauccuuauacuucuaaaaagcagcuacuguuuauguuccuauuuuaaggccaggaaauagaaaguuccagaugcuaaggaacuugcccagggugauaaguccaagcaacauuuaauaaucugugugacagcucgauuccugaauggcaugccugcacucauuaucuguccuuggaggacaguagguaccuacccccccccccauuuccuuuacccacugcagaggucucaggccucuugacuuaauaggcaacuuggucccugccccggagagagauacaauccuuucuauguuaacaauuauuccuggucuccugggaccagagcuguguguugcuguuugcugugguugugagggugggugaaguaaaacauguggcugucacccaggggucucaacacgauaacaagcugaucuguguguuucagcacuacacagaucacaagguauuuucagauacacaaccauucuggucuuccacacaaacucaggagagagccaggauugcucuggcugaacucgcagcacaaaaggugccaaaguugauucauccugcugggcugagggguaag

SEQ ID NO: 10990 - RNA, 934 nt, Mus musculus
cuuaccccucagcccagcaggaugaaucaacuuuggcaccuuuugugcugcgaguucagccagagcaauccuggcucucuccugaguuuguguggaagaccagaaugguuguguaucugaaaauaccuugugaucuguguagugcugaaacacacagaucagcuuguuaucguguugagaccccugggugacagccacauguuuuacuucacccacccucacaaccacagcaaacagcaacacacagcucuggucccaggagaccaggaauaauuguuaacauagaaaggauuguaucucucuccggggcagggaccaaguugccuauuaagucaagaggccugagaccucugcaguggguaaaggaaauggggggggggguagguaccuacuguccuccaaggacagauaaugagugcaggcaugccauucaggaaucgagcugucacacagauuauuaaauguugcuuggacuuaucacccugggcaaguuccuuagcaucuggaacuuucuauuuccuggccuuaaaauaggaacauaaacaguagcugcuuuuuagaaguauaaggauuaauuacaagagaugguggcaugaucaucauucuuaugacaaaugaucaggguggugaagauaguggguucuuuaaagguucuaggauaaaacauauggagagagugucucauuacgggacccaagacacucauuucaaaaaggcuuaacugguuacuucucacacacaguaucacaaggguguaauauauguaagagauauuccauagucuauagaaacagaagaacagauacacaguggucccuucccacucauggccgucaccugugccugaagcucucacgguccucuuuguuauacuccaaggcuggcccccuguuggucccacuguugccucccaugacaccugaccaguagucag

SEQ ID NO: 10991 - RNA, 499 nt, Mus musculus
gccaaccacauacaaagcuggggccagcgagggcgaagacgaggacgacgcggcggaugaggacgcgcugccacccuacagcgagcuggagcugagccgcggagagcugagccggggcccguccuaccgugggcgugaccuguccuuccacagcaacucggagaagaggaggaaaaaggagcccgccaagaaacccgugagggcucacccccaucucucuggagcuggguccgggaauggggguuggggggugggugaguuaugagguugcaaggccgccuggcggaaaauaugcucauggaggcugagucaucaguuucacacuauccaggggcagguggaggaaguaagagugggaccaucaagagauggcaacaucaacaaaacauauuuuuaaaaguagauaauguauaggugauuguggaaaagaccuucaaagggcucacauucccgcuagccuuuacccagaauuucugugaacugcgugcaagcuauuuug

SEQ ID NO: 10992 - RNA, 499 nt, Mus musculus
caaaauagcuugcacgcaguucacagaaauucuggguaaaggcuagcgggaaugugagcccuuugaaggucuuuuccacaaucaccuauacauuaucuacuuuuaaaaauauguuuuguugauguugccaucucuugauggucccacucuuacuuccuccaccugccccuggauagugugaaacugaugacucagccuccaugagcauauuuuccgccaggcggccuugcaaccucauaacucacccaccccccaacccccauucccggacccagcuccagagagaugggggugagcccucacggguuucuuggcgggcuccuuuuuccuccucuucuccgaguugcuguggaaggacaggucacgcccacgguaggacgggccccggcucagcucuccgcggcucagcuccagcucgcuguaggguggcagcgcguccucauccgccgcgucguccucgucuucgcccucgcuggccccagcuuuguaugugguuggc

SEQ ID NO: 10993 - RNA, 836 nt, Mus musculus
ugcgggucaccaaggggaacccucacuacaaugugcagauacugguguuauuuauuuaauuaguuaauuuaaagaucgcugugaaguuuaaaggucugggcuuuccaccuacgcagaauccaauaggugaauccaccugguggccccagccacaugaaagcaguguaacucagggggcauucacucggcacuucucugcgaaccagccagccccgcggacagacgugaaucuacccuaggugccuuagaaaggcagaagauagaaaccugugcgcagucagauagguugugacaagccgcauaccugcaaugacgagauggaagccuccuccucgguucccuugugugucucccugucccucuccucucugugaaugacaggauccacagcgggcugugcgccguaucgucgggggcagccgcagccugguucugcaggaggccugggaagcagcgagggugugcggagcgagcggagcccaguggagcgcacagagggcggagcgcgucccagccgcgccugcagauguggaaggagcuggagacagcacugaguccucuaggcgcugcauggggauauuaucacaggcuggaguuucuauuggcucagaacaccaaacaaaucacaccagucaccccuccuucucgggcuucacucagcccucgcuucucaucuaacccacaaauacuucacacacacacacacaccccagucgcucucuguauuucucccuuccucuuugcagacuguggauuuacaaccuugugggcagcucuuaacauuuuguuuagcagacuuccaauccaaaccuugucauguagagaaauccaccagc

SEQ ID NO: 10994 - RNA, 836 nt, Mus musculus
gcugguggauuucucuacaugacaagguuuggauuggaagucugcuaaacaaaauguuaagagcugcccacaagguuguaaauccacagucugcaaagaggaagggagaaauacagagagcgacuggggugugugugugugugugaaguauuuguggguuagaugagaagcgagggcugagugaagcccgagaaggaggggugacuggugugauuuguuugguguucugagccaauagaaacuccagccugugauaauauccccaugcagcgccuagaggacucagugcugucuccagcuccuuccacaucugcaggcgcggcugggacgcgcuccgcccucugugcgcuccacugggcuccgcucgcuccgcacacccucgcugcuucccaggccuccugcagaaccaggcugcggcugcccccgacgauacggcgcacagcccgcuguggauccugucauucacagagaggagagggacagggagacacacaagggaaccgaggaggaggcuuccaucucgucauugcagguaugcggcuugucacaaccuaucugacugcgcacagguuucuaucuucugccuuucuaaggcaccuaggguagauucacgucuguccgcggggcuggcugguucgcagagaagugccgagugaaugcccccugaguuacacugcuuucauguggcuggggccaccagguggauucaccuauuggauucugcguagguggaaagcccagaccuuuaaacuucacagcgaucuuuaaauuaacuaauuaaauaaauaacaccaguaucugcacauuguagugaggguuccccuuggugacccgca

SEQ ID NO: 10995 - RNA, 1376 nt, Mus musculus
uaggaggcuccuaccccaacuuuccacacuaccgcuggccuuugcggcacuggcugaauuuuucuaccuggaaaugugucuuggaauugaugcugaacagaauuucuuggguuggagcuuaaggggcugaggauggcagacgccucgcuaaugggaucuagagaugcgaagaacugucccgcugaaggcugcaggccagcuagaugcaccccugcaggccgcccaccgguuagcagcgaugugagaucuggguagggggaaagaagagucggucacaaacucauacugugggcagauuuguuccuccuuucccuucucccccuuugaaccuacuaaacucaaaauggacccuuucuccaacagcuacggaagaguggggccugaauugccccagagugugugucaggcauggccgguacaccccauaauaaggaaaggcuugucauaaaauguugcuaaaguggucauuucggacgccuuccagaaauucuacaaaccccuaauuuacacccuucagcccccccccccccccgccuuccuucaggagcuuagacuggccgguuugcuuccccgcaauucuuaagaaauacuggaaaucaaauaaaugcaaaguguccccacgcugagauuuccuugucagaaagaucuaggucguucugcagauauuucauucaaaagauggauaauacacacuuuugcaaaacuuugcagcaaccagaguauggucauccguuucuaugcuguuuaagcaacacgaagauauguuuuuaaacaugggauagcugacuuuuacaugucacuaaguuuuccuucauuucguuuucuucgcccucauucuaccguucuguccuuaaaaauaaacgcaccccaaauccuccugacaucaggccccucaugggugguggugaggccugaggccuuccagcgauacguaccucucagaguguugccuuccuuaacuuuugggucaaauuccgcagacaaaauucgaucgauaccaaauuugaggucuuugcuggagggggcaggggcggagccgcuauggugggggaccacccgcguccccgaagucgguggcugcagggagaccgcccgggguggaggcgggggcugcugcugcgguugcuguugcugcguuggugauugcugcgggagaugcugguggaaggcggcagagagcggagacagccgcugagggaagccagccgggacuucugagggcgccaccaccggggugggacggagcggggaucuggcggcagcuuggaaggaggcgugcgggugcacggagcccaagugugcggugagggcugccgaggcccccaccagucccucugcagcgggccccggcuccccgacgccggcgugcaggaugu

SEQ ID NO: 10996 - RNA, 1376 nt, Mus musculus
acauccugcacgccggcgucggggagccggggcccgcugcagagggacuggugggggccucggcagcccucaccgcacacuugggcuccgugcacccgcacgccuccuuccaagcugccgccagauccccgcuccgucccaccccggugguggcgcccucagaagucccggcuggcuucccucagcggcugucuccgcucucugccgccuuccaccagcaucucccgcagcaaucaccaacgcagcaacagcaaccgcagcagcagcccccgccuccaccccgggcggucucccugcagccaccgacuucggggacgcggguggucccccaccauagcggcuccgccccugcccccuccagcaaagaccucaaauuugguaucgaucgaauuuugucugcggaauuugacccaaaaguuaaggaaggcaacacucugagagguacguaucgcuggaaggccucaggccucaccaccacccaugaggggccugaugucaggaggauuuggggugcguuuauuuuuaaggacagaacgguagaaugagggcgaagaaaacgaaaugaaggaaaacuuagugacauguaaaagucagcuaucccauguuuaaaaacauaucuucguguugcuuaaacagcauagaaacggaugaccauacucugguugcugcaaaguuuugcaaaaguguguauuauccaucuuuugaaugaaauaucugcagaacgaccuagaucuuucugacaaggaaaucucagcguggggacacuuugcauuuauuugauuuccaguauuucuuaagaauugcggggaagcaaaccggccagucuaagcuccugaaggaaggcgggggggggggggggcugaaggguguaaauuagggguuuguagaauuucuggaaggcguccgaaaugaccacuuuagcaacauuuuaugacaagccuuuccuuauuaugggguguaccggccaugccugacacacacucuggggcaauucaggccccacucuuccguagcuguuggagaaaggguccauuuugaguuuaguagguucaaagggggagaagggaaaggaggaacaaaucugcccacaguaugaguuugugaccgacucuucuuucccccuacccagaucucacaucgcugcuaaccggugggcggccugcaggggugcaucuagcuggccugcagccuucagcgggacaguucuucgcaucucuagaucccauuagcgaggcgucugccauccucagccccuuaagcuccaacccaagaaauucuguucagcaucaauuccaagacacauuuccagguagaaaaauucagccagugccgcaaaggccagcgguaguguggaaaguugggguaggagccuccua

SEQ ID NO: 10997 - RNA, 1189 nt, Mus musculus
aagaagugagggaccagggugccccagcucugccaccucucccuggggguggggguggcuaucuccccucccacuauuuguaccucuaguguaugcacaaugccuggcacagaguggucacccccaaaacaucucuaaaugccagcuaccaacuaagaaaccuguguccucuauucacuuucagauggcuuccuuacucccaaaagcccuacuucacuucaacaacgcauguuaucauugccugcuugugaggaagcuccggucauaucauucagaaugauaaacuaaacuccuggcaagggaccgaaugucucggguaugaugaaggucacccacugaagacuaccuggacaauaauuccgagaguucagaggacuuuggucagaacaaacacaagcaaugaguuuugugauuccccuccacuccaacucccucccuagcccugucuaggucagagcaccuagaaaccauaaucaugugcccugaaaacgaaacucauucgguuccccauccauccuuccuuuggcucucccaccaaaguaaaaaggcaggccgaagaacaucugaagucccggggugcagagauuguugaucagagaagggggagggguaacagguucuagguauguacuggcugaguuagcaggccccgcgcggguuaaccccggggucuaggacugaaucaccuaauauucuccuguggcggggugccccagagagagugcgggaaauagguggaccuagacugcaacuucgcagcuggguccggggcucaagucaacuaaccucaccauggcuucagcauuaccaucagcuccaacugggagcaaggguccugcccgcgcgcucagcuacacacccuccuagugauggucccggaggccagcggggaugcgggcacaacuccacccagcgcgacucccgguucugucuggaucagggcggccgggccguggggaccuaccuugccguacuucuucaguuuucgccgguaccucuucuugggcuugucgccuggcgcgggcuccuccagggagucguagcgcucaggcagcgcagccaggugcacccugcgugcgcucggaguccccgcgcgccgcccgcccucuucgcgcucacaguccgggcucgccggguccucguccucgcccuccaggugcuccacgauggcaucugucuccucgucacc

SEQ ID NO: 10998 - RNA, 1189 nt, Mus musculus
ggugacgaggagacagaugccaucguggagcaccuggagggcgaggacgaggacccggcgagcccggacugugagcgcgaagagggcgggcggcgcgcggggacuccgagcgcacgcagggugcaccuggcugcgcugccugagcgcuacgacucccuggaggagcccgcgccaggcgacaagcccaagaagagguaccggcgaaaacugaagaaguacggcaagguagguccccacggcccggccgcccugauccagacagaaccgggagucgcgcuggguggaguugugcccgcauccccgcuggccuccgggaccaucacuaggaggguguguagcugagcgcgcgggcaggacccuugcucccaguuggagcugaugguaaugcugaagccauggugagguuaguugacuugagccccggacccagcugcgaaguugcagucuagguccaccuauuucccgcacucucucuggggcaccccgccacaggagaauauuaggugauucaguccuagaccccgggguuaacccgcgcggggccugcuaacucagccaguacauaccuagaaccuguuaccccucccccuucucugaucaacaaucucugcaccccgggacuucagauguucuucggccugccuuuuuacuuuggugggagagccaaaggaaggauggauggggaaccgaaugaguuucguuuucagggcacaugauuaugguuucuaggugcucugaccuagacagggcuagggagggaguuggaguggaggggaaucacaaaacucauugcuuguguuuguucugaccaaaguccucugaacucucggaauuauuguccagguagucuucagugggugaccuucaucauacccgagacauucggucccuugccaggaguuuaguuuaucauucugaaugauaugaccggagcuuccucacaagcaggcaaugauaacaugcguuguugaagugaaguagggcuuuugggaguaaggaagccaucugaaagugaauagaggacacagguuucuuaguugguagcuggcauuuagagauguuuugggggugaccacucugugccaggcauugugcauacacuagagguacaaauagugggaggggagauagccacccccacccccagggagagguggcagagcuggggcacccuggucccucacuucuu

SEQ ID NO: 10999 - RNA, 4726 nt, Mus musculus
uuaaggcggucaugaguuguccaagccccauacucucugguaggguaaccuuuaaacucggagcgcaaaucuacacccuuauugaucuuucaauccaguauccgccucaccauuugacauucuagucaaccauuaagaacaauacugaaacuaaaaucuuaagcgagaggaagggggggagaucaagagagauggagaauucucuugaacgccaaggguuaagguucuuuuuuuuuuuuaugcaggaaguuguauaguaaauaacauuaggucugaucuaccucauuuccacuuaacugcuaaucugcacacaacccaagcaaagagcgccccauccgcagaaaugucuguuugaaaugucuguuugaaaccuggcggcucuaggguagaggaugccugcuggccaaaggggcuaugucauaggcgccaaggcuaacucugagaagggagaccugagcagaucucaggucugagcuagcuaagaaaaaccucccaccuucuuuccuuaaaauaaaaaaaaaaaaaaacaaacaauguauuuuugcugguuuaggugcauaaacauacaucuggggaguguuaagagucuccugucucgaccacacaagguuggguuucuuucuuuuucucuucuuuacacaccucagaacuccccuaaauuuuucaaggugaaugguuagggggaggcggcaacuggaaacacuccuacuuaaaaagaaacuuugauguagccuaaaucuuugaggagccugaagaaacuccaguaggccggaggagaaaagucggccaggauugcugguaaguaaacuaaaagcaaagacguaggaaaauucuguguagccgggagucuaagcaaacccgacuucucuucagcuuaaggcuuuccucucccuggaccguggcaaccaccagagucucuuccucacaccaccgguagguaggacgccuaaaacucaaaugcacuagcuuuugaggguggagagcaaaaggaaauagaaagaaaugcacguauuugggccuuuucugaaaauauaaauggagaaacaaaacgcaaggcucuggcgaaagaccccuucaccggcuaacaagaagcuggaaguccuucgggggagcccaguuccaggccggccuggcccgcacugcugcccggccugaaaggcucggcgccugcaggcagcgcuugagauuucucccuggcugcaaaaucuacaaccucguguggaccaggacugcauuucggcgcuugccaggugagugugccuggccccaaggacaccggcaaagagaggugccugcuacgugcgcucuuuuauuuaaaaaagaaaaaaagaagaacucucccaaccagcgacacugcuuccucgcccauuuccgggcccccgauacuuuuuuuaaaugaacuaguaacacacuuaggagcuuuggcuugcucugcccagccagggucucuggcggucucguggacccaggaaaacaaacgcggauccaaaagguuccagcgccaagguggacucaccguggugggucggaggauaccucugcaccguagcccugacggaguuuccguaguaggacgggacgugguugccuugaccaucgauguuaaaaaguacguccaccucuuccgucagcggauacugagcuuccauguacgaauggccgaggcccggguggugcgugucugggugcugaccguugaggaccgcggggugaugguggcucacccagcgcggcugguccgcagucaccuccauguccucggcugugcucgcgcccucucgcccggcccggaacccucgcggguagagggagggcugucggccugggagguccgcggacuccugccgucggaggcccaggagaggggucguuuaaugguuuguuugcaguuaaggguauagaaaaggagagcaaaaaggaggguuuagggaggaaagaaaaaucuuugcgggauaguuuagcaaaagaaaggaagggaaagaagaaaaagaaaagaaugagggcgauccccccccccaaaaaaaaagcagacacggaggaauaaaggggucaaaaaaaaaaaaaaaaaaaggagggagagaggaauccgagugugaccacacugcacacugauuccuuggcgcucagagacgguugcucuuccgaucaccugcaagggagagaaagagagaccugaaugagguguaagaacuuuuaacaccugaaauucuggagggcacuaggucuucgcaagcuuccugcagggccgacucacccgggacgugcacacgcacgcgaagacccggagggaaagaagccaagcuccgcagcacaccuccgacagccaggcucgcaggagcccaggacugacuaagcaauuaaaacuuggggacaaguccucccuggaggacaccggccccaggaucuuuccaaccacuacaaauccuccaaaaggagaaagcugagcuuuuaguuuacaaaaaaccaaacaaacaaacccccaaacacacacacacaaacagucccuccaagaggagggagugauaucaaacuuaaaaaaaaaaaaaaagucacaagucacaauaccaaccugaguagcaaggagcguagaggaggaggaggaggcgugugaccugcccggucagauugcguagcucucuaugucucgcucucucagucucucucucuuucuccucucccucucucaguauuuuuuuuuuacagggaaugcauucuuucugaaacuaucaagacggcgccaggcagcucaguguucgcagacagcuguggcgcgacgcaacuuaaggagguucuagugucauccgcgccgagggggaggagccuggcgcuggcaggaggggacacgauccucagcacaaggaaacugcaacccaaacccgcuccaggacuucaccuccacccccaucccaucccccccacccaccccggcacaccgccgccccuccucccgccccucuacugaccggaaaggggcgccgccaagggccgccuagggcagaggggccgcgggcagggugggcgaggcccgcccgggcuuggggcagaggggacaggcaggagggaauucgcucucuggcccuuuaaauguagcaaagccgauucauucgggcucaguagauuauuccguacgagugaaacccggcugccccauucauaaagcuaauuuccauaagcagacuuuucgauacuuuuuuaaaaaugagcaaacuuuuaaauuaggauucaagccagaacguuuuucaguuuauaucagcuuaggggcuaugugcauguaaaacagauuagaaaaguuucauggcgaaguaacugaagauuugccuccgaaccagcuuuccgggaggcugcugaaucgcgcggaggaccugggcuuugauucggacgcccgcguuauuguuauggucucugcuugcuuucccaaaccucuccagaacgaacagcgucagcuguugcagcugucuuuuucggaucuaaugauaucaucaaugugugcuuuugaccuuagugacaacgcgaugcauaaaaagcuggcuuagcgagaccuaggcucacugguccccgaaguaccguguacaacuaacuugaucuuugcugcgauagccuaacuuuucucuucgccuagcucggggugcuacuuuauucugcuuucacccgaggaaaacgguccccucuauaauauccaacccugaccuccgggguggacccagccgcaacuucccuggacauuuugggucucugggacagggucuggugggagggccgcaagcugacacaggagagaggcuggaagacgcccaguagagaggcugggcggacgagggcggggccauuuguaaggaccaaucaucgggagauaccacgaccgggccgcagucgccccgccccacgggcuccaaccucugcggcccuguuccguccuuugagucacugcauccccuaguggcguugagguuucugcagccuggguccagaaaacacugcccggaugagcaagguccgaaagagacuucgggugcaccccagggcaguguaagagguguucccauuccacccuccagggcagagagcuuggcuuuagaggguuacuggaacugaaggcgucauccccucuucauuucuuuaccccauaauauuucccacuuauucaaaacuuggauucccgacaagcccuuucuuaaaaguuccaaguaacuucuucuauucuacuguggagaaaagccaucaauaucuaccuugaagccaguggagugcggggagagggaaggugcguucuuuuuacaauacaacccuugaagaagacaaaauuuauuuagaaaugugcccugcgggcuuggguuuggagcuucuccugacaccccccccccuuuuacaucugaucuuugacugaaaucaaggcugaauuucuaaauacaaauuacgaagauaccuuuuuuuuaaaaacgagucuucccucccuucugaguucacccugcaccccuuggucccacguuuaugagggcggcccagucuuagaauaucgauuuuuuuacuuucacucuuugaccaacccaucucuccugggccaaucaagcugccagcaucucuuccagcucacggcgcucucaaaaccuuuuaauuauuuaguugcugucuaacauucaccggaaaccauuccauaaacaagcagagaagaccgcacacacauuuuugcuaaaaggcccgggauuaagaucuagaaugagaguuuaaa

SEQ ID NO: 11000 - RNA, 4726 nt, Mus musculus
uuuaaacucucauucuagaucuuaaucccgggccuuuuagcaaaaaugugugugcggucuucucugcuuguuuauggaaugguuuccggugaauguuagacagcaacuaaauaauuaaaagguuuugagagcgccgugagcuggaagagaugcuggcagcuugauuggcccaggagagauggguuggucaaagagugaaaguaaaaaaaucgauauucuaagacugggccgcccucauaaacgugggaccaaggggugcagggugaacucagaagggagggaagacucguuuuuaaaaaaaagguaucuucguaauuuguauuuagaaauucagccuugauuucagucaaagaucagauguaaaaggggggggggugucaggagaagcuccaaacccaagcccgcagggcacauuucuaaauaaauuuugucuucuucaaggguuguauuguaaaaagaacgcaccuucccucuccccgcacuccacuggcuucaagguagauauugauggcuuuucuccacaguagaauagaagaaguuacuuggaacuuuuaagaaagggcuugucgggaauccaaguuuugaauaagugggaaauauuaugggguaaagaaaugaagaggggaugacgccuucaguuccaguaacccucuaaagccaagcucucugcccuggaggguggaaugggaacaccucuuacacugcccuggggugcacccgaagucucuuucggaccuugcucauccgggcaguguuuucuggacccaggcugcagaaaccucaacgccacuaggggaugcagugacucaaaggacggaacagggccgcagagguuggagcccguggggcggggcgacugcggcccggucgugguaucucccgaugauugguccuuacaaauggccccgcccucguccgcccagccucucuacugggcgucuuccagccucucuccugugucagcuugcggcccucccaccagacccugucccagagacccaaaauguccagggaaguugcggcuggguccaccccggaggucaggguuggauauuauagaggggaccguuuuccucgggugaaagcagaauaaaguagcaccccgagcuaggcgaagagaaaaguuaggcuaucgcagcaaagaucaaguuaguuguacacgguacuucggggaccagugagccuaggucucgcuaagccagcuuuuuaugcaucgcguugucacuaaggucaaaagcacacauugaugauaucauuagauccgaaaaagacagcugcaacagcugacgcuguucguucuggagagguuugggaaagcaagcagagaccauaacaauaacgcgggcguccgaaucaaagcccagguccuccgcgcgauucagcagccucccggaaagcugguucggaggcaaaucuucaguuacuucgccaugaaacuuuucuaaucuguuuuacaugcacauagccccuaagcugauauaaacugaaaaacguucuggcuugaauccuaauuuaaaaguuugcucauuuuuaaaaaaguaucgaaaagucugcuuauggaaauuagcuuuaugaauggggcagccggguuucacucguacggaauaaucuacugagcccgaaugaaucggcuuugcuacauuuaaagggccagagagcgaauucccuccugccuguccccucugccccaagcccgggcgggccucgcccacccugcccgcggccccucugcccuaggcggcccuuggcggcgccccuuuccggucaguagaggggcgggaggaggggcggcggugugccggggugggugggggggaugggauggggguggaggugaaguccuggagcggguuuggguugcaguuuccuugugcugaggaucguguccccuccugccagcgccaggcuccucccccucggcgcggaugacacuagaaccuccuuaaguugcgucgcgccacagcugucugcgaacacugagcugccuggcgccgucuugauaguuucagaaagaaugcauucccuguaaaaaaaaaauacugagagagggagaggagaaagagagagagacugagagagcgagacauagagagcuacgcaaucugaccgggcaggucacacgccuccuccuccuccucuacgcuccuugcuacucagguugguauugugacuugugacuuuuuuuuuuuuuuuaaguuugauaucacucccuccucuuggagggacuguuuguguguguguguuuggggguuuguuuguuugguuuuuuguaaacuaaaagcucagcuuucuccuuuuggaggauuuguagugguuggaaagauccuggggccgguguccuccagggaggacuuguccccaaguuuuaauugcuuagucaguccugggcuccugcgagccuggcugucggaggugugcugcggagcuuggcuucuuucccuccgggucuucgcgugcgugugcacgucccgggugagucggcccugcaggaagcuugcgaagaccuagugcccuccagaauuucagguguuaaaaguucuuacaccucauucaggucucucuuucucucccuugcaggugaucggaagagcaaccgucucugagcgccaaggaaucagugugcaguguggucacacucggauuccucucucccuccuuuuuuuuuuuuuuuuuuugaccccuuuauuccuccgugucugcuuuuuuuuuggggggggggaucgcccucauucuuuucuuuuucuucuuucccuuccuuucuuuugcuaaacuaucccgcaaagauuuuucuuuccucccuaaacccuccuuuuugcucuccuuuucuauacccuuaacugcaaacaaaccauuaaacgaccccucuccugggccuccgacggcaggaguccgcggaccucccaggccgacagcccucccucuacccgcgaggguuccgggccgggcgagagggcgcgagcacagccgaggacauggaggugacugcggaccagccgcgcugggugagccaccaucaccccgcgguccucaacggucagcacccagacacgcaccacccgggccucggccauucguacauggaagcucaguauccgcugacggaagagguggacguacuuuuuaacaucgauggucaaggcaaccacgucccguccuacuacggaaacuccgucagggcuacggugcagagguauccuccgacccaccacggugaguccaccuuggcgcuggaaccuuuuggauccgcguuuguuuuccuggguccacgagaccgccagagacccuggcugggcagagcaagccaaagcuccuaaguguguuacuaguucauuuaaaaaaaguaucgggggcccggaaaugggcgaggaagcagugucgcugguugggagaguucuucuuuuuuucuuuuuuaaauaaaagagcgcacguagcaggcaccucucuuugccgguguccuuggggccaggcacacucaccuggcaagcgccgaaaugcaguccugguccacacgagguuguagauuuugcagccagggagaaaucucaagcgcugccugcaggcgccgagccuuucaggccgggcagcagugcgggccaggccggccuggaacugggcucccccgaaggacuuccagcuucuuguuagccggugaaggggucuuucgccagagccuugcguuuuguuucuccauuuauauuuucagaaaaggcccaaauacgugcauuucuuucuauuuccuuuugcucuccacccucaaaagcuagugcauuugaguuuuaggcguccuaccuaccgguggugugaggaagagacucuggugguugccacgguccagggagaggaaagccuuaagcugaagagaagucggguuugcuuagacucccggcuacacagaauuuuccuacgucuuugcuuuuaguuuacuuaccagcaauccuggccgacuuuucuccuccggccuacuggaguuucuucaggcuccucaaagauuuaggcuacaucaaaguuucuuuuuaaguaggaguguuuccaguugccgccucccccuaaccauucaccuugaaaaauuuaggggaguucugagguguguaaagaagagaaaaagaaagaaacccaaccuuguguggucgagacaggagacucuuaacacuccccagauguauguuuaugcaccuaaaccagcaaaaauacauuguuuguuuuuuuuuuuuuuuauuuuaaggaaagaaggugggagguuuuucuuagcuagcucagaccugagaucugcucaggucucccuucucagaguuagccuuggcgccuaugacauagccccuuuggccagcaggcauccucuacccuagagccgccagguuucaaacagacauuucaaacagacauuucugcggauggggcgcucuuugcuuggguugugugcagauuagcaguuaaguggaaaugagguagaucagaccuaauguuauuuacuauacaacuuccugcauaaaaaaaaaaaagaaccuuaacccuuggcguucaagagaauucuccaucucucuugaucucccccccuuccucucgcuuaagauuuuaguuucaguauuguucuuaaugguugacuagaaugucaaauggugaggcggauacuggauugaaagaucaauaaggguguagauuugcgcuccgaguuuaaagguuacccuaccagagaguauggggcuuggacaacucaugaccgccuuaa

SEQ ID NO: 11001 - RNA, 2523 nt, Mus musculus
gagcaucuggcggagcugggggaaaggcaagagaaagccaucaaggagaaugcuguugccgcugcugccuggagucuuuggcuccugcaguucaugaggccucucucuauaggguaaggggcugacgaacgcuacgguucccuggggacucagcaucuggagcggagcaggcaaaggcucagcuagaaccgggaucuggggcuguuguacuuggauagccggagucaauuuggccuaucugaaaacccaggccuugaggcugcugcuggaggcgucaaguugagcaggguaugugugcccucuuggggaaaggguaagaaauggaucugacuuacucuaugcguggaguaagcugagacaccccucaccccccuacacacacacacacacacacacacacacacacacacacacuugcccauccucaggucccucccacucgccuucacuagggcgaccccaucccucuagaaguagacacaaccgguccccuucagaauuuggaagcccugauugaaaaaaaagguuuagcgagugauugggccucaucacuuggggccauggacccagaagguagaaauccacccagagucaacaacccgaaccugacuccgagagagaccaggcgagcuccgcggggccgagaugcgaaaagaugcuacuuugggggucgcggggguggggggguuguugagcgcagcccuccagagagugaccugcaaagccaaaccccgggggucgaaguacuauaguuacuaauccugggcagggguagaaagcgugccucggaaugccuagggcugucauuugagcguguuuacuuagggacuuugcacgccgagcgcaagcggaauaguaggauucuccuagaggcagcaaauguuugcaggcuggaaaacgaagcggagcggggcgugcugccuugucccuccucccggagccaaggcgccggccugggcggaucugauggcgcgguuaccgacugaagugaagcccggaaccugaagggcugggaggucggggagaaagcagagcagcaccgaaggccagaaauuaaauucacagcccgggaccccgacgacccaaggacuagggaaaaagucacuucccauuccagcucgaucaaucuuccuuccaugcgauugauuaauagaaaacgaagugaaaagaccguggucgcugugcgucugggaaggaagcgaagggcagagguauccaggccggcgccgguacccccuuaccaccgguucacaacccggaggucuacaucgccucggacuagggaagcggggcgguggcgagaacccagggagaccgcgcgggaccuuuaauuggguguauccguuuuaacaguggccauuguugaagcaauuagcgagagacaauaaccaccgagaugcguuuaauucgauuccgugcacgcugcaauccccgcccgggcucugcgauaugcaggccugggauaacccggagggucugguugugaagguacggguuggguuccuugaucauuuugucuuaggcauggaaguuguaaaagaaaggcgggagggggagcuagaucugcccccaagcaagccacgguaggagacucauccuuggucaucccccggaccacuguucuuucuuggagcauggguuggagcugcggccgccuggucaauccacagugccuguuugagaggagaaaagccgggaagacugggacauggauccaagucucaaucuuacuuccccgccucgguuucucgaacuaaauccuaauugccuucccaauccggggaggagcaaagaagagacccugcuuaagucucacaacacacuuccucuccucuggagccagccccuguacccccuccuccguuuuaaccuccggauuaaguuacccaggccaggcgaggguuuuuuacuggauacgagaauaguacagguaaagcuguauaaauaguucgccagcugcggagcaggaggguuaugccggggacacagucccaaggcgccaccagucagccuggcuugagcuuacaaaacggcuggggaggccacuuugccucggcgacccggaccucauagguuaaacacauauuacguuaucaccuuagcuuucaccauguccucuuuucucuuuuuuccccgcaugagcugaaauacagagaagagagcaaaaucaaaccgcgguggaaaacgaagcaagcagcggggccaugcuggcugaggcuuccugcuccucaacggagacaccuuuccaauuaaaacaguagacaugggaacuuuagugauguaaagaaagaagguugcuaaaagucacuggccaggagaagaagcuggcuguagaagccuggggguggggggacccaugggaauuuaaaugaaaaggcuaugcacccgcagaucucccggcucccacgcccacccgccccgggucugggguccauuuuccaugcgaaaugagccacuguuuuggauauguguuuugauuuuuuuguuuguuuguuuacucaucuaucacaguuuaaaacaccg

SEQ ID NO: 11002 - RNA, 2523 nt, Mus musculus
cgguguuuuaaacugugauagaugaguaaacaaacaaacaaaaaaaucaaaacacauauccaaaacaguggcucauuucgcauggaaaauggaccccagacccggggcgggugggcgugggagccgggagaucugcgggugcauagccuuuucauuuaaauucccauggguccccccacccccaggcuucuacagccagcuucuucuccuggccagugacuuuuagcaaccuucuuucuuuacaucacuaaaguucccaugucuacuguuuuaauuggaaaggugucuccguugaggagcaggaagccucagccagcauggccccgcugcuugcuucguuuuccaccgcgguuugauuuugcucucuucucuguauuucagcucaugcggggaaaaaagagaaaagaggacauggugaaagcuaaggugauaacguaauauguguuuaaccuaugagguccgggucgccgaggcaaaguggccuccccagccguuuuguaagcucaagccaggcugacugguggcgccuugggacuguguccccggcauaacccuccugcuccgcagcuggcgaacuauuuauacagcuuuaccuguacuauucucguauccaguaaaaaacccucgccuggccuggguaacuuaauccggagguuaaaacggaggaggggguacaggggcuggcuccagaggagaggaaguguguugugagacuuaagcagggucucuucuuugcuccuccccggauugggaaggcaauuaggauuuaguucgagaaaccgaggcggggaaguaagauugagacuuggauccaugucccagucuucccggcuuuucuccucucaaacaggcacuguggauugaccaggcggccgcagcuccaacccaugcuccaagaaagaacagugguccgggggaugaccaaggaugagucuccuaccguggcuugcuugggggcagaucuagcucccccucccgccuuucuuuuacaacuuccaugccuaagacaaaaugaucaaggaacccaacccguaccuucacaaccagacccuccggguuaucccaggccugcauaucgcagagcccgggcggggauugcagcgugcacggaaucgaauuaaacgcaucucggugguuauugucucucgcuaauugcuucaacaauggccacuguuaaaacggauacacccaauuaaaggucccgcgcggucucccuggguucucgccaccgccccgcuucccuaguccgaggcgauguagaccuccggguugugaaccggugguaaggggguaccggcgccggccuggauaccucugcccuucgcuuccuucccagacgcacagcgaccacggucuuuucacuucguuuucuauuaaucaaucgcauggaaggaagauugaucgagcuggaaugggaagugacuuuuucccuaguccuugggucgucggggucccgggcugugaauuuaauuucuggccuucggugcugcucugcuuucuccccgaccucccagcccuucagguuccgggcuucacuucagucgguaaccgcgccaucagauccgcccaggccggcgccuuggcuccgggaggagggacaaggcagcacgccccgcuccgcuucguuuuccagccugcaaacauuugcugccucuaggagaauccuacuauuccgcuugcgcucggcgugcaaagucccuaaguaaacacgcucaaaugacagcccuaggcauuccgaggcacgcuuucuaccccugcccaggauuaguaacuauaguacuucgacccccgggguuuggcuuugcaggucacucucuggagggcugcgcucaacaacccccccacccccgcgacccccaaaguagcaucuuuucgcaucucggccccgcggagcucgccuggucucucucggagucagguucggguuguugacucuggguggauuucuaccuucuggguccauggccccaagugaugaggcccaaucacucgcuaaaccuuuuuuuucaaucagggcuuccaaauucugaaggggaccgguugugucuacuucuagagggauggggucgcccuagugaaggcgagugggagggaccugaggaugggcaaguguguguguguguguguguguguguguguguguguguguaggggggugaggggugucucagcuuacuccacgcauagaguaagucagauccauuucuuacccuuuccccaagagggcacacauacccugcucaacuugacgccuccagcagcagccucaaggccuggguuuucagauaggccaaauugacuccggcuauccaaguacaacagccccagaucccgguucuagcugagccuuugccugcuccgcuccagaugcugaguccccagggaaccguagcguucgucagccccuuacccuauagagagaggccucaugaacugcaggagccaaagacuccaggcagcagcggcaacagcauucuccuugauggcuuucucuugccuuucccccagcuccgccagaugcuc

SEQ ID NO: 11003 - RNA, 829 nt, Mus musculus
gcugccucuagaccuggccugcucccagugaagccccaggccccaccuuugaagcaccuagaauugcuuacggcauccaagaaaaucccgagccaggugguugggguucgaccacuuaaacaaacacacaggccccuucaucuuaaagaaaaugcagugaaacugaggagagccagccuugcugaccucccagguucaaccuggccucuagguuccccgggcuagcuaaggcgcuccccaguccccagugccugccugcaucaucagccuacucucuucugaagcuuuggugguuucaaaaggagaaagugggcuuuaucuugucgaugugggacuuuugugucuccagauuagcuuaaggaauuggaauacugauuguggagagacaauccaccauagucgagggaugagggggcuucacagcaaagguagaaaagcgggaggagagcugcuucagauccugggacaagcagaggccgcuuugguuuuuguuuuuguuuuuguuuuuuuuuaaauaggaaucaucauuagugucauuggaugcgauggugagccuauagaaaagaucgugguuaugccuggcucagacuucccggcaucaugggcucuuugcccagagcuacuauuugccggccugccggccugccuggaacucuccgguccagguccgggcuuacugaggcacccuccacagccugcgaccccagcaaacugagcuccagccauuuguuacauaaaauaaagcaaccaccaagugcuuacccaucacuagcuccuggcagacccccuccucuggacaaacccggaccucugagagcaccuggcaacc

SEQ ID NO: 11004 - RNA, 829 nt, Mus musculus
gguugccaggugcucucagagguccggguuuguccagaggagggggucugccaggagcuagugauggguaagcacuuggugguugcuuuauuuuauguaacaaauggcuggagcucaguuugcuggggucgcaggcuguggagggugccucaguaagcccggaccuggaccggagaguuccaggcaggccggcaggccggcaaauaguagcucugggcaaagagcccaugaugccgggaagucugagccaggcauaaccacgaucuuuucuauaggcucaccaucgcauccaaugacacuaaugaugauuccuauuuaaaaaaaaacaaaaacaaaaacaaaaaccaaagcggccucugcuugucccaggaucugaagcagcucuccucccgcuuuucuaccuuugcugugaagcccccucaucccucgacuaugguggauugucucuccacaaucaguauuccaauuccuuaagcuaaucuggagacacaaaagucccacaucgacaagauaaagcccacuuucuccuuuugaaaccaccaaagcuucagaagagaguaggcugaugaugcaggcaggcacuggggacuggggagcgccuuagcuagcccggggaaccuagaggccagguugaaccugggaggucagcaaggcuggcucuccucaguuucacugcauuuucuuuaagaugaaggggccuguguguuuguuuaaguggucgaaccccaaccaccuggcucgggauuuucuuggaugccguaagcaauucuaggugcuucaaagguggggccuggggcuucacugggagcaggccaggucuagaggcagc

SEQ ID NO: 11005 - RNA, 526 nt, Mus musculus
cauucucagaaaaaggcuggaagcgacucuaaacugcagauaaugccacagaccagggauucccggccugcuguaagacaguugcugcaaguucacgaguuggccccggggccaagaucccaguuucucgccccucgaggguuaugcucucaauugcacgcgccgagcacgguucuggcacccuaaaacuaccuugucugggcugcaaggcgcucuccucugcguaugacccccgccuuuccagcaugucacagagucccccucgcuuuagcccggggagccggguugccgcacccuuccuccgcgggcucccacccccauuuccggggucuccucccucuugucagcaccuucuccgcccuccccacugccugcccgcgcucaccugguuguuuuugcagagaucagcccacaugcuggugccguccccuccgcgcaucaggacgugguaggugaagaaguagauacccgguauggagcaggugaacuugcccguggugggaucauagugguuuccgagauuggu

SEQ ID NO: 11006 - RNA, 526 nt, Mus musculus
accaaucucggaaaccacuaugaucccaccacgggcaaguucaccugcuccauaccggguaucuacuucuucaccuaccacguccugaugcgcggaggggacggcaccagcaugugggcugaucucugcaaaaacaaccaggugagcgcgggcaggcaguggggagggcggagaaggugcugacaagagggaggagaccccggaaaugggggugggagcccgcggaggaagggugcggcaacccggcuccccgggcuaaagcgagggggacucugugacaugcuggaaaggcgggggucauacgcagaggagagcgccuugcagcccagacaagguaguuuuagggugccagaaccgugcucggcgcgugcaauugagagcauaacccucgaggggcgagaaacugggaucuuggccccggggccaacucgugaacuugcagcaacugucuuacagcaggccgggaaucccuggucuguggcauuaucugcaguuuagagucgcuuccagccuuuuucugagaaug

SEQ ID NO: 11007 - RNA, 82 nt, Mus musculus
gcucguccggagcagcucacacuuuuaugccgcugcugcccgugaucgacuuuuccuuuuuugcagacugcgccaguucuca

SEQ ID NO: 11008 - RNA, 82 nt, Mus musculus
ugagaacuggcgcagucugcaaaaaaggaaaagucgaucacgggcagcagcggcauaaaagugugagcugcuccggacgagc

SEQ ID NO: 11009 - RNA, 528 nt, Mus musculus
uacuguguuaggugucaagcugcggagcuuuucccuuguggguaaggaauggagugugcugaugggaaacaaaacugagccaaaaaaauugggauccugacccaaaauaaagggccaaagggcaaguggaauaauugaaguuaagcuaauguuuuuuucaagauagagccugacauaaucuuaguaggugugcuuucacucuuuugaacuugaagaugagguucaacagucuuuaaguucagaguggaaugaaacgaguuaagaagagaaagacaccauugagaaaauccugaaaguuuuucuguagauacuacaaaauuaucauugucuuucaguauaggcagaucucucccucauauaacugauguuucuuggcgcuuggaguaccagauaaagguaaagauaacaagcuuuucuguagagggaguuagaggaacuuuuuuuuuaaaaagguuagaguuaaagacugauguuuuguguuguuuuagaccaaccaacuucauaagauguaccgaccuggauauuugg

SEQ ID NO: 11010 - RNA, 528 nt, Mus musculus
ccaaauauccaggucgguacaucuuaugaaguugguuggucuaaaacaacacaaaacaucagucuuuaacucuaaccuuuuuaaaaaaaaaguuccucuaacucccucuacagaaaagcuuguuaucuuuaccuuuaucugguacuccaagcgccaagaaacaucaguuauaugagggagagaucugccuauacugaaagacaaugauaauuuuguaguaucuacagaaaaacuuucaggauuuucucaauggugucuuucucuucuuaacucguuucauuccacucugaacuuaaagacuguugaaccucaucuucaaguucaaaagagugaaagcacaccuacuaagauuaugucaggcucuaucuugaaaaaaacauuagcuuaacuucaauuauuccacuugcccuuuggcccuuuauuuugggucaggaucccaauuuuuuuggcucaguuuuguuucccaucagcacacuccauuccuuacccacaagggaaaagcuccgcagcuugacaccuaacacagua

SEQ ID NO: 11011 - RNA, 1213 nt, Mus musculus
gaagguugguuuagguuuuaauggcaaagagagaauggaaagcagaaauuuaacauagauuucacuuuuaaaaguaacauaguaacauccccaguagccugcauuuacuggugccccuaauugaaaaauaacuuuaaaguuugaguucagcacacuuucuuucauuccaucaugcaucugacucauaaaacugagcaaaaguaagagauuggagaaugccuuucacaaauuaaacuuccaaaguuuuaagcaggaguuuuaaauuacccuauaaagggaaaguucacacaaguucuuaaaacuguuaauauuuucaguguaaaacugaagaaauuaaagucuucguugauugauggauaugcuaacgaauuucuuaccaauuaaauaaaaugaagaucauuccugaaaauuugaaugaaauuaaauguuccaaagacaucuguagucacuuuagaguaaauauuagcgaaacuuuaaacagaaaaugugugugaaucauaaccuuccuuagagaaguugagagauaauuuagauauucucagccugcaaaaauucuguuagaaauucccuuuuaacuagaacuugaauaccugauuggaggaccagauccagcagaagaagcgcuucuuuuccaaagggcuuugcgagcuguugagcucccguggacuccuuagguguucuuccuuccgacuguguucuugcagcugcuucagaguugcugcuuccucacuuguaugcccaaguugugacaugauuguacaucuuuuaggacuugguggggaaacuuaaggaugcuucaaaaagccuggaaagagcaacucaguuguaauuuggggaggcugaugaccccaggagccuagaggaaaaccagacgcgccuugucuccugcuggaccaucguucgcgcgagcuggaugucauuuucaguggaaaaagagcuagcacccuuuugaagugaugccaaccaucaauuuugacacuuuuuuuacacaugugaaaugguuaagagggagacucuuaagcaucuggauuuucaguauuacucuugcguuccuucuaucuugagcgucuucaagcccuauuaaaguaucguacccugaauaaauacggugguauucccacaagaagggcggcauucuguuuggaguuugugugugacuuugacgacugagugugccaagcacaucugcccugcgugggcucggacgccugcc

SEQ ID NO: 11012 - RNA, 1213 nt, Mus musculus
ggcaggcguccgagcccacgcagggcagaugugcuuggcacacucagucgucaaagucacacacaaacuccaaacagaaugccgcccuucuugugggaauaccaccguauuuauucaggguacgauacuuuaauagggcuugaagacgcucaagauagaaggaacgcaagaguaauacugaaaauccagaugcuuaagagucucccucuuaaccauuucacauguguaaaaaaagugucaaaauugaugguuggcaucacuucaaaagggugcuagcucuuuuuccacugaaaaugacauccagcucgcgcgaacgaugguccagcaggagacaaggcgcgucugguuuuccucuaggcuccuggggucaucagccuccccaaauuacaacugaguugcucuuuccaggcuuuuugaagcauccuuaaguuuccccaccaaguccuaaaagauguacaaucaugucacaacuugggcauacaagugaggaagcagcaacucugaagcagcugcaagaacacagucggaaggaagaacaccuaaggaguccacgggagcucaacagcucgcaaagcccuuuggaaaagaagcgcuucuucugcuggaucugguccuccaaucagguauucaaguucuaguuaaaagggaauuucuaacagaauuuuugcaggcugagaauaucuaaauuaucucucaacuucucuaaggaagguuaugauucacacacauuuucuguuuaaaguuucgcuaauauuuacucuaaagugacuacagaugucuuuggaacauuuaauuucauucaaauuuucaggaaugaucuucauuuuauuuaauugguaagaaauucguuagcauauccaucaaucaacgaagacuuuaauuucuucaguuuuacacugaaaauauuaacaguuuuaagaacuugugugaacuuucccuuuauaggguaauuuaaaacuccugcuuaaaacuuuggaaguuuaauuugugaaaggcauucuccaaucucuuacuuuugcucaguuuuaugagucagaugcaugauggaaugaaagaaagugugcugaacucaaacuuuaaaguuauuuuucaauuaggggcaccaguaaaugcaggcuacuggggauguuacuauguuacuuuuaaaagugaaaucuauguuaaauuucugcuuuccauucucucuuugccauuaaaaccuaaaccaaccuuc

SEQ ID NO: 11013 - RNA, 1114 nt, Mus musculus
cagagggacagaaacuguuguguuagggcaggagaguuaauacuugugcaggugaggcugagacggcuuuggggcaccuugacuccaaagcccgaagccgcacaugcgggguucuuuuuucucgcggcuuccgccgcaacucucucugcugcugcugcugucguugaggcgagucuggacccaggaggauauuggaacugccccuucuaaauccccgguggcccccgaaugccccgaggcauguucauguucacuaggcggcaaggccaauugcuccgcacucgcgcugccugcgguaccagcggaccugagcuggcaaguacgcucacugcugcuggaucacaaucgcgugagcgcgcugccuccgggugccuucgccaaugcaggcgcgcugcuauaccuagaucugagggagaaccggcuucggucggugcacgcacgagcuuucuggggucugggaguguugcaauggcuggaccugagcuccaaccagcuggaaacucugccuccuggcaccuucgcgccgcugcgcgcgcuuaguuuccucucccuagcggguaaccggcuggcacuccuggagccuucgauccugggcccgcuuccauuacugcgagugcucagccugcaggacaauucacuaucggcaaucgaggcggguuugcugaauaacuugccugcccucgauguguugcgcuugcauggcaaccccuggacgugcaacugugcgcugcguccccuuugcacuuggcugcguaagcacccgcguccagccucaggugagccaucuggggcgcaggacggauaauguuuggugcaauugcugccaucugacgccgcuccugugucccgcagaaacugagacccugcucugcgugucuccaagacuccagacgcucagccuacugacagcuuuuccggaugccgccuucaaacagugcacucagucacuagcagcgcgagaccuggcgguggucuacgcucucgggccggucucuuuccuugcuaguuuggccaucugccuggcauugggcuccgugcucacugcuuguggugcacggcgccgccgccgccgccgcaccacggugcgccacuuacuaaggagacagcuagaccc

SEQ ID NO: 11014 - RNA, 1114 nt, Mus musculus
gggucuagcugucuccuuaguaaguggcgcaccguggugcggcggcggcggcggcgccgugcaccacaagcagugagcacggagcccaaugccaggcagauggccaaacuagcaaggaaagagaccggcccgagagcguagaccaccgccaggucucgcgcugcuagugacugagugcacuguuugaaggcggcauccggaaaagcugucaguaggcugagcgucuggagucuuggagacacgcagagcagggucucaguuucugcgggacacaggagcggcgucagauggcagcaauugcaccaaacauuauccguccugcgccccagauggcucaccugaggcuggacgcgggugcuuacgcagccaagugcaaaggggacgcagcgcacaguugcacguccagggguugccaugcaagcgcaacacaucgagggcaggcaaguuauucagcaaacccgccucgauugccgauagugaauuguccugcaggcugagcacucgcaguaauggaagcgggcccaggaucgaaggcuccaggagugccagccgguuacccgcuagggagaggaaacuaagcgcgcgcagcggcgcgaaggugccaggaggcagaguuuccagcugguuggagcucagguccagccauugcaacacucccagaccccagaaagcucgugcgugcaccgaccgaagccgguucucccucagaucuagguauagcagcgcgccugcauuggcgaaggcacccggaggcagcgcgcucacgcgauugugauccagcagcagugagcguacuugccagcucagguccgcugguaccgcaggcagcgcgagugcggagcaauuggccuugccgccuagugaacaugaacaugccucggggcauucgggggccaccggggauuuagaaggggcaguuccaauauccuccuggguccagacucgccucaacgacagcagcagcagcagagagaguugcggcggaagccgcgagaaaaaagaaccccgcaugugcggcuucgggcuuuggagucaaggugccccaaagccgucucagccucaccugcacaaguauuaacucuccugcccuaacacaacaguuucugucccucug

SEQ ID NO: 11015 - RNA, 561 nt, Mus musculus
uaucggcgugauucagauaucuuuguacccuacggucgcuuggagccucucucugggcccacauccccacuaccggccaaaagcaggauggcugccugggugaucagcaauuuccaggagcggcagcagcgugcaaagcuguaccggcagcuggccccucaucugcagguggauguguucggucgcgccagcggacggccccuaugcgcuaauugucugcugcccacuuuggcccgguaccgcuucuaccuggccuuugagaacucacagcaucgggacuacaucacugagaaguucuggcgcaaugcccuggcggcuggugcuguacccguggcgcugggaccuccucgggccaccuacgaggcuuuugugccaccagaugccuuuguacacguggacgacuucagcucugcccgugaacuggcugucuuccucgucagcaugaaugagagucguuaucguggcuucuuugcuuggcgagaccggcuccgugugcggcuccugggugacuggagggagcgcuucugcaccaucugugcccgcuacccuuacuugccccgc

SEQ ID NO: 11016 - RNA, 561 nt, Mus musculus
gcggggcaaguaaggguagcgggcacagauggugcagaagcgcucccuccagucacccaggagccgcacacggagccggucucgccaagcaaagaagccacgauaacgacucucauucaugcugacgaggaagacagccaguucacgggcagagcugaagucguccacguguacaaaggcaucugguggcacaaaagccucguagguggcccgaggaggucccagcgccacggguacagcaccagccgccagggcauugcgccagaacuucucagugauguagucccgaugcugugaguucucaaaggccagguagaagcgguaccgggccaaagugggcagcagacaauuagcgcauaggggccguccgcuggcgcgaccgaacacauccaccugcagaugaggggccagcugccgguacagcuuugcacgcugcugccgcuccuggaaauugcugaucacccaggcagccauccugcuuuuggccgguaguggggaugugggcccagagagaggcuccaagcgaccguaggguacaaagauaucugaaucacgccgaua

SEQ ID NO: 11017 - RNA, 2730 nt, Mus musculus
ggaggaggacgcgucgggcugccagcggccagagccaccuuggcgaacuugcgcaccgugggcccaggagugcgcggcgcgggccgggcagcggcuccggggggugcagcgcuggggcccacagccacggacacgcuaagcaggaagcacucugccggcucauagagccuuccugcugccgccagcucucgugcauagcuacccaggggcgccgcauguguagccagcucacgcagcgacagguaggugggcgauaacagcaacccuucgaggccaaagcguaggaaguugucggcagagccugggcucgggaagcccaagaacagcacgccacggccucgcgacaggaauccgacgcgcgcuaugcgagagaaggcgcgaugcacugggcugcugucgcggcagaacugcagcacguggcggcacacgcugcccacgcggccguacacgcaacgcgccuugugcgcgucccaguccucucggcggcacagacgcgagcaguaguagguauagcagcuguggcacgacuugaaguagaggcaggcguugaacauggucucuguccgccggcagcgcgcguuggagcaggucaucaagucauccucgucugcgcugggcucgggggaggcguccgcugccucccccgagccggugggcucuucagugcugccagccgaggccgggggcgagcgcgauggcgccagcaggguggccccuccagggccugcagcccgugaguccagcaggcggcguaguuggcggccuaaaccuucggcggcaggcuccggggccugggcuggcgaccgugagucgaugaccaggucagugaugagcucguccagcugcucgaggcugcgcuggcggcuugaagcaggacccucagggaccguggauacgggcugccguggucggccuccaggcaauucccagcccuuggcagucgggcgauccacugagcgcaggucguugucugugaugguaaucucuggcgugacguaccaguugcggcccaggcucucucccgcgcggcccuucucugucagcgacgucucggacagcgacagugcugcauagcgucugggugagguggacaaauucacuacgacugguggacgccgaccuucaggggaugaaccccucguaucccgaaccucgcgucccaggagguucucauagcugcggccgcguccuagaggaucuucacgacgaggaccaggagcuaggauguugucccaggaucgagaguaguggcggcuaucgguggccagccggggugggcuugugccggugccgccgugccacgaggccaacagugguccaggggcgggaggcggcauuaccugaagggugcgguaaggccucggaccccagucagcccagggugggcugcugcgcgggugcggguaaguccgagccaguacaucgcguucucgguaccucccaaaguccucgguguagaaagugcgggcuccagggugcgcccggggcucuucugggacauaccggggaacgaaaggcauaccguaggcucgaguugucuccccguaguaggagcgggaggggggcuccuggaucgggaaggugcguacuucgccagcauaguagcugcccccacgccuuggacugggucuaggggguucuucggacaaguagggccuggaacaguagccaucaaagggaaggccggggcuugugguaaagcugccugcguagcccucuggcuccucgguguagaagaauugggugggaccuggaggcguugugaaggguugacugcggugcuccaaguagucccggggcccaggcaguggcccgucacaguacagaguucuggggucaguacaguacaagucacuggggguaggagugcgugacagggccacguggcgagggccgggaacugugaggccauggaacuguggagcugugcgagcccaggacgucgucucucuaggugcgcaagaucgcgagcuucgggcggcgugcugcagcacugccucguccggcuugauguccaaacggcagcggacaugggggacagguccagagggugguuccgguggugcgcagcggccugggguggcgcauagaggcgcgaugcguccggggccuccccgcuguggcuggagcuugauggggugcagcucauuagcgagagcucucagcgcaggauacgagggcucccggcgcggcgaccccuccacccgcacugcacgcugggcuucccgaccucugcguugcaguacgggcggcgaagcuggagcagucgccaggccuugggacgcacggggcgcgcucuuggaacgggugcggcgccgaggcucgcugucucugggucgggcgcgcgguggcgcagguucaggagguggcggcucugggugugucuccauggugggcucguccagugccucuaagaagucaaaacuacggcaguggcgcuuguugaaaggcgugggcgcagcaggccgggccacggaucgcucacauggcuggcguuuggacgugagcccuggguccaccaccuugauguccugguacacggucgacaccagcaaguccggcggguccgugcgggucaucuuaaaagacguccccaggcuggcagcuccagucacacggccuuucggggauuuugcccugggaggagauaccggucagggcagccuccucugcaccccaagcccuuuaccccaccccaccccacgugcugguccggcuuaccuggggcau

SEQ ID NO: 11018 - RNA, 2730 nt, Mus musculus
augccccagguaagccggaccagcacgugggguggggugggguaaagggcuuggggugcagaggaggcugcccugaccgguaucuccucccagggcaaaauccccgaaaggccgugugacuggagcugccagccuggggacgucuuuuaagaugacccgcacggacccgccggacuugcuggugucgaccguguaccaggacaucaaggugguggacccagggcucacguccaaacgccagccaugugagcgauccguggcccggccugcugcgcccacgccuuucaacaagcgccacugccguaguuuugacuucuuagaggcacuggacgagcccaccauggagacacacccagagccgccaccuccugaaccugcgccaccgcgcgcccgacccagagacagcgagccucggcgccgcacccguuccaagagcgcgccccgugcgucccaaggccuggcgacugcuccagcuucgccgcccguacugcaacgcagaggucgggaagcccagcgugcagugcggguggaggggucgccgcgccgggagcccucguauccugcgcugagagcucucgcuaaugagcugcaccccaucaagcuccagccacagcggggaggccccggacgcaucgcgccucuaugcgccaccccaggccgcugcgcaccaccggaaccacccucuggaccugucccccauguccgcugccguuuggacaucaagccggacgaggcagugcugcagcacgccgcccgaagcucgcgaucuugcgcaccuagagagacgacguccugggcucgcacagcuccacaguuccauggccucacaguucccggcccucgccacguggcccugucacgcacuccuacccccagugacuuguacuguacugaccccagaacucuguacugugacgggccacugccugggccccgggacuacuuggagcaccgcagucaacccuucacaacgccuccaggucccacccaauucuucuacaccgaggagccagagggcuacgcaggcagcuuuaccacaagccccggccuucccuuugauggcuacuguuccaggcccuacuuguccgaagaacccccuagacccaguccaaggcgugggggcagcuacuaugcuggcgaaguacgcaccuucccgauccaggagccccccucccgcuccuacuacggggagacaacucgagccuacgguaugccuuucguuccccgguaugucccagaagagccccgggcgcacccuggagcccgcacuuucuacaccgaggacuuugggagguaccgagaacgcgauguacuggcucggacuuacccgcacccgcgcagcagcccacccugggcugacugggguccgaggccuuaccgcacccuucagguaaugccgccucccgccccuggaccacuguuggccucguggcacggcggcaccggcacaagcccaccccggcuggccaccgauagccgccacuacucucgauccugggacaacauccuagcuccugguccucgucgugaagauccucuaggacgcggccgcagcuaugagaaccuccugggacgcgagguucgggauacgagggguucauccccugaaggucggcguccaccagucguagugaauuuguccaccucacccagacgcuaugcagcacugucgcuguccgagacgucgcugacagagaagggccgcgcgggagagagccugggccgcaacugguacgucacgccagagauuaccaucacagacaacgaccugcgcucaguggaucgcccgacugccaagggcugggaauugccuggaggccgaccacggcagcccguauccacggucccugaggguccugcuucaagccgccagcgcagccucgagcagcuggacgagcucaucacugaccuggucaucgacucacggucgccagcccaggccccggagccugccgccgaagguuuaggccgccaacuacgccgccugcuggacucacgggcugcaggcccuggaggggccacccugcuggcgccaucgcgcucgcccccggccucggcuggcagcacugaagagcccaccggcucgggggaggcagcggacgccucccccgagcccagcgcagacgaggaugacuugaugaccugcuccaacgcgcgcugccggcggacagagaccauguucaacgccugccucuacuucaagucgugccacagcugcuauaccuacuacugcucgcgucugugccgccgagaggacugggacgcgcacaaggcgcguugcguguacggccgcgugggcagcgugugccgccacgugcugcaguucugccgcgacagcagcccagugcaucgcgccuucucucgcauagcgcgcgucggauuccugucgcgaggccguggcgugcuguucuugggcuucccgagcccaggcucugccgacaacuuccuacgcuuuggccucgaaggguugcuguuaucgcccaccuaccugucgcugcgugagcuggcuacacaugcggcgccccuggguagcuaugcacgagagcuggcggcagcaggaaggcucuaugagccggcagagugcuuccugcuuagcguguccguggcugugggccccagcgcugcaccccccggagccgcugcccggcccgcgccgcgcacuccugggcccacggugcgcaaguucgccaagguggcucuggccgcuggcagcccgacgcguccuccucc

SEQ ID NO: 11019 - RNA, 532 nt, Mus musculus
caccgccccaccccaguaccugcgugugugucgguggguaucggagugugucuguguguguccgcgcucccgccucgcggaagcuauugagaacgugugcacccguauuccugugcacauacauuuuguguuuguguguccuuacgucuuuccaggcaaugaguguguguguuuucgguacacgucucucgugcuucuaugucauguuuuuuacacgucuuuguguguguccucgugaagguguagauagugaagaugucuacgccuuuguaugcgccucggccccuuuagcgaaucugguagauuuuucucuauaagugugucucugaguuaccuuuguguuucuguuugccccggagcuccugaauuguucugugucgcccagggguuuuuguguuuguggcuuuguguucuguguauuucucggcgccuuuguguauccaggagcauggguauguggauguagaguuuucuucacccacccuucguccuuguuuuuacccagugugaaaaaucuaaggccuugagcccu

SEQ ID NO: 11020 - RNA, 532 nt, Mus musculus
agggcucaaggccuuagauuuuucacacuggguaaaaacaaggacgaagggugggugaagaaaacucuacauccacauacccaugcuccuggauacacaaaggcgccgagaaauacacagaacacaaagccacaaacacaaaaaccccugggcgacacagaacaauucaggagcuccggggcaaacagaaacacaaagguaacucagagacacacuuauagagaaaaaucuaccagauucgcuaaaggggccgaggcgcauacaaaggcguagacaucuucacuaucuacaccuucacgaggacacacacaaagacguguaaaaaacaugacauagaagcacgagagacguguaccgaaaacacacacacucauugccuggaaagacguaaggacacacaaacacaaaauguaugugcacaggaauacgggugcacacguucucaauagcuuccgcgaggcgggagcgcggacacacacagacacacuccgauacccaccgacacacacgcagguacugggguggggcggug

SEQ ID NO: 11021 - RNA, 2372 nt, Mus musculus
ucaggcugccgaaacugucggcaacugaguccagaguucccugggugaacaguggcaccaagauugucucuaguccgauugaggacgaugcuccguucacagaugccuguuuccuucuguccguucuccucuacccguaggccuucuuuguccuuacuuuucaaccccgaauugacuagacccggucuucacauugccccacauaaucguccaugugucuccgaggcauucuuaggguucuuggucucccauccuuugccucuaaggaagaacaauacgacuggacaggagaacaccggccuaggccuagacccacuucucuccgcgggccucaagcuccuggcuucgcccgucucuucuguacaagcggaugcccaccccuggcucugagacucacaacgcagguggccuaucucuuccgcgccguccaacgcgggaugcuugcggccuccgacgucugcugcagaauccgcucgggacuguuuccaccugagaaagagaguugccagcgacugcuggaaucgcaagaaacaaaacagggagagauccgggcucuucuuaucccagaggcgugcagcuccugagcccugacuuggucucuggcucuucuccuuuaggaccuugcaaccucacucgguagcgacccaucuugugagagcgggggagcggugugaggggaagggcuauaccagcgaaaacccaaccguuuggugcuucugaccagaguccgggagagagaggacccuuccuccagguuuagaaccaccggcugcagugucagaucccagcaggaggaggaccacagccuuggauucaucagcaaggaggcuaucagaagcaucgcaccggccuuccugcucugccucaagaaccgaagccauggaacaccuaggcucaccccaugcugccccuggcuaauggcaucucaagaucuacgaggcucugccgcgcagaaucaaagcugucccaaaacugugggccaagucgggagcugcuccucggggaaacucagucuaucccagacccucagugaugaagaacccgaagaccacggaaauggagcaagggcgcgcccaagacucagcagaggucgaucacuagcaauccaacucccgagcauccagguaccccucugagcauucuagcuggucuucaccccacacacgagucaaagcauuggacgaccacuuucuacuaccuaaggaagggcgucugaagucucccugugcugguggaaguucuccagagaggcgagacuagagagggguuucugggguacuuauucuccacugggggcuuuugaggcugaugagagaggggugucaggguuugcugguggcuggugaguguuaggaugccuagagccagaagaugaacauccgcagccagaucccucagcccuccaacaacccccacucuggccauuacucuggaccaucaggcauggacuugcuccacuuguggggaaaucaggcucucucagauccaaaggcugccggcagcucuuaggaagguucagagaaggcccucccaggacugguggcccagaacugaggucuccuacuggcuacacaaugguuaggaacaggagaagggcaggugucaggaagcaucccugucugucucagggucugguuaggagacaccaggguaaaagaccugcugcgccuuuguacuucaaggucccugucugugcaaugggcauaaaagagacuuacagagucucugagagggucacaugaaagugcucgugguguggccagcucacuguggggcucuagaucuacuauuugaugaauaauuguaugggaggagagcugcuacuuagacauaggagacucucuuccucuuucuguuccucugccgccucuagagccagaacgaaaacagacuugucucaaauucaguccugucuggucucuuccuucccucugggacagguggaguccccgagccggcuacuguggacuggccaccugagacacggccagugccugggcacccagcacaaacagcucagccuucucacuuugucaugaaaaccgaggcugagggcagcuaacaccgacagugagagcuuugagaggcaauagaaucaagauuuuuuuuuaaaagcucuuuggaaagaaacccguuagagacugugauguguguacuuuuuuuguauguuugcuuuuuaccaagcacuuuccuaagaaucucugcauuucuugccaaaggaugguuucaacaggcauccugucuuuaagaaugaguggcuccccaguccaguuacaggaaccagaacaaagagagggugaaggaccguguuuggagccauaaaagccucauuaggaacuuaagacuaacucacagaaucggacacagauuca

SEQ ID NO: 11022 - RNA, 2372 nt, Mus musculus
ugaaucuguguccgauucugugaguuagucuuaaguuccuaaugaggcuuuuauggcuccaaacacgguccuucacccucucuuuguucugguuccuguaacuggacuggggagccacucauucuuaaagacaggaugccuguugaaaccauccuuuggcaagaaaugcagagauucuuaggaaagugcuugguaaaaagcaaacauacaaaaaaaguacacacaucacagucucuaacggguuucuuuccaaagagcuuuuaaaaaaaaaucuugauucuauugccucucaaagcucucacugucgguguuagcugcccucagccucgguuuucaugacaaagugagaaggcugagcuguuugugcugggugcccaggcacuggccgugucucagguggccaguccacaguagccggcucggggacuccaccugucccagagggaaggaagagaccagacaggacugaauuugagacaagucuguuuucguucuggcucuagaggcggcagaggaacagaaagaggaagagagucuccuaugucuaaguagcagcucuccucccauacaauuauucaucaaauaguagaucuagagccccacagugagcuggccacaccacgagcacuuucaugugacccucucagagacucuguaagucucuuuuaugcccauugcacagacagggaccuugaaguacaaaggcgcagcaggucuuuuacccuggugucuccuaaccagacccugagacagacagggaugcuuccugacaccugcccuucuccuguuccuaaccauuguguagccaguaggagaccucaguucugggccaccaguccugggagggccuucucugaaccuuccuaagagcugccggcagccuuuggaucugagagagccugauuuccccacaaguggagcaaguccaugccugaugguccagaguaauggccagaguggggguuguuggagggcugagggaucuggcugcggauguucaucuucuggcucuaggcauccuaacacucaccagccaccagcaaacccugacaccccucucucaucagccucaaaagcccccaguggagaauaaguaccccagaaaccccucucuagucucgccucucuggagaacuuccaccagcacagggagacuucagacgcccuuccuuagguaguagaaaguggucguccaaugcuuugacucguguguggggugaagaccagcuagaaugcucagagggguaccuggaugcucgggaguuggauugcuagugaucgaccucugcugagucuugggcgcgcccuugcuccauuuccguggucuucggguucuucaucacugagggucugggauagacugaguuuccccgaggagcagcucccgacuuggcccacaguuuugggacagcuuugauucugcgcggcagagccucguagaucuugagaugccauuagccaggggcagcauggggugagccuagguguuccauggcuucgguucuugaggcagagcaggaaggccggugcgaugcuucugauagccuccuugcugaugaauccaaggcugugguccuccuccugcugggaucugacacugcagccggugguucuaaaccuggaggaaggguccucucucucccggacucuggucagaagcaccaaacgguuggguuuucgcugguauagcccuuccccucacaccgcucccccgcucucacaagaugggucgcuaccgagugagguugcaagguccuaaaggagaagagccagagaccaagucagggcucaggagcugcacgccucugggauaagaagagcccggaucucucccuguuuuguuucuugcgauuccagcagucgcuggcaacucucuuucucagguggaaacagucccgagcggauucugcagcagacgucggaggccgcaagcaucccgcguuggacggcgcggaagagauaggccaccugcguugugagucucagagccaggggugggcauccgcuuguacagaagagacgggcgaagccaggagcuugaggcccgcggagagaagugggucuaggccuaggccgguguucuccuguccagucguauuguucuuccuuagaggcaaaggaugggagaccaagaacccuaagaaugccucggagacacauggacgauuauguggggcaaugugaagaccgggucuagucaauucgggguugaaaaguaaggacaaagaaggccuacggguagaggagaacggacagaaggaaacaggcaucugugaacggagcaucguccucaaucggacuagagacaaucuuggugccacuguucacccagggaacucuggacucaguugccgacaguuucggcagccuga

SEQ ID NO: 11023 - RNA, 2198 nt, Mus musculus
auucaaacgccuuuggagggccaguucaagggaagccccaagccaaagagggcgagaucggcgagugaaaugaggccaaaaagagaaaagagaggccucuuggaggaggaaagagaacccuccagacucuuggagcucccgggaccggccccucaucgagauccucagcguugcgccggcacaaccucuggcgcaucggcgcuaucagcgucuauucagacggacaauacuggccucgccuccucuugauucgccuaugucuuugcuaaaucgcuuuuugagaaauuccuccaacauuugcauaauguguucccgcuuuccgcgaccccccacccccgccugcccgcucgcacgcucacacacuugcagacacacucucccgggcucacucagcaccccuccuuccugcugccgcccgccacccgacccggcccgguugaaucccggcucccgcuggccccaggauccccgacgcucacccacucgccugcuugcucaccuggucggugguggggccgcccuccgccggcaaccggcagcccucgggcagcgccggggcggcgcucucaugcuuccaguacaugggcccgggagcgggagggcucggugggcgcgcagugcgaagagaggcgcagaguggggccucgggcguccugggggcagaggcugcugggagagcuggagaaccgaggcuccggccccgccgccccgggcccagccccagcuccccgcccccggccugagcgcaguccuggccucccuggcugccagcaccacugccucugaagaaggucccgacaaacuuggagaggucccugcagcugcuucugcggcugccgccuccuccuccucuuccuccuccuccucuuccuccuccuguucucccuccucguuguccuccuccccuuccagcugcggcgacgaccgcccugccgcuggagccccgcuccguucaagaugagucaugcgugaccaauccccuccccgcuaagaagagcgagacacuccaaaggaggcagagacucagagacauacacacacagagagacacacugaaacuaggcgcuacagggagacucuuggaacaugcuaacauacaaagacacuggcggggcacauauccucacagcuccuucugccgccccucccucaagggcacccacugccgcccucacacaacguuaauaggugcgagaggaauccguggucagcccaucuacaaggcuggauuccacaugaagccacguucuguugauguagugcugagccugguauauuugugucgcaaauggucaccugcucacaccaauccuucagguccuagacuucgacacaccccucaaacuccugcaaaaauaucccugcuucaugacaaccggagcuugcaccagcuucuaaaggcugaacagggcugggggcaggggagccugugcuagugagagugggaggguaggucccuugguucuuuuggaaugaauuacuugggacauccacuuccacuucaagauuuaccuaaucauacuuucuacguacuauaggacucuaaggaugaugagaguuagggaaaggcaaagacccagacauuuagauagcaggcacaagccccaaacagagaacucucaaacucaaaggucugacacugacaaacacugacauuuauagccucagccuucuuccucaaacaccaacuaugccagagaaguguguaaaugugugucuucuucuaaaacacugugcacacucagacuuagaccuaguccugcauagagcuacccacccaccacacagaccaccccucccuaacugcccucauuuacagauguaaacagcacccccucaaaucacgcuuacacuuguacacacagccguacucaggagaggccaaguuccuauggagcuccaaacccuguauaaccucuguuaugaggcaucucuuacuaugcacugcauucuuauaggugaugagccaggcgccaggcucaaggggaagcaacacacaccuuugcaaagaacaucguucccaggugucagucucugucugcacaauuaggcauggccagaagcacacauggacaaugucuauacacgacugcaauacugaaaacccaccucccacuccuuagagauauauaucugcucuucaggcagacacaaccccagcuaauggcaucagcccuugcauugcaguccuuuauugc

SEQ ID NO: 11024 - RNA, 2198 nt, Mus musculus
gcaauaaaggacugcaaugcaagggcugaugccauuagcugggguugugucugccugaagagcagauauauaucucuaaggagugggagguggguuuucaguauugcagucguguauagacauuguccaugugugcuucuggccaugccuaauugugcagacagagacugacaccugggaacgauguucuuugcaaagguguguguugcuuccccuugagccuggcgccuggcucaucaccuauaagaaugcagugcauaguaagagaugccucauaacagagguuauacaggguuuggagcuccauaggaacuuggccucuccugaguacggcuguguguacaaguguaagcgugauuugagggggugcuguuuacaucuguaaaugagggcaguuagggagggguggucugugugguggguggguagcucuaugcaggacuaggucuaagucugagugugcacaguguuuuagaagaagacacacauuuacacacuucucuggcauaguugguguuugaggaagaaggcugaggcuauaaaugucaguguuugucagugucagaccuuugaguuugagaguucucuguuuggggcuugugccugcuaucuaaaugucugggucuuugccuuucccuaacucucaucauccuuagaguccuauaguacguagaaaguaugauuagguaaaucuugaaguggaaguggaugucccaaguaauucauuccaaaagaaccaagggaccuacccucccacucucacuagcacaggcuccccugcccccagcccuguucagccuuuagaagcuggugcaagcuccgguugucaugaagcagggauauuuuugcaggaguuugaggggugugucgaagucuaggaccugaaggauuggugugagcaggugaccauuugcgacacaaauauaccaggcucagcacuacaucaacagaacguggcuucauguggaauccagccuuguagaugggcugaccacggauuccucucgcaccuauuaacguugugugagggcggcagugggugcccuugagggaggggcggcagaaggagcugugaggauaugugccccgccagugucuuuguauguuagcauguuccaagagucucccuguagcgccuaguuucagugugucucucuguguguguaugucucugagucucugccuccuuuggagugucucgcucuucuuagcggggaggggauuggucacgcaugacucaucuugaacggagcggggcuccagcggcagggcggucgucgccgcagcuggaaggggaggaggacaacgaggagggagaacaggaggaggaagaggaggaggaggaagaggaggaggaggcggcagccgcagaagcagcugcagggaccucuccaaguuugucgggaccuucuucagaggcaguggugcuggcagccagggaggccaggacugcgcucaggccgggggcggggagcuggggcugggcccggggcggcggggccggagccucgguucuccagcucucccagcagccucugcccccaggacgcccgaggccccacucugcgccucucuucgcacugcgcgcccaccgagcccucccgcucccgggcccauguacuggaagcaugagagcgccgccccggcgcugcccgagggcugccgguugccggcggagggcggccccaccaccgaccaggugagcaagcaggcgagugggugagcgucggggauccuggggccagcgggagccgggauucaaccgggccgggucggguggcgggcggcagcaggaaggaggggugcugagugagcccgggagagugugucugcaagugugugagcgugcgagcgggcaggcggggguggggggucgcggaaagcgggaacacauuaugcaaauguuggaggaauuucucaaaaagcgauuuagcaaagacauaggcgaaucaagaggaggcgaggccaguauuguccgucugaauagacgcugauagcgccgaugcgccagagguugugccggcgcaacgcugaggaucucgaugaggggccggucccgggagcuccaagagucuggaggguucucuuuccuccuccaagaggccucucuuuucucuuuuuggccucauuucacucgccgaucucgcccucuuuggcuuggggcuucccuugaacuggcccuccaaaggcguuugaau

SEQ ID NO: 11025 - RNA, 1824 nt, Mus musculus
ugucuguauuucugcugagacuuacaaaccacugcauauaaaauauauauuuaauaaaauaaguugcuaguuuuaugagccagugugugugugagggaaagacauggcauuugugcuguaaacuuuauuugugaauguuagucuuaacucuggaguaagcgaucuugcccucaucauuacaggguuagcaugugaaacauguaaguaggugggagauaaacacguuuauguuagcugagcucagcacugugccugugacucuugaacuccgacuuuucagucccaaagucuggaauggugugguguggugugguguggugugguguggugugguguggugugugugugugugugugugugugugugugugugugagagagagagagagagagagagagagagagagagagagagagagagagaggaguuccaugaaaaaucgauguguauauuacuuggucauuuaaaauaaaauaucaaaaguuacccuaauuuuaacccuauuauccugacagcaguuuucuucccagcuguugcgacccccccucucccauacacuuugguaaacgacucaaguuccaagagaacuuucacuucuuuauuuauaaucacagaagugagguguuacuucacacacacacacacacacacacacacacaaagaaugaaauaaagaaaugaaacucgcuaggcagacaaaaacagucaaguuucugcuuagaaaacagccuucuccggugggaaagguuagacuagucugccagaucuaagagaaggacuugcucccgaauuugguaggucuuucucgaauaaguuuuauaauuauuaacagguauuugccaaguuuuaauugcuugauauaaugaauugaaagucggugugagaacaaagcaguagaaacucuccacuugaugaguuuuuuaccccagccauucaguucucaacaaaacuuuuccuagacuauguagcaaaaaacaccuuugguuaccugaauggacagguacagggcgaauuacugggggaaggggaaaaagggagaggaaaggaaagagagaguaagggaaggcaugagaaagcaaagaagccacucuugggaaaagaaagccugccaccaaagagcuaaaaccaccugaaauuccuguccagagacacccggcucacuucagacuaacauucccacucaaaaugagaaaauuagagagggaggguggggggcaagagcaccaaaaaaggauaaaaagaggaggaaaagaaggggggggugggaaaccuaccugugaagucuuguuuguaguuuuggccagaaauggugagaagaaaaagcaugaagaagccgcgaagugugggggagaaaaagguggaggcgaagaaacagcucccggagcaaacugaacaaaaccucgccaagagugucuggaggcaggaccguuauuccugccgagcagguuagaacugaucucuuuucggccacuccaggaaacacaaaccuggggacggacugacguguuacgccucuucuaaugacauuuuuuucuuuuucuuuucuguaggggagagaagagagacccugaaacacgcgccaccuaucuuuguggggagggauaauugaagcgcccugagcgugagcaucaugugaaaacgugaucgccaaguuucucucugggaaaggaucugggauagauuauaccuugaagucuccgcaaacgcuuuaguggaagaaaugaaauuccaccucccucccuuccucucucccucccucccuucuccacgccccccccccccccccccccccccgucaagcaagccuuuggcaucauuauccuc

SEQ ID NO: 11026 - RNA, 1824 nt, Mus musculus
gaggauaaugaugccaaaggcuugcuugacggggggggggggggggggggggggcguggagaagggagggagggagagaggaagggagggagguggaauuucauuucuuccacuaaagcguuugcggagacuucaagguauaaucuaucccagauccuuucccagagagaaacuuggcgaucacguuuucacaugaugcucacgcucagggcgcuucaauuaucccuccccacaaagauagguggcgcguguuucagggucucucuucucuccccuacagaaaagaaaaagaaaaaaaugucauuagaagaggcguaacacgucaguccguccccagguuuguguuuccuggaguggccgaaaagagaucaguucuaaccugcucggcaggaauaacgguccugccuccagacacucuuggcgagguuuuguucaguuugcuccgggagcuguuucuucgccuccaccuuuuucucccccacacuucgcggcuucuucaugcuuuuucuucucaccauuucuggccaaaacuacaaacaagacuucacagguagguuucccaccccccccuucuuuuccuccucuuuuuauccuuuuuuggugcucuugccccccacccucccucucuaauuuucucauuuugagugggaauguuagucugaagugagccgggugucucuggacaggaauuucaggugguuuuagcucuuugguggcaggcuuucuuuucccaagaguggcuucuuugcuuucucaugccuucccuuacucucucuuuccuuuccucucccuuuuuccccuucccccaguaauucgcccuguaccuguccauucagguaaccaaagguguuuuuugcuacauagucuaggaaaaguuuuguugagaacugaauggcugggguaaaaaacucaucaaguggagaguuucuacugcuuuguucucacaccgacuuucaauucauuauaucaagcaauuaaaacuuggcaaauaccuguuaauaauuauaaaacuuauucgagaaagaccuaccaaauucgggagcaaguccuucucuuagaucuggcagacuagucuaaccuuucccaccggagaaggcuguuuucuaagcagaaacuugacuguuuuugucugccuagcgaguuucauuucuuuauuucauucuuugugugugugugugugugugugugugugugaaguaacaccucacuucugugauuauaaauaaagaagugaaaguucucuuggaacuugagucguuuaccaaaguguaugggagagggggggucgcaacagcugggaagaaaacugcugucaggauaauaggguuaaaauuaggguaacuuuugauauuuuauuuuaaaugaccaaguaauauacacaucgauuuuucauggaacuccucucucucucucucucucucucucucucucucucucucucucucucucucacacacacacacacacacacacacacacacacacaccacaccacaccacaccacaccacaccacaccacaccacaccauuccagacuuugggacugaaaagucggaguucaagagucacaggcacagugcugagcucagcuaacauaaacguguuuaucucccaccuacuuacauguuucacaugcuaacccuguaaugaugagggcaagaucgcuuacuccagaguuaagacuaacauucacaaauaaaguuuacagcacaaaugccaugucuuucccucacacacacacuggcucauaaaacuagcaacuuauuuuauuaaauauauauuuuauaugcagugguuuguaagucucagcagaaauacagaca

SEQ ID NO: 11027 - RNA, 1647 nt, Mus musculus
ggaggcacaaggaggagaagcgcuggcuccagggugcugcucgguggguaucucgccgcuuuuccacaucuucuugaacuuggaucggcgguucuggaaccagauuuugaccuuuguagaaaaaaaggaaaagcccugagcuuuaguacaggaaccugggcaggagguugguggaguggagacggcgggcgagcagaccugggcucugggccuccgcugcuucuagcuacauuggggggaucucaaaaugcugauggaugagcucuaaguaugugaccaagguucuggguagugcggugucaggucaguuauggaacccgcuuuagcagcagcgaguggaaaggcguuguagugugggauuucuguccacccgggucauuuucuuuccucccaugcggcugcccccuuugaaaaaaauuucuuauuuuguuuguuuguuuguuuuaagcauugggccuagaaguuuacuuugcccggaauaaaaaagcacaggugaaaauauacuuuugaaaaguuguuccggacgugcccgcuuccuagagaaagcaggccaucucccaccuugcucaccugaguuugggugaggcccagggacgccgccagcucggcucgcucuggcagggccagauacugggucuucuggaagcgucguugaagggccgccagcuggaaacuggaguagauggugcgugguuuccggacuuucuuuggcuucccguucacuauucggauuucaggcucaaggucuuccuugucugcaacgaaaagugaguggugagcacccaccguccaaccccgcgguccuaaaguucggagcggaggccuuuagagacuugaggaggccuucccaacuucagcacgcgccgacuggccuggccacggaacccugcaagggacccgggggagcugugcaagagagaaagaagaggcgggcagcaaagcuaugcgcuacccacagcaugccaacuggcccaaccgcccaccgacucugucccccggagcguggagaggcagaaacugcgauucgcgugcaguuggagauugggcagaguucagggcgggagcaagagaugcacagagugcaaggcuagagcuccggacugccccccaccccaugcuuacccggucccuccccgugacuugggcacccuagaugcuugcgaugcuuacccggcucguuguugaccggagacgaacuggugccguagggcgcguaggagguguacgcggcgguguagcccaggucguagcugcuuuuggcggaguaggagacauuguugaggccgcuggcgugguacugguaggagcccaugugcgcguagggcgaggcccccccgccgccgccgcccgccgggugcugcugguugguguaguagcugcuguccguagccguggacaccgggaggguuggcgacuccuggggcuugugcaggcugcuguugcugcugcugcuguugcuguugccgccagggccggcgcccgcaccgcucgggggcugcuggugcuggugguacgugcuggaggcggugaucugggucgagugcauaucagccaccagacugucaaagacuccagucauccugacccgggacaggaaagagcacggguggcgggcgagagggggaugcgaggcgccuccucugucua

SEQ ID NO: 11028 - RNA, 1647 nt, Mus musculus
uagacagaggaggcgccucgcaucccccucucgcccgccacccgugcucuuuccugucccgggucaggaugacuggagucuuugacagucugguggcugauaugcacucgacccagaucaccgccuccagcacguaccaccagcaccagcagcccccgagcggugcgggcgccggcccuggcggcaacagcaacagcagcagcagcaacagcagccugcacaagccccaggagucgccaacccucccgguguccacggcuacggacagcagcuacuacaccaaccagcagcacccggcgggcggcggcggcgggggggccucgcccuacgcgcacaugggcuccuaccaguaccacgccagcggccucaacaaugucuccuacuccgccaaaagcagcuacgaccugggcuacaccgccgcguacaccuccuacgcgcccuacggcaccaguucgucuccggucaacaacgagccggguaagcaucgcaagcaucuagggugcccaagucacggggagggaccggguaagcaugggguggggggcaguccggagcucuagccuugcacucugugcaucucuugcucccgcccugaacucugcccaaucuccaacugcacgcgaaucgcaguuucugccucuccacgcuccgggggacagagucggugggcgguugggccaguuggcaugcuguggguagcgcauagcuuugcugcccgccucuucuuucucucuugcacagcucccccgggucccuugcaggguuccguggccaggccagucggcgcgugcugaaguugggaaggccuccucaagucucuaaaggccuccgcuccgaacuuuaggaccgcgggguuggacggugggugcucaccacucacuuuucguugcagacaaggaagaccuugagccugaaauccgaauagugaacgggaagccaaagaaaguccggaaaccacgcaccaucuacuccaguuuccagcuggcggcccuucaacgacgcuuccagaagacccaguaucuggcccugccagagcgagccgagcuggcggcgucccugggccucacccaaacucaggugagcaaggugggagauggccugcuuucucuaggaagcgggcacguccggaacaacuuuucaaaaguauauuuucaccugugcuuuuuuauuccgggcaaaguaaacuucuaggcccaaugcuuaaaacaaacaaacaaacaaaauaagaaauuuuuuucaaagggggcagccgcaugggaggaaagaaaaugacccggguggacagaaaucccacacuacaacgccuuuccacucgcugcugcuaaagcggguuccauaacugaccugacaccgcacuacccagaaccuuggucacauacuuagagcucauccaucagcauuuugagauccccccaauguagcuagaagcagcggaggcccagagcccaggucugcucgcccgccgucuccacuccaccaaccuccugcccagguuccuguacuaaagcucagggcuuuuccuuuuuuucuacaaaggucaaaaucugguuccagaaccgccgauccaaguucaagaagauguggaaaagcggcgagauacccaccgagcagcacccuggagccagcgcuucuccuccuugugccucc

SEQ ID NO: 11029 - RNA, 581 nt, Mus musculus
accaccggccuuuucucuuaagucggcugggugcgcaaagagcacaggacccgaaccgcagcggucuggggaaaggaaggaaaccagaacagagcugccuaacggggcauagcgcugaagcccaggccucugggcugaauccuggguaaaggaacacugaggaaggaggaaggcugcugccuuugguucugggauuuggauuuggggagagacuaaggccugguaagcuggaggugggagccuaggccucuuuuggacuccaggccugagaggauugccgcagcccaaugagugaggcuuuggagcaaguggcugggggccuggaaagucuaccucggagucagguggugcagauagacuccaacaggcaggcagacgcuauugagggccccuggagaaccaaccgaucucccugggagaugcuaugaccaucaaauucaagggcuccagaggagucuuggggauaugccacgagauugcucagggcuuaguggggcuccaacacagugaaagcuccaagagacuugaacacagaagacgaugagaggaaggccaaagcacaagggguuugucugugggcg

SEQ ID NO: 11030 - RNA, 581 nt, Mus musculus
cgcccacagacaaaccccuugugcuuuggccuuccucucaucgucuucuguguucaagucucuuggagcuuucacuguguuggagccccacuaagcccugagcaaucucguggcauauccccaagacuccucuggagcccuugaauuugauggucauagcaucucccagggagaucgguugguucuccaggggcccucaauagcgucugccugccuguuggagucuaucugcaccaccugacuccgagguagacuuuccaggcccccagccacuugcuccaaagccucacucauugggcugcggcaauccucucaggccuggaguccaaaagaggccuaggcucccaccuccagcuuaccaggccuuagucucuccccaaauccaaaucccagaaccaaaggcagcagccuuccuccuuccucaguguuccuuuacccaggauucagcccagaggccugggcuucagcgcuaugccccguuaggcagcucuguucugguuuccuuccuuuccccagaccgcugcgguucggguccugugcucuuugcgcacccagccgacuuaagagaaaaggccgguggu

SEQ ID NO: 11031 - RNA, 281 nt, Mus musculus
cuuuauaagcauucgaggggguuuauacauccuauaagauuucccgggucguuguaaagcguguuuaugauaggaaaccaauuuaggugggcuuaagguagacuucgaagaggacauuaaucgccguagagagcuuucccucuauuuggguggggggggggugggugaguugaggaccuuagaggagggaaguacauuugcagccaguugaugagugggaacacgagagccuccugccuuucagggagaggguaagugaucugccgcacuggacuuaaccc

SEQ ID NO: 11032 - RNA, 281 nt, Mus musculus
ggguuaaguccagugcggcagaucacuuacccucucccugaaaggcaggaggcucucguguucccacucaucaacuggcugcaaauguacuucccuccucuaagguccucaacucacccaccccccccccacccaaauagagggaaagcucucuacggcgauuaauguccucuucgaagucuaccuuaagcccaccuaaauugguuuccuaucauaaacacgcuuuacaacgacccgggaaaucuuauaggauguauaaacccccucgaaugcuuauaaag

SEQ ID NO: 11033 - RNA, 1019 nt, Mus musculus
caaguucagucucugggccugaaauccaaggccagcccauuccugggcgaaugugggagaagggaacacagaugucuuuuccgacugggagcugguucacggucacaguuuccggguccguuuuacuuucuugauugccgggaacgggacccggaaggccgaaggacggcucccacacacaggcagggccucugguccagggcaagucuuuggaaaucaagguuaaagcucccugcugcuguccuaaggccccgggcuuccgcaaggcggcucgccgccugcaaccaaagaagaagggaggaaguuguucaaguuucucauaaaauucugaguuuccacggugguuguggcagugguuguucuuuaaugagcuggaccacaaccccagaccauauccucuuuauaaaacuuucccucaccagaggaaacggaagacuuagacucucccucuuuauucccuucuugcccaaacaaaaccuugucaaagaauuuuagggaucguccaaaacuauaaaauuuaacuucugacaaaaguauagcuuuuaauauuugacgauuuguguuaaaacaaaaauugaccuucuugguuaguagcggaggggaaaaaucaauaguauaauuuucaauaauucauaaagcaaacgccauuaugcuaaaucuuaacuauuaaucuuauccuuuacaaagucucgauugauuuguuaauaaaauaucuucccguuuguggcaacagcggguauaacucuuuaaaaaccuucagaagcaagaaaauuaccaaguagcccaagaauguagaugagaauuuuauugaucgcccugauucuucuuaauauguauuaauaaauuccacaaccccuuguaccuugcacuugucagaaaccaaugcuuuuacaaaauccauaaaaggaaaacauauuuuucuuugcagaagaucuaaaugacaaguuugcuuugcucucuccucuuuuuauuuuuauuuuuucuucuggcccgguuuucuaaaacuuguggaguccggg

SEQ ID NO: 11034 - RNA, 1019 nt, Mus musculus
cccggacuccacaaguuuuagaaaaccgggccagaagaaaaaauaaaaauaaaaagaggagagagcaaagcaaacuugucauuuagaucuucugcaaagaaaaauauguuuuccuuuuauggauuuuguaaaagcauugguuucugacaagugcaagguacaagggguuguggaauuuauuaauacauauuaagaagaaucagggcgaucaauaaaauucucaucuacauucuugggcuacuugguaauuuucuugcuucugaagguuuuuaaagaguuauacccgcuguugccacaaacgggaagauauuuuauuaacaaaucaaucgagacuuuguaaaggauaagauuaauaguuaagauuuagcauaauggcguuugcuuuaugaauuauugaaaauuauacuauugauuuuuccccuccgcuacuaaccaagaaggucaauuuuuguuuuaacacaaaucgucaaauauuaaaagcuauacuuuugucagaaguuaaauuuuauaguuuuggacgaucccuaaaauucuuugacaagguuuuguuugggcaagaagggaauaaagagggagagucuaagucuuccguuuccucuggugagggaaaguuuuauaaagaggauauggucugggguugugguccagcucauuaaagaacaaccacugccacaaccaccguggaaacucagaauuuuaugagaaacuugaacaacuuccucccuucuucuuugguugcaggcggcgagccgccuugcggaagcccggggccuuaggacagcagcagggagcuuuaaccuugauuuccaaagacuugcccuggaccagaggcccugccugugugugggagccguccuucggccuuccgggucccguucccggcaaucaagaaaguaaaacggacccggaaacugugaccgugaaccagcucccagucggaaaagacaucuguguucccuucucccacauucgcccaggaaugggcuggccuuggauuucaggcccagagacugaacuug

SEQ ID NO: 11035 - RNA, 1648 nt, Mus musculus
ggcagaggcauccacaauuacaccgggaauguuuuccuagcgaugucagccuacaaaggacacaaucucucuucuucaaauuccuccccaaaauguccuuucccaacagcucuccugcugcuaauacuuuuuuaguagauuccuugaucagugccugcaggagugacaguuuuuauucgagcagcgccagcauguacaugccaccaccuagcgcagacauggggaccuauggaaugcaaaccuguggacugcucccgucuuuggccaaaagagaagugaaccaccaaaauauggguaugaauguacauccuuauauaccucaaguagacaguuggacagacccgaacagaucuugucgaauagagcaaccuguuacacagcaaguccccacuugcucauucaccgccaacauuaaagaagaauccaauugcugcauguauucugauaagcgcaacaaacucauuucugccgaggucccuucguaccagaggcugguccccgagucuuguccuguugagaaccccgagguuccugucccuggauauuuuagacugagucagaccuacgccaccgggaaaacccaagaguacaauaacagccccgaaggcagcuccacugucaugcuccagcucaacccucguggcgcggccaagccgcagcucucggcugcccagcugcagauggaaaagaagaugaacgaaagcgcgagcggccaggagcccacuaaagucucccaaguggagagccccgaggccaaaggcggccuuccagaagacaggagcugccuggcugagguuuccguguccagucccgaagugcaggagaaggaaagcaaaggucgguaugaacagaguugccaccccagcggggcgugcaguccgguaaaaccucgaaaagggagcgcucgggugcccagagcagagcccgggcagcggagcccagagcccauacuccgcaggugcugcuccacccggcuuuuagaagggauaucccugccuugaaagggucggggcuucucucccgcugcuccggccagaccuggccccaagcugauggcgccugggcagaggacaggcuugccggguuuaucagucuugagccagauccgaaauacaacaaaagagcuaaaaggagaccagccguuuguaaacagggcuccagugcccgcuuuucuuuggcucagauuugcagcccuaguuuuugccuugaacccagggaucauuuuaagguagccuaagacaccguguuuguguucaaggguuugcaccccgcauccugcgaucuaagagggaaaggaaaugguuuggccuguuggugcuuggguggggaagcagagguaaccuuggcuuugucuggcgaaagugccgcaggcuuugcaaucuucuacaaagggggcaaaggcggaggagggggagaacagaucugcauugcccaccuagggcugggguaaugcaaagaaccagggauauggguuucuaagaaggaaucuugagcccccacgcccauuucugcagucugucccucacugucuaccgggugagccacagaguuacauuucuggaggaaggcuuuugugugagagcaaagaaaaauugaggaaauucuggggggaaggggggaacuguaacaaugcccagucaggguggag

SEQ ID NO: 11036 - RNA, 1648 nt, Mus musculus
cuccacccugacugggcauuguuacaguuccccccuuccccccagaauuuccucaauuuuucuuugcucucacacaaaagccuuccuccagaaauguaacucuguggcucacccgguagacagugagggacagacugcagaaaugggcgugggggcucaagauuccuucuuagaaacccauaucccugguucuuugcauuaccccagcccuaggugggcaaugcagaucuguucucccccuccuccgccuuugcccccuuuguagaagauugcaaagccugcggcacuuucgccagacaaagccaagguuaccucugcuuccccacccaagcaccaacaggccaaaccauuuccuuucccucuuagaucgcaggaugcggggugcaaacccuugaacacaaacacggugucuuaggcuaccuuaaaaugaucccuggguucaaggcaaaaacuagggcugcaaaucugagccaaagaaaagcgggcacuggagcccuguuuacaaacggcuggucuccuuuuagcucuuuuguuguauuucggaucuggcucaagacugauaaacccggcaagccuguccucugcccaggcgccaucagcuuggggccaggucuggccggagcagcgggagagaagccccgacccuuucaaggcagggauaucccuucuaaaagccggguggagcagcaccugcggaguaugggcucugggcuccgcugcccgggcucugcucugggcacccgagcgcucccuuuucgagguuuuaccggacugcacgccccgcugggguggcaacucuguucauaccgaccuuugcuuuccuucuccugcacuucgggacuggacacggaaaccucagccaggcagcuccugucuucuggaaggccgccuuuggccucggggcucuccacuugggagacuuuagugggcuccuggccgcucgcgcuuucguucaucuucuuuuccaucugcagcugggcagccgagagcugcggcuuggccgcgccacgaggguugagcuggagcaugacaguggagcugccuucggggcuguuauuguacucuuggguuuucccgguggcguaggucugacucagucuaaaauauccagggacaggaaccucgggguucucaacaggacaagacucggggaccagccucugguacgaagggaccucggcagaaaugaguuuguugcgcuuaucagaauacaugcagcaauuggauucuucuuuaauguuggcggugaaugagcaaguggggacuugcuguguaacagguugcucuauucgacaagaucuguucgggucuguccaacugucuacuugagguauauaaggauguacauucauacccauauuuuggugguucacuucucuuuuggccaaagacgggagcaguccacagguuugcauuccauagguccccaugucugcgcuaggugguggcauguacaugcuggcgcugcucgaauaaaaacugucacuccugcaggcacugaucaaggaaucuacuaaaaaaguauuagcagcaggagagcuguugggaaaggacauuuuggggaggaauuugaagaagagagauuguguccuuuguaggcugacaucgcuaggaaaacauucccgguguaauuguggaugccucugcc

SEQ ID NO: 11037 - RNA, 1797 nt, Mus musculus
guuuuuaacccaucuucaaagaauuucacaaaacaggauccccccccccccaacacaggcccuuuuccucccaaagaacggugcauucagcgucucugagcugccucgccccauccagacagucuuugggaugcucgguacugauuuuuuuaaaccuccucucccagaccccaaauccucucaaauuccaagacagaucccuuuagggacguauuuuucugaggcuagcagagagagagagagagagagagagagagagagagagagagagagaagugucugauuccauucuagcuugagaggacuggaauaaauuugccccugacuuaccuuggaugggcaaaagaaguagagugauuuuaaccucugcguuucucccagcgauguggggagcgccauuaguugcugauggggggaaaccugugcuacaggaaagggcaggcccccugaaacaaaaucagaaagccauucgccaaggcaaucaaucagguccuaaguagccauuuacccccuuucuuggcggggcuagagguggguugggagcccuccaagggugcucugggcaacuuguagagcgaggaauauguccucucagccgccgcuggcgugcggcuuuugucucggcucccaggcaggcuuuguaccauggauuugggagugacaaugggcauuucucucagauucaaggcugcccggccuuaccucucaaggggaaaacuggaaaggggguggaucaaggaccuguucuuucgucuggauuuugaagacaucuucagaauccguuugcaggcacgugugaaaggcacgcagcgaaccuacccucggagaugcgguuccugcaggccucucugaggcugggcuaauuccggcuagugagaaccggucucacuggccuuuagguuuuccccucuguggcauguuuucuugcagggccauuccagaaggcuggggaaagaugaggcaccauggccaucacugucggcuccuugggacuccagugcucaccacccaugcgagggcagagagacagcccuuggaggccgccccuuggaagccaugcugagcuggaccaggcccgagaguccaguugacccagcucacccccugggccucggggcgugugccuagcuuuuugucgaggguuuacauguggcugccccgggagugugagcgcgguagagggaggggcacuccgagcugcuccauccguccguuuuauuagggacacauuaaucuauaaucaaauacaccucauaaaauuuuuauugaaaggcauaauaucauuacagaggucuuccaccuguuuuaaacaacacgccaagcugugugaguguguguguguguguguguguguguguguguguguguguguguagggauggguuuagguaagaaaagaggcgaggggagaacgacucccuuugggcgacagggguccgcccuuaaaggccagccugccuggggcagcccgggcccaggagccuccaacugcuccggggcuuuggauaaucgccuaggugugacuuagaagcccggcccagggcucagagcccaggagucggagagccagaguccggguggagaucgcaggacccagagaggcaagaagagaugaacaaauaguccccagcgccuccugcggccgcaguuaggccuguggccgccgccgccaccagggcgggcugagccgggccaggccgggcuggugcguggaccugggcccggcagcucuaauugcaacgcuccuguugaugaugauuuuuuuuuuuuuaaaucacagcagcccccaguuuagcg

SEQ ID NO: 11038 - RNA, 1797 nt, Mus musculus
cgcuaaacugggggcugcugugauuuaaaaaaaaaaaaaucaucaucaacaggagcguugcaauuagagcugccgggcccagguccacgcaccagcccggccuggcccggcucagcccgcccugguggcggcggcggccacaggccuaacugcggccgcaggaggcgcuggggacuauuuguucaucucuucuugccucucuggguccugcgaucuccacccggacucuggcucuccgacuccugggcucugagcccugggccgggcuucuaagucacaccuaggcgauuauccaaagccccggagcaguuggaggcuccugggcccgggcugccccaggcaggcuggccuuuaagggcggaccccugucgcccaaagggagucguucuccccucgccucuuuucuuaccuaaacccaucccuacacacacacacacacacacacacacacacacacacacacacacucacacagcuuggcguguuguuuaaaacagguggaagaccucuguaaugauauuaugccuuucaauaaaaauuuuaugagguguauuugauuauagauuaaugugucccuaauaaaacggacggauggagcagcucggagugccccucccucuaccgcgcucacacucccggggcagccacauguaaacccucgacaaaaagcuaggcacacgccccgaggcccagggggugagcugggucaacuggacucucgggccugguccagcucagcauggcuuccaaggggcggccuccaagggcugucucucugcccucgcauggguggugagcacuggagucccaaggagccgacagugauggccauggugccucaucuuuccccagccuucuggaauggcccugcaagaaaacaugccacagaggggaaaaccuaaaggccagugagaccgguucucacuagccggaauuagcccagccucagagaggccugcaggaaccgcaucuccgaggguagguucgcugcgugccuuucacacgugccugcaaacggauucugaagaugucuucaaaauccagacgaaagaacagguccuugauccacccccuuuccaguuuuccccuugagagguaaggccgggcagccuugaaucugagagaaaugcccauugucacucccaaauccaugguacaaagccugccugggagccgagacaaaagccgcacgccagcggcggcugagaggacauauuccucgcucuacaaguugcccagagcacccuuggagggcucccaacccaccucuagccccgccaagaaaggggguaaauggcuacuuaggaccugauugauugccuuggcgaauggcuuucugauuuuguuucagggggccugcccuuuccuguagcacagguuuccccccaucagcaacuaauggcgcuccccacaucgcugggagaaacgcagagguuaaaaucacucuacuucuuuugcccauccaagguaagucaggggcaaauuuauuccaguccucucaagcuagaauggaaucagacacuucucucucucucucucucucucucucucucucucucucucucucugcuagccucagaaaaauacgucccuaaagggaucugucuuggaauuugagaggauuuggggucugggagaggagguuuaaaaaaaucaguaccgagcaucccaaagacugucuggauggggcgaggcagcucagagacgcugaaugcaccguucuuugggaggaaaagggccuguguuggggggggggggauccuguuuugugaaauucuuugaagauggguuaaaaac

SEQ ID NO: 11039 - RNA, 75 nt, Mus musculus
cagcgacucggacuuucuucuuuuuuuagguagaagugacugugugguuggucucugugaguuaucugggggaca

SEQ ID NO: 11040 - RNA, 75 nt, Mus musculus
ugucccccagauaacucacagagaccaaccacacagucacuucuaccuaaaaaaagaagaaaguccgagucgcug

SEQ ID NO: 11041 - RNA, 790 nt, Mus musculus
aaccuuuaauaucccaaugauuugauaaggguguaaagaaacaggaacccugauaaguaaguuacugauagaaauacaagaugagucuuuguuuuguuugagacagaauguuucucaauugcccagacugcgccuuguauuccuucauuuuaaaauaauuuauuuuauuuuuuuuuguauacgauaguuugcaugaagauaugcgcaccauauauuuggugucuaaggacuucagaagacggaaucaaaucuccucaaacuggagcuacaaauagucguuagcugccacguggguacugggaaucaaacccagguccucugaaagagcagaggccagugcucuccaccauugaaccaucuuuccagccucuggacucuucaucuuccuuccucuugagugcuggaauuacacgcacauacagacgaaucuaucucgcuuugcuuuuaaaaugagaaacuuaacaaaaugcauuuaaaggugucagcacauacguacuuugacuuaauuucacuucaagauuuuuuuuuuuuuggaaacaggauuucucuauguagcucuggcuguccuggaacucguucuauagacuaagcuggucuucaacacauagagaucuuucugccucugcuuccugaaugcuggcauuaaaggcaugagucacugcugccuagcuucaaggaauuucuuaauggguaaacauuuguauauacauauuuauuagcaaaaguuugaaacaguugaagaaccaucaucaggaaccaguaaaaucaauuuggaaaguguacauaguac

SEQ ID NO: 11042 - RNA, 790 nt, Mus musculus
guacuauguacacuuuccaaauugauuuuacugguuccugaugaugguucuucaacuguuucaaacuuuugcuaauaaauauguauauacaaauguuuacccauuaagaaauuccuugaagcuaggcagcagugacucaugccuuuaaugccagcauucaggaagcagaggcagaaagaucucuauguguugaagaccagcuuagucuauagaacgaguuccaggacagccagagcuacauagagaaauccuguuuccaaaaaaaaaaaaaucuugaagugaaauuaagucaaaguacguaugugcugacaccuuuaaaugcauuuuguuaaguuucucauuuuaaaagcaaagcgagauagauucgucuguaugugcguguaauuccagcacucaagaggaaggaagaugaagaguccagaggcuggaaagaugguucaaugguggagagcacuggccucugcucuuucagaggaccuggguuugauucccaguacccacguggcagcuaacgacuauuuguagcuccaguuugaggagauuugauuccgucuucugaaguccuuagacaccaaauauauggugcgcauaucuucaugcaaacuaucguauacaaaaaaaaauaaaauaaauuauuuuaaaaugaaggaauacaaggcgcagucugggcaauugagaaacauucugucucaaacaaaacaaagacucaucuuguauuucuaucaguaacuuacuuaucaggguuccuguuucuuuacacccuuaucaaaucauugggauauuaaagguu

SEQ ID NO: 11043 - RNA, 1002 nt, Mus musculus
gcccggcguccucaccgagcaggauagccggcugggaccgaagccgacccgcccgccaccagccaggugagggcagcccggaggaggcgggggcgcaggcuucucuucuaugcgagcgggggcggcgggaggcacgagggacccggucccuuuuccuggaaaggaggaccugggcgcuuuuucaugaaagaggcucaggggcuuuuacuucagagggagggguggagggcagggauaauggaaaaggggcuugcggggaccccuuaauggggcauuuuuccccacgagaagggacuuauugacugcuucuguaaaaguggggcucacauucuuggaaggaugcggacuuucaaggaagauacagggggguucuggcacgguuugaaagcaguguuaacugggauaugggaacaaggcgcuaggggcuuggagaugcccuuagucugacaucgcugcaccuucuccauugguucuauggcucugggucuauccagcucugucccaguuuuccucuuugaagaugacuauuuuugagcuucaccuggacagagcuuugugcagccauuuccuuuccuggagcucugagacccaccugacgccuuaccauccuccucugaccugcuggggaaugggauuguuagaggaaaggauccaggguucaggggcaugugcaguggaguacggaagguaggaaggguauuggacacacaagaaccuuuggcacugguggguucaucugacuuagaggggagguggcaaaggauaaggugggcaggagcuucgagcgaagaccugccaggaaagcugccgggcagagggagagcucccaccucucagcaaacaaaugacagaggcugugcuugccuuuguuugcuuccuccuucgcucccuugucucuucugguuuugcaaaaggggucacugaggcgggaaacacauugaccuuuguguaagagggagagcugguagagaagcgcacugauuugaaauggaaaaaaagaac

SEQ ID NO: 11044 - RNA, 1002 nt, Mus musculus
guucuuuuuuuccauuucaaaucagugcgcuucucuaccagcucucccucuuacacaaaggucaauguguuucccgccucagugaccccuuuugcaaaaccagaagagacaagggagcgaaggaggaagcaaacaaaggcaagcacagccucugucauuuguuugcugagaggugggagcucucccucugcccggcagcuuuccuggcaggucuucgcucgaagcuccugcccaccuuauccuuugccaccuccccucuaagucagaugaacccaccagugccaaagguucuuguguguccaauacccuuccuaccuuccguacuccacugcacaugccccugaacccuggauccuuuccucuaacaaucccauuccccagcaggucagaggaggaugguaaggcgucaggugggucucagagcuccaggaaaggaaauggcugcacaaagcucuguccaggugaagcucaaaaauagucaucuucaaagaggaaaacugggacagagcuggauagacccagagccauagaaccaauggagaaggugcagcgaugucagacuaagggcaucuccaagccccuagcgccuuguucccauaucccaguuaacacugcuuucaaaccgugccagaaccccccuguaucuuccuugaaaguccgcauccuuccaagaaugugagccccacuuuuacagaagcagucaauaagucccuucucguggggaaaaaugccccauuaagggguccccgcaagccccuuuuccauuaucccugcccuccaccccucccucugaaguaaaagccccugagccucuuucaugaaaaagcgcccagguccuccuuuccaggaaaagggaccgggucccucgugccucccgccgcccccgcucgcauagaagagaagccugcgcccccgccuccuccgggcugcccucaccuggcugguggcgggcgggucggcuucggucccagccggcuauccugcucggugaggacgccgggc

SEQ ID NO: 11045 - RNA, 1098 nt, Mus musculus
cuugagccccgacggaaaacaccccuguucucuccuguuucccuucccccucuccaggaguacccucucuuuuacucauccggggagauacaucucccagcccuccacccucccagcucuuagaggaaguguuaggcacaaugauuuggcccaauauccagcaccccucucucuuccccuaaaguacagaggcuucucuccgccucaggaacaguccugggggccauagcuuuccugaagugaucacuuaauaaucgaaaaucuaccccacgggcgcccagagcacccuuucccgacuuguccccagcagggguaggggcucgagaacccgcggaagcacauugcccacgcccagagacuacaggaacugcgugccuggggguugaugggagggcggggcaucggagaaccuuggcccuuucgaccaggacccagacgugauggagccgggagaugggcccaaggguaagccccgagauugucuuugagauagaccugagcccacagcuugggaacucggugccuauuuugacugacaggacuagacagggccucuccagggguugcggguugaagagugaagaacaauuuuacccuccugacccaggccucgacugggcuccccguuuggaggcucuaccccugcccucaaugcguagggcacaucaaacugagcucggugacccucacggcucgacgacuaucgcagaggcuucucgacagaagucagcccacugcugggacugcacgcucuccauucuugacgaugcaguuaggaccaggugccuggggccacuaagauaaugguuccaaagucaggguuucuucgcagcccaaauuuugcuccuuucucaacccuuuccccacccacagaccgggcgcuugccggugguucccgccaugggaacuggucauucgcugauaguccagcauuugcucccgcacacaaauucgcgguuacggccacccaagcucuauggccagacacgcacacacaugcacacgcacguguccacauggcgcugguaugcucacacguucaaaggcgcaccgguauccaggcguggcggggcgcacacuggcacaugcaaacagcua

SEQ ID NO: 11046 - RNA, 1098 nt, Mus musculus
uagcuguuugcaugugccagugugcgccccgccacgccuggauaccggugcgccuuugaacgugugagcauaccagcgccauguggacacgugcgugugcaugugugugcgugucuggccauagagcuuggguggccguaaccgcgaauuugugugcgggagcaaaugcuggacuaucagcgaaugaccaguucccauggcgggaaccaccggcaagcgcccggucuguggguggggaaaggguugagaaaggagcaaaauuugggcugcgaagaaacccugacuuuggaaccauuaucuuaguggccccaggcaccugguccuaacugcaucgucaagaauggagagcgugcagucccagcagugggcugacuucugucgagaagccucugcgauagucgucgagccgugagggucaccgagcucaguuugaugugcccuacgcauugagggcagggguagagccuccaaacggggagcccagucgaggccugggucaggaggguaaaauuguucuucacucuucaacccgcaaccccuggagaggcccugucuaguccugucagucaaaauaggcaccgaguucccaagcugugggcucaggucuaucucaaagacaaucucggggcuuacccuugggcccaucucccggcuccaucacgucuggguccuggucgaaagggccaagguucuccgaugccccgcccucccaucaacccccaggcacgcaguuccuguagucucugggcgugggcaaugugcuuccgcggguucucgagccccuaccccugcuggggacaagucgggaaagggugcucugggcgcccgugggguagauuuucgauuauuaagugaucacuucaggaaagcuauggcccccaggacuguuccugaggcggagagaagccucuguacuuuaggggaagagagaggggugcuggauauugggccaaaucauugugccuaacacuuccucuaagagcugggaggguggagggcugggagauguaucuccccggaugaguaaaagagaggguacuccuggagagggggaagggaaacaggagagaacagggguguuuuccgucggggcucaag

SEQ ID NO: 11047 - RNA, 533 nt, Mus musculus
gcggccguacuuggccuugcagugcaaaauguguuuggcgaggaagucaaggcggcgcuguagcagcugagcgugggguucugagagcuccgccagcucugggaaacgcgguucguggcgacuguagaggcgcagcaaccgggccgccgcguccugaccccggugcagcuccaagacgcgccuagcaguccgcucucggaauacacacaccgacuguagcagcgguucguuauacuugucccacaugccggcuacccgguagccgugcaccaagcccgccucauuguccagaaagaccaacgccccuccugguccucggugcagguugcucguagcgcggugcauaacgcgugggucccacuguaagcugaagagguugcucacaagccggucaaaguuggccgucagguaaucgaagaggaucagaucgguccauuguaccaaguccaccagcuccgccuggcugagguuggucagcucgcccccggcgucgcgcaggggccgcagacggccguccucugaucgccagggcu

SEQ ID NO: 11048 - RNA, 533 nt, Mus musculus
agcccuggcgaucagaggacggccgucugcggccccugcgcgacgccgggggcgagcugaccaaccucagccaggcggagcugguggacuugguacaauggaccgaucugauccucuucgauuaccugacggccaacuuugaccggcuugugagcaaccucuucagcuuacagugggacccacgcguuaugcaccgcgcuacgagcaaccugcaccgaggaccaggaggggcguuggucuuucuggacaaugaggcgggcuuggugcacggcuaccggguagccggcaugugggacaaguauaacgaaccgcugcuacagucgguguguguauuccgagagcggacugcuaggcgcgucuuggagcugcaccggggucaggacgcggcggcccgguugcugcgccucuacagucgccacgaaccgcguuucccagagcuggcggagcucucagaaccccacgcucagcugcuacagcgccgccuugacuuccucgccaaacacauuuugcacugcaaggccaaguacggccgc

SEQ ID NO: 11049 - RNA, 569 nt, Mus musculus
aaacucccaauaaaguguguugguuaauaucaaaacuacaugcuaagccagguuugugguacacauuuuuaauucuaccauuugacagcuagaggcauguggaucugaaauucaaagcuauccuuaccuacaucgauagucgaaggccagccuguacuacauaugacccuaucucaaacaaaggaaaagagaaaaaaaaauguuaauaucauuucaaaagauuuuuuaaucuuguuuuuuaaaccuagggaagaaaaagccgggaagagucagugcuggagaucccucuucauagagaccuacucagacguggggagguacaucgaccauuacgccgccauuaaaaaggccuggcgugaccucaagaaguacuuggagcccagguguccucggaugguuuuaucucugaaagguacuggcacacagagucccccguccacauuuuaguuagucaagaaggaguaguuuaaauaacuucagaucuccuguguaucugacugacccaaccucuuccaggucaccauucacacuuuacuagccaagcaaguguaaugcugauauuguuagag

SEQ ID NO: 11050 - RNA, 569 nt, Mus musculus
cucuaacaauaucagcauuacacuugcuuggcuaguaaagugugaauggugaccuggaagagguugggucagucagauacacaggagaucugaaguuauuuaaacuacuccuucuugacuaacuaaaauguggacgggggacucugugugccaguaccuuucagagauaaaaccauccgaggacaccugggcuccaaguacuucuugaggucacgccaggccuuuuuaauggcggcguaauggucgauguaccuccccacgucugaguaggucucuaugaagagggaucuccagcacugacucuucccggcuuuuucuucccuagguuuaaaaaacaagauuaaaaaaucuuuugaaaugauauuaacauuuuuuuuucucuuuuccuuuguuugagauagggucauauguaguacaggcuggccuucgacuaucgauguagguaaggauagcuuugaauuucagauccacaugccucuagcugucaaaugguagaauuaaaaauguguaccacaaaccuggcuuagcauguaguuuugauauuaaccaacacacuuuauugggaguuu

SEQ ID NO: 11051 - RNA, 6627 nt, Mus musculus
cccauagauugcguccuugucucuuuucaaggcgucguugacagcagaucccaugcuggcuggcaugacauuggggugcggggcgugcgcgccguagugcugcguggcguggagcggcggcccgugguuuagguggugaaccggggggaucggccgcggcgcgugagggucuccguacauggaagcgggaaccccuacuccguccaucccgccguaauggggcagcucaucguacugucagagcccgggcaagaggagggggcgguggcacagaguaagagagaacccaggggggcagaggcaggaaagcaaaggaacccggagcaaagaaaagaggguacagaggaguggggauggaauagagauaggggguguaaagacggaugagagagagagagagagagagagagagagagagagagagagagagaauaaaaacaaagucagaaaaaaagaaaaguaccggacacaaguuaaacacacuacaaaccaaaccaggagaaaaaacagauuugaaaguugggagaggaugucguaaauuuuaaaauuaaagucugagccgagagcagcauucagggaaggcagaucaggcggagaggccggggacgccggguggggggugggggggcacagggaggccccgcucccgcuggaggcugcagaaccccagcgagccaacccagggagaaguggaguuagcaagagaaggaagccccggaucccaccccuuaccccccuucgccuccuccaggagauccaauaaaucaaagggcgaaaugaaacaaaauaaagagaagaaaaacgcuaauaaucaggccgagaacggcaaggacaagggaagacuagggucggugccuccccgggggcuaggagcugaggguggggaggaauaacgugaaaguuaccagaaacauuauuuagcagcggauucccugcguccuugucaauuucagagacaaaacaagcagccggggcuagucuaggcagcgcggccccacgccggcggcuccuacgcagcccgcgcccgcccggagccgcgcgaguagcggcgaaagaggcgcagcggcggcggcaggagaacccggggaaucacgcugccgggguaaaagcuggagcgaggcgaaagcguguaacaauugcacacaaguacacacacacacacacacacacacacacacacacacacacaccacucacacgcucucgccgcccgcagagaacccggggaaucacgcugccgggguaaaagcuggagcgaggcgaaagcguguaacaauugcacacaaguacacacacacacacacacacacacacacacacacacacacacacacacacacacacaccacucacacgcucucgccgcccgcccgcucgcucagcgcugggacacgcgcggccagacacgcacacacgcacgcacacacacucucacacacgcagaggcacaggggggaaagaagccggugaauaauuuuguuacuauuuuuuaaaauacuggccgccaucaucaucaagcaaccagcagcagccagcucaaagggagagaaggcauggggcagggcccuguaggagaggauuuauaucuagguaaguguuggagauuuaaaccuacccuuugcgccaucagucugcgcuccaauaaacuccuggaugugucguauauuuaauaucccaguccggauaagaaagugagcuagguugaagaguccuuuuuuuccaaaccaaggagacuucucccaauuuuccaauguuauuuuuugggggguggggaaagcccagucaagaaaacgaagaauuuuuuucagugauauuucuucuuuuucucuuuuuuccucuucuuccuccuccuccugaucuuccuccuccucccccuccucccccuccccuccuccuccucuucgguccuccuuuacuccucuuucucuucuuuuccucuuaguugaaaaaaaaaaagaaaagaaagaaaagaaaaagaaaaaaaauugucaagcccccgaacugaagguuacgagcggccagucagcagcccacauguaaccgaacugucgaguuucauggcuuuuugccacuccagcugucaaucaaagcccggaaugucaagguagugaaugaaugaugguugaugaugaugaagaggagcaaucuuucagacccguuuuuuuuuucuuccaguaaaacuccgcgagggguuucugcuucuugaauucuuccuccccccuccccccucuuuuagcuuugcccccaaaauagcucuaauaugauccucucuuuuuaaaguauuguucaaagaaagcaaggagaaaaccaagaaaaaaaugaauaguuugcaaaaauuggacuuccucccccccucucugguagguauuuugucuuucccucucucucuuucucgcucgcucucacucgcgcucgcucucucgcgcucucuuucucucucugggagaugagugagugucaguagguguuggcagguuggcugcagccgggcuuauaguagagccucaguuuggcggcgcgggucggcggcgggagaacgaaaugacggaacccggaagucgugguggccauagcccguccuacggcggagacacaucccgagaguggggagcuggagcgaggaggagcgcgcagcgcggagccucugauaugcagcgagugcggucggacggccccgggggggggggggggggcuggggaaggggaggcuggagcggagaggaccggagcaaaucagcaagccugcuucuccagggggacgacgcgggagggagaggaagaggggagggaggggggaugagggagggggaaagggggaagggagggaaggagggagagcgacaggagagggagagagagggagagagagagagagagagagagagagagagagagagagagagagagagagagagagagaacacgcgugauuggagggggaaggaagagagguggaagaggacagggagagcgcagacaggaaaacugcagaaagccacagggaaaguacgguacagacucagaucuuuuuauuuucaacuuacuucucguuuauuuccccaccacuccucuuggcuccugccuaacugggucgcguuggggauguuuggcauggcgcucuagcuuuuguucguuuuaauuccgcggcccccuuccucugccggcggauuacuaggucccgaacucugccacuacaaccuagagcagcaagcuccgccaacugcaccaccgccaggcuaggauuuuuguuguuguuguuguuguuguuguuguuaagugguacuuucuuucucgugcagaugcagagcccuuuuugucaauauucauuuuugucuaguacaagauaugagcagcugaacucggagcauagucccucggugcgcugcagacaguguagaccaccauugagagucuagggguccugggcucaaucuggagggagaaagcaggaugagaguuaguagggcgggaguuagugggguaggaguuagaggagagggaguuguuugguguuuguuguuuaccgauguagacaaguguguguguguguguguguguguguguguguacgcgcgcgugcgugcgugcgcgugaccgcugugcgccucuaaagugaaucuuggaucuaggaagcaccggaggagaaagauuaaaaagcaugugagacagaagaugcuugcgaggaguggcuggcucuggcugcccagcuuuguugugguugcccugggcgcagcgguuguaaagagggcuaaaggcugaguuaauuacaccgggaggauuucgcuggauggggaccaugggacuggcuccuaaaguuuucccaaaaggaaaaggaagcgaguaggguuaaaaagguaaauacccgacuagguuuugguagaaacuaguucuggccggggucccgcccaaucccuggccggaguuccagcuggcuuuaccucugcucugcuguuuccccgcggcugcgcgucaaucaccgagagacgagagcugggggcggagcuuuggucacccggcgcgcguagccggguucacccugccgccaccaggcagcuggcagcgcgacccagccacgcacugggagcgcgcccucuccccaacuucucacccucgcccuggguuccgggccccaggcccagagaauagcaaacagaguaaggguuugcuguucaacugcggccucccuccccaacucugaaccaucccgugacagaaagcagcgccuccugcaagggugccuuugacuggacuuucucaugggggcggggguggaugggagugguuagguauaguagaguggugugugugugugugugugugugugugugugugugugugugugugugugagagagagagagagagagagaggacuuacagagagagggagagggagacggagagggagagggagggagggagggagggagagagagagagagagagagagagagagagagagagagagagagagagagguuuuucucccauuuagcaucuuccugguuuccuagcaagcuucugaacaucccaagcuagcuaaaacuacugcaugccgagacuccaugcggagucugaggaaauuuggccucguucuccuagggcuggugaaugagcuccggaggucaauaaagcccuccaaaaaugaugaaugauugagcaccugugaugaugauagugauuaccagagcaauuaaacaguuugauuaaaugagccaucauaacaaugaugucugcgggaaaucggcccucacauauaaagacaguguggaggggcuggcagaggcccggagagcgcgccgggagagggguugcagcccgugcgaguuuggcuccaguggccaaagcagggaaggcggccucggggaccuucugggagcagaguccagccaaggguuucccucucuuuccgcuucaagcccaagacagcagagcaguuuggaacccgaaggacuauaugguccuuucccccucccccaccacuuuuuuccccccuagaagaacuucaagauuacaaauauccgucucauuugaugcugaauuacucguggacagauaagaaaagguaaguaaaaagaaaaggaaaaguuggccuccagaauuuuuuuuuuugggagggggugaaguuaaaucucaguuuauccuccuaggguaaaagagagggaaagagagagagggaggugagacacacacagagacagacacagaaaggagagacacagaauaugagagaauauuuggccuggcugaagaccguuuucugcuucacagaguugugaaugauacuggauccaaguugucggcccagcacuguuggcagaguuuacauucaguuuugauuccucuaauuguucuuaauuucaacauuggcuauuuaguaucgccaguaagauuuuugcucuuuuuaaauccugguuaaauaaacgccaguuaggaaguuucuuuuucaaaggaacacggguuuccgagauaaacgcuucuuuuguaaagaacaacuucgugagaaaccucugcaucuuccuguaagcaugcuuagcucuuuuuuuccacagcgguucgcagcccccacccccaccccaaccccagcuuguugauauuguaaagcgauuuaauuucccgguaaccuuuauuuaguaaaacuucuuuagcauuaagaaaaaacagcauuaauaaaguuucucccugaguuaaaaacaaaaauccaaguugauuauuucuauuuucuaaagcaaucguuaaggaaauaauggcuugaugaagggugguaauuugggguuuuacaaagaaaaaugcuaaccccgauuuauacugugggcagugcagacggagcuuaaacuugaaccucuuccucuccuucaccacguaacuucuuaugaauuuuggcaaaugccuuaaagcaaacaagaggacaaucuggucagauguagggggcagaaaggaaggacauuuuaagaaaagcgagaauuuuuagggagacuuuuagaguuaagaagugugaggugguugaaaauagcaugcuggugaaggccuuuuggcuuugaaauucacuuuaucuaaaaggagcggcugcuuucacugaagagauggguuacacagaugcacgcuauugguaaaacucuuaguuuaaauguuaguuuuaaaaucuaccacugccaugcauugcacaggggaucaaguuggaguaucuuuccugaucccugugauaccacaaguugugaucauccaacagcuuauggguguuuuuauuaauacaacagcauagguugcauauagugagggacuugccucuguuccucaucucgauuuccaugucugguagaagccauugcacaacagcgagguguccacacuuucucuuuucuuucuguauaugggcaccuuguuuucagagcuucacacuccacacccuuuguggauucauuuacucucccacauuugaggugaagggaaauagguggggcagccccagagacagacaagagaugggggucacaggcgccaugcacaccucagucaacagucagccccuucugcccaggcuggaaaugguuuuaacaggcgguaaaauuucaucuugcggugucaaauuggggucauuuugggguuagaguucucaguguccgugagg

SEQ ID NO: 11052 - RNA, 6627 nt, Mus musculus
ccucacggacacugagaacucuaaccccaaaaugaccccaauuugacaccgcaagaugaaauuuuaccgccuguuaaaaccauuuccagccugggcagaaggggcugacuguugacugaggugugcauggcgccugugacccccaucucuugucugucucuggggcugccccaccuauuucccuucaccucaaaugugggagaguaaaugaauccacaaaggguguggagugugaagcucugaaaacaaggugcccauauacagaaagaaaagagaaaguguggacaccucgcuguugugcaauggcuucuaccagacauggaaaucgagaugaggaacagaggcaagucccucacuauaugcaaccuaugcuguuguauuaauaaaaacacccauaagcuguuggaugaucacaacuugugguaucacagggaucaggaaagauacuccaacuugauccccugugcaaugcauggcagugguagauuuuaaaacuaacauuuaaacuaagaguuuuaccaauagcgugcaucuguguaacccaucucuucagugaaagcagccgcuccuuuuagauaaagugaauuucaaagccaaaaggccuucaccagcaugcuauuuucaaccaccucacacuucuuaacucuaaaagucucccuaaaaauucucgcuuuucuuaaaauguccuuccuuucugcccccuacaucugaccagauuguccucuuguuugcuuuaaggcauuugccaaaauucauaagaaguuacguggugaaggagaggaagagguucaaguuuaagcuccgucugcacugcccacaguauaaaucgggguuagcauuuuucuuuguaaaaccccaaauuaccacccuucaucaagccauuauuuccuuaacgauugcuuuagaaaauagaaauaaucaacuuggauuuuuguuuuuaacucagggagaaacuuuauuaaugcuguuuuuucuuaaugcuaaagaaguuuuacuaaauaaagguuaccgggaaauuaaaucgcuuuacaauaucaacaagcugggguuggggugggggugggggcugcgaaccgcuguggaaaaaaagagcuaagcaugcuuacaggaagaugcagagguuucucacgaaguuguucuuuacaaaagaagcguuuaucucggaaacccguguuccuuugaaaaagaaacuuccuaacuggcguuuauuuaaccaggauuuaaaaagagcaaaaaucuuacuggcgauacuaaauagccaauguugaaauuaagaacaauuagaggaaucaaaacugaauguaaacucugccaacagugcugggccgacaacuuggauccaguaucauucacaacucugugaagcagaaaacggucuucagccaggccaaauauucucucauauucugugucucuccuuucugugucugucucugugugugucucaccucccucucucucuuucccucucuuuuacccuaggaggauaaacugagauuuaacuucacccccucccaaaaaaaaaaauucuggaggccaacuuuuccuuuucuuuuuacuuaccuuuucuuaucuguccacgaguaauucagcaucaaaugagacggauauuuguaaucuugaaguucuucuaggggggaaaaaaguggugggggagggggaaaggaccauauaguccuucggguuccaaacugcucugcugucuugggcuugaagcggaaagagagggaaacccuuggcuggacucugcucccagaagguccccgaggccgccuucccugcuuuggccacuggagccaaacucgcacgggcugcaaccccucucccggcgcgcucuccgggccucugccagccccuccacacugucuuuauaugugagggccgauuucccgcagacaucauuguuaugauggcucauuuaaucaaacuguuuaauugcucugguaaucacuaucaucaucacaggugcucaaucauucaucauuuuuggagggcuuuauugaccuccggagcucauucaccagcccuaggagaacgaggccaaauuuccucagacuccgcauggagucucggcaugcaguaguuuuagcuagcuugggauguucagaagcuugcuaggaaaccaggaagaugcuaaaugggagaaaaaccucucucucucucucucucucucucucucucucucucucucucucucucucccucccucccucccucccucucccucuccgucucccucucccucucucuguaaguccucucucucucucucucucucucacacacacacacacacacacacacacacacacacacacacacacacaccacucuacuauaccuaaccacucccauccacccccgcccccaugagaaaguccagucaaaggcacccuugcaggaggcgcugcuuucugucacgggaugguucagaguuggggagggaggccgcaguugaacagcaaacccuuacucuguuugcuauucucugggccuggggcccggaacccagggcgagggugagaaguuggggagagggcgcgcucccagugcguggcugggucgcgcugccagcugccugguggcggcagggugaacccggcuacgcgcgccgggugaccaaagcuccgcccccagcucucgucucucggugauugacgcgcagccgcggggaaacagcagagcagagguaaagccagcuggaacuccggccagggauugggcgggaccccggccagaacuaguuucuaccaaaaccuagucggguauuuaccuuuuuaacccuacucgcuuccuuuuccuuuugggaaaacuuuaggagccagucccaugguccccauccagcgaaauccucccgguguaauuaacucagccuuuagcccucuuuacaaccgcugcgcccagggcaaccacaacaaagcugggcagccagagccagccacuccucgcaagcaucuucugucucacaugcuuuuuaaucuuucuccuccggugcuuccuagauccaagauucacuuuagaggcgcacagcggucacgcgcacgcacgcacgcgcgcguacacacacacacacacacacacacacacacacuugucuacaucgguaaacaacaaacaccaaacaacucccucuccucuaacuccuaccccacuaacucccgcccuacuaacucucauccugcuuucucccuccagauugagcccaggaccccuagacucucaaugguggucuacacugucugcagcgcaccgagggacuaugcuccgaguucagcugcucauaucuuguacuagacaaaaaugaauauugacaaaaagggcucugcaucugcacgagaaagaaaguaccacuuaacaacaacaacaacaacaacaacaacaaaaauccuagccuggcgguggugcaguuggcggagcuugcugcucuagguuguaguggcagaguucgggaccuaguaauccgccggcagaggaagggggccgcggaauuaaaacgaacaaaagcuagagcgccaugccaaacauccccaacgcgacccaguuaggcaggagccaagaggagugguggggaaauaaacgagaaguaaguugaaaauaaaaagaucugagucuguaccguacuuucccuguggcuuucugcaguuuuccugucugcgcucucccuguccucuuccaccucucuuccuucccccuccaaucacgcguguucucucucucucucucucucucucucucucucucucucucucucucucucucucucucucccucucucucccucuccugucgcucucccuccuucccucccuucccccuuucccccucccucauccccccucccuccccucuuccucucccucccgcgucgucccccuggagaagcaggcuugcugauuugcuccgguccucuccgcuccagccuccccuuccccagcccccccccccccccccggggccguccgaccgcacucgcugcauaucagaggcuccgcgcugcgcgcuccuccucgcuccagcuccccacucucgggaugugucuccgccguaggacgggcuauggccaccacgacuuccggguuccgucauuucguucucccgccgccgacccgcgccgccaaacugaggcucuacuauaagcccggcugcagccaaccugccaacaccuacugacacucacucaucucccagagagagaaagagagcgcgagagagcgagcgcgagugagagcgagcgagaaagagagagagggaaagacaaaauaccuaccagagagggggggaggaaguccaauuuuugcaaacuauucauuuuuuucuugguuuucuccuugcuuucuuugaacaauacuuuaaaaagagaggaucauauuagagcuauuuugggggcaaagcuaaaagaggggggaggggggaggaagaauucaagaagcagaaaccccucgcggaguuuuacuggaagaaaaaaaaaacgggucugaaagauugcuccucuucaucaucaucaaccaucauucauucacuaccuugacauuccgggcuuugauugacagcuggaguggcaaaaagccaugaaacucgacaguucgguuacaugugggcugcugacuggccgcucguaaccuucaguucgggggcuugacaauuuuuuuucuuuuucuuuucuuucuuuucuuuuuuuuuuucaacuaagaggaaaagaagagaaagaggaguaaaggaggaccgaagaggaggaggaggggagggggaggagggggaggaggaggaagaucaggaggaggaggaagaagaggaaaaaagagaaaaagaagaaauaucacugaaaaaaauucuucguuuucuugacugggcuuuccccaccccccaaaaaauaacauuggaaaauugggagaagucuccuugguuuggaaaaaaaggacucuucaaccuagcucacuuucuuauccggacugggauauuaaauauacgacacauccaggaguuuauuggagcgcagacugauggcgcaaaggguagguuuaaaucuccaacacuuaccuagauauaaauccucuccuacagggcccugccccaugccuucucucccuuugagcuggcugcugcugguugcuugaugaugauggcggccaguauuuuaaaaaauaguaacaaaauuauucaccggcuucuuuccccccugugccucugcgugugugagagugugugugcgugcgugugugcgugucuggccgcgcgugucccagcgcugagcgagcgggcgggcggcgagagcgugugagugguguguguguguguguguguguguguguguguguguguguguguguguguguguguguacuugugugcaauuguuacacgcuuucgccucgcuccagcuuuuaccccggcagcgugauuccccggguucucugcgggcggcgagagcgugugagugguguguguguguguguguguguguguguguguguguguguguacuugugugcaauuguuacacgcuuucgccucgcuccagcuuuuaccccggcagcgugauuccccggguucuccugccgccgccgcugcgccucuuucgccgcuacucgcgcggcuccgggcgggcgcgggcugcguaggagccgccggcguggggccgcgcugccuagacuagccccggcugcuuguuuugucucugaaauugacaaggacgcagggaauccgcugcuaaauaauguuucugguaacuuucacguuauuccuccccacccucagcuccuagcccccggggaggcaccgacccuagucuucccuuguccuugccguucucggccugauuauuagcguuuuucuucucuuuauuuuguuucauuucgcccuuugauuuauuggaucuccuggaggaggcgaagggggguaaggggugggauccggggcuuccuucucuugcuaacuccacuucucccuggguuggcucgcugggguucugcagccuccagcgggagcggggccucccugugcccccccaccccccacccggcguccccggccucuccgccugaucugccuucccugaaugcugcucucggcucagacuuuaauuuuaaaauuuacgacauccucucccaacuuucaaaucuguuuuuucuccugguuugguuuguaguguguuuaacuuguguccgguacuuuucuuuuuuucugacuuuguuuuuauucucucucucucucucucucucucucucucucucucucucucucucauccgucuuuacacccccuaucucuauuccauccccacuccucuguacccucuuuucuuugcuccggguuccuuugcuuuccugccucugccccccuggguucucucuuacucugugccaccgcccccuccucuugcccgggcucugacaguacgaugagcugccccauuacggcgggauggacggaguagggguucccgcuuccauguacggagacccucacgcgccgcggccgauccccccgguucaccaccuaaaccacgggccgccgcuccacgccacgcagcacuacggcgcgcacgccccgcaccccaaugucaugccagccagcaugggaucugcugucaacgacgccuugaaaagagacaaggacgcaaucuauggg

SEQ ID NO: 11053 - RNA, 533 nt, Mus musculus
cuuuuacucauauacaagaacaauacauagauuguuuaauaaauuaacaguauugucucugagguagacaaaugugaacgaacuuucccccuacaugcuagucaauucuuaaucaugguaacuuuuguuucuuuuauauuuaauucuaaacuguguuuacaucuuaaaauuaauuuaucuuaaauuuuuacuuuuuauaucaugguaaaguccuuuuagucccacaaauguuuuuuaucuuuuuuuuuuuuugaaaguuuuuacuuaugaucuauacaucaaaagguuacacacucuaauggcuuucaaaagucaacacaaaacucuuuugacuuagaaauuaagccaaaucgcuucucggccucaagaaauuaagccaagauacccguaaaaaucuuuuaaagucaucaguaugguuuguuuccuaugagauuuaauucauccuuuuuccuguauagcuaaaaauuagagguuauauuuuuuccuuaaacuugaaaaaacugcuccaagaauuucucuuauaauaauggugu

SEQ ID NO: 11054 - RNA, 533 nt, Mus musculus
acaccauuauuauaagagaaauucuuggagcaguuuuuucaaguuuaaggaaaaaauauaaccucuaauuuuuagcuauacaggaaaaaggaugaauuaaaucucauaggaaacaaaccauacugaugacuuuaaaagauuuuuacggguaucuuggcuuaauuucuugaggccgagaagcgauuuggcuuaauuucuaagucaaaagaguuuuguguugacuuuugaaagccauuagaguguguaaccuuuugauguauagaucauaaguaaaaacuuucaaaaaaaaaaaaagauaaaaaacauuugugggacuaaaaggacuuuaccaugauauaaaaaguaaaaauuuaagauaaauuaauuuuaagauguaaacacaguuuagaauuaaauauaaaagaaacaaaaguuaccaugauuaagaauugacuagcauguagggggaaaguucguucacauuugucuaccucagagacaauacuguuaauuuauuaaacaaucuauguauuguucuuguauaugaguaaaag

SEQ ID NO: 11055 - RNA, 609 nt, Mus musculus
uugucuucauguugccuagagggaaagaaaggaacuaaauuauucuuugaaucuugcaaaauggauaguccaauacagucucccagaucgcuauuauuaucacuuugcagggaugaaagaacagauguagagccgugguuacguuucuuggccaaauccgagucauacucauucaccagacuaaggggagaauggggugagaccccaggccaccucagugcucgggccuccucuucaauccucagaacccauugugacuuacaacaccaugccccucuucucuccuagcccugggauuuuaucaucaguuccugcauccuguuccuuccuugaagccccccagccaguccucgaggccaaugcuaagucaucaucuuccucucuccucccucagccucaggccuauucucuggggaauccacucugaccccgggcaaaaacuccaaguacgcaguuucuccaaggggcaguagggaaaagugcgccgcgccgcggggcgcugcuugcuaagcgggaaaccgguuccuaaccgcuggcgccccucgaggggaggggagagggcggaggugcuucugcggcggcaucuguccgaggcgggcgggaagcugc

SEQ ID NO: 11056 - RNA, 609 nt, Mus musculus
gcagcuucccgcccgccucggacagaugccgccgcagaagcaccuccgcccucuccccuccccucgaggggcgccagcgguuaggaaccgguuucccgcuuagcaagcagcgccccgcggcgcggcgcacuuuucccuacugccccuuggagaaacugcguacuuggaguuuuugcccggggucagaguggauuccccagagaauaggccugaggcugagggaggagagaggaagaugaugacuuagcauuggccucgaggacuggcuggggggcuucaaggaaggaacaggaugcaggaacugaugauaaaaucccagggcuaggagagaagaggggcaugguguuguaagucacaauggguucugaggauugaagaggaggcccgagcacugagguggccuggggucucaccccauucuccccuuagucuggugaaugaguaugacucggauuuggccaagaaacguaaccacggcucuacaucuguucuuucaucccugcaaagugauaauaauagcgaucugggagacuguauuggacuauccauuuugcaagauucaaagaauaauuuaguuccuuucuuucccucuaggcaacaugaagacaa

SEQ ID NO: 11057 - RNA, 1388 nt, Mus musculus
agcagugucucucaaggcuuaagugccccgccccgggcaggccuucuuccccgcccccagccuguccugcgggcgcaguagcucagaccccaccucgccucuacccgggugcagugugccagguccagaucguuguccccugggaaggguagccggugagaguugagauaacaccgcgcuggaggucuccgagcugcgcugguggcccuggggagcgcuuguaggcuucuagcuaagaaggaggcccgaagccgcaccccaguaaccugcagccaguuuggggacaccgcugaaagacagcuuuggcguuuuuguuuuuguuuuucaguuccgggggcugguucugcauaaugggagaaacugaaaaauagcgugcacaguggccaagaggagggaacaguagaagcaggagacuuguagggagaaaggcuucgccuggccucccugcuacucgggcuucagggcugggaaauguugaggacucuguagagucgaaaagcuguaggcccaagaaagagcuguaguuuaugggaacccaggucguauggcuuagagaccuaggggccaucuacaucagggucagagccagauggcccugacuagaggccugcuaugagccucacaaccuuccauuccuuugaguaaccagaaggguguugucuuucuuccacuagagaguugguucuacuaauuacggagugacagagaaggacuccagcuguguggucuggagagacacugggcaccacagcuugagcccuuggugccuagcaauguggguaaagauugauaccagcagaugggaacucuagcagggacccaaggcuaagggugguguuccgaagaggaauauuguaauaggugcuucugguaaaaagagagagagaaaaaaugaacacuuuuuccuucuuaggucagaaauuuuauaagugggugauuuguccauuucugaggaaaauggugauuccaacuuuuguuuggcccuucacuauuugccaaauauuuuggcauacuaauguguaugaggguaggccacuuccaaaauaauagauaucccgugugggagucucccuugagagucaagcaagugcccgcguuagaguuucuacuaacucccaggcuaggauuuugagaugaaaacuguuagaugaaaaccauuagagucaggugggguugcaagcccagcuccaaggagagagagggagcacccucuggcacuccaggcaggucuacggugcaaagaggaugcagacagagaggauuuggaaguccacuugccaggaccgccgggagguacgccccgagcuccccgucccucgggccugggacucggcuugcccauaaccuacauuaacucgcuagugcagccugggcccaucugccggccc

SEQ ID NO: 11058 - RNA, 1388 nt, Mus musculus
gggccggcagaugggcccaggcugcacuagcgaguuaauguagguuaugggcaagccgagucccaggcccgagggacggggagcucggggcguaccucccggcgguccuggcaaguggacuuccaaauccucucugucugcauccucuuugcaccguagaccugccuggagugccagagggugcucccucucucuccuuggagcugggcuugcaaccccaccugacucuaaugguuuucaucuaacaguuuucaucucaaaauccuagccugggaguuaguagaaacucuaacgcgggcacuugcuugacucucaagggagacucccacacgggauaucuauuauuuuggaaguggccuacccucauacacauuaguaugccaaaauauuuggcaaauagugaagggccaaacaaaaguuggaaucaccauuuuccucagaaauggacaaaucacccacuuauaaaauuucugaccuaagaaggaaaaaguguucauuuuuucucucucucuuuuuaccagaagcaccuauuacaauauuccucuucggaacaccacccuuagccuugggucccugcuagaguucccaucugcugguaucaaucuuuacccacauugcuaggcaccaagggcucaagcuguggugcccagugucucuccagaccacacagcuggaguccuucucugucacuccguaauuaguagaaccaacucucuaguggaagaaagacaacacccuucugguuacucaaaggaauggaagguugugaggcucauagcaggccucuagucagggccaucuggcucugacccugauguagauggccccuaggucucuaagccauacgaccuggguucccauaaacuacagcucuuucuugggccuacagcuuuucgacucuacagaguccucaacauuucccagcccugaagcccgaguagcagggaggccaggcgaagccuuucucccuacaagucuccugcuucuacuguucccuccucuuggccacugugcacgcuauuuuucaguuucucccauuaugcagaaccagcccccggaacugaaaaacaaaaacaaaaacgccaaagcugucuuucagcgguguccccaaacuggcugcagguuacuggggugcggcuucgggccuccuucuuagcuagaagccuacaagcgcuccccagggccaccagcgcagcucggagaccuccagcgcgguguuaucucaacucucaccggcuacccuucccaggggacaacgaucuggaccuggcacacugcacccggguagaggcgagguggggucugagcuacugcgcccgcaggacaggcugggggcggggaagaaggccugcccggggcggggcacuuaagccuugagagacacugcu

SEQ ID NO: 11059 - RNA, 1350 nt, Mus musculus
aguagcggcgcugcucgcaggcuaggaacccgaggccaagagcugcagccaaagucacuugggugcaguguacucccucacuagcccgcucgagacccuaggauuugcuccaggacacguacuuagagcagccaccgcccagucgcccucaccuggauuaccuaccgaggcaucgagcagcggaguuuuugagaaggcgacaagggagcagcgucccgaggggaaucagcuuuucaggaacucggcuggcagacgggacuugcgggagagcgacaucccuaacaagcagauucggagucccggaguggagaggacaccccaagggaugacgccugcgucccggagcgccugucgcugggcgcuacugcugcuggcgguacuguggccgcagguaaugucucacguccucuccgcccccucccgcagcgcuccgggcuugcgccccggccccggcugagccugaccgcucuccucccuccuucucucggucccugugcagcagcgcgcugcgggcuccggcaucuuccagcugcggcugcaggaguucgucaaccagcgcgguaugcuggccaaugggcaguccugcgaaccgggcugccggacuuucuuccgcaucugccuuaagcacuuccaggcaaccuucuccgagggacccugcaccuuuggcaaugucuccacgccgguauugggcaccaacuccuucgucgucagggacaagaauagcggcaguggucgcaacccucugcaguugcccuucaauuucaccuggccgguaagcacaacuuaaaugcaccgggagauaaccgaagggaaagaagggagcgccgggacaccagagcuccuuuccaaagcgcucucuggagagccccaagggcucuuucucuucugcccccgccccccuguucucucauaggaucaucccggagaggcuuugguuagucuuuccucccaguuucuucccuuuccuucuccccaauucuugggauacgaauuucauuaccaaacccccaacgcggcgccgcccgcccaccccccggcucucacuuacacucccgcaucccucaucccuccccugccuucucagcucgcgcgcagcgcugcgcgaacaccaguuauguugagccgagcuccguaacuauauccugcaauuagauuaauuaaacaggcugcugcgaggcacccccuccuuucccucccugcugauaucgcuaucucuaaugucccccacccccccuuuugcuucccagggaaccuucucacucaacauccaagcuuggcacacaccgggagacgaccugcggccaggugaguaucuaacuucucggccacaggggggcgacaucacacagc

SEQ ID NO: 11060 - RNA, 1350 nt, Mus musculus
gcugugugaugucgccccccuguggccgagaaguuagauacucaccuggccgcaggucgucucccggugugugccaagcuuggauguugagugagaagguucccugggaagcaaaagggggggugggggacauuagagauagcgauaucagcagggagggaaaggagggggugccucgcagcagccuguuuaauuaaucuaauugcaggauauaguuacggagcucggcucaacauaacugguguucgcgcagcgcugcgcgcgagcugagaaggcaggggagggaugagggaugcgggaguguaagugagagccggggggugggcgggcggcgccgcguuggggguuugguaaugaaauucguaucccaagaauuggggagaaggaaagggaagaaacugggaggaaagacuaaccaaagccucuccgggaugauccuaugagagaacaggggggcgggggcagaagagaaagagcccuuggggcucuccagagagcgcuuuggaaaggagcucuggugucccggcgcucccuucuuucccuucgguuaucucccggugcauuuaaguugugcuuaccggccaggugaaauugaagggcaacugcagaggguugcgaccacugccgcuauucuugucccugacgacgaaggaguuggugcccaauaccggcguggagacauugccaaaggugcagggucccucggagaagguugccuggaagugcuuaaggcagaugcggaagaaaguccggcagcccgguucgcaggacugcccauuggccagcauaccgcgcugguugacgaacuccugcagccgcagcuggaagaugccggagcccgcagcgcgcugcugcacagggaccgagagaaggagggaggagagcggucaggcucagccggggccggggcgcaagcccggagcgcugcgggagggggcggagaggacgugagacauuaccugcggccacaguaccgccagcagcaguagcgcccagcgacaggcgcuccgggacgcaggcgucaucccuugggguguccucuccacuccgggacuccgaaucugcuuguuagggaugucgcucucccgcaagucccgucugccagccgaguuccugaaaagcugauuccccucgggacgcugcucccuugucgccuucucaaaaacuccgcugcucgaugccucgguagguaauccaggugagggcgacugggcgguggcugcucuaaguacguguccuggagcaaauccuagggucucgagcgggcuagugagggaguacacugcacccaagugacuuuggcugcagcucuuggccucggguuccuagccugcgagcagcgccgcuacu

SEQ ID NO: 11061 - RNA, 1053 nt, Mus musculus
aacauuaaaaucaauuuuccacccauuuacugaacucuuaucaagucaggaaaaaugcaccccuagaaugacaagaaacuucagcaugugcacucgcuugaaucauugagcaggcucuuccaaaggacagaacuguggccguuuauuucuaucuuaccacuucuaauagagacuccaacuuaaucucagagauuguccuuuuuaaacgauuaaaaacucuuaggggaauuauuuccaucuccuucagcuccggaaacugccaagccuuagacagccaaccugaccgauuuaagucaucccagcugcaacacuagggcaugggaagcugauaguacagggcuuuccaagaagauaccgcaugaacacccauuuagagccagccacagcugcaugcagagcucacgcaggccggacacuaguguucaaaacccucugccuuacaaacuuccaggguaggugucugaacgcgaguguacagcucugguuuucaugagaaugacuuaaaggaaggaccaucuccugaccacgcaucucaucucagucucuggauucuucccuuucagcgaugccucccaaauagcugaugcccacacgggaaaagcacuucucccugcaacuggaauugguaagcagcagaagcagugggcuucucccuuucucuggguuucagcuccuccccuucuuccacaaggaaccauucucgccuccccaaaucugcuucaacaauggcccaggauucccuccagccaggacuucuccucugggccaggaacaaggcgaguuaucugaacaagaguugaugaccgaguaacuuuggcacuuccaggcugucucccggggaucucacccaggguccucuacgggccagaaccugcccugucaguugcuguggaucuuaaagucccaagaagggcgaggggaggcacaccgaagcagcugggagcuucccuuacccuuucagcgcaucguguccuccgccgccucuucucuuggcccgauuggcucuggucuccuucaggcucccagccuccaaauuggcguccgccccauggc

SEQ ID NO: 11062 - RNA, 1053 nt, Mus musculus
gccauggggcggacgccaauuuggaggcugggagccugaaggagaccagagccaaucgggccaagagaagaggcggcggaggacacgaugcgcugaaaggguaagggaagcucccagcugcuucggugugccuccccucgcccuucuugggacuuuaagauccacagcaacugacagggcagguucuggcccguagaggacccugggugagauccccgggagacagccuggaagugccaaaguuacucggucaucaacucuuguucagauaacucgccuuguuccuggcccagaggagaaguccuggcuggagggaauccugggccauuguugaagcagauuuggggaggcgagaaugguuccuuguggaagaaggggaggagcugaaacccagagaaagggagaagcccacugcuucugcugcuuaccaauuccaguugcagggagaagugcuuuucccgugugggcaucagcuauuugggaggcaucgcugaaagggaagaauccagagacugagaugagaugcguggucaggagaugguccuuccuuuaagucauucucaugaaaaccagagcuguacacucgcguucagacaccuacccuggaaguuuguaaggcagaggguuuugaacacuaguguccggccugcgugagcucugcaugcagcuguggcuggcucuaaauggguguucaugcgguaucuucuuggaaagcccuguacuaucagcuucccaugcccuaguguugcagcugggaugacuuaaaucggucagguuggcugucuaaggcuuggcaguuuccggagcugaaggagauggaaauaauuccccuaagaguuuuuaaucguuuaaaaaggacaaucucugagauuaaguuggagucucuauuagaagugguaagauagaaauaaacggccacaguucuguccuuuggaagagccugcucaaugauucaagcgagugcacaugcugaaguuucuugucauucuaggggugcauuuuuccugacuugauaagaguucaguaaauggguggaaaauugauuuuaauguu

SEQ ID NO: 11063 - RNA, 1046 nt, Mus musculus
cagccaccgcccggacccgggccucccucauucgcaggaucagugcccugggaggaggcggaggugauccaguccugccuggccugggauauuccgucccaggguggggaagagagggaaugggaagagguggaguagcgguuuagaccgaucugccugcggcugagagguccagacccgagauucccgcgaucagaagcacggagagcugggccaccugcgcggagaacgcaugcuggacaccuuggccaacgaggcccaggaggcccuggcuggaaaggggcucuguggcaguggcccucgcuucucagcccagucuucugcugucuggcugggaggagaaauuguaggcuccgaggcucaggcagggcuuguggugaggccaccaccacugagccagccaacagguuagcggcggcgaaaggggcaugccagugucaggagcccgcuggaggagcaauucucccgaggcucaggucaagcuacucaccuaggcuaaaugaagaggcugcgaaagucucagucugugaugugggggccugugauuuggguuucagacaauccucccgcccaacucucaguuaggaaugggguuuccuaaaauaacccuauuuucacauguguacacacuauacagagagcacauacacacacaugcaugggauugggguggggugggggugucugaaauccacaucgggcucgaccgcagggaccagggacuccagucaccaacugucacuuuccacacaguuacccuaagaaugcacgcaucuuguugacccggauuuuucuuguuuucaacaucuugugcccggauaugagauuauagagaucgaggcauguuaucaacuccaucuucuuuucaaaauggaccacgccucaugauaauggacucacugcacugcuucgauaccugaauaggaagacuuaaacacugauuuaaauucauaauuauuuaaauauauuaucuaguuuaauugaggucuuacuuucaaaaaaaaauccucuuaacagauccaugaacuggagauuccguccuacau

SEQ ID NO: 11064 - RNA, 1046 nt, Mus musculus
auguaggacggaaucuccaguucauggaucuguuaagaggauuuuuuuuugaaaguaagaccucaauuaaacuagauaauauauuuaaauaauuaugaauuuaaaucaguguuuaagucuuccuauucagguaucgaagcagugcagugaguccauuaucaugaggcgugguccauuuugaaaagaagauggaguugauaacaugccucgaucucuauaaucucauauccgggcacaagauguugaaaacaagaaaaauccgggucaacaagaugcgugcauucuuaggguaacuguguggaaagugacaguuggugacuggagucccuggucccugcggucgagcccgauguggauuucagacacccccaccccaccccaaucccaugcauguguguguaugugcucucuguauaguguguacacaugugaaaauaggguuauuuuaggaaaccccauuccuaacugagaguugggcgggaggauugucugaaacccaaaucacaggcccccacaucacagacugagacuuucgcagccucuucauuuagccuaggugaguagcuugaccugagccucgggagaauugcuccuccagcgggcuccugacacuggcaugccccuuucgccgccgcuaaccuguuggcuggcucaguggugguggccucaccacaagcccugccugagccucggagccuacaauuucuccucccagccagacagcagaagacugggcugagaagcgagggccacugccacagagccccuuuccagccagggccuccugggccucguuggccaagguguccagcaugcguucuccgcgcagguggcccagcucuccgugcuucugaucgcgggaaucucgggucuggaccucucagccgcaggcagaucggucuaaaccgcuacuccaccucuucccauucccucucuuccccacccugggacggaauaucccaggccaggcaggacuggaucaccuccgccuccucccagggcacugauccugcgaaugagggaggcccggguccgggcgguggcug

SEQ ID NO: 11065 - RNA, 759 nt, Mus musculus
cgagcucccgccggacggccccgcucaccugcugcuagccgcacugcagcacgagaugcgcgggggacccacgaccgugugcuucuugcgaggugagcccgcgccccgcgcccugcgcccuucgccccuucucccauguuccgcgccccgcgcucuuagccccuugucccacguuccgugccccguucccgaccucuuggcuaaucauacccuuucuugucuuucccacaggcgguuucaaaagcuuccagacguacuguccggaucugugcucugaagcuccugcccaggcccugccuccugcuggggccgaaaauagcaacucugacccgaggguuccgaucuaugaccaggugaguugauauucgaauuuguugucuucauugugcauucuagagggaugccucuggagaacgccaguggggaaagacagggguguguuccaauauacauucccagauguggagaguguuugugugaccugcaaauggugugaacguguauauauccucauacagacuuuaaggcauauguggcacaaagugucugaacauauguccccuuguggccucaagacuuuuaauucuguccuuggucagaaggccuagagcuucucuuguuucuagccaauccaagaugucuggaucaagcccuccagcacaaggcugagugaggucucaccaccguccccuuccuccuccagggugguccuguggaaaucuugcccuaccuguacuugggcagcugcaaccacuccuc

SEQ ID NO: 11066 - RNA, 759 nt, Mus musculus
gaggagugguugcagcugcccaaguacagguagggcaagauuuccacaggaccacccuggaggaggaaggggacgguggugagaccucacucagccuugugcuggagggcuugauccagacaucuuggauuggcuagaaacaagagaagcucuaggccuucugaccaaggacagaauuaaaagucuugaggccacaaggggacauauguucagacacuuugugccacauaugccuuaaagucuguaugaggauauauacacguucacaccauuugcaggucacacaaacacucuccacaucugggaauguauauuggaacacaccccugucuuuccccacuggcguucuccagaggcaucccucuagaaugcacaaugaagacaacaaauucgaauaucaacucaccuggucauagaucggaacccucgggucagaguugcuauuuucggccccagcaggaggcagggccugggcaggagcuucagagcacagauccggacaguacgucuggaagcuuuugaaaccgccugugggaaagacaagaaaggguaugauuagccaagaggucgggaacggggcacggaacgugggacaaggggcuaagagcgcggggcgcggaacaugggagaaggggcgaagggcgcagggcgcggggcgcgggcucaccucgcaagaagcacacggucgugggucccccgcgcaucucgugcugcagugcggcuagcagcaggugagcggggccguccggcgggagcucg

SEQ ID NO: 11067 - RNA, 798 nt, Mus musculus
acgccgagccuugguuuguuuggugguccgcagcagucucugaaacccuccuuacugccuuccagacucuguuggcacccuucuggugagacgaggcagaucuuuucaauggcucaucuagucagaaguucucgucaguugccucugugcaccagaggguggcacuccagagguggagaggaagggcgggaagaaggaaggaaugaagagaaggcagcauuaauucucagagcuaggucucuaguuaccgaaguaucuuagcaaagagccgcuacccucagucccuuaccggggguugggggggaaaaaccccucuaaguuucgaccggaccugggggucagagucuuagagauuuuaaagaagucacagcuuguuuagaaacaauaacuuucuguguuguggggaacccacauuuucugcacuucugaggggcagacgacaaguccuccuugacugcgcccacaucugaccugacccucugugccauguuuugcaguugcugaauuugugcgaguccgugaaggaugacgcccugaaggugaucucugccuucaacauuccacacaucaccauccgugcaccaaaaacaggaauccccaaccccggggcugccgaggccgccuacccggcacccaugcaaccgcucgugcgggaugcggcgcgcgcucaacuggccaagcugugagccaggcgagaaauuuagugucccaucuuccaaguauuuggccagagcuggagcagaggccaaaguggcaggugcagggcagccaccuuggggauuuuggucuggcagagga

SEQ ID NO: 11068 - RNA, 798 nt, Mus musculus
uccucugccagaccaaaauccccaagguggcugcccugcaccugccacuuuggccucugcuccagcucuggccaaauacuuggaagaugggacacuaaauuucucgccuggcucacagcuuggccaguugagcgcgcgccgcaucccgcacgagcgguugcaugggugccggguaggcggccucggcagccccgggguuggggauuccuguuuuuggugcacggauggugauguguggaauguugaaggcagagaucaccuucagggcgucauccuucacggacucgcacaaauucagcaacugcaaaacauggcacagagggucaggucagaugugggcgcagucaaggaggacuugucgucugccccucagaagugcagaaaauguggguuccccacaacacagaaaguuauuguuucuaaacaagcugugacuucuuuaaaaucucuaagacucugacccccagguccggucgaaacuuagagggguuuuucccccccaacccccgguaagggacugaggguagcggcucuuugcuaagauacuucgguaacuagagaccuagcucugagaauuaaugcugccuucucuucauuccuuccuucuucccgcccuuccucuccaccucuggagugccacccucuggugcacagaggcaacugacgagaacuucugacuagaugagccauugaaaagaucugccucgucucaccagaagggugccaacagagucuggaaggcaguaaggaggguuucagagacugcugcggaccaccaaacaaaccaaggcucggcgu

SEQ ID NO: 11069 - RNA, 1714 nt, Mus musculus
cugcucuucucugcugucaaauccggucccaggaguucuuccgacacagccagagaaagcugaaugggcccaaaggcccgcggcuaccugacuugaggcacuugguggaagcuccccugacugccuuguucccuggugaugcaagagccuccgccuccaggccggcuuccuaauuaggaccuaaaaaagagcacauagcccaacccguugcuuuccccagugccuguauauuuucuuuuagcauguccaggguugcagaaucggaagacuccagagcagccugcuccuacaaagaaacaccagcgcuuccccacccccaccucccaccccuguaugguucuuuucuaguccaaguaugaggcgccuagcuccacgcugagggcgcagaauacuugcugcuggcuuuggacucccagaguagcaguagcagauugggcugcaugggugggaugccgaguggccaaggcacaguacugcuucacagaccuuggucaggacagaccuggaucggcgguguacuugacuucauccacgcccuugcccugugcgcucuuguagcgaucaccccugaccuccagcaggagcaaggcuuugccuugaacaccccagcuucccugggaaccaauggcuucuuugaucucacucaggauucacuugagaagcuagacuuuagcauggggcugugcugugucaccgugacguuagauccgcauacaaacaccaaaaugaccaagauggcccaacauugauugggacggcaggucgcaacacuuguucugcaagaaaaggcuacguccuacuuacugccagccuggaugcagguuggguagcccauuaauagaguuuccuuaaucucguguggggagugggacguuccauuuccagagcagcuuuuuugggccgccgcuaugagagaaggggcuggggguggggaugcacauggcgccauugacuuccagacuucuguuggaaucacaaaggccucaggaagaucaagggauuuuuuuuucgacccccuuaugguuuucccagcucggccugaacuccgcugcuccauggucgccagcaucggcggaccgauggauagacaguuccuggcguacacugugagccccaaacauuucgaggcucccaacaccgcucauggcacaaccgucuuuccuugguagccccccuccuuuuccuuguaguuauucuuuuccagcuaacuuucucauuccccuauuuuauaugcuugucgugcccgcccaucgcucccugaagcuucccgcuucucuugucucucaacuguccuucucaccaccaccucugccucuuaaguaacugggcacuagggaaacaaacauauaaaccacaacaacaacaacagcacacacacacaaacacaacacuaaggagagccuaaaggaggacagaaggcagaaggcggcggcgacgaagaaucucgcuugaggcgcagacgaagaggggugagcaucuugcugaucugagucccccggaggucaggaauucuaggaaaggacagucaaaggccagugcccauccuugcaccaaucuaauccucaugguuuggggcugagaagcugugcaaagcaagggcggagggacgccuucugaggcuuccaacuggcgcccgcggccgggcuggacacagagcaguguacccugagcgcccccuaaguuccgcucugcgagguggccgccacgggcggac

SEQ ID NO: 11070 - RNA, 1714 nt, Mus musculus
guccgcccguggcggccaccucgcagagcggaacuuagggggcgcucaggguacacugcucuguguccagcccggccgcgggcgccaguuggaagccucagaaggcgucccuccgcccuugcuuugcacagcuucucagccccaaaccaugaggauuagauuggugcaaggaugggcacuggccuuugacuguccuuuccuagaauuccugaccuccgggggacucagaucagcaagaugcucaccccucuucgucugcgccucaagcgagauucuucgucgccgccgccuucugccuucuguccuccuuuaggcucuccuuaguguuguguuugugugugugugcuguuguuguuguugugguuuauauguuuguuucccuagugcccaguuacuuaagaggcagaggugguggugagaaggacaguugagagacaagagaagcgggaagcuucagggagcgaugggcgggcacgacaagcauauaaaauaggggaaugagaaaguuagcuggaaaagaauaacuacaaggaaaaggaggggggcuaccaaggaaagacgguugugccaugagcgguguugggagccucgaaauguuuggggcucacaguguacgccaggaacugucuauccaucgguccgccgaugcuggcgaccauggagcagcggaguucaggccgagcugggaaaaccauaagggggucgaaaaaaaaaucccuugaucuuccugaggccuuugugauuccaacagaagucuggaagucaauggcgccaugugcauccccacccccagccccuucucucauagcggcggcccaaaaaagcugcucuggaaauggaacgucccacuccccacacgagauuaaggaaacucuauuaaugggcuacccaaccugcauccaggcuggcaguaaguaggacguagccuuuucuugcagaacaaguguugcgaccugccgucccaaucaauguugggccaucuuggucauuuugguguuuguaugcggaucuaacgucacggugacacagcacagccccaugcuaaagucuagcuucucaagugaauccugagugagaucaaagaagccauugguucccagggaagcugggguguucaaggcaaagccuugcuccugcuggaggucaggggugaucgcuacaagagcgcacagggcaagggcguggaugaagucaaguacaccgccgauccaggucuguccugaccaaggucugugaagcaguacugugccuuggccacucggcaucccacccaugcagcccaaucugcuacugcuacucugggaguccaaagccagcagcaaguauucugcgcccucagcguggagcuaggcgccucauacuuggacuagaaaagaaccauacaggggugggagguggggguggggaagcgcugguguuucuuuguaggagcaggcugcucuggagucuuccgauucugcaacccuggacaugcuaaaagaaaauauacaggcacuggggaaagcaacggguugggcuaugugcucuuuuuuagguccuaauuaggaagccggccuggaggcggaggcucuugcaucaccagggaacaaggcagucaggggagcuuccaccaagugccucaagucagguagccgcgggccuuugggcccauucagcuuucucuggcugugucggaagaacuccugggaccggauuugacagcagagaagagcag

SEQ ID NO: 11071 - RNA, 1359 nt, Mus musculus
ccacaaucuauuuccagagauggguaucuauggggaucacacacacugaucacaucauacagauugauguuugcucagauuuccaaggaacuaaagcaagaccgagguuuguaacaucuacaaaggguaagaaagagugagaagccuguuuaagggaaaacacauuaguaucaagaaccccucgggcgcgcucucucucucucuaguaagagaacaggaaguugauaaacuuccacaguuagguugugggucaucuaagcuuuccagguaaggaccgcccagaggggaagggucuaaagugagggaaucacucacccagaggcaggacgaagaaaaaggggaaccagcacaggacgaagacacccacgacgauggcuagggucuuggcagccuuuuucucgcgggaaaacuugagcagccuuacggagagcgagcugcgcaaggugugccccuugcuacucugugucccuggauuuccuuuggcgcuaguggcugcgccgcgacaguggauccucagaaccaccucagaggccuugcccggcucccucuugaugcccgccucgaggcugcgcguggugcugcgcgcgaccacauacacgcggcaguacaugaccacgaucacugccauggggagguagaaggagcauacggaagagaagaucgcauagcccaccuccucggugaugccgcagaaacgcucauccgggggcacugguuccuuccaaccuaguagcggucccacagauaccaccaaggccaccgcccagagcagagccagaauggcagcggccuugcguucugucauaauggcuggauacuugagcgaguggcgcacacccacguaccgguccacagagauggugcagaggcuaaggauggaggcagugcagcauagcacguccaccgcggcccauacgucgcagaagguccggccgaaggcccagaagccuagaaccuccauaguggcugagaagggcaacacagcugcacucaguagcaggucagccacugcuagguucacgaugaaauaguuggugaccgucugcaaguggcgguugcaggccacggagaggaugacgagaagguugcccgccacagcggugaggaugaaggcggcuaggaagacacccacucccacgcccugagcacucaccacuagccccccgacggccgccgagccauucaccucgccgcuugccgcggcccccgcuucugccguggagcucugguuguccucgccgcugccgguucccaccacagcgcuaccgccuguggcacccggcacgccgcccaccgccggacccucggggccaaccgugccagcuccgccgcccgcgccggagcccccagugcuacugc

SEQ ID NO: 11072 - RNA, 1359 nt, Mus musculus
gcaguagcacugggggcuccggcgcgggcggcggagcuggcacgguuggccccgaggguccggcggugggcggcgugccgggugccacaggcgguagcgcuguggugggaaccggcagcggcgaggacaaccagagcuccacggcagaagcgggggccgcggcaagcggcgaggugaauggcucggcggccgucggggggcuaguggugagugcucagggcgugggagugggugucuuccuagccgccuucauccucaccgcuguggcgggcaaccuucucgucauccucuccguggccugcaaccgccacuugcagacggucaccaacuauuucaucgugaaccuagcaguggcugaccugcuacugagugcagcuguguugcccuucucagccacuauggagguucuaggcuucugggccuucggccggaccuucugcgacguaugggccgcgguggacgugcuaugcugcacugccuccauccuuagccucugcaccaucucuguggaccgguacgugggugugcgccacucgcucaaguauccagccauuaugacagaacgcaaggccgcugccauucuggcucugcucugggcgguggccuuggugguaucugugggaccgcuacuagguuggaaggaaccagugcccccggaugagcguuucugcggcaucaccgaggaggugggcuaugcgaucuucucuuccguaugcuccuucuaccuccccauggcagugaucguggucauguacugccgcguguauguggucgcgcgcagcaccacgcgcagccucgaggcgggcaucaagagggagccgggcaaggccucugaggugguucugaggauccacugucgcggcgcagccacuagcgccaaaggaaauccagggacacagaguagcaaggggcacaccuugcgcagcucgcucuccguaaggcugcucaaguuuucccgcgagaaaaaggcugccaagacccuagccaucgucgugggugucuucguccugugcugguuccccuuuuucuucguccugccucugggugagugauucccucacuuuagacccuuccccucugggcgguccuuaccuggaaagcuuagaugacccacaaccuaacuguggaaguuuaucaacuuccuguucucuuacuagagagagagagagcgcgcccgagggguucuugauacuaauguguuuucccuuaaacaggcuucucacucuuucuuacccuuuguagauguuacaaaccucggucuugcuuuaguuccuuggaaaucugagcaaacaucaaucuguaugaugugaucagugugugugauccccauagauacccaucucuggaaauagauugugg

SEQ ID NO: 11073 - RNA, 544 nt, Mus musculus
ccuuuggaccccaaccccuuugcguugugcccccccccccaagccccauggcgcaacaggaguccgucucuuucuguacaggggaggaaaaaaaugcuguauacguuugucucgugguuggacgccuccuuuugaggggcaaagcuguuuuucuugcuaguauucgcuguguucauggucuagaaaaugcgguuugcucugccuaccaaucucugcucucuaugucuguagcguacggguuguuuugggugaaucuugaggaauaaaaugccuuuauauuucacaggcuguaaauugaacuucccacacgauuagcuuuauuauggcuugugaacugcuggagucuggcuuuaccuuuuuguaugugaacaaaucaaauugcuuaaaaaagaguuuucuuuaguauagccacaaaugccuugaccuguugucuguuggggauuguuuuuugggggugggaggaguucuaacgagaugcuguaguaacugccucaguauaucccggaagacuuuugguuuaaucaucuuuguugagguagggcua

SEQ ID NO: 11074 - RNA, 544 nt, Mus musculus
uagcccuaccucaacaaagaugauuaaaccaaaagucuuccgggauauacugaggcaguuacuacagcaucucguuagaacuccucccacccccaaaaaacaauccccaacagacaacaggucaaggcauuuguggcuauacuaaagaaaacucuuuuuuaagcaauuugauuuguucacauacaaaaagguaaagccagacuccagcaguucacaagccauaauaaagcuaaucgugugggaaguucaauuuacagccugugaaauauaaaggcauuuuauuccucaagauucacccaaaacaacccguacgcuacagacauagagagcagagauugguaggcagagcaaaccgcauuuucuagaccaugaacacagcgaauacuagcaagaaaaacagcuuugccccucaaaaggaggcguccaaccacgagacaaacguauacagcauuuuuuuccuccccuguacagaaagagacggacuccuguugcgccauggggcuugggggggggggcacaacgcaaagggguugggguccaaagg

SEQ ID NO: 11075 - RNA, 834 nt, Mus musculus
gcgccccaaauguauuuuacucucccuaggggcuccucaaaucagcuggccagcacacugagucagcaccgaggccggaaaucuccguugcuaucccagguagucaaaagccaccuuuggaaccucacuggggcagucucaagcgaaaaucaucucaguguccucuauucugggguuucguaccgggaccccacuccuuagucauaggggagugaagcgcagugccugcacagaguccgggagcagcuggaggcaucgcguggaggaauaaggaagggaccgccaacucggcuaggaacuguuagugucccggcuucguagcgacaaacuuuuuuucucuuuguccacuggucuuugauucuuugccuguaccucuguccccaacuccuacccaccuucucuuccccagcuccccacccccucgccagccgaccucccaccccuccccagccgcgcgcugccaaacauaacucuguuaggauagugcguggcucggccacgaagaggauuuggaggcgccgcaagucaauauuugaucacaaaguuaauauuaucucaaggcuaacagugugucguauaaaaaagagacccauuugaguagaaggagggcggaaaaggcggcuguccaggaaggcuagaggugggggggcggguaccggugaagggagcgugcggaggcuggggacgcggagauagcugucaccccacuucucccuggccagggcaagagcuuaccucgggcuccgcguaguagcugcuccagucggauggcucgugcccuuccaucuucacggcucccagcauacuggaagccgagugcauggcgguuuaaaa

SEQ ID NO: 11076 - RNA, 834 nt, Mus musculus
uuuuaaaccgccaugcacucggcuuccaguaugcugggagccgugaagauggaagggcacgagccauccgacuggagcagcuacuacgcggagcccgagguaagcucuugcccuggccagggagaaguggggugacagcuaucuccgcguccccagccuccgcacgcucccuucaccgguacccgcccccccaccucuagccuuccuggacagccgccuuuuccgcccuccuucuacucaaaugggucucuuuuuuauacgacacacuguuagccuugagauaauauuaacuuugugaucaaauauugacuugcggcgccuccaaauccucuucguggccgagccacgcacuauccuaacagaguuauguuuggcagcgcgcggcuggggaggggugggaggucggcuggcgaggggguggggagcuggggaagagaagguggguaggaguuggggacagagguacaggcaaagaaucaaagaccaguggacaaagagaaaaaaaguuugucgcuacgaagccgggacacuaacaguuccuagccgaguuggcggucccuuccuuauuccuccacgcgaugccuccagcugcucccggacucugugcaggcacugcgcuucacuccccuaugacuaaggaguggggucccgguacgaaaccccagaauagaggacacugagaugauuuucgcuugagacugccccagugagguuccaaagguggcuuuugacuaccugggauagcaacggagauuuccggccucggugcugacucagugugcuggccagcugauuugaggagccccuagggagaguaaaauacauuuggggcgc

SEQ ID NO: 11077 - RNA, 1937 nt, Mus musculus
agcagcgcccugcuucuugcgcaggugacagagaagcgccaaaagcgccaccaccagggacaggcuggcaauggagaugccaaugagcacgccagagugcacuggccuugcagaagggggaccugucggagagccuggcguagggcugacuggaggcuccccagagcccuccucuuccuuggugucuucccuaacagggauggggucacagucuuugcuaaucugaccagcaagggcugugucaggcccgcagauacacucauaggagccagggaaguuucgacauucacuggugaagcauucgccuugacugcacucaucaauguccgugcauacggaacccucguccaggaugaagccuucagggcauucacaaacaguaggagaguuagggucacagucugcugggcacgaaguuucauugcagaacauuucgcacuugugcgguucauccggcuugggugcgaagccuggagcgcagaugcaucgguagucgguggggcucacuggcuggcacugaaacucgcaguuagauccgaaacacggauccagaagcuccacgcacucuccauccaccaacucauagccaucauagcagaagcauucgaagccgcccuugguguuaacacagagcuggggacauggauugggccccugcuuacagucauccacguccucacaccgguguccgucugcagccaacugguagccugucucacacauacaggaguaagagccuggcacuucagcguugcugacacaaaaaugcucgcagaguucguugcacgauugaaccacaggucuugcacacgaacguccaucggccugcagguccaugucucuggggcagaggcaucuggguucauucgugcuccuauugcacaaguacucacagccaccauucuccacgcugcaauuccaggcuccugucgcuucccaagcccagugucccucugaaguuccgggcggggcccugcacaccagcuccaagccaaggggcuccaccgcggcggaacugccuaccggcagcguuugaaaguccgcaccacugaccccgaacgggguguuguagguacuagagaugugggcagccucaggaucgcgaguauucaccgucagaggccugcaggaagcugugaaguaaaacucacagaggaaacccugggucucagucucgcauggcuucucuucccaggccggcucgccgggugcagcuucaguugcugucgagaccgugacgcacagagggccgcagaguggagccgucuggucguugggccgcgcccaccugcuguaacuggugugguuaucgccaguaacccacuggaagccgcgcaggggcccgagaugcaccgggucgucacagcccugcgggagcuguaaaccgauccagggcccuaaauccauacugcucuggcucagcagaagggagaugacaucggcagccacugaggagcgcacugucaucaaauguccuugcaggcgcuggcaggccuggcuggcaucgaggaaggucgcggggcccuggaaaagcgcgaagcacucaugcuccacgcauugacugccugugggcugcagcuuggcuagugcggagagccccaggcuagcuggagccagcacacccagaaagaaaaucccaagcaugcuguccaggggugcaccgugcaaguuccgagaaaagcuagcccugcgcuggugcagacacccaguccaggcagagggguuuccguaugccugcggcgacagcagcuagccucuaucacaaccuagacguuucuagcccaggcuccuagucccugcgaggcagccucuaacaugccacuccgcugaagcuccaguuuauaaaugcgcggcccucccucuuugcacguucgggaaaaggaaggaagugccuggugggaagggcugaugcugcguucucggauuacuggguucuc

SEQ ID NO: 11078 - RNA, 1937 nt, Mus musculus
gagaacccaguaauccgagaacgcagcaucagcccuucccaccaggcacuuccuuccuuuucccgaacgugcaaagagggagggccgcgcauuuauaaacuggagcuucagcggaguggcauguuagaggcugccucgcagggacuaggagccugggcuagaaacgucuagguugugauagaggcuagcugcugucgccgcaggcauacggaaaccccucugccuggacugggugucugcaccagcgcagggcuagcuuuucucggaacuugcacggugcaccccuggacagcaugcuugggauuuucuuucugggugugcuggcuccagcuagccuggggcucuccgcacuagccaagcugcagcccacaggcagucaaugcguggagcaugagugcuucgcgcuuuuccagggccccgcgaccuuccucgaugccagccaggccugccagcgccugcaaggacauuugaugacagugcgcuccucaguggcugccgaugucaucucccuucugcugagccagagcaguauggauuuagggcccuggaucgguuuacagcucccgcagggcugugacgacccggugcaucucgggccccugcgcggcuuccaguggguuacuggcgauaaccacaccaguuacagcaggugggcgcggcccaacgaccagacggcuccacucugcggcccucugugcgucacggucucgacagcaacugaagcugcacccggcgagccggccugggaagagaagccaugcgagacugagacccaggguuuccucugugaguuuuacuucacagcuuccugcaggccucugacggugaauacucgcgauccugaggcugcccacaucucuaguaccuacaacaccccguucggggucaguggugcggacuuucaaacgcugccgguaggcaguuccgccgcgguggagccccuuggcuuggagcuggugugcagggccccgcccggaacuucagagggacacugggcuugggaagcgacaggagccuggaauugcagcguggagaaugguggcugugaguacuugugcaauaggagcacgaaugaacccagaugccucugccccagagacauggaccugcaggccgauggacguucgugugcaagaccugugguucaaucgugcaacgaacucugcgagcauuuuugugucagcaacgcugaagugccaggcucuuacuccuguaugugugagacaggcuaccaguuggcugcagacggacaccggugugaggacguggaugacuguaagcaggggcccaauccauguccccagcucuguguuaacaccaagggcggcuucgaaugcuucugcuaugauggcuaugaguugguggauggagagugcguggagcuucuggauccguguuucggaucuaacugcgaguuucagugccagccagugagccccaccgacuaccgaugcaucugcgcuccaggcuucgcacccaagccggaugaaccgcacaagugcgaaauguucugcaaugaaacuucgugcccagcagacugugacccuaacucuccuacuguuugugaaugcccugaaggcuucauccuggacgaggguuccguaugcacggacauugaugagugcagucaaggcgaaugcuucaccagugaaugucgaaacuucccuggcuccuaugaguguaucugcgggccugacacagcccuugcuggucagauuagcaaagacugugaccccaucccuguuagggaagacaccaaggaagaggagggcucuggggagccuccagucagcccuacgccaggcucuccgacaggucccccuucugcaaggccagugcacucuggcgugcucauuggcaucuccauugccagccugucccuggugguggcgcuuuuggcgcuucucugucaccugcgcaagaagcagggcgcugcu

SEQ ID NO: 11079 - RNA, 759 nt, Mus musculus
gaugggugucuacugucuacugagccacgugcucaauugaaccagaagauugggugucuacccaacaccacucugaaaaggccgccucagcuucucccucaaccacuuggccuucuuucuauucacccccacccccacccgggcuccuucacugguucuaaacuccuuauccuggccuucaagguuucuagagcacaacuuaguggcuucuuuuuaaucaggcuuuccuccuuccuccugugaaaaagcucucuagccucggcuuugccauuuccuugcucccgagagcaguacucgugucuucucuuauaggacaucugcccugaugcuccuggauucacggaaugugguugugggcuggguacuugccuucaagguuuuauauucgauuggaauucaaauuccuguauaaaccacuguggaagucuguccauucuacaguacaagcccaggacccacaaguccucaccagcugugcaucucacccaccuuggggcucccgcagggcuauuggggccagaccauaggaggggaggagcaacuaccuaaaauaagcauggcucugucuacaaccacgcaaggcagaagagagacagaaggcauuggacuggggagccccguguguuccaggcgcggacagcccuuccuccucucccuccaccugguccgcugcgccuggaguuugcucacagcgcagcuggaaaauguuacuucgcuggaaagguuuccacgggcacugccaggaucccagucuccgcg

SEQ ID NO: 11080 - RNA, 759 nt, Mus musculus
cgcggagacugggauccuggcagugcccguggaaaccuuuccagcgaaguaacauuuuccagcugcgcugugagcaaacuccaggcgcagcggaccagguggagggagaggaggaagggcuguccgcgccuggaacacacggggcuccccaguccaaugccuucugucucucuucugccuugcgugguuguagacagagccaugcuuauuuuagguaguugcuccuccccuccuauggucuggccccaauagcccugcgggagccccaaggugggugagaugcacagcuggugaggacuuguggguccugggcuuguacuguagaauggacagacuuccacagugguuuauacaggaauuugaauuccaaucgaauauaaaaccuugaaggcaaguacccagcccacaaccacauuccgugaauccaggagcaucagggcagauguccuauaagagaagacacgaguacugcucucgggagcaaggaaauggcaaagccgaggcuagagagcuuuuucacaggaggaaggaggaaagccugauuaaaaagaagccacuaaguugugcucuagaaaccuugaaggccaggauaaggaguuuagaaccagugaaggagcccgggugggggugggggugaauagaaagaaggccaagugguugagggagaagcugaggcggccuuuucagagugguguuggguagacacccaaucuucugguucaauugagcacguggcucaguagacaguagacacccauc

SEQ ID NO: 11081 - RNA, 538 nt, Mus musculus
ccccuuuuuccugcugcucugggagcugcaggcgcgagcugcgggccggaauugggcuacagcuggagucgggcggcgacacuccgggcagccggaaugcucuggaauccuacacgagacacuucccagaggagagccccaagaggcggagcgguccugaccgccgccugccuggccugccugggcuuccaaggacgcgcccgacucuugcccuccucugucccuuccuggagugaugaaaggccgagacuugguccugccguaaagguaaaaggacucaaaaggacagccuuggaguucccagcucucuucagggcccaacuugcucauuucccaaauaaagacucaccacagacucuuuuucaugugcuccuuuuaauugcgcaggcuuugagagaacccauccucauuugucaaacucucggacugauaagcaacagaccccagagagcugacccgugcuacacucaaagaaaagaaaacccccguagcauuaagccaaggguguuguuugggcaucagaaagacucagauccgc

SEQ ID NO: 11082 - RNA, 538 nt, Mus musculus
gcggaucugagucuuucugaugcccaaacaacacccuuggcuuaaugcuacggggguuuucuuuucuuugaguguagcacgggucagcucucuggggucuguugcuuaucaguccgagaguuugacaaaugaggauggguucucucaaagccugcgcaauuaaaaggagcacaugaaaaagagucuguggugagucuuuauuugggaaaugagcaaguugggcccugaagagagcugggaacuccaaggcuguccuuuugaguccuuuuaccuuuacggcaggaccaagucucggccuuucaucacuccaggaagggacagaggagggcaagagucgggcgcguccuuggaagcccaggcaggccaggcaggcggcggucaggaccgcuccgccucuuggggcucuccucugggaagugucucguguaggauuccagagcauuccggcugcccggagugucgccgcccgacuccagcuguagcccaauuccggcccgcagcucgcgccugcagcucccagagcagcaggaaaaagggg

SEQ ID NO: 11083 - RNA, 1454 nt, Mus musculus
ugauuugggccuuggaaauuaaacuuaaaaaaaaaaaagauuucuagaaaugaggcagaaauuucauggaaaugucaaugguuugggccuuggaaauuaaaccuuuuuaaaaaaauauucuuuuuacaucuacaaguaaaccuggaaacccuuagagacgacccuuuccaaagguggaguuuucaagggggugggaggaaggccaggcaagagggaggaggccuguccaggagugccuuccaauagcgauagcuggccuccacgggaaucucuccacccaccccuuuuugccuuuaagaaauaaacgcuccaagcgacuuuacugcucacgccucggcccucggggagcucucucuggccacucuucugucuuuaaccccugcucacagccggcuccagagcuaacaccaugaguuuccaguugcuaagggugaggagcuuacaggcagaggagggccacuggaggggaccgcggggcuggaccgggcguccguccgugggcgcagggucgcuggcgcgcuguccugccgccaaucuccccagcccuuggccaccgugggccuccucugcgccuggcggcgacuaagauaagugacuuaaggccgcggggcucaucuggccuagagguguguggaagccuaguacccuagaaggccucuagguauaugggucucccgccugcgcucggagcgcuuaggucgcuuggauaugggccccaggacgcccugggaaggugacaagcccgacuccaaguguucgaggguccccgggggcaggguagggcagucucaggauugucuccuucgggguucuagagacugggagagaggccucagauuauuguuuaaaggaagccaauucagauucaccuuugcugccgccgcagagagaaggauuuggccagcgcugagcacaggagugcggccccccgggcaggccuuggacaaaaugggucccggggagccugguaaagucaaggguucgaauuucguuuuacuuugccuguuuguaaagaguugccuaguaggaagacccaaaggcugggaaaccgcuucaggccccugcggcccugagcuagacucacugagcugaguggggcugaggucccuacaucuaugggccuacauuuauucuguuagaaauuuuaaaaaaucgaugggcauuauuuuggagcgcccgaggauuguuaucaacaacaccucugcgcuuaguucuggaagcucuuuguguuuuaaaagguaugucuuuauugugcauguguuuagagugugugcacacgcgcuguguguauggccguggauagguacgcacuguguguauggccguggaucuguggcgggaguagguucucucuuccuacccuguguuuuuaaacuuggcggcaggcgccucuauccacggagccaucccuccggcuuuugcccaaaguccggugcuugcccauucuaggacag

SEQ ID NO: 11084 - RNA, 1454 nt, Mus musculus
cuguccuagaaugggcaagcaccggacuuugggcaaaagccggagggauggcuccguggauagaggcgccugccgccaaguuuaaaaacacaggguaggaagagagaaccuacucccgccacagauccacggccauacacacagugcguaccuauccacggccauacacacagcgcgugugcacacacucuaaacacaugcacaauaaagacauaccuuuuaaaacacaaagagcuuccagaacuaagcgcagagguguuguugauaacaauccucgggcgcuccaaaauaaugcccaucgauuuuuuaaaauuucuaacagaauaaauguaggcccauagauguagggaccucagccccacucagcucagugagucuagcucagggccgcaggggccugaagcgguuucccagccuuugggucuuccuacuaggcaacucuuuacaaacaggcaaaguaaaacgaaauucgaacccuugacuuuaccaggcuccccgggacccauuuuguccaaggccugcccggggggccgcacuccugugcucagcgcuggccaaauccuucucucugcggcggcagcaaaggugaaucugaauuggcuuccuuuaaacaauaaucugaggccucucucccagucucuagaaccccgaaggagacaauccugagacugcccuacccugcccccggggacccucgaacacuuggagucgggcuugucaccuucccagggcguccuggggcccauauccaagcgaccuaagcgcuccgagcgcaggcgggagacccauauaccuagaggccuucuaggguacuaggcuuccacacaccucuaggccagaugagccccgcggccuuaagucacuuaucuuagucgccgccaggcgcagaggaggcccacgguggccaagggcuggggagauuggcggcaggacagcgcgccagcgacccugcgcccacggacggacgcccgguccagccccgcgguccccuccaguggcccuccucugccuguaagcuccucacccuuagcaacuggaaacucaugguguuagcucuggagccggcugugagcagggguuaaagacagaagaguggccagagagagcuccccgagggccgaggcgugagcaguaaagucgcuuggagcguuuauuucuuaaaggcaaaaagggguggguggagagauucccguggaggccagcuaucgcuauuggaaggcacuccuggacaggccuccucccucuugccuggccuuccucccacccccuugaaaacuccaccuuuggaaagggucgucucuaaggguuuccagguuuacuuguagauguaaaaagaauauuuuuuuaaaaagguuuaauuuccaaggcccaaaccauugacauuuccaugaaauuucugccucauuucuagaaaucuuuuuuuuuuuuaaguuuaauuuccaaggcccaaauca

SEQ ID NO: 11085 - RNA, 841 nt, Mus musculus
ugggguagggugagccgcaccgcccccccuggccaggagaggagcggaaccccgccagaccugugacaguugccuuccagagagagccugggaccuggcguucccaguccugagcuugaugcgggcagcaccaguucuuucuggagcaggugcccucuucucccgcuaauuccagggccucuguuuuggaggcucggucuggauugccugccuuuuuaacuuagccggaaaagcccccuugauucccgcgguuucaacuuccugggucuguuagggucaacuggccagaaagcuauuuugcaugcggcuauucucuaagaccaugggggaacgguuggcuugaacaucuauuuuaauuuuaguuacuuuacuucaggccuaucugggucuagggaaaugcuuacagacgaggagcaggaagagagcaaauuauuuuagucuguggauacgggaggcacguucccaacagguccuggccacugggcugauggguaucaagaauuguguaauuggcuucggaaucaauccgaaauagucccugccuccaauuccacuguuugaagccaaucuccauauacuguugggacggacuaacaagauuagcucucgagaacuguggacuuucuguuugggaugaaaaaaauuaacuauaacaauuaggccaauuauuuucguuucguugaauuaaaaaauaacacugaguauugcuuuuuggcuuggacggaaaaucuuggggugcagcagcauucuguggauagaagcuuugcuuucugccucccaugggacgaggugugcccauaucucagggcgaccucccuguagucccccucccacuuuacag

SEQ ID NO: 11086 - RNA, 841 nt, Mus musculus
cuguaaagugggagggggacuacagggaggucgcccugagauaugggcacaccucgucccaugggaggcagaaagcaaagcuucuauccacagaaugcugcugcaccccaagauuuuccguccaagccaaaaagcaauacucaguguuauuuuuuaauucaacgaaacgaaaauaauuggccuaauuguuauaguuaauuuuuuucaucccaaacagaaaguccacaguucucgagagcuaaucuuguuaguccgucccaacaguauauggagauuggcuucaaacaguggaauuggaggcagggacuauuucggauugauuccgaagccaauuacacaauucuugauacccaucagcccaguggccaggaccuguugggaacgugccucccguauccacagacuaaaauaauuugcucucuuccugcuccucgucuguaagcauuucccuagacccagauaggccugaaguaaaguaacuaaaauuaaaauagauguucaagccaaccguucccccauggucuuagagaauagccgcaugcaaaauagcuuucuggccaguugacccuaacagacccaggaaguugaaaccgcgggaaucaagggggcuuuuccggcuaaguuaaaaaggcaggcaauccagaccgagccuccaaaacagaggcccuggaauuagcgggagaagagggcaccugcuccagaaagaacuggugcugcccgcaucaagcucaggacugggaacgccaggucccaggcucucucuggaaggcaacugucacaggucuggcgggguuccgcuccucuccuggccagggggggcggugcggcucacccuacccca

SEQ ID NO: 11087 - RNA, 538 nt, Mus musculus
uaagggagugagagggggaugauccuuggggcggggaaacgcgcccuucgucggcguugcgcauuauccgcgcuauuugcgcgccgcagcgacaugggaggaggguuguugaacgagggcgcugugcgccgaggucgccgcacgccgaaccccuggggcacggguaaccggacuguggcgcggaacgcgcucuuggcaccuccaagcgacgcagcgcgggaaccuucgccagagggcucgaaggauucguccccucaggucuuagaccgauaggcucacaacgaaguccggggagcucauuguccccgggggcucucgggcucuggggcggaucgagacggguggugugagcuugguggggcgcauaggugccccucuccuggcuugcuuguucgcuguagcaggguuucguacuaaccgggucucuccuguuucucucccaggaucgccacgacucgagcaguaauggcaacccucgcaucccucaccucuccucuccgggacaacaucucuacagucccgcgccgccucucucgca

SEQ ID NO: 11088 - RNA, 538 nt, Mus musculus
ugcgagagaggcggcgcgggacuguagagauguugucccggagaggagaggugagggaugcgaggguugccauuacugcucgagucguggcgauccugggagagaaacaggagagacccgguuaguacgaaacccugcuacagcgaacaagcaagccaggagaggggcaccuaugcgccccaccaagcucacaccacccgucucgauccgccccagagcccgagagcccccggggacaaugagcuccccggacuucguugugagccuaucggucuaagaccugaggggacgaauccuucgagcccucuggcgaagguucccgcgcugcgucgcuuggaggugccaagagcgcguuccgcgccacaguccgguuacccgugccccagggguucggcgugcggcgaccucggcgcacagcgcccucguucaacaacccuccucccaugucgcugcggcgcgcaaauagcgcggauaaugcgcaacgccgacgaagggcgcguuuccccgccccaaggaucaucccccucucacucccuua

SEQ ID NO: 11089 - RNA, 556 nt, Mus musculus
ugcacaucgagcagugaagucguagagcgcgcggaagagucgggcgcguggggcugggaagcuacaagguucaacggcagcggcuugcuccggcacuggguugucgucgugucccuggauccuggggaugucuuccuccgauucauccgcuggccauaucuuaucccagaaaaaggacaagaaagugagccgcuuccugaggaagggcuccaugccuagggggccugguugcggacgaaagcgcauggagccgaccucgggucaguacucugggaccuccgugcugccgcugaagaagcugagcacuacaaccaugcaccaggaucccagggugcaagagagaaaccggaaaggcuggugggacagccaggcuuaccccgggcuuucugcccacgucccuauuugguacagaaugggaagcgacaggugacacggacccuaacccuaaccccggaggucacuacagagugcuccuuaaucaggcauacaacagucaguuucccggaugguguaucaaugcguggggcggacggugaccuccgucccaggaccacac

SEQ ID NO: 11090 - RNA, 556 nt, Mus musculus
gugugguccugggacggaggucaccguccgccccacgcauugauacaccauccgggaaacugacuguuguaugccugauuaaggagcacucuguagugaccuccgggguuaggguuaggguccgugucaccugucgcuucccauucuguaccaaauagggacgugggcagaaagcccgggguaagccuggcugucccaccagccuuuccgguuucucucuugcacccugggauccuggugcaugguuguagugcucagcuucuucagcggcagcacggaggucccagaguacugacccgaggucggcuccaugcgcuuucguccgcaaccaggcccccuaggcauggagcccuuccucaggaagcggcucacuuucuuguccuuuuucugggauaagauauggccagcggaugaaucggaggaagacauccccaggauccagggacacgacgacaacccagugccggagcaagccgcugccguugaaccuuguagcuucccagccccacgcgcccgacucuuccgcgcgcucuacgacuucacugcucgaugugca

SEQ ID NO: 11091 - RNA, 2888 nt, Mus musculus
uacaguccuuaugcauggaugcuagugaucacugaaacccuuuuaaagaaaaaaguuuaauuaaaaauuaaauauauuguauuauauauguauauauauauaaaggcaaaguaaaaaacacagucucauucuagaaaauacauagcagaaaagaauuagaugauucaaaaacaacccuggcagaggcagcuagcacguccagggccugagguuccuagggaaggcccaaagcacaggaacccccagaaggagguguguaaaugaggaggcgacagaaauggcaucuuuaggccaccagcucuaaaggcuguugcauacccuaacauacauaugcgaaaggaagggagcaggcaacucugccacuuggccacaugcagaagcgguggagggcaaggacagugucuagccugagaugcaagcacuguaauagaccgcgcugcuagcaucagacagcgcagaaaugaggcugcucucuucuggacaggacauggcgcgcggaccuaguuuggccagugccacgugguaggggaguguaguggcauccggucgaguccggcugcaauugagauacuggucaaauucggugagguccacaucggcccaaaggucggcgguaggcuccaguugcucugugcccucaagagacggggacucaggugguggugacagaggauugggaaacgggcccggagugcccagggugccauaguagagaccugcgaguggcgcggcaggcggcgcuguccugagcgcuucagccaggggcgccccguagcagaagcucgggucccgugccagcucaggggcauagggugcccggaaagcccgcagagcgcaguccucgggcgccaaaggcggugggaagaaggaggccucgccaggcuccaggccguccagaggcgagcgcucgggcguggguagccccaagccaucgaacuccgcacccagaguggguagcucgcggaaggagcgagcugacccugacgcugcagcgaaggccucgggcggcgcagacggcugcacgaggcccgggagcaagaggcccggcuccagccuccggaccuugcgcgccuguuuuuugcggcgaggccgguacuuguaguugggauggucgcgcaagugcugcacacgcagccguucggccucuuccacgaagggccgcuucuccgccguguucagcuccuuccacgcuuugccuguaggcgaagggagccuguuaguggaccagugucgggcgcacgacuagccaaaccgucgugcgccuugggcgcgcggcgugaaacauggcauagaccccagcgaccagccauaaaaucccgaaucccgacccucucccaaaguccccucccucgccgccccucuaagcauucgaggcucucacccagcaucuugcucaguacugcguugugcagauccggauuuuguugcgccagucgcuugcgcucguccuucgcccacaccaugaaggcguucaugggccgccgaaugcgcaacucgucggcaguuuggcgcucuccgcggccaaagccauagcgcccugauucggggcugcgcggugggcuccgcggaaggcuggacggggaggcgggcgaggugggcgagacguuggugacagggaggccgcgcgccucagcagcggccccgauuccaggggcccaugcacagucgcggcgggagggcgggucguccugugcgccguagccgggcggcgaucucugcauuccagcugggcaaggccugggcggaacgcggcgcgggagcgcaggagacaguggcgggcacugcaaagccaaguacggaggucugauggacgucggguggagacacuggggacgugguagcuucgugccaggaaggcaucccagauauagagacaucgggccaauccgcagcagagcuggcggaccggggcggggcugccccccuccgcgguggcucccuuuuuucuucccggcaggauccagcugaggccuccccagcgcagagccccccaucugcucccacugucucaaaagaagagacccccgugugggagaggacugcuggugugggcuaggucucagaaggagggguccuccaggguuuucagguuucagagccgcgcuggcaccccauccacagaaacagaccccugggcaguaaugaugggagagggcagcggcuuuagauuggaugaaggaagauuuaauuuagcaccaaguucuagggagguuacuuucaucguguaccucgggaaaaggaaugggauuuggcgauguucuugccucuucuuguggguuuacccucccagaugcugagcucagcuagguaguuccaacgccuuucccuaauuuugucguugaggcugaagaaacgaugugucuuuucucucucucucauaaccaaacucugggacaaagcagaacucuuggcccacaaggaaaagguaaacugguggacacaggacauagccagucccugcuccucagaauuugugugugggcugcuguuucccuuccccgggccagacaaggaaaacacaagggccugagcaggugaggcagaggaaaacugggaguuuuccaaaggagcccucauucauguucucuuuuuaucuguucagccucuucacuaggaaaggaucugggcccuggaaacugauggcuuucuccugagagcugcccccuuugcacugccaaguguaacuucauagaggaaaacccuuggcagcuguucgugacaagucagaaacuccaucuacacguacccugagcacucugcgaccuucccugucaugucaggauagcccaccuugagcauugaaagagagagccuguguggcuucuggggcugcucacacauacaaguccuauggaacccugcgcugcuccugaguggucccuuuguuu

SEQ ID NO: 11092 - RNA, 2888 nt, Mus musculus
aaacaaagggaccacucaggagcagcgcaggguuccauaggacuuguaugugugagcagccccagaagccacacaggcucucucuuucaaugcucaaggugggcuauccugacaugacagggaaggucgcagagugcucaggguacguguagauggaguuucugacuugucacgaacagcugccaaggguuuuccucuaugaaguuacacuuggcagugcaaagggggcagcucucaggagaaagccaucaguuuccagggcccagauccuuuccuagugaagaggcugaacagauaaaaagagaacaugaaugagggcuccuuuggaaaacucccaguuuuccucugccucaccugcucaggcccuuguguuuuccuugucuggcccggggaagggaaacagcagcccacacacaaauucugaggagcagggacuggcuauguccuguguccaccaguuuaccuuuuccuugugggccaagaguucugcuuugucccagaguuugguuaugagagagagagaaaagacacaucguuucuucagccucaacgacaaaauuagggaaaggcguuggaacuaccuagcugagcucagcaucugggaggguaaacccacaagaagaggcaagaacaucgccaaaucccauuccuuuucccgagguacacgaugaaaguaaccucccuagaacuuggugcuaaauuaaaucuuccuucauccaaucuaaagccgcugcccucucccaucauuacugcccaggggucuguuucuguggauggggugccagcgcggcucugaaaccugaaaacccuggaggaccccuccuucugagaccuagcccacaccagcaguccucucccacacgggggucucuucuuuugagacagugggagcagauggggggcucugcgcuggggaggccucagcuggauccugccgggaagaaaaaagggagccaccgcggaggggggcagccccgccccgguccgccagcucugcugcggauuggcccgaugucucuauaucugggaugccuuccuggcacgaagcuaccacguccccagugucuccacccgacguccaucagaccuccguacuuggcuuugcagugcccgccacugucuccugcgcucccgcgccgcguuccgcccaggccuugcccagcuggaaugcagagaucgccgcccggcuacggcgcacaggacgacccgcccucccgccgcgacugugcaugggccccuggaaucggggccgcugcugaggcgcgcggccucccugucaccaacgucucgcccaccucgcccgccuccccguccagccuuccgcggagcccaccgcgcagccccgaaucagggcgcuauggcuuuggccgcggagagcgccaaacugccgacgaguugcgcauucggcggcccaugaacgccuucauggugugggcgaaggacgagcgcaagcgacuggcgcaacaaaauccggaucugcacaacgcaguacugagcaagaugcugggugagagccucgaaugcuuagaggggcggcgagggaggggacuuugggagagggucgggauucgggauuuuauggcuggucgcuggggucuaugccauguuucacgccgcgcgcccaaggcgcacgacgguuuggcuagucgugcgcccgacacugguccacuaacaggcucccuucgccuacaggcaaagcguggaaggagcugaacacggcggagaagcggcccuucguggaagaggccgaacggcugcgugugcagcacuugcgcgaccaucccaacuacaaguaccggccucgccgcaaaaaacaggcgcgcaagguccggaggcuggagccgggccucuugcucccgggccucgugcagccgucugcgccgcccgaggccuucgcugcagcgucagggucagcucgcuccuuccgcgagcuacccacucugggugcggaguucgauggcuuggggcuacccacgcccgagcgcucgccucuggacggccuggagccuggcgaggccuccuucuucccaccgccuuuggcgcccgaggacugcgcucugcgggcuuuccgggcacccuaugccccugagcuggcacgggacccgagcuucugcuacggggcgccccuggcugaagcgcucaggacagcgccgccugccgcgccacucgcaggucucuacuauggcacccugggcacuccgggcccguuucccaauccucugucaccaccaccugaguccccgucucuugagggcacagagcaacuggagccuaccgccgaccuuugggccgauguggaccucaccgaauuugaccaguaucucaauugcagccggacucgaccggaugccacuacacuccccuaccacguggcacuggccaaacuagguccgcgcgccauguccuguccagaagagagcagccucauuucugcgcugucugaugcuagcagcgcggucuauuacagugcuugcaucucaggcuagacacuguccuugcccuccaccgcuucugcauguggccaaguggcagaguugccugcucccuuccuuucgcauauguauguuaggguaugcaacagccuuuagagcugguggccuaaagaugccauuucugucgccuccucauuuacacaccuccuucuggggguuccugugcuuugggccuucccuaggaaccucaggcccuggacgugcuagcugccucugccaggguuguuuuugaaucaucuaauucuuuucugcuauguauuuucuagaaugagacuguguuuuuuacuuugccuuuauauauauauacauauauaauacaauauauuuaauuuuuaauuaaacuuuuuucuuuaaaaggguuucagugaucacuagcauccaugcauaaggacugua

SEQ ID NO: 11093 - RNA, 2122 nt, Mus musculus
uuuccccagcacaacuuuccgcuacuaucaaacaaccaacuccuucggggaggcugugggauuucccccaagcucagaagagguggcugguuaauaccuaggggaaucaaguugagcaaaacuguuguggagcuuuggaugauuggaaggcaucagaggugggacaagggaaaccgggaugccucaugccaucauguuuuguaaaaucuccuccuggauguuacccuggaagauacucggagccaguuagagcgccuaucaagcugguauuugcuacaccgugugccuuuuaaauaccuucuccagaacccgaaggaauucaggcaucuuaaggaaaguuagagagcacaagaaaaacacacaccggcaaacgaaguuagacuuuaaugaagacuuuuagccagucugugcagaauccccauggugcuagccuccaaucuuguguuaguagccugauaggagccucucauuagccuaaguuuauagagacccuuccuuuaugaucccucugaaaacaaagcugcuaauugacaaacaacaacacuagcgcgucugugucuuuagcuuccuaaagggacaggcuaacagcugcgaggaacagaggagggagagaggaggcggcgagcccagagcgcaaaagaggcaccgccccgcaccaaagcggcuaugguccacagcuauacacauuggcaggccuucuguuaaccgcaggaucucaagcaauacagcuuccagcaguccguuugcggguuccgauucagccgaaggaacaccaguuacagaugacuuuuccauucugcaaggguagaaccaagguuccuuuccauccuuuccaggugacaauguagacauuucugugucgcccucacguuuccuguaugaaauaaggugcccaacuguucugauauuaccauucaaaaacagguucugagaugaaccucauuugugaaucuauuacagagauuaauagauuauuucucccuuuucaacuaauucucaguggggaaauuuaaccauaugguaaggagagaauuagaauuucaucacauuagagcaaaauauaaugaaaagaguccaacaccuggggccaacucugaaagccacaauuaaaagguuuuuuaaugaaaccagagaaaccccaaacugcacagccuucaguaauucugccagauaagagggaauacgguuuuuacuuauaaggaugaaaacuagccacuaaauaucgugugcuucgagaaacuggacucagaagcacgaggaccacguguacuaucuccauccagacagcucuuguuuccacaauucugcccugaacuaacccugcaggaacagcccagacggauccagauguccccaaacgucuucagagcagcuaaaugcacgaaugcccccacuuggugugugagaagauuccacucugaauguucccucuugcgaagcaacuggauuuaaucuugaggaaaguuugagacuaguuuuucuuuucuuucuguccacgaagcagugagcuucucucaccaccaacuuaacagcgugggggacucggcaaaggccucccccacuccgcccccuccgaguuuuaaaucaaacgggcuauguaagcaacuuggucaucauuuuguugcuuucuuuaauuguuugauuuuuuuuccaucuauauaggaaauggacaguggagggcugugggaaaaguggugcggagaaaaucuggguuggcucuugcauugcugacauacuagcugaaaaucuaggguaaauucgagacaagccagcagggaccucaccccuacccccagcccccagguuccaucuauaaaugcagacaugcuauuaacagggagauauagaauucucuccuaugaggguaacuaagcaagcugagacaguaguggcccagugaaggguaguguguggggggugcucagugggggcgggggcuuuccacuggacucccagucuuuaccgcggauauacaauuugcugaaggagcaaagaacauccucggcucuaaguagggcuuuuagugugcucauugaugagugaaagucgccacacaugucaagcuaaaggcaguuguuggguuacuaacaggacccagcgccuugcaaacauaugcgcuaag

SEQ ID NO: 11094 - RNA, 2122 nt, Mus musculus
cuuagcgcauauguuugcaaggcgcuggguccuguuaguaacccaacaacugccuuuagcuugacauguguggcgacuuucacucaucaaugagcacacuaaaagcccuacuuagagccgaggauguucuuugcuccuucagcaaauuguauauccgcgguaaagacugggaguccaguggaaagcccccgcccccacugagcaccccccacacacuacccuucacugggccacuacugucucagcuugcuuaguuacccucauaggagagaauucuauaucucccuguuaauagcaugucugcauuuauagauggaaccugggggcuggggguaggggugaggucccugcuggcuugucucgaauuuacccuagauuuucagcuaguaugucagcaaugcaagagccaacccagauuuucuccgcaccacuuuucccacagcccuccacuguccauuuccuauauagauggaaaaaaaaucaaacaauuaaagaaagcaacaaaaugaugaccaaguugcuuacauagcccguuugauuuaaaacucggagggggcggagugggggaggccuuugccgagucccccacgcuguuaaguugguggugagagaagcucacugcuucguggacagaaagaaaagaaaaacuagucucaaacuuuccucaagauuaaauccaguugcuucgcaagagggaacauucagaguggaaucuucucacacaccaagugggggcauucgugcauuuagcugcucugaagacguuuggggacaucuggauccgucugggcuguuccugcaggguuaguucagggcagaauuguggaaacaagagcugucuggauggagauaguacacgugguccucgugcuucugaguccaguuucucgaagcacacgauauuuaguggcuaguuuucauccuuauaaguaaaaaccguauucccucuuaucuggcagaauuacugaaggcugugcaguuugggguuucucugguuucauuaaaaaaccuuuuaauuguggcuuucagaguuggccccagguguuggacucuuuucauuauauuuugcucuaaugugaugaaauucuaauucucuccuuaccauaugguuaaauuuccccacugagaauuaguugaaaagggagaaauaaucuauuaaucucuguaauagauucacaaaugagguucaucucagaaccuguuuuugaaugguaauaucagaacaguugggcaccuuauuucauacaggaaacgugagggcgacacagaaaugucuacauugucaccuggaaaggauggaaaggaaccuugguucuacccuugcagaauggaaaagucaucuguaacugguguuccuucggcugaaucggaacccgcaaacggacugcuggaagcuguauugcuugagauccugcgguuaacagaaggccugccaauguguauagcuguggaccauagccgcuuuggugcggggcggugccucuuuugcgcucugggcucgccgccuccucucucccuccucuguuccucgcagcuguuagccugucccuuuaggaagcuaaagacacagacgcgcuaguguuguuguuugucaauuagcagcuuuguuuucagagggaucauaaaggaagggucucuauaaacuuaggcuaaugagaggcuccuaucaggcuacuaacacaagauuggaggcuagcaccauggggauucugcacagacuggcuaaaagucuucauuaaagucuaacuucguuugccgguguguguuuuucuugugcucucuaacuuuccuuaagaugccugaauuccuucggguucuggagaagguauuuaaaaggcacacgguguagcaaauaccagcuugauaggcgcucuaacuggcuccgaguaucuuccaggguaacauccaggaggagauuuuacaaaacaugauggcaugaggcaucccgguuucccuugucccaccucugaugccuuccaaucauccaaagcuccacaacaguuuugcucaacuugauuccccuagguauuaaccagccaccucuucugagcuugggggaaaucccacagccuccccgaaggaguugguuguuugauaguagcggaaaguugugcuggggaaa

SEQ ID NO: 11095 - RNA, 274 nt, Mus musculus
cuucuucgaaaaccucgagaccgaccccaaagcuagaggaaagugagaagcugcuccccauuccuuuuccuuugguccucuccuaaguugugaaacacuugcagggcaaacaaagcagaggcaggaacuuagaaguaucagagacaaaccggacauucagccuuggcaagcccggaaucucggucuuugggguggggagggaggggagagggagguuuagugcggaugaagugugcuuccuuuuuccccucagaaaaguggcaacuuugguggc

SEQ ID NO: 11096 - RNA, 274 nt, Mus musculus
gccaccaaaguugccacuuuucugaggggaaaaaggaagcacacuucauccgcacuaaaccucccucuccccucccuccccaccccaaagaccgagauuccgggcuugccaaggcugaauguccgguuugucucugauacuucuaaguuccugccucugcuuuguuugcccugcaaguguuucacaacuuaggagaggaccaaaggaaaaggaauggggagcagcuucucacuuuccucuagcuuuggggucggucucgagguuuucgaagaag

SEQ ID NO: 11097 - RNA, 2473 nt, Mus musculus
aaucuagcuacagacaagggaaacugcaaacaggugaacuuguuuuaauuaaaaggcuccauuuuuaguuggguagauaucaucgacuccguugagcaauacuucuuaaauuccucucagcaaaugcaaauggggaaaaccuagguuaaaaagagaagagacucugccuaagguuuggaaacauucugacugcgaacacgaacacgagugaagacuaaagaacucccccagcugaagccagcagucagucaguaagcaaaguucuaacuugcacuaaaaagaccccagggauuaacgggcauuaauuaccuuacucuaaaugcaaguuagugacuuuguucuagaagccccuuugacuucgcuaauugguggaugaccauuaguacaacuggauagcucaucagaggugaacagacaagugggcuuuucagcaaagagaaccacuugucuucaccaagucuuuuccaaaugucaauaugcuucaaguuauaccaaagcugggagauuucaucuugcuuuucaaccugucuagguggccuggguggguuucugccggcagcaguuuccuaccuuugguuucuaugcuucuauccacgaggggggauuaauuagccgggcugaagcuggaggaggcugucgugacgagcccaguggcgauuggccgcccgccugccuggcccugccuuuauaauuuccacacgagugcaucugggcucuuacacaaaccaacagcagcuucuucugacagacacacacucacccccgacgcacacucugcacacuuuuccucuaccugauuaacaguccugcacacaccaugauuacgggaaaacguaaauaaauacggaaaggggugauuauuuugacuacuggaagagcuuugcugggucucagcauaacuuuuguuuuuauuaccgagaaggugcucucuccacgcgucucucucugacacggauucuuuagcggaggggagaaaaggggagagcucagccuuucacuuuaagacccgcuagucucgagcgggggaaaaaaggccagcagggcagggcggcccccugcugcagcuaguccgagagaggcucggugccuuuugagcgugguccccuuucuccaccgaaguuggcuccagcgcuagcagccgcauuggaucccacagccuauugcgagacuccgguguacaauccggaucucugccccaacaugaucgcggcccaggccaagcuggucuaccaccugaauaaguacuacaacgagaaaugccaggccaggaaagcugccaucgccaaaaccauccgggaagucugcaaaguggucuccgacguccugaaggagguugaagugcaggaaccgcguuucaucagcucccucaaugagauggacaaccgcuacgagggccuggagguuaucucucccaccgaguucgaggugguacucuaucugaaccagauggggguguuuaacuucguggacgacggcucccugccuggcugugcggugcugaaacugagcgaugggcgcaagaggagcaugucccucuggguggaauucaucaccgccucuggcuaccucucggcacgcaaaauccguuccagguuucagacacugguggcucaggcgguggacaaguguagcuacagagauguaguaaagaugguggcugacacgagcgaagugaaacugagaauccgagauagguauguggugcagaucaccccggccuuuaaaugcaccgggauuuggccgcggagugcugcccacuggccgcuuccccacauccccuggccaggacccaaccggguggcagagguuaaggcugaaggguucaauuuguuguccaaggagugccacucccuggccggcaagcagaguucggcugagagcgaugcuugggugcugcaguuugcagaggccgagaacagacugcagauggggggcugcaggaagaaaugccucucuauccugaaaacccugcgugaucgccaccuggaguugccaggccagccccugaacaacuaccacaugaagacucugguguccuacgagugcgagaagcauccucgagagucggacugggacgaaucuugccugggcgaucggcugaacggaauucuucugcagcucaucucaugccugcagugccggcgguguccccauuacuucuuaccgaacuuagaucuguuucaaggcaaaccccacucggccuuggaaaacgcugcuaaacaaacguggcgacuggcaagagagauccugaccaacccaaaaaguuuggaaaaacuuuagaggaugaucuaauccagggcugacaagaaugagcauucuucucaaagucccgacgaaaugaaaacuuccugguugauuccuauguacuauuucucgagacagugcaaacaaucucuuccuuuaaaaggaguaacaacacaacauuuaaccaucaucucacacaggggaaaaaccacaccacaagcaucuuuau

SEQ ID NO: 11098 - RNA, 2473 nt, Mus musculus
auaaagaugcuuguggugugguuuuuccccugugugagaugaugguuaaauguuguguuguuacuccuuuuaaaggaagagauuguuugcacugucucgagaaauaguacauaggaaucaaccaggaaguuuucauuucgucgggacuuugagaagaaugcucauucuugucagcccuggauuagaucauccucuaaaguuuuuccaaacuuuuuggguuggucaggaucucucuugccagucgccacguuuguuuagcagcguuuuccaaggccgagugggguuugccuugaaacagaucuaaguucgguaagaaguaauggggacaccgccggcacugcaggcaugagaugagcugcagaagaauuccguucagccgaucgcccaggcaagauucgucccaguccgacucucgaggaugcuucucgcacucguaggacaccagagucuucaugugguaguuguucaggggcuggccuggcaacuccagguggcgaucacgcaggguuuucaggauagagaggcauuucuuccugcagccccccaucugcagucuguucucggccucugcaaacugcagcacccaagcaucgcucucagccgaacucugcuugccggccagggaguggcacuccuuggacaacaaauugaacccuucagccuuaaccucugccacccgguuggguccuggccaggggauguggggaagcggccagugggcagcacuccgcggccaaaucccggugcauuuaaaggccggggugaucugcaccacauaccuaucucggauucucaguuucacuucgcucgugucagccaccaucuuuacuacaucucuguagcuacacuuguccaccgccugagccaccagugucugaaaccuggaacggauuuugcgugccgagagguagccagaggcggugaugaauuccacccagagggacaugcuccucuugcgcccaucgcucaguuucagcaccgcacagccaggcagggagccgucguccacgaaguuaaacacccccaucugguucagauagaguaccaccucgaacucggugggagagauaaccuccaggcccucguagcgguuguccaucucauugagggagcugaugaaacgcgguuccugcacuucaaccuccuucaggacgucggagaccacuuugcagacuucccggaugguuuuggcgauggcagcuuuccuggccuggcauuucucguuguaguacuuauucaggugguagaccagcuuggccugggccgcgaucauguuggggcagagauccggauuguacaccggagucucgcaauaggcugugggauccaaugcggcugcuagcgcuggagccaacuucgguggagaaaggggaccacgcucaaaaggcaccgagccucucucggacuagcugcagcagggggccgcccugcccugcuggccuuuuuucccccgcucgagacuagcgggucuuaaagugaaaggcugagcucuccccuuuucuccccuccgcuaaagaauccgugucagagagagacgcguggagagagcaccuucucgguaauaaaaacaaaaguuaugcugagacccagcaaagcucuuccaguagucaaaauaaucaccccuuuccguauuuauuuacguuuucccguaaucauggugugugcaggacuguuaaucagguagaggaaaagugugcagagugugcgucgggggugagugugugucugucagaagaagcugcuguugguuuguguaagagcccagaugcacucguguggaaauuauaaaggcagggccaggcaggcgggcggccaaucgccacugggcucgucacgacagccuccuccagcuucagcccggcuaauuaauccccccucguggauagaagcauagaaaccaaagguaggaaacugcugccggcagaaacccacccaggccaccuagacagguugaaaagcaagaugaaaucucccagcuuugguauaacuugaagcauauugacauuuggaaaagacuuggugaagacaagugguucucuuugcugaaaagcccacuugucuguucaccucugaugagcuauccaguuguacuaauggucauccaccaauuagcgaagucaaaggggcuucuagaacaaagucacuaacuugcauuuagaguaagguaauuaaugcccguuaaucccuggggucuuuuuagugcaaguuagaacuuugcuuacugacugacugcuggcuucagcugggggaguucuuuagucuucacucguguucguguucgcagucagaauguuuccaaaccuuaggcagagucucuucucuuuuuaaccuagguuuuccccauuugcauuugcugagaggaauuuaagaaguauugcucaacggagucgaugauaucuacccaacuaaaaauggagccuuuuaauuaaaacaaguucaccuguuugcaguuucccuugucuguagcuagauu

SEQ ID NO: 11099 - RNA, 1069 nt, Mus musculus
ggauaaccuacagucaaguggugguguggacuuuaccaucacucccaacauuucucaaguuaacuacuaaaugaacaaacguaauaacaagagcacuaaucacaacacaagcuugcagguuccguucaugagucacuaguguauauagucucuuuuuuccccccuugaaaaagaacacggguuagaaaaugucugcauaauucuuuaugucuacaaaccaaggcuugccucuugggaaaggauuggcagauguagcagaagggcuguuugccuagauugcagcugggccuuugacaagugcuucggguaaaagacuugguguuguauguacccaccaaacgccaggcaggaccgugcgcuggugcuguggauuucaaagauaacuccugggaggaagcuggaaaaucaggauauuaucucccacacauacgcucagaagccaacauccccgcggccgcucccucagaugcgccagaaggucaaugagugguaccugcaaagccaacuaacuauccaccaagcuacuuuuccagcaccagcaccagcucagagagaaguuggcggugcgcuuccccuuaacuguaccuugcaacugggcagagagagaguccuggugcugcugguacuugagcgccacugccucagcuuugcgcagcugcgucugcaguuccaaguagagcaucgcgccauagaggaagccgaagaccaccgugagaagcagcagcgucuggaagauccgcuucugcuuucgggagcacaucccguuucccauagucccuccugugccccgcgcugcggcggcgggagccgucguguccucgguccucggcugcgucggacagcucagcaacggccaccgcgagaaguagcuggacacggcaugagcagaagacgcgagacacaaaagccggaccagagaggaagaggcggccgcucagcccccgcggccggcugggcgccaggucaucgacgccacccggccagcagccaccaaacuucugcgaugucggauuuccgcgaguggcugggcccgcguggagucucuuugcauacuucagagcccgcugcc

SEQ ID NO: 11100 - RNA, 1069 nt, Mus musculus
ggcagcgggcucugaaguaugcaaagagacuccacgcgggcccagccacucgcggaaauccgacaucgcagaaguuugguggcugcuggccggguggcgucgaugaccuggcgcccagccggccgcgggggcugagcggccgccucuuccucucugguccggcuuuugugucucgcgucuucugcucaugccguguccagcuacuucucgcgguggccguugcugagcuguccgacgcagccgaggaccgaggacacgacggcucccgccgccgcagcgcggggcacaggagggacuaugggaaacgggaugugcucccgaaagcagaagcggaucuuccagacgcugcugcuucucacgguggucuucggcuuccucuauggcgcgaugcucuacuuggaacugcagacgcagcugcgcaaagcugaggcaguggcgcucaaguaccagcagcaccaggacucucucucugcccaguugcaagguacaguuaaggggaagcgcaccgccaacuucucucugagcuggugcuggugcuggaaaaguagcuugguggauaguuaguuggcuuugcagguaccacucauugaccuucuggcgcaucugagggagcggccgcggggauguuggcuucugagcguaugugugggagauaauauccugauuuuccagcuuccucccaggaguuaucuuugaaauccacagcaccagcgcacgguccugccuggcguuugguggguacauacaacaccaagucuuuuacccgaagcacuugucaaaggcccagcugcaaucuaggcaaacagcccuucugcuacaucugccaauccuuucccaagaggcaagccuugguuuguagacauaaagaauuaugcagacauuuucuaacccguguucuuuuucaaggggggaaaaaagagacuauauacacuagugacucaugaacggaaccugcaagcuuguguugugauuagugcucuuguuauuacguuuguucauuuaguaguuaacuugagaaauguugggagugaugguaaaguccacaccaccacuugacuguagguuaucc

SEQ ID NO: 11101 - RNA, 775 nt, Mus musculus
gcucuccuugcccuaaucuguugccauacggaguuagagauauccacccaugcgccaagauuccuccuugguucuaacaguuccucuuagguaguuaagaaagccaaacaaaaguggcaagccuuuuuuuaagauucuugcucugcguccccgcuucugaaagcauuuaccaugauuggguccuagugaugagcacccaggcucagccucucucugcacguucuugucccacuggauaaaaacaaacgauacacguugaucaccuuuugagauuguuuuuuuguccuucgccaauguagguuuggagauaaaaaaacgaagacugucugggagcgaguggaacccugacuauugguuuuaacuccccagguguuugggggagagaggcuaaaggcaaucaacaggacucaucucucugucacuaucugcuuuuaucuuaggagugguuuuaauuagcuggggaaaaaaucaugcagaagaguucccucaaguuuuuagaaaacagagggaaguucauaggcaaaaaccaucaaagcaaugaaaaccucaugcacucuugauacuuuuccugaaaggaaaaaguauacaaugugucugagcugauuugggccccggagauagaaaagggggcuuccuuaccccucucuggcugcagccgcaucucccuuucaaucgcuaauuuuuuuccugcagacaucauuaguuaaagaaaauacaaaguuguuuagcaaucuuuccuggcaggcaccaugagucugcaaucaucuuauugguu

SEQ ID NO: 11102 - RNA, 775 nt, Mus musculus
aaccaauaagaugauugcagacucauggugccugccaggaaagauugcuaaacaacuuuguauuuucuuuaacuaaugaugucugcaggaaaaaaauuagcgauugaaagggagaugcggcugcagccagagagggguaaggaagcccccuuuucuaucuccggggcccaaaucagcucagacacauuguauacuuuuuccuuucaggaaaaguaucaagagugcaugagguuuucauugcuuugaugguuuuugccuaugaacuucccucuguuuucuaaaaacuugagggaacucuucugcaugauuuuuuccccagcuaauuaaaaccacuccuaagauaaaagcagauagugacagagagaugaguccuguugauugccuuuagccucucucccccaaacaccuggggaguuaaaaccaauagucaggguuccacucgcucccagacagucuucguuuuuuuaucuccaaaccuacauuggcgaaggacaaaaaaacaaucucaaaaggugaucaacguguaucguuuguuuuuauccagugggacaagaacgugcagagagaggcugagccugggugcucaucacuaggacccaaucaugguaaaugcuuucagaagcggggacgcagagcaagaaucuuaaaaaaaggcuugccacuuuuguuuggcuuucuuaacuaccuaagaggaacuguuagaaccaaggaggaaucuuggcgcauggguggauaucucuaacuccguauggcaacagauuagggcaaggagagc

SEQ ID NO: 11103 - RNA, 831 nt, Mus musculus
ugagguggaugaccagagaggguuagagcuaacucugagccaaaccgggagccaggucacugugcccucaggaaggaaagcugcacagauaaugaacacacucuguaaagagucagacuugggaguauucggggacccaggacuacauggcuaaugaugcagccgggggucaguuacaacgucaggcaagauuuccuaccgaccauaccuauucucacuggcuccaucucccacucggucugccuucauagucgcuagccugagccuaagcgguccuccuagauccucccaggacagacuccccugcuaagcagcgcucuggccugugcugugcagcgggccgggcgagcagucacucggguuaccgcuggcaaguaagccaggugcuggagcguucugaggaggggaggcugggagcaggagcuacucacacgcccgcccggcccuguggcuaccucuuuuacccguguuggggcagcacgggaugaggaaggaagccugaggccagaggauccgacugcccugagacaugaauuuuugauccaaguggccaagaguggcuacugugacacuucccggaggaaagccaccacaaggaccggagcucagcaguccccugucgucuccagcccgggcauccuuagucgcuccgcagcccagacguccccuggcuccugaaggcugcgcggcgaggacagugagcgagcagacgcguggcucagggugccgaagccggcacagagcgcugcgcgcccaccuucagagaggcgccgcugccgaccgcacccccgagugccuggggaccccaggaagcuacggugggucacuguc

SEQ ID NO: 11104 - RNA, 831 nt, Mus musculus
gacagugacccaccguagcuuccugggguccccaggcacucgggggugcggucggcagcggcgccucucugaaggugggcgcgcagcgcucugugccggcuucggcacccugagccacgcgucugcucgcucacuguccucgccgcgcagccuucaggagccaggggacgucugggcugcggagcgacuaaggaugcccgggcuggagacgacaggggacugcugagcuccgguccuugugguggcuuuccuccgggaagugucacaguagccacucuuggccacuuggaucaaaaauucaugucucagggcagucggauccucuggccucaggcuuccuuccucaucccgugcugccccaacacggguaaaagagguagccacagggccgggcgggcgugugaguagcuccugcucccagccuccccuccucagaacgcuccagcaccuggcuuacuugccagcgguaacccgagugacugcucgcccggcccgcugcacagcacaggccagagcgcugcuuagcaggggagucuguccugggaggaucuaggaggaccgcuuaggcucaggcuagcgacuaugaaggcagaccgagugggagauggagccagugagaauagguauggucgguaggaaaucuugccugacguuguaacugacccccggcugcaucauuagccauguaguccuggguccccgaauacucccaagucugacucuuuacagaguguguucauuaucugugcagcuuuccuuccugagggcacagugaccuggcucccgguuuggcucagaguuagcucuaacccucucuggucauccaccuca

SEQ ID NO: 11105 - RNA, 557 nt, Mus musculus
aucccccuccuuccuuccauccgcgccuccgcuugaguuuugcuuucaugagcgccagccaguggcucuggcuguuaaaguagaaggcaggucaguguccugggugcuuacgggaaucaaacagggaauccgaaaagacaccgaugucugcuucgagcccagagauugugauuuaauuggucugaaggaaaacuuaggcguccauaaccugagaaaaagauuuccucucaucuuccaguggaggagcagcucuuugaaggcuacugcagaggcaacgaaaccagugugcgcuuuugagucuggcccagagacacauguguuacccuccucaagauugcuaucccgauccggaagucucaguuuucucaccuauuagagauguauuuuuaagcccaugauaaagauuccuggaaacacugucgauguaccuggagccuaacugcucaacaaggaguagggcuuugauuacccaucaugacuugacuggacacaaaggaaccggcguuugcuauuuaccagacuccaccaagguucccuuccaagcuacagagcuugaa

SEQ ID NO: 11106 - RNA, 557 nt, Mus musculus
uucaagcucuguagcuuggaagggaaccuugguggagucugguaaauagcaaacgccgguuccuuuguguccagucaagucaugauggguaaucaaagcccuacuccuuguugagcaguuaggcuccagguacaucgacaguguuuccaggaaucuuuaucaugggcuuaaaaauacaucucuaauaggugagaaaacugagacuuccggaucgggauagcaaucuugaggaggguaacacaugugucucugggccagacucaaaagcgcacacugguuucguugccucugcaguagccuucaaagagcugcuccuccacuggaagaugagaggaaaucuuuuucucagguuauggacgccuaaguuuuccuucagaccaauuaaaucacaaucucugggcucgaagcagacaucggugucuuuucggauucccuguuugauucccguaagcacccaggacacugaccugccuucuacuuuaacagccagagccacuggcuggcgcucaugaaagcaaaacucaagcggaggcgcggauggaaggaaggagggggau

SEQ ID NO: 11107 - RNA, 512 nt, Mus musculus
ggccccgcgugcgcuccuuuaugaagacgacauggaacggaaccgugagcuuccccucagaaccuccuggaagcccgagaacucgcgggacugggaggcuggccgcgaccggcucaauuuaacgguugguccagcuggccgggaucucgcgcgcagcacuucucgcgagauuucccuucccacgugccggguucucuaccaagucugcgcucaaaauugucggaggaugcugggaaagcccccccccaacccccucguugguguauagccauuuaaaggcgucucagugcuuuccuuuucuaaggcuguauuuauuauguucuggugcguguuauagaguguuucauguggauguaugcaucaacccgugcaccacgugcagcguccugggcauccauaaggaguaggagcccuuggaauuggaguuacagaugguuguuaguugccugguggaugcugagaaccaaacaugaguccugugcuacagccauaagccccauaaaaagaaguca

SEQ ID NO: 11108 - RNA, 512 nt, Mus musculus
ugacuucuuuuuauggggcuuauggcuguagcacaggacucauguuugguucucagcauccaccaggcaacuaacaaccaucuguaacuccaauuccaagggcuccuacuccuuauggaugcccaggacgcugcacguggugcacggguugaugcauacauccacaugaaacacucuauaacacgcaccagaacauaauaaauacagccuuagaaaaggaaagcacugagacgccuuuaaauggcuauacaccaacgaggggguugggggggggcuuucccagcauccuccgacaauuuugagcgcagacuugguagagaacccggcacgugggaagggaaaucucgcgagaagugcugcgcgcgagaucccggccagcuggaccaaccguuaaauugagccggucgcggccagccucccagucccgcgaguucucgggcuuccaggagguucugaggggaagcucacgguuccguuccaugucgucuucauaaaggagcgcacgcggggcc

SEQ ID NO: 11109 - RNA, 2196 nt, Mus musculus
guccuggggccgggucgggaauucuacaaagaacacagcaggcauccgguggauccuggacgccuuuugccucaucugcccuuuggaagugucugaagauuaaggccugcaggaagagaucugaagagagggucucacaacucuugagacucuagaagccccuggggcuuggggaggaaaggcgggagguuauguuaucugggacaggaaagcaaaagggggcaucgguguuccaaauuacacccucaaagccaaggcuggugacaaacgccugcguuaugcaaccccaaggauuuaauuuguuucgguugugggcauuaggggaaguuugugccucaauuucacuucuaagccuuuccguggaugcuacuggcucguugugugggcuagacuagcagagggaugugggggacagccagcugcccccccuacucgugucuccaagggcucuuaggugguguaagguuuuuugaagaccaugaccaugccaaacagacacugcaggauguggagaggcgacuaguucccacccugagagagaaucaccaaguagcuucugcgguagagguuucaguagaaauaccaaggggcacaauggggcagccuaggggacuucaaccaucagcucccuccuuccagaugcccagggcucuccucuccagcgccucauuuucuccaacuccucacuggccacuggaaacuucugggacuguguccuuccucuaauuccuccuaggcaauucuggugccuaagcagccgaugcccagagcaaugcacucguuccaguaagccuaccaaccccagaaccauacuuaccaccaggacgugucuacacgggccggcagagucaggaguagcagcagcagcaggcaggcaagacccaggcgggcggaagauggggacacgucgggggccgugggucugggcacggggacgcgggcacgccgaggggcgagcugcgcggcuucauccucacccugcagcuucagcauagcuccccgcagacucccgccccgaagcccgcagggccguggacgggcacugucugggcuuccucaggcgucuccuagaucgccccacagaguggccauggggaccaugggcgaccgaggaccucaaggcacguggagcccgggagccagacgcaggguucccaagagcgugcagggccaggagaccgacgagcgcugagccgggugugggcggucgggugcggugucaguggcuccggggcgcggagugcggcgggggccagagcgcgccgacagccccugcggccgcagcucucauuggacggggcggggcggggccggggacacgcgcggccuucagcgcggcuccgcccgcgccagcccgggugcuccccggcgcccuagguguggcggccgccuccuccccuccguucuacggggcgccaccgcgccgcguccccaccugcucuggccacccgcgacggggcucuucccugccugcagcccccugucccuaccgacgccacgccacgccaccggguccuagcgcccuucacucagcaacgcggaccacugcguuugauggcaaggagcacacgguguguguggcgagggagagacguggagaggguugcggacacuuccaguucuuuaaguacagaagaugcacuuucucuugguccucccauccuugcgcuucuaggaaacugguagacacccggccagcaagaguugcgggauagugggacuccuuuggccacacugcccucagggguaccaccguaggcaaccggccucgggcggcggacccucucaagaaggacucaacguucccuccaccccgcccaccgcuucucccacccacucucgucccgcccgucguugagagucuuguccaccuuggugcuuuccccaacucagggcagcgcagccacccaagaaacacaccugcgggcgggacgcagccgccugccggugcccugacggcuggccagggcucggcagagcucggucucucccaguaucuccgucccccacccccucgggcggagcugcgacugggaaagaaucagaaacagcugggcugcuuucccgcaccagaggccgggguggggguccugcggagaggguggaagcccuggugccuuuucuccccccucccuuuccacccuucuuccucuccacuggucccucagucccgcagagucggggaggugggguagg

SEQ ID NO: 11110 - RNA, 2196 nt, Mus musculus
ccuaccccaccuccccgacucugcgggacugagggaccaguggagaggaagaaggguggaaagggaggggggagaaaaggcaccagggcuuccacccucuccgcaggacccccaccccggccucuggugcgggaaagcagcccagcuguuucugauucuuucccagucgcagcuccgcccgagggggugggggacggagauacugggagagaccgagcucugccgagcccuggccagccgucagggcaccggcaggcggcugcgucccgcccgcagguguguuucuuggguggcugcgcugcccugaguuggggaaagcaccaagguggacaagacucucaacgacgggcgggacgagagugggugggagaagcggugggcgggguggagggaacguugaguccuucuugagaggguccgccgcccgaggccgguugccuacggugguaccccugagggcaguguggccaaaggagucccacuaucccgcaacucuugcuggccgggugucuaccaguuuccuagaagcgcaaggaugggaggaccaagagaaagugcaucuucuguacuuaaagaacuggaaguguccgcaacccucuccacgucucucccucgccacacacaccgugugcuccuugccaucaaacgcagugguccgcguugcugagugaagggcgcuaggacccgguggcguggcguggcgucgguagggacagggggcugcaggcagggaagagccccgucgcggguggccagagcagguggggacgcggcgcgguggcgccccguagaacggaggggaggaggcggccgccacaccuagggcgccggggagcacccgggcuggcgcgggcggagccgcgcugaaggccgcgcguguccccggccccgccccgccccguccaaugagagcugcggccgcaggggcugucggcgcgcucuggcccccgccgcacuccgcgccccggagccacugacaccgcacccgaccgcccacacccggcucagcgcucgucggucuccuggcccugcacgcucuugggaacccugcgucuggcucccgggcuccacgugccuugagguccucggucgcccaugguccccauggccacucuguggggcgaucuaggagacgccugaggaagcccagacagugcccguccacggcccugcgggcuucggggcgggagucugcggggagcuaugcugaagcugcagggugaggaugaagccgcgcagcucgccccucggcgugcccgcguccccgugcccagacccacggcccccgacguguccccaucuuccgcccgccugggucuugccugccugcugcugcugcuacuccugacucugccggcccguguagacacguccuggugguaaguaugguucugggguugguaggcuuacuggaacgagugcauugcucugggcaucggcugcuuaggcaccagaauugccuaggaggaauuagaggaaggacacagucccagaaguuuccaguggccagugaggaguuggagaaaaugaggcgcuggagaggagagcccugggcaucuggaaggagggagcugaugguugaaguccccuaggcugccccauugugccccuugguauuucuacugaaaccucuaccgcagaagcuacuuggugauucucucucagggugggaacuagucgccucuccacauccugcagugucuguuuggcauggucauggucuucaaaaaaccuuacaccaccuaagagcccuuggagacacgaguagggggggcagcuggcugucccccacaucccucugcuagucuagcccacacaacgagccaguagcauccacggaaaggcuuagaagugaaauugaggcacaaacuuccccuaaugcccacaaccgaaacaaauuaaauccuugggguugcauaacgcaggcguuugucaccagccuuggcuuugaggguguaauuuggaacaccgaugcccccuuuugcuuuccugucccagauaacauaaccucccgccuuuccuccccaagccccaggggcuucuagagucucaagaguugugagacccucucuucagaucucuuccugcaggccuuaaucuucagacacuuccaaagggcagaugaggcaaaaggcguccaggauccaccggaugccugcuguguucuuuguagaauucccgacccggccccaggac

SEQ ID NO: 11111 - RNA, 805 nt, Mus musculus
cuccucccauaaaccagccuaacucgacagcaccugcuguuuaucuugcauagcuauuugucaccuuucgguguuugcucuacccuccucuuuccuggaguguccuuugaggcauuuccaaugugcaugaccuauccuuuuucacaguggaccuguuuaguguccccagccucccucagucuucacagagccauuuguaucuuacauagaaaauguuucuauccccaaaguaccuuauaccugaaucguuuccuaccucguaguuuuaugugccagcucaacugugcaacaugacucacgcuucccggguaacuaagguccaggcccccacugccagaagaguagaugaagcaucaacagcccugggagaaguucacaccggaggauuucaggagccgcagcagcugcgccugcgcaccgcccacugaccacgcggagggcggguggagcauagagcgagagaggaggagacaguucggucgcgucagcccggcccacagcguccaguauaaaguuagccgcccacaguccaucgcuguauccccgaaggggcuaagaucgcccaaaaugucauccaagucuaugguucuggguuacugggauauccgcggggugaguggucccucgccagcccagccucugggacagagaggugcaggcggccgggcgggggucaggggccggugggccgaucuccagccuaccuaugggguccccaggacuguggguagaggaauaagguacuggaaguucccgggcgugagcgaaggggcugccuaaggacaauuucccuggacaggacgca

SEQ ID NO: 11112 - RNA, 805 nt, Mus musculus
ugcguccuguccagggaaauuguccuuaggcagccccuucgcucacgcccgggaacuuccaguaccuuauuccucuacccacaguccuggggaccccauagguaggcuggagaucggcccaccggccccugacccccgcccggccgccugcaccucucugucccagaggcugggcuggcgagggaccacucaccccgcggauaucccaguaacccagaaccauagacuuggaugacauuuugggcgaucuuagccccuucggggauacagcgauggacugugggcggcuaacuuuauacuggacgcugugggccgggcugacgcgaccgaacugucuccuccucucucgcucuaugcuccacccgcccuccgcguggucagugggcggugcgcaggcgcagcugcugcggcuccugaaauccuccggugugaacuucucccagggcuguugaugcuucaucuacucuucuggcagugggggccuggaccuuaguuacccgggaagcgugagucauguugcacaguugagcuggcacauaaaacuacgagguaggaaacgauucagguauaagguacuuuggggauagaaacauuuucuauguaagauacaaauggcucugugaagacugagggaggcuggggacacuaaacagguccacugugaaaaaggauaggucaugcacauuggaaaugccucaaaggacacuccaggaaagaggaggguagagcaaacaccgaaaggugacaaauagcuaugcaagauaaacagcaggugcugucgaguuaggcugguuuaugggaggag

SEQ ID NO: 11113 - RNA, 1095 nt, Mus musculus
acuguuacuaggccagagacauuggagaguggaggacggccaccguccugagcccggauccgaagcguauacucuuugguugucucauagucgagugggcuuaccacauccagggcuccagucugagcauccagauagaacuggccccgagcauugccacucaugaugcuguagugcacuagggcauugcugcccuugucucuaucggaggcggugacucggagaacuggggcuccuggggucacauccucccgcaccuggaccacauaacgcuucucgcuaaacuggggggcguugucauuaucauccuccaccgacaggaaaacaauggcuguggaacuccgcgggccugggucccggcccuggucacucgccuccacuguuaacuuguaggauuccacuuccucccggucuacagggccgcggguucggaucacccccgagcgaggaucgaucucaaaggcgucugaggggcugccuccggcccccuccagcaggcgguacagaauguuggcauugggaggggcgucgccgucgguggcccugacuguaagcaccucauagccaaccuccagguucucccugaggcucuccuuguacucuugcugcucaaaaacagggucgugaucguuggugucggucaccaagaugguaagcguggccaaggcacuccgucggggcauaccgugauccugugcagugacccugaagacgugggugcucuuggucucccgauccagcuccucagcuguggugacaacaccggugauuggguccaaggagaagaaaugauuggagcggcuaucaaagagggcauccaugguguacucaagucgacccgccucacccucaucuggaucaauggcucuuaaggaugcaacagagguaccagcaggcugguucucaggcacuguggccugguagcugggaggcuggaacuggggagcuguauucacauuccuuuuccugcgcccacccagagauuccucuggugagccuuccccagcccugagcccuggggccugugccagcuugcaagacuggcaucugagccguggggccuuuaagcaagggugcucuucaggcagggucagc

SEQ ID NO: 11114 - RNA, 1095 nt, Mus musculus
gcugacccugccugaagagcacccuugcuuaaaggccccacggcucagaugccagucuugcaagcuggcacaggccccagggcucagggcuggggaaggcucaccagaggaaucucugggugggcgcaggaaaaggaaugugaauacagcuccccaguuccagccucccagcuaccaggccacagugccugagaaccagccugcugguaccucuguugcauccuuaagagccauugauccagaugagggugaggcgggucgacuugaguacaccauggaugcccucuuugauagccgcuccaaucauuucuucuccuuggacccaaucaccgguguugucaccacagcugaggagcuggaucgggagaccaagagcacccacgucuucagggucacugcacaggaucacgguaugccccgacggagugccuuggccacgcuuaccaucuuggugaccgacaccaacgaucacgacccuguuuuugagcagcaagaguacaaggagagccucagggagaaccuggagguuggcuaugaggugcuuacagucagggccaccgacggcgacgccccucccaaugccaacauucuguaccgccugcuggagggggccggaggcagccccucagacgccuuugagaucgauccucgcucgggggugauccgaacccgcggcccuguagaccgggaggaaguggaauccuacaaguuaacaguggaggcgagugaccagggccgggacccaggcccgcggaguuccacagccauuguuuuccugucgguggaggaugauaaugacaacgccccccaguuuagcgagaagcguuaugugguccaggugcgggaggaugugaccccaggagccccaguucuccgagucaccgccuccgauagagacaagggcagcaaugcccuagugcacuacagcaucaugaguggcaaugcucggggccaguucuaucuggaugcucagacuggagcccuggaugugguaagcccacucgacuaugagacaaccaaagaguauacgcuucggauccgggcucaggacgguggccguccuccacucuccaaugucucuggccuaguaacagu

SEQ ID NO: 11115 - RNA, 2191 nt, Mus musculus
cagccgagcgcgagccaccaaucacaauagacagcggcggcgacaacagccgcagcuugagccacugccgccgccgcggcuucgguagcuugggcugcagccuggagcgccaacaggagcuuuagaaccauuuuaugcugauuagauaaaggggggacggaggggcgggggugauggaggaggaggauggauggccaggccaggggagggggagagggacuaaagaaagggaaagaaaugaaugaugauaauacgaugaaaagaauaagcuggggagggagagcgggggaccaggacaggcggaggaggagagggcgggggaaggguaggugaggagggggccccggggcagaucugauuguuuucuuggugguauauaagggguuuuaaggagagucgugugccagacacgcagccacugaaccacaagcagcucggcuuuaacuggagugccuuggagucgcgugccagcagccacacggccagggacugacugacagacaaccacgcacgagaacgacaacacacgagacucgggcgagcugccgcggucguccgggcucuuggcaaagucgcccagccgagaggcccccccgcggaggugcgccuaggaagcgccaagcccgcggcgcggaggacaccgugcucgguuccgggcugcggggacauucccggacacacaccggagcagcagcugcgccgcgacacaucuggagccgcguagguaagugugcaugccgcggcucuccacuucgcaggcaguguccccacgcaggcucacgccgcccacgcuaacuccaucgcucuagacgcagugacuucugugaccggcagaagguggcucgagcccggggcgcuccuccccagcucuguccucgccaucuucgcgaaugcacauugagggagauggagggggggggggcggggcgcggcgccagcgacacuuuacccuguccauucugggaauaaauuucaucugccucuucuuucucaggauguucgucaaaucugagacucuggaguugaaggaggaagaggagguacugaugcugcugggcucggcuuccccggccucggcgacccugaccccgauguccuccagcgcggacgaggaggaggacgaggagcugcgccggccgggcuccgcgcgugggcagcguggagcggaagccgggcagggggugcagggcaguccggcgucgggugccggggguugccggccagggcggcugcugggccugaugcacgagugcaagcgucgcccgucgcgcucacgggccgucucccgaggugccaagacggcggagacggugcagcgcaucaagaagacccgcaggcucaaggccaacaaccgcgagcgcaaccgcaugcacaaccuaaacgccgcgcuggacgcgcugcgcgaggugcugcccaccuuccccgaggaugccaagcucacgaagaucgagacgcugcgcuucgcccacaauuacaucugggcgcucaccgagacucugcgccuggcggaccacugcgccggcgccgguggccuccagggggcgcucuucacggaggcggugcuccugagcccgggagcugcgcucggcgccagcggggacagcccuucuccaccuuccuccuggagcugcaccaacagcccggcgucauccuccaacuccacguccccauacagcugcacuuuaucgcccgcuagccccgggucagacguggacuacuggcagcccccaccuccggagaagcaucguuaugcgccucaccugccccucgccagggacuguaucuagagcugcgggucucccucucucguccucuacccggcccucuucccauccuucucccgccccucacccuccacgccccggacuccacuucacagagcagagguggcccuugcaauccccucggcggcuggugcauucggggguggagaccagcucugguuuauugaagaugugaggauuuauggucaaagaggacuauggcgugugggagugggggcuggcguggggaaccucguaagacuguaaaagacacugagaaaaaguaccauaacuaacgagugugcagagcagacugacgcuccuccccucucucagagcugcuggaggagaacuccgggcaggcaguucgugugaaucucucagagggaaugcaacuggucccugugaucuuuucaccuucguuucua

SEQ ID NO: 11116 - RNA, 2191 nt, Mus musculus
uagaaacgaaggugaaaagaucacagggaccaguugcauucccucugagagauucacacgaacugccugcccggaguucuccuccagcagcucugagagaggggaggagcgucagucugcucugcacacucguuaguuaugguacuuuuucucagugucuuuuacagucuuacgagguuccccacgccagcccccacucccacacgccauaguccucuuugaccauaaauccucacaucuucaauaaaccagagcuggucuccacccccgaaugcaccagccgccgaggggauugcaagggccaccucugcucugugaaguggaguccggggcguggagggugaggggcgggagaaggaugggaagagggccggguagaggacgagagagggagacccgcagcucuagauacagucccuggcgaggggcaggugaggcgcauaacgaugcuucuccggaggugggggcugccaguaguccacgucugacccggggcuagcgggcgauaaagugcagcuguauggggacguggaguuggaggaugacgccgggcuguuggugcagcuccaggaggaagguggagaagggcuguccccgcuggcgccgagcgcagcucccgggcucaggagcaccgccuccgugaagagcgcccccuggaggccaccggcgccggcgcagugguccgccaggcgcagagucucggugagcgcccagauguaauugugggcgaagcgcagcgucucgaucuucgugagcuuggcauccucggggaaggugggcagcaccucgcgcagcgcguccagcgcggcguuuagguugugcaugcgguugcgcucgcgguuguuggccuugagccugcgggucuucuugaugcgcugcaccgucuccgccgucuuggcaccucgggagacggcccgugagcgcgacgggcgacgcuugcacucgugcaucaggcccagcagccgcccuggccggcaacccccggcacccgacgccggacugcccugcacccccugcccggcuuccgcuccacgcugcccacgcgcggagcccggccggcgcagcuccucguccuccuccucguccgcgcuggaggacaucggggucagggucgccgaggccggggaagccgagcccagcagcaucaguaccuccucuuccuccuucaacuccagagucucagauuugacgaacauccugagaaagaagaggcagaugaaauuuauucccagaauggacaggguaaagugucgcuggcgccgcgccccgcccccccccccuccaucucccucaaugugcauucgcgaagauggcgaggacagagcuggggaggagcgccccgggcucgagccaccuucugccggucacagaagucacugcgucuagagcgauggaguuagcgugggcggcgugagccugcguggggacacugccugcgaaguggagagccgcggcaugcacacuuaccuacgcggcuccagaugugucgcggcgcagcugcugcuccgguguguguccgggaauguccccgcagcccggaaccgagcacgguguccuccgcgccgcgggcuuggcgcuuccuaggcgcaccuccgcgggggggccucucggcugggcgacuuugccaagagcccggacgaccgcggcagcucgcccgagucucguguguugucguucucgugcgugguugucugucagucagucccuggccguguggcugcuggcacgcgacuccaaggcacuccaguuaaagccgagcugcuugugguucaguggcugcgugucuggcacacgacucuccuuaaaaccccuuauauaccaccaagaaaacaaucagaucugccccggggcccccuccucaccuacccuucccccgcccucuccuccuccgccuguccuggucccccgcucucccuccccagcuuauucuuuucaucguauuaucaucauucauuucuuucccuuucuuuagucccucucccccuccccuggccuggccauccauccuccuccuccaucacccccgccccuccguccccccuuuaucuaaucagcauaaaaugguucuaaagcuccuguuggcgcuccaggcugcagcccaagcuaccgaagccgcggcggcggcaguggcucaagcugcggcuguugucgccgccgcugucuauugugauugguggcucgcgcucggcug

SEQ ID NO: 11117 - RNA, 520 nt, Mus musculus
aucaaaguuuaguuucaaaacaaaguagcuacuucacuuauggaauguuuugcuuugccucagcaaaacuacgccuaaguuacugcccugcuuuguccuguaagcugagcacuguagcuccaaagcuccagaagcacacauuccacagagcuuuaaagaaagcuugcucauggugaagcacggggcugugcuaaagugguaucuuaauuuccuuaaaugauuacccacugcaaauuaauuugcuggcuaaucacaccaauuuaguucauuuaaaacauauggccucaugcuuuuuauuuuucagcuuuccaugaaugguucugcugugggauaagaaaggaaaugaaaagggugaaaugggaaagaauuuuuguuuuuuuguuuuuuguuuuuuguguuuucuuggacugauuagaacucguagcuucuucuacaauuccauccuuguacugcuugggcagaaaucauuuuugaaacaaacugcucuguuucuuagggcuugccuaucugccuggccgga

SEQ ID NO: 11118 - RNA, 520 nt, Mus musculus
uccggccaggcagauaggcaagcccuaagaaacagagcaguuuguuucaaaaaugauuucugcccaagcaguacaaggauggaauuguagaagaagcuacgaguucuaaucaguccaagaaaacacaaaaaacaaaaaacaaaaaaacaaaaauucuuucccauuucacccuuuucauuuccuuucuuaucccacagcagaaccauucauggaaagcugaaaaauaaaaagcaugaggccauauguuuuaaaugaacuaaauuggugugauuagccagcaaauuaauuugcaguggguaaucauuuaaggaaauuaagauaccacuuuagcacagccccgugcuucaccaugagcaagcuuucuuuaaagcucuguggaaugugugcuucuggagcuuuggagcuacagugcucagcuuacaggacaaagcagggcaguaacuuaggcguaguuuugcugaggcaaagcaaaacauuccauaagugaaguagcuacuuuguuuugaaacuaaacuuugau

SEQ ID NO: 11119 - RNA, 1840 nt, Mus musculus
aagacaccuucccaguaguaguccuacagugaucuaauuucuaauuguaaaguuaaauguacacacacccagcccacaggaguagggagaagaaaccagguuggcugcaaccaagaaagcucaggcuacuauucacgggaugguuucugaaagcuugaaauaaaacagauuagccagacucacagcuguugggggcggggaggagggggcaguuuugacuaaugcaccgggacgcugaaaugugcugaauaacagaucugucagagcagaaagaauguuugcuucguauaaagggcagauaaggaaaugggcaagaagaggagcuuauucaaaaaucaaaugcaaccaaccaagcucuuucuauacaacugccuccuccuccuccuccucuuccccaccacugcuguaagaaaagcccaaaaccaggccgugaagagugucucaaguguccucguauuuuacaagcugucugcaucagcaauccacauuauuucccucuccgauguaaaguguacccagagagacuccaaguuuaggaugcagauuuaugcaucagaucacacuuacaccugugacuguuagccuguuuagauucacaccuaccagacuuucuggacaccuaggcuguguguguguguguguguguguguguguguguguguguguguguguguguuucuuuguaaauggacaccuaggcuguguguguguguguguguguguguguuucuuuguaaauaugugugccccaaaguaaugcaccacaaauccaaaugugggcaaagaauugcuuuuggaaaauaaaaggcuuagccucuggcugcuuuccacucuucuuuaaacucuuuaucucuucaauucaucuucgcuuuacccucaggcucaaaguacaaaacaaccccaacuucuauuuccuccgaccagguggugaaccgggagcgggugccuuuuucuuccgcgcuccgaggcuuuuccucugguccccuccagggacaggaaagccaaucaauccuggaauugauucguuccaagauugcagguaaaacaggugcggcaucuucaaggcagcccugggacaagcucugagggauggggacaggggugagugguggugugagccagcgggaaaccuguccagcugaggccuucaguggggacugagcccgggaucuccggggagaucgcgcggugcgcugccuuggggggacacgcugagugacagcagagacccugccggagguuguugggaccugucagagcaagcaacagucaggcccgccaggucugagcggugccgcgugcuacacacacacacacacacacacacacacacacacacgcaccccgagcgccuccucucaguacucauguuaagcuuguguacaccguccccccuccgaaccacaaaccgagagcccucgggugccauuuguuccaaguacgguccucgccgccacccuuugucgaaucgccgggucaccugcaaguuuccccucgggacacaguccauccugaucacuggcuguagggacgcuccacgcgucaccugugucccugcuccugcccgcucucaccgcacacggggcacgagccucucuuucuccugagcccggagccaggcugcuccacucgaggucccugagggaaaggggagggcacccgagacccgccucaccucccgucgaagucggcagccaccugcagguagagcgaggacgcgagcaccgccgcuaggagcacagccaugccggaggaccgggacgcggggacgcugaagguugcggggagcugcgcgucccgggaucucccggccgccuucggcgcggcacccgcggcugcu

SEQ ID NO: 11120 - RNA, 1840 nt, Mus musculus
agcagccgcgggugccgcgccgaaggcggccgggagaucccgggacgcgcagcuccccgcaaccuucagcguccccgcgucccgguccuccggcauggcugugcuccuagcggcggugcucgcguccucgcucuaccugcagguggcugccgacuucgacgggaggugaggcgggucucgggugcccuccccuuucccucagggaccucgaguggagcagccuggcuccgggcucaggagaaagagaggcucgugccccgugugcggugagagcgggcaggagcagggacacaggugacgcguggagcgucccuacagccagugaucaggauggacugugucccgaggggaaacuugcaggugacccggcgauucgacaaaggguggcggcgaggaccguacuuggaacaaauggcacccgagggcucucgguuugugguucggaggggggacgguguacacaagcuuaacaugaguacugagaggaggcgcucggggugcguguguguguguguguguguguguguguguguguguagcacgcggcaccgcucagaccuggcgggccugacuguugcuugcucugacaggucccaacaaccuccggcagggucucugcugucacucagcguguccccccaaggcagcgcaccgcgcgaucuccccggagaucccgggcucaguccccacugaaggccucagcuggacagguuucccgcuggcucacaccaccacucaccccuguccccaucccucagagcuugucccagggcugccuugaagaugccgcaccuguuuuaccugcaaucuuggaacgaaucaauuccaggauugauuggcuuuccugucccuggaggggaccagaggaaaagccucggagcgcggaagaaaaaggcacccgcucccgguucaccaccuggucggaggaaauagaaguugggguuguuuuguacuuugagccugaggguaaagcgaagaugaauugaagagauaaagaguuuaaagaagaguggaaagcagccagaggcuaagccuuuuauuuuccaaaagcaauucuuugcccacauuuggauuuguggugcauuacuuuggggcacacauauuuacaaagaaacacacacacacacacacacacacacagccuagguguccauuuacaaagaaacacacacacacacacacacacacacacacacacacacacacacacacacagccuagguguccagaaagucugguaggugugaaucuaaacaggcuaacagucacagguguaagugugaucugaugcauaaaucugcauccuaaacuuggagucucucuggguacacuuuacaucggagagggaaauaauguggauugcugaugcagacagcuuguaaaauacgaggacacuugagacacucuucacggccugguuuugggcuuuucuuacagcagugguggggaagaggaggaggaggaggaggcaguuguauagaaagagcuugguugguugcauuugauuuuugaauaagcuccucuucuugcccauuuccuuaucugcccuuuauacgaagcaaacauucuuucugcucugacagaucuguuauucagcacauuucagcgucccggugcauuagucaaaacugcccccuccuccccgcccccaacagcugugagucuggcuaaucuguuuuauuucaagcuuucagaaaccaucccgugaauaguagccugagcuuucuugguugcagccaaccugguuucuucucccuacuccugugggcuggguguguguacauuuaacuuuacaauuagaaauuagaucacuguaggacuacuacugggaaggugucuu

SEQ ID NO: 11121 - RNA, 1085 nt, Mus musculus
aaggaauuuuaaaggcagggcaauggaucauugagagaguauaaaagaagccuuugggauuucaaauguacagauucagacucgauggaaucccacugguguuuggaaagcccgaggacuaucaugaagagaacagccauuuugucucuucuagcuccuguaaacgacaggcuaucuuuggacagauaccacgucuuuggguaucaaccaucucuccugagcccuucucacagucaaaucaaagcuguuacauaaaagugcagucaagacaaggcaaagggaauucugugucccuugcucaaggggcuguuaaugagcuuuuucuggccucuucuggcaacucucuaccucucccccuuguccuuuuacuccagugaggagggacucaaagcuaagggaccccaggaagagcaauggguuggcaguugggguagugggggcacucucacuaacaaaaacauuacauucuuugcaggaaggauguuugaaggguuuggguguuaaaguuggguuuacugacagccuagaugaagugcuauccgagguaaugaagagaacacaucuugggguuccgaaacuccgggggcaaaacaaaauuuguuuauguggagauagauaccucagcccuuaagggucccagagagacugguuccuaaauugggagacaacagcuuggggaucaacauuuggaagcuccagguaacuuugguccacaaaggcuccugccacgcaccuuccggcgcaaaugaccacuagaagucugcgaggagccccucaccgcaaauucaacucaccaggaaauugaugucgccugggcgaaccaggcgguagcugcauuuagcgcaguccuggcugcauuccgccugcacuguagccaggaggcaggacccaagcgccagcagccaggugcaaagccucaggaaccgcgccaugggcuguaggagagaagaacgcgccuguagggacccguucugucucugacaagguucucuuagagagaaccuugccggguggguggucguggaucaggaccagcagggacagucuuuccugagccccgcccacaacccaacaaccuccccggg

SEQ ID NO: 11122 - RNA, 1085 nt, Mus musculus
cccggggagguuguuggguugugggcggggcucaggaaagacugucccugcugguccugauccacgaccacccacccggcaagguucucucuaagagaaccuugucagagacagaacgggucccuacaggcgcguucuucucuccuacagcccauggcgcgguuccugaggcuuugcaccuggcugcuggcgcuuggguccugccuccuggcuacagugcaggcggaaugcagccaggacugcgcuaaaugcagcuaccgccugguucgcccaggcgacaucaauuuccuggugaguugaauuugcggugaggggcuccucgcagacuucuaguggucauuugcgccggaaggugcguggcaggagccuuuguggaccaaaguuaccuggagcuuccaaauguugauccccaagcuguugucucccaauuuaggaaccagucucucugggacccuuaagggcugagguaucuaucuccacauaaacaaauuuuguuuugcccccggaguuucggaaccccaagauguguucucuucauuaccucggauagcacuucaucuaggcugucaguaaacccaacuuuaacacccaaacccuucaaacauccuuccugcaaagaauguaauguuuuuguuagugagagugcccccacuaccccaacugccaacccauugcucuuccuggggucccuuagcuuugagucccuccucacuggaguaaaaggacaagggggagagguagagaguugccagaagaggccagaaaaagcucauuaacagccccuugagcaagggacacagaauucccuuugccuugucuugacugcacuuuuauguaacagcuuugauuugacugugagaagggcucaggagagaugguugauacccaaagacgugguaucuguccaaagauagccugucguuuacaggagcuagaagagacaaaauggcuguucucuucaugauaguccucgggcuuuccaaacaccagugggauuccaucgagucugaaucuguacauuugaaaucccaaaggcuucuuuuauacucucucaaugauccauugcccugccuuuaaaauuccuu

SEQ ID NO: 11123 - RNA, 758 nt, Mus musculus
auggcgauugagacgcuuuaauaacauaagcuucacaaacauacgcuuacaacaccucacccaugcuggcauuuaaaauacacaucauccucaaauaacaccuuucuuuguuagucuuuacugaagggcaacauaggggaguagguuucucguaaauacccuaaagcauuugaaccaaccacccaaaacgcaaucgauuauccuacauaucucacgaaaacugaauauuuaugaccccagaauaggcugacaacauccuagaacuacacuucccacaaagcauagaguggaacacgggcagcaggcugggcggccuggcauuaagggcgaccacugcucccagcgagcuuggaucgucauccccuggaaaaucgcaacgcuuggcauggagugggacucucuccuuucugacagcuccgucacccucguuuuguuuuuuguuuuguuuuguuuuucugccauuaacagcggcccuauuggccuuuacagcuucaaccugaaagucaucucccaucugugaccuuucugccgauuccuuggaggugcgggaaaggcaacccucuccccuuccccaaagcuccacguccagaauucgcccgucagucagaaucaagggacaugcggggggucugacggaacggacggguggacacaguccgaccugggggcgacaggccgcgcgccagcuccgguagcaagccaggggcccgggauccccccaaagcccgggccgaagcagauuucgagcagggguagcu

SEQ ID NO: 11124 - RNA, 758 nt, Mus musculus
agcuaccccugcucgaaaucugcuucggcccgggcuuuggggggaucccgggccccuggcuugcuaccggagcuggcgcgcggccugucgcccccaggucggacuguguccacccguccguuccgucagaccccccgcaugucccuugauucugacugacgggcgaauucuggacguggagcuuuggggaaggggagaggguugccuuucccgcaccuccaaggaaucggcagaaaggucacagaugggagaugacuuucagguugaagcuguaaaggccaauagggccgcuguuaauggcagaaaaacaaaacaaaacaaaaaacaaaacgagggugacggagcugucagaaaggagagagucccacuccaugccaagcguugcgauuuuccaggggaugacgauccaagcucgcugggagcaguggucgcccuuaaugccaggccgcccagccugcugcccguguuccacucuaugcuuugugggaaguguaguucuaggauguugucagccuauucuggggucauaaauauucaguuuucgugagauauguaggauaaucgauugcguuuugggugguugguucaaaugcuuuaggguauuuacgagaaaccuacuccccuauguugcccuucaguaaagacuaacaaagaaagguguuauuugaggaugauguguauuuuaaaugccagcaugggugagguguuguaagcguauguuugugaagcuuauguuauuaaagcgucucaaucgccau

SEQ ID NO: 11125 - RNA, 520 nt, Mus musculus
cgagccagggaagggccggaaaccacgauauuugagcuaccaagacgugcuuuagaguccuucuucuuaacccgaguuuaguggcaaucccaacuuuuaacuuuaagccucucguugguccaugaggucguguacagcugcaaaauggaauucaaaucaagggcuuauaugguuacuauaagaacaaccaaaaaaaaaaaaaaaagaaagaaauuaggugccagaucaaagacauuuuuagaggaaaagaaaauaaucgagacccuaaaugaacugaaguugcauauauucccgcaaaauggaaucccuagggcccuagauaaugccuugaaauuugaauacaugcggcucccaauguaacuuaggcaaguacgagauagcaacaaacacugaccauguuacuuccuguauuaauuuuacauuuacaaagaaaguuacauuaucuuugucauuaucauaaaaauaagaguccuuccuccuaguucagcuaccucacccaucucacacccaagagaaaaau

SEQ ID NO: 11126 - RNA, 520 nt, Mus musculus
auuuuucucuugggugugagaugggugagguagcugaacuaggaggaaggacucuuauuuuuaugauaaugacaaagauaauguaacuuucuuuguaaauguaaaauuaauacaggaaguaacauggucaguguuuguugcuaucucguacuugccuaaguuacauugggagccgcauguauucaaauuucaaggcauuaucuagggcccuagggauuccauuuugcgggaauauaugcaacuucaguucauuuagggucucgauuauuuucuuuuccucuaaaaaugucuuugaucuggcaccuaauuucuuucuuuuuuuuuuuuuuuugguuguucuuauaguaaccauauaagcccuugauuugaauuccauuuugcagcuguacacgaccucauggaccaacgagaggcuuaaaguuaaaaguugggauugccacuaaacucggguuaagaagaaggacucuaaagcacgucuugguagcucaaauaucgugguuuccggcccuucccuggcucg

SEQ ID NO: 11127 - RNA, 484 nt, Mus musculus
gcgccccagguaagucucuagaucugaccacuucuucauuuuaccaucugacugaagggauagaaacuaguuuggguuuuuagguauaaagacaguguuuuaccuccuaacguuguuccuuaaggcaaauuuccaaguuaaaaaaaaaaaucucacuuuucugauacuacuuuaugccuugcgagcgauguucaaauaucaucaaaugaacaagucucacuuuuaaaacaaacguguccuaaaaguccuaaaaauucaccacaaacacuucaacuucuugucagcguaaaagaucgccucugaagugaggucuuuaaaaacccgaaaugugggucacuguagaacaggacuuuaggcaccccaaaacgcaaaguaauaaguccucuggaccaccaccuagacuggcggcgucacccgcccacugugggcagcagaguccaaaggcgcucaagccuaguucucagccccuugcccaagaguccau

SEQ ID NO: 11128 - RNA, 484 nt, Mus musculus
auggacucuugggcaaggggcugagaacuaggcuugagcgccuuuggacucugcugcccacagugggcgggugacgccgccagucuagguggugguccagaggacuuauuacuuugcguuuuggggugccuaaaguccuguucuacagugacccacauuucggguuuuuaaagaccucacuucagaggcgaucuuuuacgcugacaagaaguugaaguguuuguggugaauuuuuaggacuuuuaggacacguuuguuuuaaaagugagacuuguucauuugaugauauuugaacaucgcucgcaaggcauaaaguaguaucagaaaagugagauuuuuuuuuuuaacuuggaaauuugccuuaaggaacaacguuaggagguaaaacacugucuuuauaccuaaaaacccaaacuaguuucuaucccuucagucagaugguaaaaugaagaaguggucagaucuagagacuuaccuggggcgc

SEQ ID NO: 11129 - RNA, 537 nt, Mus musculus
ggagaggugcgcgcggccucgggaaggacauggacgccugggacucggggcacuuggcuccggggcugcgggccgugaugucucuggggagccaaggacuggcucaguccucuagccucagaaagagagagagaacgggagcccaccggcagccugcgcguccacgugaagguggaagccuucugggguguggguacuggacgccugggggccgggagaucacgccaccccgagccccaucggaagauccucucugauuaaacauuaacgggccccgguacuaaaggaucagguuucggccucgcccuccccagacagcgucaaaugacgcucagagugaggacaaaaccccaaauccuaauugggcugcaaacgggaccuguuacauuccccccucuuaauccccacuccaauccuccucaggcggggugccaacucagaggcgugcugagccccaccucuuuagcauuuccggggucucccagccaccccuguacuucucccuccaacaauauuaacuaacuucuccugggcccu

SEQ ID NO: 11130 - RNA, 537 nt, Mus musculus
agggcccaggagaaguuaguuaauauuguuggagggagaaguacagggguggcugggagaccccggaaaugcuaaagagguggggcucagcacgccucugaguuggcaccccgccugaggaggauuggaguggggauuaagaggggggaauguaacaggucccguuugcagcccaauuaggauuugggguuuuguccucacucugagcgucauuugacgcugucuggggagggcgaggccgaaaccugauccuuuaguaccggggcccguuaauguuuaaucagagaggaucuuccgauggggcucgggguggcgugaucucccggcccccaggcguccaguacccacaccccagaaggcuuccaccuucacguggacgcgcaggcugccggugggcucccguucucucucucuuucugaggcuagaggacugagccaguccuuggcuccccagagacaucacggcccgcagccccggagccaagugccccgagucccaggcguccauguccuucccgaggccgcgcgcaccucucc

SEQ ID NO: 11131 - RNA, 3376 nt, Mus musculus
ccacuuuccccauguuuugcuucuaaggcuuucagaaaaguuacaugauaccauuuggaggggaaaauauuaucagguacauaauuggcagcuggacaugugucagucguugccuguaaaucuaauuacugagaauuagagcaugccacuacaugaccacagggauaagaaaaccacuacgacucggcucugauuagaaauucaacuuuuuaauuucuccucacuccugaauggguggauuagguauuauauuaacugugaaaauguacacccuguccgggugcccaggcuaucccauaccaagcgaggaaaggucguuuguuaagacaugaaacagcugaagguaaaacacccugccuagacgucaagagaauuaacuuuaaagucaauuauuaggaucaaaauaggugaauaccaccauuagcuguguauuuacuugaaauaauaaucauaauaaugugcuuaaagagcuaucuaaaacaacacugcacaaaacaaacagauuucgacgauaagaauacuuuaaaaccuccauugucacaaaagcauuccaaaaauuaugaccaaaccuaagauucucuugauaucgaggauguuauuggaguugaccaguuucuccaaaguacgucauuuuggggaguuggauccacuuaaagauauaaaauauggcaaccaugaagguuuuaaaacagugaagaucuguaccccuccaaacuuaaaagcugucauuuuagaaacccaggcaaccuuauuaacuuguuuuccccaccucuguggauaccaaccugcagcgcaguucucccaaauccauuuugagcguugacguuuacauuauuuugcaacaaacuaguaaguugcucuagguccccccuggcagcugcggacgccaacucguucccccaaggcucggccauucuuuaggguccugacgaucgggaaaagacgauuaguugcuucucuuuuuccccuuuccuuugcuccuaaucaggcugcaugauggcaucggaggcugacagaaggacugggaugguuaaucuggaguagagcuugguaguaaauacuaguaaggucggccugccaaaagcccgccccucgauucacacgugauuauucagcaaaagugagcccauuggagaggggcuccuucucuagcuuuuuagcuuaaccccuaagaaggauucuggcgauucaacagagauacauacacagaagcaguucuugauuaauuacuauggacgugagauguaggcagagcugucacguaccuaagcuuuacagcucugugaggaagauguugcggagacuuaaaggacuaggucagcucagacaacaccgcgaaagaaaaaguauuagagaguagaaaagguauuaacccacccuuguucacaguggugauuugaggcagaauuucagagucagguccuucgcagagcucacuuuccauccgucuagccgaaggggguaguccagagugcugcucgcucgcuagcagagcgccgcgcuggcuggaugcugacgugcucgggaggguuaaagacgaucgcugagggcagaccagagcagcagcucugaagcccucaacucucaggucucaacgacucccuagcgggcucggcgucuucagaagagccuccggagcccgcccgccgagcugccgcagccccgccgagccucagaggccgugggagccgggcagggcgcgggucuccggaggcuggugggugugcggcagacccccgccaagcccgucaugccggccccgccgggucccgggacucccggcagccugaagacggugcacggcgaagggggaagcgucuauggggcuccagccgcugggguagcucgcggcagcaucgcucuugcacccggccagcucaccaguaacuucccgccuacgaccgagcuagcucaggcucuucacugcaagcgcucgcugaggggcggccgucgccucugccgcugucguucccucccuuucagauuuucccggggcguccgaugaugggaagggucuuuggaaguaggagcggucgccacagaucccgggcgcagccagucccgccaacuucuuggcggccgcccagcagcucgggcgcucggugccacuuggccaguuaguucuuggcgguccuccggccugugccccuaucagugccgcggacaggacagcggcugccagccaguuggguuccggagccgaggcaggcugcgccggccggucgcgagccgcagcugacaguuucuuuuguaguccgacucccccaaaucucugaucgccgcucccuucuccgcuacagacacuugcgcgucuuuccuuuaggaucuuucccuucccucccuccuuugcuucuuuuuccgcugaagcaacugcugcuacgguugccucugaagguacugugccgguuucuuaucccuuuuuuccgaccucaucagcuuuuuuugaaaagaaaaaaauugagcgcuuuuugaguugaaaaacccgcccccauuuuaacggcagaguuuuaaggaggcuccgccgaguuagggcgccgcgggagcgggaaggccgggccccgcccacgccccgcccaacgcccuggcggcgcaguggccggcagcccgcucgcuccgcccucgcggcccugcgcccuucucugcccgcgcugggccuggguucgcuggcgcucccgccugcccucucgcuucgcuagucuccccugccgaagcgggguggguucggcccggccuggccugcuguucuggggcuggcuggagugggagccucuaccgugcgggaccccgguggugguaacuaaggccgcgggugcgggcggaggcccuuagaggcucggcggcccugcagcugacggguaggaucuccucugcuggagccgggcagcuccacccuccucggcgcuccccgaccaggcucgccgaguucgaguggccuggcccggggcugcuggacuccuuugcucugccacaggccuuggcaccugucaggucauugccagggcugcagaggcgacacaacugacagcaccacagggcagagaagucuuguagaccgaguuuuaugagaacugaaagcauauuacaagaaaucccgacgaacuucagggucuagaaaaugugaacuucuagucuugagggaaaaggagaaaugcaauuaacuuuaaacaaagcuuacagugaguuagaaagguuuucuaaaaaggcuaugucuuuauugggggauuucuuucacucacuacaccgaggauugguuguuuuuagguggaggugaggaugguggucuaaguguaaaaggaccagugcauccauauauuucauauucaucaauuuucuguacuuuucacgucuucuuguaggcauaugagauuauugccuu

SEQ ID NO: 11132 - RNA, 3376 nt, Mus musculus
aaggcaauaaucucauaugccuacaagaagacgugaaaaguacagaaaauugaugaauaugaaauauauggaugcacugguccuuuuacacuuagaccaccauccucaccuccaccuaaaaacaaccaauccucgguguagugagugaaagaaaucccccaauaaagacauagccuuuuuagaaaaccuuucuaacucacuguaagcuuuguuuaaaguuaauugcauuucuccuuuucccucaagacuagaaguucacauuuucuagacccugaaguucgucgggauuucuuguaauaugcuuucaguucucauaaaacucggucuacaagacuucucugcccuguggugcugucaguugugucgccucugcagcccuggcaaugaccugacaggugccaaggccuguggcagagcaaaggaguccagcagccccgggccaggccacucgaacucggcgagccuggucggggagcgccgaggaggguggagcugcccggcuccagcagaggagauccuacccgucagcugcagggccgccgagccucuaagggccuccgcccgcacccgcggccuuaguuaccaccaccggggucccgcacgguagaggcucccacuccagccagccccagaacagcaggccaggccgggccgaacccaccccgcuucggcaggggagacuagcgaagcgagagggcaggcgggagcgccagcgaacccaggcccagcgcgggcagagaagggcgcagggccgcgagggcggagcgagcgggcugccggccacugcgccgccagggcguugggcggggcgugggcggggcccggccuucccgcucccgcggcgcccuaacucggcggagccuccuuaaaacucugccguuaaaaugggggcggguuuuucaacucaaaaagcgcucaauuuuuuucuuuucaaaaaaagcugaugaggucggaaaaaagggauaagaaaccggcacaguaccuucagaggcaaccguagcagcaguugcuucagcggaaaaagaagcaaaggagggagggaagggaaagauccuaaaggaaagacgcgcaagugucuguagcggagaagggagcggcgaucagagauuugggggagucggacuacaaaagaaacugucagcugcggcucgcgaccggccggcgcagccugccucggcuccggaacccaacuggcuggcagccgcuguccuguccgcggcacugauaggggcacaggccggaggaccgccaagaacuaacuggccaaguggcaccgagcgcccgagcugcugggcggccgccaagaaguuggcgggacuggcugcgcccgggaucuguggcgaccgcuccuacuuccaaagacccuucccaucaucggacgccccgggaaaaucugaaagggagggaacgacagcggcagaggcgacggccgccccucagcgagcgcuugcagugaagagccugagcuagcucggucguaggcgggaaguuacuggugagcuggccgggugcaagagcgaugcugccgcgagcuaccccagcggcuggagccccauagacgcuucccccuucgccgugcaccgucuucaggcugccgggagucccgggacccggcggggccggcaugacgggcuuggcgggggucugccgcacacccaccagccuccggagacccgcgcccugcccggcucccacggccucugaggcucggcggggcugcggcagcucggcgggcgggcuccggaggcucuucugaagacgccgagcccgcuagggagucguugagaccugagaguugagggcuucagagcugcugcucuggucugcccucagcgaucgucuuuaacccucccgagcacgucagcauccagccagcgcggcgcucugcuagcgagcgagcagcacucuggacuacccccuucggcuagacggauggaaagugagcucugcgaaggaccugacucugaaauucugccucaaaucaccacugugaacaaggguggguuaauaccuuuucuacucucuaauacuuuuucuuucgcgguguugucugagcugaccuaguccuuuaagucuccgcaacaucuuccucacagagcuguaaagcuuagguacgugacagcucugccuacaucucacguccauaguaauuaaucaagaacugcuucuguguauguaucucuguugaaucgccagaauccuucuuagggguuaagcuaaaaagcuagagaaggagccccucuccaaugggcucacuuuugcugaauaaucacgugugaaucgaggggcgggcuuuuggcaggccgaccuuacuaguauuuacuaccaagcucuacuccagauuaaccaucccaguccuucugucagccuccgaugccaucaugcagccugauuaggagcaaaggaaaggggaaaaagagaagcaacuaaucgucuuuucccgaucgucaggacccuaaagaauggccgagccuugggggaacgaguuggcguccgcagcugccaggggggaccuagagcaacuuacuaguuuguugcaaaauaauguaaacgucaacgcucaaaauggauuugggagaacugcgcugcagguugguauccacagagguggggaaaacaaguuaauaagguugccuggguuucuaaaaugacagcuuuuaaguuuggagggguacagaucuucacuguuuuaaaaccuucaugguugccauauuuuauaucuuuaaguggauccaacuccccaaaaugacguacuuuggagaaacuggucaacuccaauaacauccucgauaucaagagaaucuuagguuuggucauaauuuuuggaaugcuuuugugacaauggagguuuuaaaguauucuuaucgucgaaaucuguuuguuuugugcaguguuguuuuagauagcucuuuaagcacauuauuaugauuauuauuucaaguaaauacacagcuaauggugguauucaccuauuuugauccuaauaauugacuuuaaaguuaauucucuugacgucuaggcaggguguuuuaccuucagcuguuucaugucuuaacaaacgaccuuuccucgcuugguaugggauagccugggcacccggacaggguguacauuuucacaguuaauauaauaccuaauccacccauucaggagugaggagaaauuaaaaaguugaauuucuaaucagagccgagucguagugguuuucuuaucccuguggucauguaguggcaugcucuaauucucaguaauuagauuuacaggcaacgacugacacauguccagcugccaauuauguaccugauaauauuuuccccuccaaaugguaucauguaacuuuucugaaagccuuagaagcaaaacauggggaaagugg

SEQ ID NO: 11133 - RNA, 551 nt, Mus musculus
gcccgcgccgcgaacaaaggccgccaugaagcccgggccgccgcgccgcgggaccgcacaggggcagcgcguggacaccgccacccaugcgcccggggcccgcgggcuguugcugccaccgcugcugcugcugcugcuggccggccgcgccgcgggggugagugaugggccccaagaggguccccagcguguaccccgcgugucuuugcguguccccucgucgcgcgugccgcgcugggugugucccggucucaugggguccccuccccgccgggaagcgugugcguccgguauccgcuggggucgccuucuccccacccccacuccaucccaagcugccugcagggccuugggggcauuggaggaggagggggugggucgaugaaggugacccgcgagggugaaugagggugacccugugugugugugucugcuucuaagaagggugcgugggcaccugugggugugggcacgggagaggcucuguccauauggcuggauggcauccgcaucccgcuccacacuagggugacccauucugcacgcugugu

SEQ ID NO: 11134 - RNA, 551 nt, Mus musculus
acacagcgugcagaaugggucacccuaguguggagcgggaugcggaugccauccagccauauggacagagccucucccgugcccacacccacaggugcccacgcacccuucuuagaagcagacacacacacacagggucacccucauucacccucgcgggucaccuucaucgacccacccccuccuccuccaaugcccccaaggcccugcaggcagcuugggauggaguggggguggggagaaggcgaccccagcggauaccggacgcacacgcuucccggcggggaggggaccccaugagaccgggacacacccagcgcggcacgcgcgacgaggggacacgcaaagacacgcgggguacacgcuggggacccucuuggggcccaucacucacccccgcggcgcggccggccagcagcagcagcagcagcgguggcagcaacagcccgcgggccccgggcgcauggguggcgguguccacgcgcugccccugugcggucccgcggcgcggcggcccgggcuucauggcggccuuuguucgcggcgcgggc

SEQ ID NO: 11135 - RNA, 2169 nt, Mus musculus
uuucccuuuucccucaacaucugcccguuaagccaaacucaugguccuuuuauuaaauaacauuuuagcuuuauucaguaguucguucaucucucaccccaaguccaucgcugcucacauuuagaaucuagagaggccacguggccacuuuacccguuuccacaguccucgccuggccccugccugugguccugccugcucagcgugcagaucugggaaccugagauccagggaaggauuuguucacggaccgggcuagcucucccggagccgucuuccugucuggugguggucacaccucagacucgcgcggcggggcgcgugcgcgcuggcagccguacaaccacuggaugacgcgcgcguugcguuccaccaccgacaccguggggcguccgucccgcgccgacccugccgccuccgagccgccgccgccgcccgcacaguccgggcuacccgcgucccugucgcuggauguccaaucgcugguguccccggagccgggcggcggcgacguugcgaccugagggccgugcucugcgccccagcucugcggagagaagcgcucggcgcccagcaccuccaccagcgcgcgcuccaagccgcaguaguugaagaaucgcucuuucuccgacaguggcagcgagcacgugggacacacugcgcgcuuuccugucgccucugguguauccggggacccagcccaccccgcgggagccccaggucucucuguaggugccgggcugcucggggcagcgucccggguggcacccaggaaaaggcgucguacuagccccuggcccuuggcguucucuuuguucaccgaagccuugcagucccucuucuggcgguaaaagauaagggagucaggucuuggcugucgccugccgcuaccccggcgggcaggcccaggcguucugggcgaugcagaggcccccaacucauugcagggguguggugucagcgguccuggucccccgcgcagggcuggcuccugacgacguacaaucaccuggugcgucuugacguacuuggcuuugucggcuuccagccucuccacggcgcuggggguucguccccucgaagguguagugggugaggacagcagcaucuuaacggagcugggcaggucagggcuccauacacaguuaaggacgcacagguagcugaggagcagcgagcaauucuccggaguuccuggcgccuguggggagagaggaauugucuggaagagaguaguaggcuguuccuguuccuuucccgcaggcauuccuggguagaggaucagccaguuaccccucccccacgaacuggugccaugcccaaggagcagaagagagaaccucccuccuuccuuuacagcauugggugguucuuggggagggggcaucuaugcuccuuugagaacaucccgaccuggccucugaaccauguacacaagacaagcaagcaggacacuuggaaaggaaaaucaggcgggguccuagcccgguucccgaaaccggccuuaaccggaaaaaauaccucuucccaacaguguagcuucaaacccaagacaaggaggcuccccagccacaggcugacugcagccgacccacccuucccgcccccaagcaccgaggucagggacauaaccauaggguagaagccucuaggagcugcugccagcuuccuugcccaggcccaacagggcuauucaggaaggagagggagguuguccgcgggccguaucaaucugcgacugccagccacucuaugccccugccaaggggagucccagaaagccuaacuguaaacaccauuccguccaacaacccccacacuuccauuucagaggccaggacaauggccuggaaaugaaaggguuuaaacgggucccuuugagaguuagggugccaccuugaaacccagauuucuugccuuacugugcagaucuagaucagcuuggacucccugccggucuaucagaacguuucccucugagguuugguuucugaucuuguuguucuaaaacugggcaggaaccccucgucucacuuaucuguucccuccaccaauucuucugaauaacuuccacaccagaaauuggcccucggggucccuauccccuucacauucaaagaccucuggccuuuuuccuucaccccccuugugcugcggaaaagggcagga

SEQ ID NO: 11136 - RNA, 2169 nt, Mus musculus
uccugcccuuuuccgcagcacaaggggggugaaggaaaaaggccagaggucuuugaaugugaaggggauagggaccccgagggccaauuucugguguggaaguuauucagaagaauugguggagggaacagauaagugagacgagggguuccugcccaguuuuagaacaacaagaucagaaaccaaaccucagagggaaacguucugauagaccggcagggaguccaagcugaucuagaucugcacaguaaggcaagaaaucuggguuucaagguggcacccuaacucucaaagggacccguuuaaacccuuucauuuccaggccauuguccuggccucugaaauggaaguguggggguuguuggacggaaugguguuuacaguuaggcuuucugggacuccccuuggcaggggcauagaguggcuggcagucgcagauugauacggcccgcggacaaccucccucuccuuccugaauagcccuguugggccugggcaaggaagcuggcagcagcuccuagaggcuucuacccuaugguuaugucccugaccucggugcuugggggcgggaagggugggucggcugcagucagccuguggcuggggagccuccuugucuuggguuugaagcuacacuguugggaagagguauuuuuuccgguuaaggccgguuucgggaaccgggcuaggaccccgccugauuuuccuuuccaaguguccugcuugcuugucuuguguacaugguucagaggccaggucgggauguucucaaaggagcauagaugcccccuccccaagaaccacccaaugcuguaaaggaaggagggagguucucucuucugcuccuugggcauggcaccaguucgugggggagggguaacuggcugauccucuacccaggaaugccugcgggaaaggaacaggaacagccuacuacucucuuccagacaauuccucucuccccacaggcgccaggaacuccggagaauugcucgcugcuccucagcuaccugugcguccuuaacuguguauggagcccugaccugcccagcuccguuaagaugcugcuguccucacccacuacaccuucgaggggacgaacccccagcgccguggagaggcuggaagccgacaaagccaaguacgucaagacgcaccaggugauuguacgucgucaggagccagcccugcgcgggggaccaggaccgcugacaccacaccccugcaaugaguugggggccucugcaucgcccagaacgccugggccugcccgccgggguagcggcaggcgacagccaagaccugacucccuuaucuuuuaccgccagaagagggacugcaaggcuucggugaacaaagagaacgccaagggccaggggcuaguacgacgccuuuuccugggugccacccgggacgcugccccgagcagcccggcaccuacagagagaccuggggcucccgcggggugggcuggguccccggauacaccagaggcgacaggaaagcgcgcagugugucccacgugcucgcugccacugucggagaaagagcgauucuucaacuacugcggcuuggagcgcgcgcugguggaggugcugggcgccgagcgcuucucuccgcagagcuggggcgcagagcacggcccucaggucgcaacgucgccgccgcccggcuccggggacaccagcgauuggacauccagcgacagggacgcggguagcccggacugugcgggcggcggcggcggcucggaggcggcagggucggcgcgggacggacgccccacggugucggugguggaacgcaacgcgcgcgucauccagugguuguacggcugccagcgcgcacgcgccccgccgcgcgagucugaggugugaccaccaccagacaggaagacggcuccgggagagcuagcccgguccgugaacaaauccuucccuggaucucagguucccagaucugcacgcugagcaggcaggaccacaggcaggggccaggcgaggacuguggaaacggguaaaguggccacguggccucucuagauucuaaaugugagcagcgauggacuuggggugagagaugaacgaacuacugaauaaagcuaaaauguuauuuaauaaaaggaccaugaguuuggcuuaacgggcagauguugagggaaaagggaaa

SEQ ID NO: 11137 - RNA, 407 nt, Mus musculus
agucaggggcgugguuucgcgcagcuuggaggccagcaacaggcagacggguaccuagaagcugcaauugcgccuuucggguggggacgcaggacagguagcgauacagguagaucauagccagauggaagacauccuccucgcagcgcugcuccucacacaccuccagcauccaguaugccagcaucuuccgcaugugcggcuugaucuucuuuugcaugcacuggaaggaggaggaucgcggcacguagcgcuccuccaggcggaguaaacucugcaggacacacugguccauaagcagccgcgggucgggccuggcccggggcgcgugccgggugcccucgcaacauagcagcuccauccugcgauggcucacgggugaaagcaagagugugggcuagcgaguc

SEQ ID NO: 11138 - RNA, 407 nt, Mus musculus
gacucgcuagcccacacucuugcuuucacccgugagccaucgcaggauggagcugcuauguugcgagggcacccggcacgcgccccgggccaggcccgacccgcggcugcuuauggaccaguguguccugcagaguuuacuccgccuggaggagcgcuacgugccgcgauccuccuccuuccagugcaugcaaaagaagaucaagccgcacaugcggaagaugcuggcauacuggaugcuggaggugugugaggagcagcgcugcgaggaggaugucuuccaucuggcuaugaucuaccuguaucgcuaccuguccugcguccccacccgaaaggcgcaauugcagcuucuagguacccgucugccuguugcuggccuccaagcugcgcgaaaccacgccccugacu

SEQ ID NO: 11139 - RNA, 1937 nt, Mus musculus
ccgccaucuuagccgccgccgccuccagcgcagcgcugccgacgaggggagggcgcgcgcggcccagcagcacggcggcugccguucccaucccggugcucgccgcgccgcccagccgccggcccccggcugcccgcgccccucucggcgucccgcgcgacucccugcugcuuccgcgucgggccggccguggcgccccgagcccgagcgaugcugcgccgcccugcgcccgcgcuggccccggccguccggcugcugcuggcggggcugcugugcggcggcggggucugggccgcgcgagguaagcgacggggcgcggugagccgggugcgggagucagaaccgagugcaagguugggccgaaugcagaagucaugcggggccgcgggguucgggucggggccgggugcgggaaccgugcucgggugcaagguggggggcugagugcgagggucaugcggggcggcgggguuaugggcaagugcugcaguccuguagggccucuggguucugggccgagugcgggacucgugccagagcccaggguucggguccuagugcgcgcauuguaucaggcaagguucggguccgaguguggggaucgugccgaggcccaggguucggauacgagugcgcgagucauauugggcaagguuggguccgaguucgggcauaguaaccgggugcaaggaggugggcagagugcaggagucgugcagggccgcggaauuuggguccgagugugggaauugugccagggcugaggguucagguccgagugcgcgcgucguauugggcgaggcucggaucccggugcgcagaucgucuccagcaagguucggggcccagaucguaucaggugcacagguacaggacccagugcaggaauagugucagcgcacagggaucggugccgagugagguaguguugcuggggcgcgggguuccgacccgacugugugacugauugccugggagcggggcucugggcugagugcggaacaucgagcccgcucgcuacgugagauucagguucaggcgcucagagaagagcuccggagaaccuaggcgcgcgcugcagaugccuggggaagccaauuuuguacccgggcggggcaccugggccaugacugcccuaguuguagccccagggugcuugaggugcuggucuggggagaucuggggacacgcggugggaguuagcccacuuuccaguagcgcaugcagccuggggggugcgccccugggugggaugcaguguacguguguuggaugaucagcccagggaugcacgcaaggauuuuggugugugcuuacauaagauuccacuccuccgcaucacuuucccaagaucccgguucucugcugcggcuagguggacaccacgacuucgccccuuuucgccuccucuccgcguccuuuaaacgcgguuucggaaguaacagaggcgaaaacuccucuuccuucccacccuuuugcccaaagacgaaauugagaagguguuugugaucacuuuucauccaccagugugaacaaagcgcucguccgcugcaccuuuacucagaguaguguaccggacuuguaugaccaccacagagaccagccagccccgcuaauuccuuaggagugugggaggcaaauaggauuuugcuguuuuaaaucuucauccacuucaucuaaacauuguaccugccuucugauauugaccgagcuugccaccaaaacugcuuacgcauugcagauaaagccuucugaauggaacuugaaaccguaaacauuuuuccuggucuuaaaguagucuagguagauagucuguagagagugcucgaaucuauuuucuucaaguguauauuuuggaaaucaaaagagcuuugugggaggaggauugauagaagucugggugagauggucacguaauaacuuugcaagcuuuaaaa

SEQ ID NO: 11140 - RNA, 1937 nt, Mus musculus
uuuuaaagcuugcaaaguuauuacgugaccaucucacccagacuucuaucaauccuccucccacaaagcucuuuugauuuccaaaauauacacuugaagaaaauagauucgagcacucucuacagacuaucuaccuagacuacuuuaagaccaggaaaaauguuuacgguuucaaguuccauucagaaggcuuuaucugcaaugcguaagcaguuuugguggcaagcucggucaauaucagaaggcagguacaauguuuagaugaaguggaugaagauuuaaaacagcaaaauccuauuugccucccacacuccuaaggaauuagcggggcuggcuggucucugugguggucauacaaguccgguacacuacucugaguaaaggugcagcggacgagcgcuuuguucacacugguggaugaaaagugaucacaaacaccuucucaauuucgucuuugggcaaaagggugggaaggaagaggaguuuucgccucuguuacuuccgaaaccgcguuuaaaggacgcggagaggaggcgaaaaggggcgaagucgugguguccaccuagccgcagcagagaaccgggaucuugggaaagugaugcggaggaguggaaucuuauguaagcacacaccaaaauccuugcgugcaucccugggcugaucauccaacacacguacacugcaucccacccaggggcgcaccccccaggcugcaugcgcuacuggaaagugggcuaacucccaccgcguguccccagaucuccccagaccagcaccucaagcacccuggggcuacaacuagggcagucauggcccaggugccccgcccggguacaaaauuggcuuccccaggcaucugcagcgcgcgccuagguucuccggagcucuucucugagcgccugaaccugaaucucacguagcgagcgggcucgauguuccgcacucagcccagagccccgcucccaggcaaucagucacacagucgggucggaaccccgcgccccagcaacacuaccucacucggcaccgaucccugugcgcugacacuauuccugcacuggguccuguaccugugcaccugauacgaucugggccccgaaccuugcuggagacgaucugcgcaccgggauccgagccucgcccaauacgacgcgcgcacucggaccugaacccucagcccuggcacaauucccacacucggacccaaauuccgcggcccugcacgacuccugcacucugcccaccuccuugcacccgguuacuaugcccgaacucggacccaaccuugcccaauaugacucgcgcacucguauccgaacccugggccucggcacgauccccacacucggacccgaaccuugccugauacaaugcgcgcacuaggacccgaacccugggcucuggcacgagucccgcacucggcccagaacccagaggcccuacaggacugcagcacuugcccauaaccccgccgccccgcaugacccucgcacucagccccccaccuugcacccgagcacgguucccgcacccggccccgacccgaaccccgcggccccgcaugacuucugcauucggcccaaccuugcacucgguucugacucccgcacccggcucaccgcgccccgucgcuuaccucgcgcggcccagaccccgccgccgcacagcagccccgccagcagcagccggacggccggggccagcgcgggcgcagggcggcgcagcaucgcucgggcucggggcgccacggccggcccgacgcggaagcagcagggagucgcgcgggacgccgagaggggcgcgggcagccgggggccggcggcugggcggcgcggcgagcaccgggaugggaacggcagccgccgugcugcugggccgcgcgcgcccuccccucgucggcagcgcugcgcuggaggcggcggcggcuaagauggcgg

SEQ ID NO: 11141 - RNA, 1113 nt, Mus musculus
cacuccgcucaguacgucgccauccaccuggcccaacgccaagaugguuauaguuuugauggcuggcacagcccaggcggcuaaauggaaauacugugaguuggccucgauggcuucguggccccacuucaugccggcugccaggaaccaggugagggacaggaucacccaccagauggagcuggccaugcugaagaaguagagcaucauaaagaguauagugcagccuucuuucuuagugcccugcgccaccgugcgcgccccguccucugcaaacuugucguugcacaccacccgguccuccaacagaaagccagcgauguaggccaccgccaccgcuguguaacagccggacaggaaaaugaugggccguuccggguagcugaagcgccgcauguccacuagguacgugagcaccgugaagagcguggaggcgcagcacagcacggaccagaugccuauccaggugcgcgagaagcgcagcuccucuggcccgaaguacaugagcccguaaaccuugguggguucgcagggugcgccgcaguccuucucccccagaaagugguaguugagguaggagggcacccugagggcgcgcgggcaggagaacuuuccccgcuccaccgucccggcaccccccggguagccgccgcgguaaccaccgccgccgugcugcggauuacugguccagaacucugguagcaaggagggaguuggggugccuuugucggacguguucuggcccacgcacagcucuccugcgccgugcaccgggaacuucucgcacuugagugugucuggccacuggaagccgaacuuguucaugagcgccucgcagcccuggcgugcgcgcucgcacagggagcggcagggcgguagcgccugcuccaguacggugcacacaggcgcguacauggagcacaggaagaacuugagcucggcggagcacugcaccuucaccagaggguagaacuggugcaccuccagaccggcguccuccugauucguguggcccagcagguugggcaugauggucugguuguacgcgauguccgugcacagcgggauggagaugggcuggcaguagccgugguccgggauggagaugccccg

SEQ ID NO: 11142 - RNA, 1113 nt, Mus musculus
cggggcaucuccaucccggaccacggcuacugccagcccaucuccaucccgcugugcacggacaucgcguacaaccagaccaucaugcccaaccugcugggccacacgaaucaggaggacgccggucuggaggugcaccaguucuacccucuggugaaggugcagugcuccgccgagcucaaguucuuccugugcuccauguacgcgccugugugcaccguacuggagcaggcgcuaccgcccugccgcucccugugcgagcgcgcacgccagggcugcgaggcgcucaugaacaaguucggcuuccaguggccagacacacucaagugcgagaaguucccggugcacggcgcaggagagcugugcgugggccagaacacguccgacaaaggcaccccaacucccuccuugcuaccagaguucuggaccaguaauccgcagcacggcggcggugguuaccgcggcggcuacccggggggugccgggacgguggagcggggaaaguucuccugcccgcgcgcccucagggugcccuccuaccucaacuaccacuuucugggggagaaggacugcggcgcacccugcgaacccaccaagguuuacgggcucauguacuucgggccagaggagcugcgcuucucgcgcaccuggauaggcaucugguccgugcugugcugcgccuccacgcucuucacggugcucacguaccuaguggacaugcggcgcuucagcuacccggaacggcccaucauuuuccuguccggcuguuacacagcgguggcgguggccuacaucgcuggcuuucuguuggaggaccggguggugugcaacgacaaguuugcagaggacggggcgcgcacgguggcgcagggcacuaagaaagaaggcugcacuauacucuuuaugaugcucuacuucuucagcauggccagcuccaucuggugggugauccugucccucaccugguuccuggcagccggcaugaaguggggccacgaagccaucgaggccaacucacaguauuuccauuuagccgccugggcugugccagccaucaaaacuauaaccaucuuggcguugggccagguggauggcgacguacugagcggagug

SEQ ID NO: 11143 - RNA, 1063 nt, Mus musculus
agggaggagccuugaaaccgacgcggagcuggcggcucagggaccgucgcccaaucgcagcacccgcuucacagcgcaaagggagcccuuucccuccgagcccggacuggagcccgcagcagaccggaggagguggaggaaguagugguggcgguggcagagacuccgcuccggcacaaagaguagcuaugaagccggacaggcuaggucgcuuuugcuuuugcagaagaaagggcgaggacaaguaagagaauggucccauaugcggcaggagauaaugaauaggagucggcuggccgcggggauuuagcucugucuugcuuuuuaucugucuucauauuuuauaauccuacccucgacucucuggucacagacugcuacuuugagugcugcguucugauugcgugccccugacuugagagucggguuuccuuugaauuuaagucugucgagguuuuguuuaaacuaugacuccaauaaaccguggagcucacagacuggccuugguggacuuuggacgcgccauuucccccgaucgcugucaaaugaaagcaaaacgcaaaguuuggugggauguaaauuguaaacccagaugcuccugugaguaguaugcgucguguagucaaacuuucccccuucucuuuaaugguaucagaaacagaaguaaaggaaaacagaagcuauucauuaaaugcuggaggaaaaccggcuugagaaccaacgcauugggugcuccagcgugagacacgggagccauacauccagacaggaggaucaaucugggaccauuugagggccgcuucuaaacacuggggacccugcagggucuguugggaacuucugaggccugggucauuuaaguuccuccucaguggaaguagucaaagcugaagcuauuaguuugaaggacaaaacacaugaccaaagugagucugaaagaccaagcacagucagucagucgacucaaaccaggauaaucaaccucagcagacacacaugcuuguucuugcaaguuuauuuucaagaacuugugugagucggauuuaucaauaaagugcuauua

SEQ ID NO: 11144 - RNA, 1063 nt, Mus musculus
uaauagcacuuuauugauaaauccgacucacacaaguucuugaaaauaaacuugcaagaacaagcaugugugucugcugagguugauuauccugguuugagucgacugacugacugugcuuggucuuucagacucacuuuggucauguguuuuguccuucaaacuaauagcuucagcuuugacuacuuccacugaggaggaacuuaaaugacccaggccucagaaguucccaacagacccugcaggguccccaguguuuagaagcggcccucaaauggucccagauugauccuccugucuggauguauggcucccgugucucacgcuggagcacccaaugcguugguucucaagccgguuuuccuccagcauuuaaugaauagcuucuguuuuccuuuacuucuguuucugauaccauuaaagagaagggggaaaguuugacuacacgacgcauacuacucacaggagcaucuggguuuacaauuuacaucccaccaaacuuugcguuuugcuuucauuugacagcgaucgggggaaauggcgcguccaaaguccaccaaggccagucugugagcuccacgguuuauuggagucauaguuuaaacaaaaccucgacagacuuaaauucaaaggaaacccgacucucaagucaggggcacgcaaucagaacgcagcacucaaaguagcagucugugaccagagagucgaggguaggauuauaaaauaugaagacagauaaaaagcaagacagagcuaaauccccgcggccagccgacuccuauucauuaucuccugccgcauaugggaccauucucuuacuuguccucgcccuuucuucugcaaaagcaaaagcgaccuagccuguccggcuucauagcuacucuuugugccggagcggagucucugccaccgccaccacuacuuccuccaccuccuccggucugcugcgggcuccaguccgggcucggagggaaagggcucccuuugcgcugugaagcgggugcugcgauugggcgacggucccugagccgccagcuccgcgucgguuucaaggcuccucccu

SEQ ID NO: 11145 - RNA, 831 nt, Mus musculus
cugacauagauacagguagaggaugcaaucuuccucucacgggacacuucucuccaaaaaagccuuguucguucaaacucccaaaccccugcuuuggugggaaacacugcaguugugaauaaauuaccuagagucuguguccuagcccccaccccccauccccgcucgugcgcauaacacuccaaaucccauuucugugacgggccugggucccuuuggaaccguaagcgucagcacccacccccucacugcugcugcggcacucggucucccguaccuggacucucgccucggugaggucgaucuucagugcuagcucuucccugguguagaugucaggguagugcgucucagcgaagacccucuccaacucuuugagcugcgcgcuugugaagguggugcggaugcgccgcugcuugcguuucucguugaggccgccguggucggugaagaguuuguauggaacuagaggaugacagaggagacuagagugagcaaaacagucaggaugugaagggccacugaaccagaacgcggggaccaaggucagauagcccgggagccgcuacagacaccaggcacuucuagaaggagguuuuaguuacggcgaccugccaagaaaacccagcaaauuaguaucauacagaaacaggggcgcgaguguaacuuugugccuguuuuuguggcccaagugccuuugggugagaugaaauagcaaguuggagaguguuugaggccccaaauggaggauaguucauucagcaggaaaacaguccaaaaccaucauuaguuggaauaucagaaagccaggaacgaaguuaaccacucacg

SEQ ID NO: 11146 - RNA, 831 nt, Mus musculus
cgugagugguuaacuucguuccuggcuuucugauauuccaacuaaugaugguuuuggacuguuuuccugcugaaugaacuauccuccauuuggggccucaaacacucuccaacuugcuauuucaucucacccaaaggcacuugggccacaaaaacaggcacaaaguuacacucgcgccccuguuucuguaugauacuaauuugcuggguuuucuuggcaggucgccguaacuaaaaccuccuucuagaagugccuggugucuguagcggcucccgggcuaucugaccuugguccccgcguucugguucaguggcccuucacauccugacuguuuugcucacucuagucuccucugucauccucuaguuccauacaaacucuucaccgaccacggcggccucaacgagaaacgcaagcagcggcgcauccgcaccaccuucacaagcgcgcagcucaaagaguuggagagggucuucgcugagacgcacuacccugacaucuacaccagggaagagcuagcacugaagaucgaccucaccgaggcgagaguccagguacgggagaccgagugccgcagcagcagugagggggugggugcugacgcuuacgguuccaaagggacccaggcccgucacagaaaugggauuuggaguguuaugcgcacgagcggggauggggggugggggcuaggacacagacucuagguaauuuauucacaacugcaguguuucccaccaaagcagggguuugggaguuugaacgaacaaggcuuuuuuggagagaagugucccgugagaggaagauugcauccucuaccuguaucuaugucag

SEQ ID NO: 11147 - RNA, 3287 nt, Mus musculus
uacuaccagccgagccuaguuuuaugaaaaagccuccugugagaugccuugucugaggucucuagaguauauaguccucauaauaaacuuggcucuuuccacuuggacaauagcaaagcgguuggucuuauugcuggcgcuuuuuacaugacaauaacucauccgucuauugggcuggcacuggggaacugagcuguccaaccucccuaucauugauuccugcaucucuaauuagaauuuaauaccacaccauuacgcaccgagccccugauccucccuucuaaccagcuccugcccuuuaauucaaucacgcuacuuggaaauaaugaaaguugggugacgauuuucccugauccaauuuccaagagcuuuuaagccuuuuuaacugaucauauaccuuaggcauaaauugagauaguguguuuccccccuucuucguccuuuuuuuuuuuuuuuucuugguuagggagaagaaaccuugaugucauagaaaaccuguuuuguaagaguguuacacgcucaauuuaacaacaagccuucccccgaagugcaugaaaugcuauaaaggacugggacauuggcaagacucaggcgcccuguaacauagcguaagugggccaaaggguuuuaugugaacgauaagaauaagcggauuucuuuaaaauacaccuaguccaagggguuggaaaaaauagcaucuuaucaauuguguuucuccucgaagcuuaaugugcuuuccaaagacgugggcagacagccccuuuacaagaguaaaauaaacaaccgaguaaagcucucaaaggugaaacaucuggauuuccuacugaacguuucucugcgcuuagcagugcugugucugccugcguuaguucagauuugcaucggcguguaugaaacuucccgugguggagguucguuuuaaucacucgcuagcuaccaagcccagcacgaaauguacccaaaugggggucuccuuuuccagcccuuugcucucgcacucucuuucgcgucccaauccccuccagacuuggaguuucccaaagaggaucgcugccuguuugcccuuuagguuuuuggacuucacggagcaauuuaagcaaacaaggcaacggcucgaagcagcgcacuuuccuaguucgauuccucgggcucuuggguccuggcaacaaggcgcagacaaagaagccagccgugauuuguggaccuccuuggcccuaugauuuaagcggaggguaauuuucauuugguucguuagacucuagcagaauaaagggaaauauuucauuaaauccuuccucucgguggacaagaggggggaaaugcuuaguugaaucgccgugcgguguaaacaaacccuggauauuuuauaugaauuaaauguguagauaauuaguuuuauugcauucauuacccccuuuaugugcucuguaacaagucaguaauuaaaguaacaaacucauaaagucuuuauaggggcauuuaggcguucaguguuugccaaacuaagugguuuaauucgaugcuagugcuggggaguggaugggcgcccgcucuccacugccacccuacuuuauugcacacuaaaccgcugcagacgcuguaauggauuaaacccacagcgacaccggcccccagccuuuucagccucggcccagguguuugcgcauccucuguacggaagagcgcugaacuggcgaguucaggcaaggagacccagcgaggaagcuggugauaguuuuauggggagagcugauaguuuuauugcaguuguacgcuguacaaugcguauuugauaaagaagggcccuuggugagcaacgugcacuuuuuuugugcacgaggguaagaugaaaauaaaugcguucaagguuugacugcggcgggaaacaaauugcaacacucuaaaugguuuuucuuuauggucaccagacaagaggagaaaaggggauacaaacaucugucuucagucccugaaccuaaaggccagcaaagacggaugcgaauccaaggguuauuacugcgcgaauuugucuuuauuuaucgcucccucaugaauaugaaucugcaucuggaccgggaggugccuguguaccccacggauccacauggaauuucccucgcugguuuucucccacugccuuccacuucagagagguggggggguaagccaacaagcacaaggcgcugauuguccaaguuucuccguucccugggaguuagggcugaggccagaaaggagggcagagucguugguuuuucucaaagggauguuuuagcucaggccagcgcucugacgaugccaaagcgcaggguuuagaccagguuaggccagauuaacaccggccagccugcgccugguugagacgggcuuuaagugguuuuuuuuuuuuuuuuuuuuuuuuucuugcaggagagacauuuagggggucuaggaugcguuuagucucuaaggccuagguuuggcaaaggccagguucaaagccugucugaggugugugaccgguguaagccauucgaagcuucacccaggcuccugacagcugcucuucaacagagucaggaacccuccacaccacgaauuucuacacuguguuccaacagccuccacaggcaccuuuucagccgacuccggguugaaaguuauggugcacuggcaguucuuugaaaaggaguuuggggagagguucuggcuauccuguucaaugcccucgggcuggacaaguggggagggggguuggggggggggagagcaggaaaugcccucggaggagggacaagcccagccgaagccacccguagggcgccagcccaaggcuugucccucccguagucuggcuccaagcugccuccacuuggucgcgccagccaucuucagggugccagcccuguucagccgacuggacggucuucugccucucucuagacgcccccuggugcccauccucacccgacccaugugcugugcgccuccuugaagaccucuccuagcuagaaccgcacgguugguugagcaaacgcucuugacuucauuuuccccuuuguaggccuuguacguuuauuuuguucagugucacugucccucccacucgcccuguccccagcccuggccccucuuuuguggcucaggauccugauucugcucggcugcgaugaaaggcuuguggggaaugggccagcccagagccccagccccagcuucccugcuuugucccaguugugcuuucuacacgcgagcgcuccccuaaaaguuguaccaaaugguuaauuuaauuauuccaacuauagacc

SEQ ID NO: 11148 - RNA, 3287 nt, Mus musculus
ggucuauaguuggaauaauuaaauuaaccauuugguacaacuuuuaggggagcgcucgcguguagaaagcacaacugggacaaagcagggaagcuggggcuggggcucugggcuggcccauuccccacaagccuuucaucgcagccgagcagaaucaggauccugagccacaaaagaggggccagggcuggggacagggcgagugggagggacagugacacugaacaaaauaaacguacaaggccuacaaaggggaaaaugaagucaagagcguuugcucaaccaaccgugcgguucuagcuaggagaggucuucaaggaggcgcacagcacaugggucgggugaggaugggcaccagggggcgucuagagagaggcagaagaccguccagucggcugaacagggcuggcacccugaagauggcuggcgcgaccaaguggaggcagcuuggagccagacuacgggagggacaagccuugggcuggcgcccuacggguggcuucggcugggcuugucccuccuccgagggcauuuccugcucuccccccccccaaccccccuccccacuuguccagcccgagggcauugaacaggauagccagaaccucuccccaaacuccuuuucaaagaacugccagugcaccauaacuuucaacccggagucggcugaaaaggugccuguggaggcuguuggaacacaguguagaaauucgugguguggaggguuccugacucuguugaagagcagcugucaggagccugggugaagcuucgaauggcuuacaccggucacacaccucagacaggcuuugaaccuggccuuugccaaaccuaggccuuagagacuaaacgcauccuagacccccuaaaugucucuccugcaagaaaaaaaaaaaaaaaaaaaaaaaaaccacuuaaagcccgucucaaccaggcgcaggcuggccgguguuaaucuggccuaaccuggucuaaacccugcgcuuuggcaucgucagagcgcuggccugagcuaaaacaucccuuugagaaaaaccaacgacucugcccuccuuucuggccucagcccuaacucccagggaacggagaaacuuggacaaucagcgccuugugcuuguuggcuuacccccccaccucucugaaguggaaggcagugggagaaaaccagcgagggaaauuccauguggauccgugggguacacaggcaccucccgguccagaugcagauucauauucaugagggagcgauaaauaaagacaaauucgcgcaguaauaacccuuggauucgcauccgucuuugcuggccuuuagguucagggacugaagacagauguuuguauccccuuuucuccucuugucuggugaccauaaagaaaaaccauuuagaguguugcaauuuguuucccgccgcagucaaaccuugaacgcauuuauuuucaucuuacccucgugcacaaaaaaagugcacguugcucaccaagggcccuucuuuaucaaauacgcauuguacagcguacaacugcaauaaaacuaucagcucuccccauaaaacuaucaccagcuuccucgcugggucuccuugccugaacucgccaguucagcgcucuuccguacagaggaugcgcaaacaccugggccgaggcugaaaaggcugggggccggugucgcuguggguuuaauccauuacagcgucugcagcgguuuagugugcaauaaaguaggguggcaguggagagcgggcgcccauccacuccccagcacuagcaucgaauuaaaccacuuaguuuggcaaacacugaacgccuaaaugccccuauaaagacuuuaugaguuuguuacuuuaauuacugacuuguuacagagcacauaaaggggguaaugaaugcaauaaaacuaauuaucuacacauuuaauucauauaaaauauccaggguuuguuuacaccgcacggcgauucaacuaagcauuuccccccucuuguccaccgagaggaaggauuuaaugaaauauuucccuuuauucugcuagagucuaacgaaccaaaugaaaauuacccuccgcuuaaaucauagggccaaggagguccacaaaucacggcuggcuucuuugucugcgccuuguugccaggacccaagagcccgaggaaucgaacuaggaaagugcgcugcuucgagccguugccuuguuugcuuaaauugcuccgugaaguccaaaaaccuaaagggcaaacaggcagcgauccucuuugggaaacuccaagucuggaggggauugggacgcgaaagagagugcgagagcaaagggcuggaaaaggagacccccauuuggguacauuucgugcugggcuugguagcuagcgagugauuaaaacgaaccuccaccacgggaaguuucauacacgccgaugcaaaucugaacuaacgcaggcagacacagcacugcuaagcgcagagaaacguucaguaggaaauccagauguuucaccuuugagagcuuuacucgguuguuuauuuuacucuuguaaaggggcugucugcccacgucuuuggaaagcacauuaagcuucgaggagaaacacaauugauaagaugcuauuuuuuccaaccccuuggacuagguguauuuuaaagaaauccgcuuauucuuaucguucacauaaaacccuuuggcccacuuacgcuauguuacagggcgccugagucuugccaaugucccaguccuuuauagcauuucaugcacuucgggggaaggcuuguuguuaaauugagcguguaacacucuuacaaaacagguuuucuaugacaucaagguuucuucucccuaaccaagaaaaaaaaaaaaaaaaggacgaagaaggggggaaacacacuaucucaauuuaugccuaagguauaugaucaguuaaaaaggcuuaaaagcucuuggaaauuggaucagggaaaaucgucacccaacuuucauuauuuccaaguagcgugauugaauuaaagggcaggagcugguuagaagggaggaucaggggcucggugcguaauggugugguauuaaauucuaauuagagaugcaggaaucaaugauagggagguuggacagcucaguuccccagugccagcccaauagacggaugaguuauugucauguaaaaagcgccagcaauaagaccaaccgcuuugcuauuguccaaguggaaagagccaaguuuauuaugaggacuauauacucuagagaccucagacaaggcaucucacaggaggcuuuuucauaaaacuaggcucggcugguagua

SEQ ID NO: 11149 - RNA, 716 nt, Mus musculus
ccgcagcuccgcccgcauccccagcgguuccaucucgccauucaugcggauggcgccgcuggcauuucuguugcuguucacgcugccgcagcaucuagcugaaggugagggcgcagcaccugcguggcgcagggugccugacccauccgggcgggccaucgcagucagcgggucccaggagcggggaaaggggcucuuccagcauccuccuauaaucuugucucuuccacagcugccccuuccucagucauagccgcaacggagcugcguuguguuugcuuaaccguaacuccaaaaauuaaucccaaauugaucgcuaauuuggaggugaucccugcagguccacagugcccuacgguggaagucaugugaguucugacuguguucugggugcaggugaucuugggagauggaaguccaggacacccccugcccuacccacaucccuuaucccggauucuucagucacccgggcucaccugugcauccucuuuuuuuccuccuccgcagagcuaaacugaaaaaccagaaggaggucugucuggauccagaagcuccugugauaaagaaaaucauucagaaaauauugggcagguacuugcuaucuuagucucugcagcgggcaagguccuuauucucccuguaugaguugaggcucccaucccacauucgaaacugagcuuagaauaaaaggauucagaagggaaaguuguuau

SEQ ID NO: 11150 - RNA, 716 nt, Mus musculus
auaacaacuuucccuucugaauccuuuuauucuaagcucaguuucgaaugugggaugggagccucaacucauacagggagaauaaggaccuugcccgcugcagagacuaagauagcaaguaccugcccaauauuuucugaaugauuuucuuuaucacaggagcuucuggauccagacagaccuccuucugguuuuucaguuuagcucugcggaggaggaaaaaaagaggaugcacaggugagcccgggugacugaagaauccgggauaagggauguggguagggcaggggguguccuggacuuccaucucccaagaucaccugcacccagaacacagucagaacucacaugacuuccaccguagggcacuguggaccugcagggaucaccuccaaauuagcgaucaauuugggauuaauuuuuggaguuacgguuaagcaaacacaacgcagcuccguugcggcuaugacugaggaaggggcagcuguggaagagacaagauuauaggaggaugcuggaagagccccuuuccccgcuccugggacccgcugacugcgauggcccgcccggaugggucaggcacccugcgccacgcaggugcugcgcccucaccuucagcuagaugcugcggcagcgugaacagcaacagaaaugccagcggcgccauccgcaugaauggcgagauggaaccgcuggggaugcgggcggagcugcgg

SEQ ID NO: 11151 - RNA, 1067 nt, Mus musculus
ccagacccacaaaucacuccuaacacgcuuaggcuccuuggagcacacaaaccacugcagugagcaucucccuuggcacguagccaggcucucgcccucucccucucucucgcagggcccugcguccaaaccucuacuccugagcaccgcuaacagggcucccugcaggaacaaagccgugugccugcuggccccgucacaccaucacagcggucccggugcaacccgaauccacgugcagcugccuucaugacagagccccgccugcauuaaccacugcagaguaguauuuugaaaagaagcgagcaguucugaagcaaaaaacacacgcggccuccugauccccgcacagccagcgggagcuugaggugguuaucuuugcgauagauccuaccaaagaaacacuuagaccccugugucugaaacuaugccagccuuuugauugcgccucugcagaacugacucccugaguuugauucaauuacagucucccaacuagaggaaaucuuggcuuugcucagaaguucacggguuccugucucuccugcgacacaauaccacaauguagccuugagcuguuuguaaaugccccgcugacuggaauccuugcgggcaaaggcgugcgagggacaaaaaugagucaccaaugaccucuuaguggccuuccuaacccuaaaaggcacaccaacccaggcuuggauuuucugggucuuaucccacaauugccuaacugccauucagauagcaucccuggaauaccaucuuccuugaaaacacucucaaguucuagauggagccguagcucuggacagacccuucaugccuguccagacaucucuucuccuccccauuuuuccaauccccuaacuuucccagaccuuugaggacacucuaagucacggcuaguauaaaucauccacaagcaacucgcuguacucccaggcccucccccuuugccgcucagacuccaagcccuucgcuccucugggucgccagaggccagagagaggagaagguuggcgccgccugcuccaagcgcugcucacgacccuggaaaaucucccgga

SEQ ID NO: 11152 - RNA, 1067 nt, Mus musculus
uccgggagauuuuccagggucgugagcagcgcuuggagcaggcggcgccaaccuucuccucucucuggccucuggcgacccagaggagcgaagggcuuggagucugagcggcaaagggggagggccugggaguacagcgaguugcuuguggaugauuuauacuagccgugacuuagaguguccucaaaggucugggaaaguuaggggauuggaaaaauggggaggagaagagaugucuggacaggcaugaagggucuguccagagcuacggcuccaucuagaacuugagaguguuuucaaggaagaugguauuccagggaugcuaucugaauggcaguuaggcaauugugggauaagacccagaaaauccaagccuggguuggugugccuuuuaggguuaggaaggccacuaagaggucauuggugacucauuuuugucccucgcacgccuuugcccgcaaggauuccagucagcggggcauuuacaaacagcucaaggcuacauugugguauugugucgcaggagagacaggaacccgugaacuucugagcaaagccaagauuuccucuaguugggagacuguaauugaaucaaacucagggagucaguucugcagaggcgcaaucaaaaggcuggcauaguuucagacacaggggucuaaguguuucuuugguaggaucuaucgcaaagauaaccaccucaagcucccgcuggcugugcggggaucaggaggccgcguguguuuuuugcuucagaacugcucgcuucuuuucaaaauacuacucugcagugguuaaugcaggcggggcucugucaugaaggcagcugcacguggauucggguugcaccgggaccgcugugauggugugacggggccagcaggcacacggcuuuguuccugcagggagcccuguuagcggugcucaggaguagagguuuggacgcagggcccugcgagagagagggagagggcgagagccuggcuacgugccaagggagaugcucacugcagugguuugugugcuccaaggagccuaagcguguuaggagugauuugugggucugg

SEQ ID NO: 11153 - RNA, 2824 nt, Mus musculus
gcggggguaaacacacccgccuugggaggccggagcuggggucgcuuccccgcccccucccccuccuuagggggugggcgcggguccgccuccccccugcccgcuguguggcucgggguucagccgcgcugcuguguaaaccgcugcuuuccgaggcggaucucccuuuuaacaccuucuaaacaaaggcuaaugaggccaccgcauuacucuaucaacacacaaucauuagcaacugagaaauacacacacacacacacacacacacacacgugcgcgcgcaaacacacacuuauauacacacacaagcaugcacucacacccagagcugccaaagucgggccaauucuaaagcaacccaaauuagguuaacaaaaagguggggaguggaagggugggaagagggggugggggagagagagagagagagagagagagagggagagggagagggagagggagagggagggagagggagagggagagggagagggagagggagagagagagagagagagagagagagagagagagagagagagagagagagagaacacaaacgaggacccaaaccaaaacucaaaagcauacuaggugugccagggacucuucauuuggagagacaucgcaggucaacugcccuccuugaacuucagagaagacacucccagggcccaguggauggauucugcaagcuauggaaccagagggggucccagacuugggguuggaccccaccauguagcauuaagcccuguuccccgagaagagaagagaagagaagagaagagaagagaagagaagagaagagaagagaagagaagagaagagaagagaagagaagagaagagaagagaagauucucagccaugcucaacacucaacccuggcagaaaccagcaaccuggacuccaacgacgacccuuagcgugggguuuuccccucuaagcaaaauaucuguuuggcuuacaaguuagagugcgggggggggggggcuuccucugauauuuuccaaguccccuccuugcugagagggaucaagccaggcucuguuuccuggagccugaacucugcucugggaacgagugucuugcaauccaaggacaagcuguagccugcugcugggggguuggggcgagggucccaagggccuacggguggggccucuggggaagguaaagagcgggagucacuuucuguccugcgugcuugggaucucugggccacggggcuuacuuagcauuaucaaaacagaguccaauuucccagcugacacccuagcugucuucuuaucugguaaccuaagggugcugccaucccguuccccucuucaucgcccccaccaccacccccaaccgcugcccagcagucugggcaggaggcucagaccugccaggcucagauauuggaccagguguuuuucagacuaaacacuccuccgcugucucgggaaacgucuuacugguguaucucccaacccucgaagguaaagaggaugaaauccuggccgguucggaaaugucccaggaccgccccgcacaguuuaaaaggcaguuaauuccgaagguuucauggugcaggaggauccagagcccuauaacgaugcucuggaaacccaguaguccauccacaguguugcgcuagggcacaugagccuucccaguucugucacccgugucccucuuaggccagaacacugucccuacuaggaccuggucuccgaacuccguucaggucuguggggccugcuagagcccaagaauucucauccacucgcaccccaacucacucuucucggccugaccuugacccacacagaacagcaccggagugcacccggcugggcuuggaaacccaagguuugucguuccuauggcagagacuagagacagggucauccugaaguaccaggcgggcgcuucacuccggccuggucuccacgcccgcuccuaccccgggccuaugccucugggcggcgggccgugcgcgacgggaugcugagugucugugcgcggggccgccuauauuuacacccaaaacaaaauaauuacacucuugucggagggagaaagccagugauuaggcgcaggcucuuugcggcaaagcaguuucucagugguacaccaguauaauuuuucacggcuggcugaaaucaaagaggggaaguaaugaauccggagagcaauuuaaauuuacaauuuguaacgccgccgccgcugccgcgcagacccggccgagagcgcagcucccaggcgcucgcugcguuuguuuaauguuaaagcuucgcuggcucuuggugggggaguuggggggggggaugaggauacgugauggggggggggguaaaugaucaaggucgggagaagaccggcugcugcgacaccugagaugcuuccgggagaaaagggcaggggcaaagcuccuggauuuccccuuccccuuccccacccccgcccccgccccgcgcgcgcgcuguuggagccuccagucugccccuucucaaaaaaaaaaaaaaaucaggccauucugauggauccgagacuuaagaagacuuagaaggacucaggcaaucggagaugggccccuuucuuguuaguugaagaaucucagaggcacggggagaggaguauaggugcgacgaggaaaagguucuucucggccugcgcaagaggcaccuccuuccuccacugcuguccaguguccccagcuggagaccgcgagaaagacacccccccaagcccagacucuccgggccuggaagcucccacuccagucgggaggugugcgucucuucgccaguaauuaauuaccgaacucaaggggg

SEQ ID NO: 11154 - RNA, 2824 nt, Mus musculus
cccccuugaguucgguaauuaauuacuggcgaagagacgcacaccucccgacuggagugggagcuuccaggcccggagagucugggcuugggggggugucuuucucgcggucuccagcuggggacacuggacagcaguggaggaaggaggugccucuugcgcaggccgagaagaaccuuuuccucgucgcaccuauacuccucuccccgugccucugagauucuucaacuaacaagaaaggggcccaucuccgauugccugaguccuucuaagucuucuuaagucucggauccaucagaauggccugauuuuuuuuuuuuuuugagaaggggcagacuggaggcuccaacagcgcgcgcgcggggcgggggcggggguggggaaggggaaggggaaauccaggagcuuugccccugcccuuuucucccggaagcaucucaggugucgcagcagccggucuucucccgaccuugaucauuuacccccccccccaucacguauccucauccccccccccaacucccccaccaagagccagcgaagcuuuaacauuaaacaaacgcagcgagcgccugggagcugcgcucucggccgggucugcgcggcagcggcggcggcguuacaaauuguaaauuuaaauugcucuccggauucauuacuuccccucuuugauuucagccagccgugaaaaauuauacugguguaccacugagaaacugcuuugccgcaaagagccugcgccuaaucacuggcuuucucccuccgacaagaguguaauuauuuuguuuuggguguaaauauaggcggccccgcgcacagacacucagcaucccgucgcgcacggcccgccgcccagaggcauaggcccgggguaggagcgggcguggagaccaggccggagugaagcgcccgccugguacuucaggaugacccugucucuagucucugccauaggaacgacaaaccuuggguuuccaagcccagccgggugcacuccggugcuguucugugugggucaaggucaggccgagaagagugaguuggggugcgaguggaugagaauucuugggcucuagcaggccccacagaccugaacggaguucggagaccagguccuaguagggacaguguucuggccuaagagggacacgggugacagaacugggaaggcucaugugcccuagcgcaacacuguggauggacuacuggguuuccagagcaucguuauagggcucuggauccuccugcaccaugaaaccuucggaauuaacugccuuuuaaacugugcggggcgguccugggacauuuccgaaccggccaggauuucauccucuuuaccuucgaggguugggagauacaccaguaagacguuucccgagacagcggaggaguguuuagucugaaaaacaccugguccaauaucugagccuggcaggucugagccuccugcccagacugcugggcagcgguugggggugguggugggggcgaugaagaggggaacgggauggcagcacccuuagguuaccagauaagaagacagcuagggugucagcugggaaauuggacucuguuuugauaaugcuaaguaagccccguggcccagagaucccaagcacgcaggacagaaagugacucccgcucuuuaccuuccccagaggccccacccguaggcccuugggacccucgccccaaccccccagcagcaggcuacagcuuguccuuggauugcaagacacucguucccagagcagaguucaggcuccaggaaacagagccuggcuugaucccucucagcaaggaggggacuuggaaaauaucagaggaagcccccccccccccgcacucuaacuuguaagccaaacagauauuuugcuuagaggggaaaaccccacgcuaagggucgucguuggaguccagguugcugguuucugccaggguugaguguugagcauggcugagaaucuucucuucucuucucuucucuucucuucucuucucuucucuucucuucucuucucuucucuucucuucucuucucuucucuucucuucucuucucggggaacagggcuuaaugcuacauggugggguccaaccccaagucugggacccccucugguuccauagcuugcagaauccauccacugggcccugggagugucuucucugaaguucaaggagggcaguugaccugcgaugucucuccaaaugaagagucccuggcacaccuaguaugcuuuugaguuuugguuuggguccucguuuguguucucucucucucucucucucucucucucucucucucucucucucucucucucucccucucccucucccucucccucucccucucccucccucucccucucccucucccucucccucucucucucucucucucucucucucccccacccccucuucccacccuuccacuccccaccuuuuuguuaaccuaauuuggguugcuuuagaauuggcccgacuuuggcagcucugggugugagugcaugcuuguguguguauauaaguguguguuugcgcgcgcacguguguguguguguguguguguguguguauuucucaguugcuaaugauuguguguugauagaguaaugcgguggccucauuagccuuuguuuagaagguguuaaaagggagauccgccucggaaagcagcgguuuacacagcagcgcggcugaaccccgagccacacagcgggcaggggggaggcggacccgcgcccacccccuaaggagggggagggggcggggaagcgaccccagcuccggccucccaaggcggguguguuuacccccgc

SEQ ID NO: 11155 - RNA, 531 nt, Mus musculus
ggcgagcgugccgcgaccccgucucccuccuccaccggagcgaucggccuugucccgccggugcgggugacaaccucugcugugucaagcccgcugccguccccaucccgccaacucccacugccagagcuuagcuaggcacuccagcuuggggacccggguaccggcuucuucccaccucuugcccacccuccugacugaagucggguuuggaaacccgcaggagacccggaagguuucgaucagacuuuauggcuccgcaggcccgcgaagcccucugcaaaggcgcgcgcggugacuagagcccgcuuucgaggaggaggaggaggccccggccuggguuccuuagaucuggagacccggccaggcgcggcuuccugauuggcacaagccagccaauauccuaaugggguccuggcagaguccgcuuuccacgggcgguuggcaacgaggacuccuacaccucaggucuaggcaaggugucauggagauuuccugcuggaggagacacuggggcgggagcaaccucca

SEQ ID NO: 11156 - RNA, 531 nt, Mus musculus
uggagguugcucccgccccagugucuccuccagcaggaaaucuccaugacaccuugccuagaccugagguguaggaguccucguugccaaccgcccguggaaagcggacucugccaggaccccauuaggauauuggcuggcuugugccaaucaggaagccgcgccuggccgggucuccagaucuaaggaacccaggccggggccuccuccuccuccucgaaagcgggcucuagucaccgcgcgcgccuuugcagagggcuucgcgggccugcggagccauaaagucugaucgaaaccuuccgggucuccugcggguuuccaaacccgacuucagucaggagggugggcaagaggugggaagaagccgguacccggguccccaagcuggagugccuagcuaagcucuggcagugggaguuggcgggauggggacggcagcgggcuugacacagcagagguugucacccgcaccggcgggacaaggccgaucgcuccgguggaggagggagacggggucgcggcacgcucgcc

SEQ ID NO: 11157 - RNA, 839 nt, Mus musculus
gcugguggccagaaauaaaaucgggaguagccgcccccucuccucgaaaugcgaaaaccuaggguccuuccuccagcaguucaggguucccagggacguggcucagggaagcggcccggcucgcugugucccagccccgucucuugccuacgaaguucucccuaacuggggaaggccacucaacagaccgcgcccguucagcuaaauccaaacccguaguuuauuuuucaggcgucacaagcucuggagguuuaaaacuucgaaugcuuuugaguugguugaaauguguccauaacgccauaccaacuaucugauucgcaaaguuuaauguuuaaccuuuuuagggcccucgucucccuuuuuuuuuucuccuugugagccgcgaauaauaauaauaauaauaaaagggguguucgguuuaggggcuuuuuguuguuguuuaccaaggucagauacgaaacggguuuauuuuuaaaggaagaucaccgccccccuccugcugcccccguugggccauugggagucgcagaauccgaguccccgagacguggcauucucgcccgugaacuggaaaaagacuccuucaaaacaagauuugguuucauuuuccaacgcccgggccugggaauaccgaugcccggagaacguggcuugguguggaggauuuggggaucaucagagaagaaagaaggggucuccaaagaucucaauucuacccuagcuuugugacccacacacccccaaaauaaccuacaaaggaaaaaaaauaacuuaacagcgcgggccagcggaggggcgccuccccagcaucggguaaacccuccuguaaguccuauuua

SEQ ID NO: 11158 - RNA, 839 nt, Mus musculus
uaaauaggacuuacaggaggguuuacccgaugcuggggaggcgccccuccgcuggcccgcgcuguuaaguuauuuuuuuuccuuuguagguuauuuugggggugugugggucacaaagcuaggguagaauugagaucuuuggagaccccuucuuucuucucugaugauccccaaauccuccacaccaagccacguucuccgggcaucgguauucccaggcccgggcguuggaaaaugaaaccaaaucuuguuuugaaggagucuuuuuccaguucacgggcgagaaugccacgucucggggacucggauucugcgacucccaauggcccaacgggggcagcaggaggggggcggugaucuuccuuuaaaaauaaacccguuucguaucugaccuugguaaacaacaacaaaaagccccuaaaccgaacaccccuuuuauuauuauuauuauuauucgcggcucacaaggagaaaaaaaaaagggagacgagggcccuaaaaagguuaaacauuaaacuuugcgaaucagauaguugguauggcguuauggacacauuucaaccaacucaaaagcauucgaaguuuuaaaccuccagagcuugugacgccugaaaaauaaacuacggguuuggauuuagcugaacgggcgcggucuguugaguggccuuccccaguuagggagaacuucguaggcaagagacggggcugggacacagcgagccgggccgcuucccugagccacgucccugggaacccugaacugcuggaggaaggacccuagguuuucgcauuucgaggagagggggcggcuacucccgauuuuauuucuggccaccagc

SEQ ID NO: 11159 - RNA, 529 nt, Mus musculus
gucguggagcagcuuagccgcuccuugcaaacccucaaggaccgcuuggagagccucgagguaccugugcgcgguggcaucuagcggguggugguccccgggaucgugggacugaggaugcgggagaaauggguacgugggcuggccgggcgcccccauccacggggagagcugaguucgggggugcaagucucgcuccuacucuggaccuuacugugauggccucccgucuccuuguccucuucuguccccacguucgaugggaaaggugaaauucucacccccaucuccauuccgucgcgcgcggggacuuacccacuagacucaccgugaacuuaccgagguuuuuaccuaaagaacccagacugccaagccuggagggcaaaacccggugaccccggcagccuguuuccucuuugcaaaccuccacuuucagaagcgggacacgcuccugcuggcuguacccagugcugagacugccaccggaggucagcugccccugggcaucugguguuuucuuugacaaauu

SEQ ID NO: 11160 - RNA, 529 nt, Mus musculus
aauuugucaaagaaaacaccagaugcccaggggcagcugaccuccgguggcagucucagcacuggguacagccagcaggagcgugucccgcuucugaaaguggagguuugcaaagaggaaacaggcugccggggucaccggguuuugcccuccaggcuuggcagucuggguucuuuagguaaaaaccucgguaaguucacggugagucuaguggguaaguccccgcgcgcgacggaauggagaugggggugagaauuucaccuuucccaucgaacguggggacagaagaggacaaggagacgggaggccaucacaguaagguccagaguaggagcgagacuugcacccccgaacucagcucuccccguggaugggggcgcccggccagcccacguacccauuucucccgcauccucagucccacgaucccggggaccaccacccgcuagaugccaccgcgcacagguaccucgaggcucuccaagcgguccuugaggguuugcaaggagcggcuaagcugcuccacgac

SEQ ID NO: 11161 - RNA, 1064 nt, Mus musculus
gaugcgcgucacugaccacagauucccucggacuggugcagagcagagggggaggaaccucucuccagaggccgcggccgcucgcugcuaggcgggcugaacuggcgcagugcugcagccgaucccacgugcccgccgugguccccagccugcgcuccuggcaccgggacugcggcaggggagacugggugcgguucggcuggggaaguugccuggacuccgugguugaguccccggaccucugcuuuaaacuccuaagggugagaagaguggugacacacagaccuccuucuucaugcgcggggaucuuugaugucccgugaugggcacugaaucggugccauacacugguaaccccgugaguuuuauuccacaucugguagaucugcauuguggacugauuuucuuugucucccuguccuuucuuauaggauguccaagauucccauccaccuccgacccagaaaagcagacgcgguuucaaggucaauaaauuagagagguuaaacagacacccaaacaaauuagaccgugcaccucaaaggauguuuggaguugucaccuccuaguucuggcuuuuagucucauagugucucuagguaacaauuauuucccgugcaucaagcugaauauugaaagcacaggauagcagcccuggcuuccccaugaaggaacccuccugagccauuuguccucuguguccuaguucucuccccauaaugacgucaguaauaucgcuccaucacagcaguccuccgcuccucauucuuuucaucguuuuucucuucaggcaugaccccugagagcauacaagcacacuaacaacacuguuucuccuccacucaguccacagcacuaucagccuucccgcuaggggaaacuucaaagugacguccuccgggcagccacuguggaaaaugacaugggcuuggugcuuuaggcauuuuaaggucaggugcccgacgcauggauuccacuucuggaauugcaacaggagcaugaagaaacauuccaacauuccugcacaccacagugagacuguccacugaucagcggccagacgg

SEQ ID NO: 11162 - RNA, 1064 nt, Mus musculus
ccgucuggccgcugaucaguggacagucucacuguggugugcaggaauguuggaauguuucuucaugcuccuguugcaauuccagaaguggaauccaugcgucgggcaccugaccuuaaaaugccuaaagcaccaagcccaugucauuuuccacaguggcugcccggaggacgucacuuugaaguuuccccuagcgggaaggcugauagugcuguggacugaguggaggagaaacaguguuguuagugugcuuguaugcucucaggggucaugccugaagagaaaaacgaugaaaagaaugaggagcggaggacugcugugauggagcgauauuacugacgucauuauggggagagaacuaggacacagaggacaaauggcucaggaggguuccuucauggggaagccagggcugcuauccugugcuuucaauauucagcuugaugcacgggaaauaauuguuaccuagagacacuaugagacuaaaagccagaacuaggaggugacaacuccaaacauccuuugaggugcacggucuaauuuguuugggugucuguuuaaccucucuaauuuauugaccuugaaaccgcgucugcuuuucugggucggagguggaugggaaucuuggacauccuauaagaaaggacagggagacaaagaaaaucaguccacaaugcagaucuaccagauguggaauaaaacucacgggguuaccaguguauggcaccgauucagugcccaucacgggacaucaaagauccccgcgcaugaagaaggaggucugugugucaccacucuucucacccuuaggaguuuaaagcagagguccggggacucaaccacggaguccaggcaacuuccccagccgaaccgcacccagucuccccugccgcagucccggugccaggagcgcaggcuggggaccacggcgggcacgugggaucggcugcagcacugcgccaguucagcccgccuagcagcgagcggccgcggccucuggagagagguuccucccccucugcucugcaccaguccgagggaaucuguggucagugacgcgcauc

SEQ ID NO: 11163 - RNA, 1693 nt, Mus musculus
agccaaccguccucgauccuccccuccccucccuuucuuuuuuuccucccagcuuggccaguucagcaucgcgcacccccccuuccugagcccaugcugccccuagcggcgggccaaagcagugcaugccgcgcccccaccccaucccccaaggcgcccgcccacgcgccccccuccgcccccgcugcucgcgaagcacgcugggauuuggcgcccccccuccuaggaucucucuauauaaggcaagcaguccggacucccgauacacgcguuuccaacuugaguuggugugugucgaagaauccugaccaacuacgaccuggggagagcagccaaccgagaagguccaccgagccucgccuaggucugcugcgcgggcugcgguccggagccuucuccggaccgcggucacccaguggaccgggccgucgcgggaccccucauccuucguggcaucgcagaggaauccucguguggugaguaugguuaggauuuuuuuuuuuuuuuuaacuccaagaaaacggucacacgcaauccccguuuuacaucgggagcugcgggagauaaaaguagcgccccccaaaauaucuccucgcaaauuuugucaagccuucaguggccagauccugagacgagagcguggaaagcaagucuucacggcuucggguccgcgaauucgguuuccacgacucgcguccagaaauggucgguagacacaugagcugcggacagcgaugagcugcagacgcacaugagcuacugaccgaauugugaugagcuccccaaauacgcugcaaagugacuggcucugcacucuuaagugccgcgcuacgaacggauugcacugcagacggccgcgucuugcgcugugauaaacuaacgggcgcuucaugcgcuacaaaauccuaauaggcgcuucaugcgcuacaaaauacucauaggcgcuucaugcgcuacaaaauacucauaggcgcuucaugcgcuacaaaauacucauaggcgcuucaugcgcuacaaaauacucauaggcacuucacacgcuacgaacugaugggcgcuucaugcgcuucgcuguacuaaugggcgcuucaugugcuacgauguacuaaugagcgcuuaaugcgcuucgcuguacuaaugggcgcgccaugcgcuucacuguacuaaugggcgcuucaugcgcuucagcguacgaacgagcaaaugaaacgggcgaacaggcgaaccugugaacggggcgaacggggcgcuucaugcgccacaaaccagcccgaacuacggugauacccaaaaccgauucguguuucacguauucaauuuggaaagcugcaggagaguaaccaaacgcaaaagcgcaacaagagugaauuuagaaaaugcgcuacaaacugcggcacaggcauaagaccugcagccucuuaagugacacagaaaguagcguugggaagacgagagaacguaucucuccuuggugaggggacaacacaguucaccuuucgggucaaaacuggcuccguuuuccugucggacggcuaucugcaugauggugguggugcuggugguaaacaaaauggagcccugggaggccaaaauugguuuuaacauucugcccacguaacuccugcuuauggcaguggaguggaggggugcuggauuuuggagauggcggaauggccugccuugucuaguggug

SEQ ID NO: 11164 - RNA, 1693 nt, Mus musculus
caccacuagacaaggcaggccauuccgccaucuccaaaauccagcaccccuccacuccacugccauaagcaggaguuacgugggcagaauguuaaaaccaauuuuggccucccagggcuccauuuuguuuaccaccagcaccaccaccaucaugcagauagccguccgacaggaaaacggagccaguuuugacccgaaaggugaacuguguuguccccucaccaaggagagauacguucucucgucuucccaacgcuacuuucugugucacuuaagaggcugcaggucuuaugccugugccgcaguuuguagcgcauuuucuaaauucacucuuguugcgcuuuugcguuugguuacucuccugcagcuuuccaaauugaauacgugaaacacgaaucgguuuuggguaucaccguaguucgggcugguuuguggcgcaugaagcgccccguucgccccguucacagguucgccuguucgcccguuucauuugcucguucguacgcugaagcgcaugaagcgcccauuaguacagugaagcgcauggcgcgcccauuaguacagcgaagcgcauuaagcgcucauuaguacaucguagcacaugaagcgcccauuaguacagcgaagcgcaugaagcgcccaucaguucguagcgugugaagugccuaugaguauuuuguagcgcaugaagcgccuaugaguauuuuguagcgcaugaagcgccuaugaguauuuuguagcgcaugaagcgccuaugaguauuuuguagcgcaugaagcgccuauuaggauuuuguagcgcaugaagcgcccguuaguuuaucacagcgcaagacgcggccgucugcagugcaauccguucguagcgcggcacuuaagagugcagagccagucacuuugcagcguauuuggggagcucaucacaauucggucaguagcucaugugcgucugcagcucaucgcuguccgcagcucaugugucuaccgaccauuucuggacgcgagucguggaaaccgaauucgcggacccgaagccgugaagacuugcuuuccacgcucucgucucaggaucuggccacugaaggcuugacaaaauuugcgaggagauauuuuggggggcgcuacuuuuaucucccgcagcucccgauguaaaacggggauugcgugugaccguuuucuuggaguuaaaaaaaaaaaaaaaauccuaaccauacucaccacacgaggauuccucugcgaugccacgaaggaugaggggucccgcgacggcccgguccacugggugaccgcgguccggagaaggcuccggaccgcagcccgcgcagcagaccuaggcgaggcucgguggaccuucucgguuggcugcucuccccaggucguaguuggucaggauucuucgacacacaccaacucaaguuggaaacgcguguaucgggaguccggacugcuugccuuauauagagagauccuaggagggggggcgccaaaucccagcgugcuucgcgagcagcgggggcggaggggggcgcgugggcgggcgccuugggggauggggugggggcgcggcaugcacugcuuuggcccgccgcuaggggcagcaugggcucaggaagggggggugcgcgaugcugaacuggccaagcugggaggaaaaaaagaaagggaggggaggggaggaucgaggacgguuggcu

SEQ ID NO: 11165 - RNA, 560 nt, Mus musculus
cccauggugcagcagcccgugguucauucauuggggagcugccugcagccuugccucucagaugcccccuuccccuccccuguaugcaggggccaguaagguaauuuaugccuucugccccuggagcugcaccagccucucucugggagucccuuagcagcuugcugaaaggggaguucuggucccugcuuugacaggcuauuguaaaagcauaggucagcauuugccaacucauuuccuccauaaaagaaccucuuuucucaaccaugugagggugaaacaaucuauagauuagcacugugcuguagguccaguagaaucacugagauccucccagcuuuugccuguuaucuaacaaguguguuguuuaaccccauuguucccacgugggcuguuacuuacggaugaggaccccaggauuucccaacuuccugaacucuaccacagccauaaucucaguauuaucugcuucuucaaacccuaaaccuucuccaaguccuagaaaguuccaauguccacaauuuuguauuccuguccuuuaccaagaccgugacauuuau

SEQ ID NO: 11166 - RNA, 560 nt, Mus musculus
auaaaugucacggucuugguaaaggacaggaauacaaaauuguggacauuggaacuuucuaggacuuggagaagguuuaggguuugaagaagcagauaauacugagauuauggcugugguagaguucaggaaguugggaaauccugggguccucauccguaaguaacagcccacgugggaacaaugggguuaaacaacacacuuguuagauaacaggcaaaagcugggaggaucucagugauucuacuggaccuacagcacagugcuaaucuauagauuguuucacccucacaugguugagaaaagagguucuuuuauggaggaaaugaguuggcaaaugcugaccuaugcuuuuacaauagccugucaaagcagggaccagaacuccccuuucagcaagcugcuaagggacucccagagagaggcuggugcagcuccaggggcagaaggcauaaauuaccuuacuggccccugcauacaggggaggggaagggggcaucugagaggcaaggcugcaggcagcuccccaaugaaugaaccacgggcugcugcaccauggg

SEQ ID NO: 11167 - RNA, 810 nt, Mus musculus
ggcuguguugggcuccucgccccgagggcggugggaacagccccgggcuucagccaagccacggcuccgacccacggcgaccugcacgccccgggcaccugccaacggggccagcggggucgggaucccgcuccuccgcggugggcgaugaucgaaggcggcgccgggccagcgcgaauggcuccaaggcgcuccgcaccaggccagcucggagugccgggcuccggccgccaacguucgcaugcucggggaaagucccaagggcccaguggacauccccacugcgccucgccagggucaaggaugccaagcgcccugucacagucuggcggggaccagggaggagcgaguuuccgaccccgacccugucggcacacagcucgucucuccuccccggccacaccucacuuuuucgacuaaagagguugaggugucaagcagcgaucccucccaaggaucuuaaagccaaggacaggaaucugugggaauagaguuugaggggagacguugucaaauagaggcucugcuccuugacucguagcucaaaaggggacgacgauuuauucuuagcuguugagaagaaucggggcgggggcugauuaaugcuuggucuaguuucuugacggccugccccuaaacuuaagaaguaacaacuuagaaucugaacgugaagggaaaguguaguugggccgaaacgcaggcggagagaugucccgggccaguauucgcccucggugcagaugucucccagacuccaggugucucucgaaccuccagaggacccagagcggguaccuaguagcaggggug

SEQ ID NO: 11168 - RNA, 810 nt, Mus musculus
caccccugcuacuagguacccgcucuggguccucuggagguucgagagacaccuggagucugggagacaucugcaccgagggcgaauacuggcccgggacaucucuccgccugcguuucggcccaacuacacuuucccuucacguucagauucuaaguuguuacuucuuaaguuuaggggcaggccgucaagaaacuagaccaagcauuaaucagcccccgccccgauucuucucaacagcuaagaauaaaucgucguccccuuuugagcuacgagucaaggagcagagccucuauuugacaacgucuccccucaaacucuauucccacagauuccuguccuuggcuuuaagauccuugggagggaucgcugcuugacaccucaaccucuuuagucgaaaaagugagguguggccggggaggagagacgagcugugugccgacagggucggggucggaaacucgcuccucccugguccccgccagacugugacagggcgcuuggcauccuugacccuggcgaggcgcaguggggauguccacugggcccuugggacuuuccccgagcaugcgaacguuggcggccggagcccggcacuccgagcuggccuggugcggagcgccuuggagccauucgcgcuggcccggcgccgccuucgaucaucgcccaccgcggaggagcgggaucccgaccccgcuggccccguuggcaggugcccggggcgugcaggucgccgugggucggagccguggcuuggcugaagcccggggcuguucccaccgcccucggggcgaggagcccaacacagcc

SEQ ID NO: 11169 - RNA, 558 nt, Mus musculus
gugucgcucaccuggagagggcgggauuuaugcucaugccuacugcagguaaccccuggauguugccuugaacugggugugggguuuagaacgggacaauucgagagacaggagggguucgaagcucugccuuuauuccuuccguuauggcagcuucuccccaccagcuccggaguucucagugaucugacugcccaggcagccucuccugggacuucaugaccuuggggugagcuauggggacucuccaucgcagucgggauucaagggcugcuuccaugccccaucacaugugggauacuuccugaggucugacauggaagauggugggggcucuguucguuucuccuuuuuagggcucauagccagacaucucagucugcguugugugucagcacugcucuuauucaaaaccuccagacccaggagcgggcagucauguuuagacgcugcaauugugaacuggcaggcaggaucugacuuagaucuaagccuuuuuuguugggcaggagggagcuucugugggguagaugcugaacuugguccugcucagggcga

SEQ ID NO: 11170 - RNA, 558 nt, Mus musculus
ucgcccugagcaggaccaaguucagcaucuaccccacagaagcucccuccugcccaacaaaaaaggcuuagaucuaagucagauccugccugccaguucacaauugcagcgucuaaacaugacugcccgcuccugggucuggagguuuugaauaagagcagugcugacacacaacgcagacugagaugucuggcuaugagcccuaaaaaggagaaacgaacagagcccccaccaucuuccaugucagaccucaggaaguaucccacaugugauggggcauggaagcagcccuugaaucccgacugcgauggagaguccccauagcucaccccaaggucaugaagucccaggagaggcugccugggcagucagaucacugagaacuccggagcugguggggagaagcugccauaacggaaggaauaaaggcagagcuucgaaccccuccugucucucgaauugucccguucuaaaccccacacccaguucaaggcaacauccagggguuaccugcaguaggcaugagcauaaaucccgcccucuccaggugagcgacac

SEQ ID NO: 11171 - RNA, 559 nt, Mus musculus
cgcgcgggagucgggauugcgacgcggaggugaugggaccggccacugacggaaagaaaaggcucaggccucaaacuguugggcgggcgcggcuugcacccggaauaguuggagaaacgaguccggaacuuuugggacagguugcgugcgggaaggagacucugcguguuggagaaggggucggggcaagagaccagggaagccagucggucacaaagagcccgaguaaggaugggguuagggggaugcaaggagggagaagagauguauucgugaagcaacaguccauggggauucugggcaguguucagaccuugaggcaaucugaguuguagagaagaaagagaggaugaagguggaagacauuuaaggauuuggagggaaggggcgaggaaaacuuguacauucugagaaggaaaaaaaaaaugccuccuuguaguaacuaaaaagccaaacgaaccaccugguaaucuugauuuagaucagcccagggaaccaaugauuuuugucuuguuuuuacccguuuaaguuuccuuaucugaaaaauggaagcucugau

SEQ ID NO: 11172 - RNA, 559 nt, Mus musculus
aucagagcuuccauuuuucagauaaggaaacuuaaacggguaaaaacaagacaaaaaucauugguucccugggcugaucuaaaucaagauuaccaggugguucguuuggcuuuuuaguuacuacaaggaggcauuuuuuuuuuccuucucagaauguacaaguuuuccucgccccuucccuccaaauccuuaaaugucuuccaccuucauccucucuuucuucucuacaacucagauugccucaaggucugaacacugcccagaauccccauggacuguugcuucacgaauacaucucuucucccuccuugcaucccccuaaccccauccuuacucgggcucuuugugaccgacuggcuucccuggucucuugccccgaccccuucuccaacacgcagagucuccuucccgcacgcaaccugucccaaaaguuccggacucguuucuccaacuauuccgggugcaagccgcgcccgcccaacaguuugaggccugagccuuuucuuuccgucaguggccggucccaucaccuccgcgucgcaaucccgacucccgcgcg

SEQ ID NO: 11173 - RNA, 3541 nt, Mus musculus
cagcagagucccuuccccgcuugggcggucaccacuguacuuccgacucuggaaagccucccuucgcuacuuucucccugcagcuaccugcucaagauaggcuacuccguuuaugaaaccugccucucucuccugggcugagucucucagcuguuuggcagggacuuugggacaccugcucugguuauguuugcagacacugccugaccucucaaacagaaaguaacauuccaccuucagaaagaagguagugggaucgucuccaagcugggucugaugggagaugggugcccgagguauuacuaagacacaacucaaaccucauuugugaaagaaauuucuuguuuacacaaaggggugggaggggcccaccauccuggccaugcucugagaaagaauccgguccuuuggcaacaugaaggcaaggaccccacugaaccaggcucugggacccuggaaggagcgcuuauuccacccgucccgggacaagcuuaagaaaaagcgcuugcacaagaaguacgcuacacgcgugggcauuuagggauuugaggucaguuucaggggcuccuucuuguggucccugcccgcggcuuugcuuaguuucaacgaccucccaauacgguccccuaguagccccaaacacgagaaagagaaaucgcauucugguggucaugcgggaaucugggaccuccccacaacccaaaguuucccccccaucuccagcgaacccaccaagugcccccuuuacaaucucacaaccuccggcucacucuacaccagugaagacuaggaauaaauccacgaucuggccccgcaccugcgggguucuccaauuuggagggggcguggauggugccaaggucaggacucugcgugcggccacgcgggagaggcugcaagcgguccgaccacgcggugcagccggcuucccaggagccccaccaggcuuggggcggaggggaaugaccaggggucccggcagagccgcggcuguccacucaccauuaugggagugagaugcaggcgacaguagcagcagcagcagcgcggagagcgccguagugggaggcaugguugugcucgcccggggacuccgagcagguggcugcggcgcuggcgcagggucgcgcguccggacagcgggagcgucggcgccgcuccgggaggccuggcgacggccgcgaacuccggagucgcgauccggccgcuccuccugccuaccgcagagcugggcugggacacggagccagcagcgacgagcgaaggugucugcggcccgggcggugucugcgccgcugcggccccgcgcacguugcugcgaagacucccgccccgucccguccgcgcuggccuccgcccccucccccaggagcucgcccacagcggcggcggggucgggcggggcggcggcugggcgggcgcugggcugcgaacaauaagcagaggaggaaacuccgcccuggagcgcggcgggcgggggagcaggggcuggcggucccgggcagugcgugugugagugagugugugugugugugugugugugugugugugugugugugugugugugugccugugaaucugugcucacgcuguguauacuugccugcgcgcgcgccagggacccugucagacaaucaauccaugccgcggauguccuacacauugcuuuugcaggggaucagcccggauccuccauaaugcuaccgcccuuacaacgcaggcacaggcccccccagucuggaaguuccgauaagaaccgacccuuccaggcccccagaccucagcgccuuccugcggcagaacaagggaagcagguccccugcccagcaggugccuggaucucgugcaguccccaagucuguccuccgggaugagccccguaccaucuggacggguuuuuguuuuuguuuuuguuuuuguuuuuguuuuuaaccucucccaccgauguacaaauggaugcgacucuuuuaaggcaaaaauuucagcgcuuaauucgugcgcgucuguguucuaagugcuuugcacguauuaauucgcuugcucuucacggcagucacauuuuuaagccucguuuugcagacagaaaaauagaguuaaaaaaauaguuuaaaaaguuguuuaagaucccuuaggugguaaauagcagccuuacuucugagauuaaucuggaaaaauacuuugcacagagcccguaauacuguaauugagccauaagaaauaauauugcugaauaaaaagcagcaauggagauuuaagggccucggcgucaaauccaaccugggcucaaaaccuaguugggcuaacucacucugagugcuuugauucuuuacauacgaagaacaaggcuaacaacacuuccaacagcugcugagacacuugcuugggagacgcacuuagcguagggccagaaccuugaacagccuuaaugaaagaagcagcuuucgcucgugagaaacccauagaccugaggugggagaucggaauuggagaaucucauaaauggagaaucucauaaacccgaguuuacucugugaaaggacaaagaagcucgcauccuauucguuuggggaggcggggaggcuuugcgggcugcagacucaguggaguccccugcagagguggcacucucaucucgggauacaaagcugaagggggaggggaggcugacacggaaaggauauggugaaaauuugucacacaugacuccuggguugcuaauccggagucuuucugucagaugagccuaaguggagagauuguucccggaucccaaggaccguggaccuuaugaaucucucaagugggcuaugcgcaggcucaucgugaaaccgcuuaggaagaguaggguuggggcguccuugcagcgggccucaaguuugagaagagcuuccaggcugucuuuacuaggaaguuucugcaugaucguucuggcaugguauuccacgccgcguaugggaaagacagaggguguucccugugaauacgccgguguguguguuuaugugugucugauggucuuuuuuuuuuuuuuuuuuuuuuuuuuuagcacuguucuccucgacaguagugccaacaaaaggcuugcuucucaaaccaagcaacacuuuuucaaaacugagguugaaauuuuuguuuuguaugcucuccgaugaauuguaugcucuccgaugaaucaugccuuucacucagcgaaucuauacaaacucaaaaacaaucaauacuaaauucguggauaaagucugggacauuuuacauucacaugauuucagauuggccccacuauuagaucacacauaguuaaaaaugacagcaaauaucuagacuuaggaagugggguacuuuuugcaguaaaaacugcaaagucagaauugugguucccaaucuccaguacugacaggaccccccaauuuacuuccagaaugaggccaacagaaagugcucuucucagcuggacugaagcccugguucaucugcacagugagcuugcuggccuggaacacaagauuguagcugcaaugcagugcccuuuacugaugcuagu

SEQ ID NO: 11174 - RNA, 3541 nt, Mus musculus
acuagcaucaguaaagggcacugcauugcagcuacaaucuuguguuccaggccagcaagcucacugugcagaugaaccagggcuucaguccagcugagaagagcacuuucuguuggccucauucuggaaguaaauugggggguccugucaguacuggagauugggaaccacaauucugacuuugcaguuuuuacugcaaaaaguaccccacuuccuaagucuagauauuugcugucauuuuuaacuaugugugaucuaauaguggggccaaucugaaaucaugugaauguaaaaugucccagacuuuauccacgaauuuaguauugauuguuuuugaguuuguauagauucgcugagugaaaggcaugauucaucggagagcauacaauucaucggagagcauacaaaacaaaaauuucaaccucaguuuugaaaaaguguugcuugguuugagaagcaagccuuuuguuggcacuacugucgaggagaacagugcuaaaaaaaaaaaaaaaaaaaaaaaaaaagaccaucagacacacauaaacacacacaccggcguauucacagggaacacccucugucuuucccauacgcggcguggaauaccaugccagaacgaucaugcagaaacuuccuaguaaagacagccuggaagcucuucucaaacuugaggcccgcugcaaggacgccccaacccuacucuuccuaagcgguuucacgaugagccugcgcauagcccacuugagagauucauaagguccacgguccuugggauccgggaacaaucucuccacuuaggcucaucugacagaaagacuccggauuagcaacccaggagucaugugugacaaauuuucaccauauccuuuccgugucagccuccccucccccuucagcuuuguaucccgagaugagagugccaccucugcaggggacuccacugagucugcagcccgcaaagccuccccgccuccccaaacgaauaggaugcgagcuucuuuguccuuucacagaguaaacucggguuuaugagauucuccauuuaugagauucuccaauuccgaucucccaccucaggucuauggguuucucacgagcgaaagcugcuucuuucauuaaggcuguucaagguucuggcccuacgcuaagugcgucucccaagcaagugucucagcagcuguuggaaguguuguuagccuuguucuucguauguaaagaaucaaagcacucagagugaguuagcccaacuagguuuugagcccagguuggauuugacgccgaggcccuuaaaucuccauugcugcuuuuuauucagcaauauuauuucuuauggcucaauuacaguauuacgggcucugugcaaaguauuuuuccagauuaaucucagaaguaaggcugcuauuuaccaccuaagggaucuuaaacaacuuuuuaaacuauuuuuuuaacucuauuuuucugucugcaaaacgaggcuuaaaaaugugacugccgugaagagcaagcgaauuaauacgugcaaagcacuuagaacacagacgcgcacgaauuaagcgcugaaauuuuugccuuaaaagagucgcauccauuuguacaucggugggagagguuaaaaacaaaaacaaaaacaaaaacaaaaacaaaaacccguccagaugguacggggcucaucccggaggacagacuuggggacugcacgagauccaggcaccugcugggcaggggaccugcuucccuuguucugccgcaggaaggcgcugaggucugggggccuggaagggucgguucuuaucggaacuuccagacugggggggccugugccugcguuguaagggcgguagcauuauggaggauccgggcugauccccugcaaaagcaauguguaggacauccgcggcauggauugauugucugacagggucccuggcgcgcgcgcaggcaaguauacacagcgugagcacagauucacaggcacacacacacacacacacacacacacacacacacacacacacacacacucacucacacacgcacugcccgggaccgccagccccugcucccccgcccgccgcgcuccagggcggaguuuccuccucugcuuauuguucgcagcccagcgcccgcccagccgccgccccgcccgaccccgccgccgcugugggcgagcuccugggggagggggcggaggccagcgcggacgggacggggcgggagucuucgcagcaacgugcgcggggccgcagcggcgcagacaccgcccgggccgcagacaccuucgcucgucgcugcuggcuccgugucccagcccagcucugcgguaggcaggaggagcggccggaucgcgacuccggaguucgcggccgucgccaggccucccggagcggcgccgacgcucccgcuguccggacgcgcgacccugcgccagcgccgcagccaccugcucggaguccccgggcgagcacaaccaugccucccacuacggcgcucuccgcgcugcugcugcugcuacugucgccugcaucucacucccauaauggugaguggacagccgcggcucugccgggaccccuggucauuccccuccgccccaagccugguggggcuccugggaagccggcugcaccgcguggucggaccgcuugcagccucucccgcguggccgcacgcagaguccugaccuuggcaccauccacgcccccuccaaauuggagaaccccgcaggugcggggccagaucguggauuuauuccuagucuucacugguguagagugagccggagguugugagauuguaaagggggcacuugguggguucgcuggagaugggggggaaacuuuggguuguggggaggucccagauucccgcaugaccaccagaaugcgauuucucuuucucguguuuggggcuacuaggggaccguauugggaggucguugaaacuaagcaaagccgcgggcagggaccacaagaaggagccccugaaacugaccucaaaucccuaaaugcccacgcguguagcguacuucuugugcaagcgcuuuuucuuaagcuugucccgggacggguggaauaagcgcuccuuccagggucccagagccugguucagugggguccuugccuucauguugccaaaggaccggauucuuucucagagcauggccaggauggugggccccucccaccccuuuguguaaacaagaaauuucuuucacaaaugagguuugaguugugucuuaguaauaccucgggcacccaucucccaucagacccagcuuggagacgaucccacuaccuucuuucugaagguggaauguuacuuucuguuugagaggucaggcagugucugcaaacauaaccagagcaggugucccaaagucccugccaaacagcugagagacucagcccaggagagagaggcagguuucauaaacggaguagccuaucuugagcagguagcugcagggagaaaguagcgaagggaggcuuuccagagucggaaguacaguggugaccgcccaagcggggaagggacucugcug

SEQ ID NO: 11175 - RNA, 1129 nt, Mus musculus
ggaaccaaaucauaguacuuaaaagcaguuaaaaugggggcugguaaguuggcucaguggguaagagcacccgaccgcucuuccgaagguccagcaaccacaugguggcucacaaccauccguaacgagaucugacucccucuucuggagugucugaagacagcuacaguguacuuacauauaauaaauaaauaaaucuaaaaaaaaaaaaaagaguuucuuuaaaaaaaaaaaaaaaaaaaaagcaguuaaaaugaacaucuaaagugguggugggagguggcucccuaucaccuucgccuuugaaggggcguggauuagcagaacagaaagcuagccucagcuaaaugacaaguucacuaacauccugggcuauuuaagauccuaucccaacaaaagaacacaaacaucgagggauagacaucagugagagaaagccuugccacaguugaugguaggauggcgacuucucaaggacucaccucugggaaaaggcaggggucguucugcaaaagcaggauucgcagcugcccuucauugaggccaaaaagcccccggcuuuucaggacuuggacguugauagguguguggauaucaugggacagagaacagguagaccuagaagaguucaaagcagucaggaggccgggucaagaagagggaagaggcuggugggucuaacucugccuagggcauuuccacuucacaagugaauuccccaaguacuaauaaaacaauucggauugaggcaacucagcuuccaggggucauuucccuguucugugaguacccuacccucaggcuuuuuugagauuacuuaucuguuuuuguaaagacuaaaacguaaucuucaggccaacaacagcugcuggccucucuuuguccaccaacacuacaaagaaagcacuagaaagcuucccggauugcugcaaagcacugggcuugggcuaugcagcacuaugcccucaccccauccugccaccaguuuccugcgauuggacaccagauuuuuaagcgcgaaagggcugugguuauggaaggagggagagaagggaacagaaguuccgcgggccauaaagcccccaggugucccucaagcggcauuuggcauaagugaauucaaaagugg

SEQ ID NO: 11176 - RNA, 1129 nt, Mus musculus
ccacuuuugaauucacuuaugccaaaugccgcuugagggacaccugggggcuuuauggcccgcggaacuucuguucccuucucucccuccuuccauaaccacagcccuuucgcgcuuaaaaaucugguguccaaucgcaggaaacugguggcaggauggggugagggcauagugcugcauagcccaagcccagugcuuugcagcaauccgggaagcuuucuagugcuuucuuuguaguguugguggacaaagagaggccagcagcuguuguuggccugaagauuacguuuuagucuuuacaaaaacagauaaguaaucucaaaaaagccugaggguaggguacucacagaacagggaaaugaccccuggaagcugaguugccucaauccgaauuguuuuauuaguacuuggggaauucacuugugaaguggaaaugcccuaggcagaguuagacccaccagccucuucccucuucuugacccggccuccugacugcuuugaacucuucuaggucuaccuguucucugucccaugauauccacacaccuaucaacguccaaguccugaaaagccgggggcuuuuuggccucaaugaagggcagcugcgaauccugcuuuugcagaacgaccccugccuuuucccagaggugaguccuugagaagucgccauccuaccaucaacuguggcaaggcuuucucucacugaugucuaucccucgauguuuguguucuuuuguugggauaggaucuuaaauagcccaggauguuagugaacuugucauuuagcugaggcuagcuuucuguucugcuaauccacgccccuucaaaggcgaaggugauagggagccaccucccaccaccacuuuagauguucauuuuaacugcuuuuuuuuuuuuuuuuuuuuuaaagaaacucuuuuuuuuuuuuuuagauuuauuuauuuauuauauguaaguacacuguagcugucuucagacacuccagaagagggagucagaucucguuacggaugguugugagccaccaugugguugcuggaccuucggaagagcggucgggugcucuuacccacugagccaacuuaccagcccccauuuuaacugcuuuuaaguacuaugauuugguucc

SEQ ID NO: 11177 - RNA, 810 nt, Mus musculus
cacaguauuaguaacagcucuugccuuuucauaguaaccuuaguauaaaaaccaaccccccucucugucucugucucugucucugucucugucugucuguuggucugucugugucugugucuguccccccuccuccccccucacacacagacaguauaaaccagaaagccagucaccagcugugaauggaaagauaugggagccccuacaagggccucaaucuccguaaucaaugagaguaauggaucgauaauccauuuuaucagcucuaccugugacuagugugagauuuccuuccccccuccuuucccuagacucuaucaccagacagcuaccauuaugcagucagaaagccauuaaugucucguucccaguucugaaccucgggugacucucaagcuugccucgauuuaccugagcacaaauccugacuguaugagucagggcaguaugugugaugaccauuaauaagcacggagggggccaauacugaguuuccuaucaggaaacucgggcuucccuuaguuugaauguucugguugugaugcaaauuuaauucgauauggcagguuaaagucagaaaaguuugaaagacugugggauaaggcaacaaguagacgggaugggggugggggcugaguucuucccacaaguccugccgcuaggaauagggcauucgccuuuguaaggagccuguuugcuggcucagaaucguugaccaugguuaagccacccacccuagaagccaccagcauccaucaucucugaaguaccuggcacauaauccuauuucuucuuccuagcccaucc

SEQ ID NO: 11178 - RNA, 810 nt, Mus musculus
ggaugggcuaggaagaagaaauaggauuaugugccagguacuucagagaugauggaugcugguggcuucuaggguggguggcuuaaccauggucaacgauucugagccagcaaacaggcuccuuacaaaggcgaaugcccuauuccuagcggcaggacuugugggaagaacucagcccccacccccaucccgucuacuuguugccuuaucccacagucuuucaaacuuuucugacuuuaaccugccauaucgaauuaaauuugcaucacaaccagaacauucaaacuaagggaagcccgaguuuccugauaggaaacucaguauuggcccccuccgugcuuauuaauggucaucacacauacugcccugacucauacagucaggauuugugcucagguaaaucgaggcaagcuugagagucacccgagguucagaacugggaacgagacauuaauggcuuucugacugcauaaugguagcugucuggugauagagucuagggaaaggaggggggaaggaaaucucacacuagucacagguagagcugauaaaauggauuaucgauccauuacucucauugauuacggagauugaggcccuuguaggggcucccauaucuuuccauucacagcuggugacuggcuuucugguuuauacugucugugugugaggggggaggaggggggacagacacagacacagacagaccaacagacagacagagacagagacagagacagagacagagagggggguugguuuuuauacuaagguuacuaugaaaaggcaagagcuguuacuaauacugug

SEQ ID NO: 11179 - RNA, 285 nt, Mus musculus
cacuaaugggcuugggugcaggugacggucugagggcaagaugcccggaguguggagauggaaagugggagcuuaggaccgaggaagggcagaggggagaggaaggagaagaagaggcuagaaggaagggcacucgggcuagaagggagggugcucacagccuaggagggaggagcuggagaaagguggagcgcggaacggggugguggugguaguagugaagaguuggggggaguagggagaggagggggcguguuuggggaggagagcaauguguguauggcu

SEQ ID NO: 11180 - RNA, 285 nt, Mus musculus
agccauacacacauugcucuccuccccaaacacgcccccuccucucccuacuccccccaacucuucacuacuaccaccaccaccccguuccgcgcuccaccuuucuccagcuccucccuccuaggcugugagcacccucccuucuagcccgagugcccuuccuucuagccucuucuucuccuuccucuccccucugcccuuccucgguccuaagcucccacuuuccaucuccacacuccgggcaucuugcccucagaccgucaccugcacccaagcccauuagug

SEQ ID NO: 11181 - RNA, 1880 nt, Mus musculus
cgggcucccaguggcagccucggggaguuucuggcugaggccgaacccggcuagcagcguuggggagagugcuugggggagggcccaccuuuuggggagaccaguagauccaaugggucuauggaagccacugggaccuugcggucccgcacaccugcaccgggagcgggaaaaaccucgcucgccugccucccucccagagcgcgcaguuaucccgcgggccccagauaugcuccccaaguagaauauucaggucccuacagacccgcacgcagagagcugacaauucccgcgacaggcaaccuaagcggucccgcuucaucucccuagcgggacucgacggucggggauagagagagggcuccgagggugcucacucuugacuguucccuucuccccgcagagcgggccgcuuagaauugggguguggguggcuccagacgccgccacucgagcggcaguggcuccagccuccucccccgccgcugggggcgggaaguggcugugggagucacccgggcgugacugcccccgaggccccuccugccgcgacaagggcgcuccauaaaagccugugggcgacccgcucuccgcaucccaccgguggaucucuucucucacagaggcacccagagcagagcacccgccgcucagcgacgacugcccgcccgccacggugagugccaggaucaacugggacaggggcgcgggcucccagacgccagugaacuugccccgcagccgguccccugagcuugcucugccagcuugacacccagcucuuuggggcgccuaaauuucacuugcuggacucagguucuacuguccaccugcccuuccccgggacccuccaaucugggcgccccgccuccgugccucuuaucuuuugaggguagggagaagaaccugggaacaccuaucccagggcagcggugggguuuuguuugguuguuuguuuguuugguugguugguugguuacaaccaggaacccagauugcaugugugcuccuagugggagauucccccaaguauugucucuagcacggugagcucuguugccuccaaaauccgaacugagccucuggguauccgacugucacagcgcuuguagccacacaaaucaaaagcaacccagaagaaaaguuuucuccuccaagggugauuuaggaacgagaggagaaaaguggucauucuuuaagauagagggcagaacuuccaauucuguucugaaaaggggaccucugccucucaccaggagaaucggaggaaguuuucugaaauauguggacggggcagaagauccaggucggggcaaguggucuucuaaagauuuggaaguggcgccugcccagucugggcuuuuauucuagggucugggaugggauuagaugagggucuagagugauagcuggaauugggacaaagacgagcaaucucagcaucuccaagucugagccuucuguauccacagaugcuagguaacaagcgaauggggcuguguggacugacccucgcucuaucucugcucguguguuugggcauucuggcugagggguaccccuccaagccggacaauccgggcgaggacgcgccagcagaggacauggccagauacuacuccgcucugcgacacuacaucaaucucaucaccagacagaggugggugcauacgcggcugguaccuagagccgggaaaacuugcgguucuggagaucuuggacaucagggaucauuucuuucuccuuguucauagggcaggaucagacauaaauucagcucuagauaaauaugugagcuggguacacacuccacaaacuggauacauugucuuugucacuagacuuucucuccaagacccaagcccaagguucagugccuc

SEQ ID NO: 11182 - RNA, 1880 nt, Mus musculus
gaggcacugaaccuugggcuugggucuuggagagaaagucuagugacaaagacaauguauccaguuuguggaguguguacccagcucacauauuuaucuagagcugaauuuaugucugauccugcccuaugaacaaggagaaagaaaugaucccugauguccaagaucuccagaaccgcaaguuuucccggcucuagguaccagccgcguaugcacccaccucugucuggugaugagauugauguagugucgcagagcggaguaguaucuggccauguccucugcuggcgcguccucgcccggauuguccggcuuggagggguaccccucagccagaaugcccaaacacacgagcagagauagagcgagggucaguccacacagccccauucgcuuguuaccuagcaucuguggauacagaaggcucagacuuggagaugcugagauugcucgucuuugucccaauuccagcuaucacucuagacccucaucuaaucccaucccagacccuagaauaaaagcccagacugggcaggcgccacuuccaaaucuuuagaagaccacuugccccgaccuggaucuucugccccguccacauauuucagaaaacuuccuccgauucuccuggugagaggcagagguccccuuuucagaacagaauuggaaguucugcccucuaucuuaaagaaugaccacuuuucuccucucguuccuaaaucacccuuggaggagaaaacuuuucuucuggguugcuuuugauuuguguggcuacaagcgcugugacagucggauacccagaggcucaguucggauuuuggaggcaacagagcucaccgugcuagagacaauacuugggggaaucucccacuaggagcacacaugcaaucuggguuccugguuguaaccaaccaaccaaccaaacaaacaaacaaccaaacaaaaccccaccgcugcccugggauagguguucccagguucuucucccuacccucaaaagauaagaggcacggaggcggggcgcccagauuggagggucccggggaagggcagguggacaguagaaccugaguccagcaagugaaauuuaggcgccccaaagagcugggugucaagcuggcagagcaagcucaggggaccggcugcggggcaaguucacuggcgucugggagcccgcgccccugucccaguugauccuggcacucaccguggcgggcgggcagucgucgcugagcggcgggugcucugcucugggugccucugugagagaagagauccaccggugggaugcggagagcgggucgcccacaggcuuuuauggagcgcccuugucgcggcaggaggggccucgggggcagucacgcccgggugacucccacagccacuucccgcccccagcggcgggggaggaggcuggagccacugccgcucgaguggcggcgucuggagccacccacaccccaauucuaagcggcccgcucugcggggagaagggaacagucaagagugagcacccucggagcccucucucuauccccgaccgucgagucccgcuagggagaugaagcgggaccgcuuagguugccugucgcgggaauugucagcucucugcgugcgggucuguagggaccugaauauucuacuuggggagcauaucuggggcccgcgggauaacugcgcgcucugggagggaggcaggcgagcgagguuuuucccgcucccggugcaggugugcgggaccgcaaggucccaguggcuuccauagacccauuggaucuacuggucuccccaaaaggugggcccucccccaagcacucuccccaacgcugcuagccggguucggccucagccagaaacuccccgaggcugccacugggagcccg

SEQ ID NO: 11183 - RNA, 2967 nt, Mus musculus
guaguaggucgcuuuuugcaucgcgauguuucacgaucgugaucacacucucugacaagggcuugacacccguaagggagcacauuggcacgcccccgcggucacgugacacuccgccgccaauggccgccgcgcgcaaaccugagggaggggggagaagugcagcgcggugagggcuccgcgcaaauccaucuuacucucaauagcuaagugacaugaaagccauaaaagaaaaaguggucagcaauauuuagcagcacgacguggccccgggcgcagggagccgcacuauaaaaagcugcuggaauuuacuggcagcuacaaauauuugcuuaacuugcgucuggaguugggggauuuuccgcggagcagcagaaccaguaagggcuggaagcugggucucuggagccaagguccaaaaugagacagggucuggaggcuagguuggggucuuucuuuuccagaagaagcuguggcgucccuuuguagaggcugaggcuuucugagaucuugggggaacucucaaaagggcaaagggucgucauuuuuucuccaauccucccauaaggauucauauuugccucaaagaucuaugauggucagacuuccuuccuagccagccuuugccuggaacucucaaaggagguuugcacacacacacacacacacacacacacacacacacacacacacacacacacaggcaacuacccuaucggaucaugauggaguuuggaagcugaguuuguuagacaguuagccuguucuaguucagggaagaggaccaaccgccuccaaaugaacccuauaaggucaagaagaguguggaagagaaaacuuuugaagaaguuucucucucucucucucucucucucucucucucucucucucucucucucucucacugugugugugugugggggggggggggucuucccaacuccacccucaagucacaacucaaaucuuguaacuuucuauacauuuucucccauccuguuuuucaggcaauuugaaacaagccacuccaaccucuuuuucaaaguuauaggagguucccugucuugaagucuccugccuuggauuuucugaggugcugcuauucugggcaacuaucaaaauccuaccuguuaaaacaugauggauuagagaaaaaaaacaacccaccaggaaccugaaaaaccggcguucaucuccaugaccacggcuugaacucuccuuccaacuuaacgauaauagguucugucuuagaaacugcuauguaauuugauguaugggggucauuuggcuccagaggaggcauggaagcacaaaccauaaacuccugccagacuucccugaucuuuguauacuuuuguuggucauauuuguuauuugguccauuuuccugcuucagaaauacuaaguaaagaaaaacaucuuuuuaaaaaacccuaaaagucucuuauuuaaaaaauacuuuauagaaaugaaaucuguguucuccugguuuucaacuucugcaugguaaauuucuaauucucagcaagaaaaguuccuuggaagucuuacauguucacacccagacacacauucagaaugcuagucccucugaccauuaaaaaagcuauaacaauaaaucuauguagauaauguuuaacauuucaaagcccuaacuauggccauucaaucccagaguuauccaacuuuucuagaaguaccagcugucaaccaggaauauguguguguguguguguguguguguguguguguguguguguguguaucaagcauccaccaaugggcgauuacaauuuuguucuuaauaaugaacccccuuagauuucaucauuaaaccaacaaucugaucaacaucuggaaaacaggcacaauuaacuuuccagaaccucaauaaaaauuacagcaacacuuauccagaauuauuguguauggucaugaagccugaguguuguuucccuuuuggaaauaucuaggaaguuacagauaacagcaugaaaaguaaauaaaggguaaaauaaaauuuaagagugaauuacaacuuaaugucuacuuuucuaguucuuacacugaaaacaguucccauuacauuuggcagcauuaaugucugucauuauaaauuuuugagguaccaagcuuaauuaagguaaacgucggguuaagaaaauuacucuagacauuugaacagcaaaauauuagguaaacaaaaugaaguugauuuugagcaugcgguauuucuagugacuuucugagccauuagcacaggcuauaccagcauacagcuugcuuaagccuuuuuccauuguacuguacauggucuuguaaaaauaacaaaaaauaucuuuaaaaaucaaagugccuagggcagcguccacaaacuuaaaauaugaauucagcucagagaucccauuguuugagguccgcaaucaccuuggaguccacacaacccgcccccuccagcccccaaaguuucaaucuaguaaauaaguuggagauuugccagccaggaaacuuugcuuugucccccuaagcaagggcugaggguggagggagauuccuucccgacgcucuguuccuggacaauaaccuccaggugcaagagcugaagcgaguugaggaggcugaacugagaacaggaugcaagaagcccuguugucucuacaccacaagguaugcccaaauucgacaccuucagucucugcucccucuccuccccucacccgaguuugaaaggggacgucgagauagaagccccgguucccacuccacuccucucucuaucucucaccaacccagaaaaguugaugcugggcuagggaagaggggagagugggggcggggaugggagcgcggccugaacugaagugugaggguaucagucacugccggcgaggaagcuccggcuugugaacucuucuugaaccgagauuuaagucugcagccauaaaucacugagacauacacuccacc

SEQ ID NO: 11184 - RNA, 2967 nt, Mus musculus
gguggaguguaugucucagugauuuauggcugcagacuuaaaucucgguucaagaagaguucacaagccggagcuuccucgccggcagugacugauacccucacacuucaguucaggccgcgcucccauccccgcccccacucuccccucuucccuagcccagcaucaacuuuucuggguuggugagagauagagagaggaguggagugggaaccggggcuucuaucucgacguccccuuucaaacucgggugaggggaggagagggagcagagacugaaggugucgaauuugggcauaccuugugguguagagacaacagggcuucuugcauccuguucucaguucagccuccucaacucgcuucagcucuugcaccuggagguuauuguccaggaacagagcgucgggaaggaaucucccuccacccucagcccuugcuuagggggacaaagcaaaguuuccuggcuggcaaaucuccaacuuauuuacuagauugaaacuuugggggcuggagggggcggguuguguggacuccaaggugauugcggaccucaaacaaugggaucucugagcugaauucauauuuuaaguuuguggacgcugcccuaggcacuuugauuuuuaaagauauuuuuuguuauuuuuacaagaccauguacaguacaauggaaaaaggcuuaagcaagcuguaugcugguauagccugugcuaauggcucagaaagucacuagaaauaccgcaugcucaaaaucaacuucauuuuguuuaccuaauauuuugcuguucaaaugucuagaguaauuuucuuaacccgacguuuaccuuaauuaagcuugguaccucaaaaauuuauaaugacagacauuaaugcugccaaauguaaugggaacuguuuucaguguaagaacuagaaaaguagacauuaaguuguaauucacucuuaaauuuuauuuuacccuuuauuuacuuuucaugcuguuaucuguaacuuccuagauauuuccaaaagggaaacaacacucaggcuucaugaccauacacaauaauucuggauaaguguugcuguaauuuuuauugagguucuggaaaguuaauugugccuguuuuccagauguugaucagauuguugguuuaaugaugaaaucuaaggggguucauuauuaagaacaaaauuguaaucgcccauugguggaugcuugauacacacacacacacacacacacacacacacacacacacacacacauauuccugguugacagcugguacuucuagaaaaguuggauaacucugggauugaauggccauaguuagggcuuugaaauguuaaacauuaucuacauagauuuauuguuauagcuuuuuuaauggucagagggacuagcauucugaaugugugucugggugugaacauguaagacuuccaaggaacuuuucuugcugagaauuagaaauuuaccaugcagaaguugaaaaccaggagaacacagauuucauuucuauaaaguauuuuuuaaauaagagacuuuuaggguuuuuuaaaaagauguuuuucuuuacuuaguauuucugaagcaggaaaauggaccaaauaacaaauaugaccaacaaaaguauacaaagaucagggaagucuggcaggaguuuaugguuugugcuuccaugccuccucuggagccaaaugacccccauacaucaaauuacauagcaguuucuaagacagaaccuauuaucguuaaguuggaaggagaguucaagccguggucauggagaugaacgccgguuuuucagguuccugguggguuguuuuuuuucucuaauccaucauguuuuaacagguaggauuuugauaguugcccagaauagcagcaccucagaaaauccaaggcaggagacuucaagacagggaaccuccuauaacuuugaaaaagagguuggaguggcuuguuucaaauugccugaaaaacaggaugggagaaaauguauagaaaguuacaagauuugaguugugacuugaggguggaguugggaagacccccccccccccacacacacacacagugagagagagagagagagagagagagagagagagagagagagagagagagagaaacuucuucaaaaguuuucucuuccacacucuucuugaccuuauaggguucauuuggaggcgguugguccucuucccugaacuagaacaggcuaacugucuaacaaacucagcuuccaaacuccaucaugauccgauaggguaguugccugugugugugugugugugugugugugugugugugugugugugugugugugugcaaaccuccuuugagaguuccaggcaaaggcuggcuaggaaggaagucugaccaucauagaucuuugaggcaaauaugaauccuuaugggaggauuggagaaaaaaugacgacccuuugcccuuuugagaguucccccaagaucucagaaagccucagccucuacaaagggacgccacagcuucuucuggaaaagaaagaccccaaccuagccuccagacccugucucauuuuggaccuuggcuccagagacccagcuuccagcccuuacugguucugcugcuccgcggaaaaucccccaacuccagacgcaaguuaagcaaauauuuguagcugccaguaaauuccagcagcuuuuuauagugcggcucccugcgcccggggccacgucgugcugcuaaauauugcugaccacuuuuucuuuuauggcuuucaugucacuuagcuauugagaguaagauggauuugcgcggagcccucaccgcgcugcacuucuccccccucccucagguuugcgcgcggcggccauuggcggcggagugucacgugaccgcgggggcgugccaaugugcucccuuacgggugucaagcccuugucagagagugugaucacgaucgugaaacaucgcgaugcaaaaagcgaccuacuac

SEQ ID NO: 11185 - RNA, 5873 nt, Mus musculus
gaagacauugaagaacucccuugaaugggagggaacaaacuacacugggcucauccaggccuuguccaaagggacagaguuagccucaggugagaagagccuggggugucaguccuauggugggucuguuccccacugcugucaguauucacagugagcuggggguggggguggggagaugggcuucuagacugcagagacagaacaggggcaggaagccacuagacgcugguuuucaguagacuaagcaaacagauccagaggaagaauaggcaggacuggauaccuuugggguucugagaaguaucaggcauugggggccaugaagcaccccauuucuugccucagauaccugugcccuuuacaucaggaggcccagaggcugagcacuucuccuaacugcguuugcgaagacuccagcucaaccuucugaagaggagaacuguucucuguugcccacugcgcggaacacugccuccaggggaagggaauccguccagauuauuugaucucuggacuccuggaagccugaaccucuggaguuuggcuuucaguaaaccuuuucucgcgggcgggggauguucccccaaggggcgcaccacucagugagucugggcucaaaaagaggccuggacagcuguauugggagaaguggagcugacugauagauacucccacugccaaccccucuagcugcgaagacccagagucacagaaacuuugcggaaauaaucccugucacaaccugaaaggucacagaggaccaggggacaguaucuacgacagcugggagacucuuacuauuuagaaggaugcucucuuuguucuuacauuugacgaaagaaaaguucauuucuuuuucuuucccuagacgacgcauucaccccuucuccccgggagaaagcaggucccuggacuuucacccuugccuuucagccagccaugugcaaaggugcucuggaccgcucaggaccacugccgaccacgccccacgggccucgggucacuuagacagcucccacaaccgcagccgccucucucccaagccggauuuucuugcgaagcgaagcuguuuccguggggauccacauucgguggcccaagcaaagguuuagauuccauuuaaaacgacuggcgcgacuuaucuccccuuggcucccuaggauucucagccacccucuaucccuccuagccgggcggaagccaaacccacagcguuugaaguucagagaauuccaauccucgaagaacuggccgcaucugagccgaucgccccagcaggagaaggacugcaagucggcggggcugcagcggagagaugcaccggggcggacuccacuaagguggcugucaccucucuuugcuuucgaaggguuaccuugcuucacgcgcuauuagaaauuuccuuccuucuuccgcugcucaguaaauaaccuucauaauacaacgauagugaagauuaaaacacacuucccaagcaggaagaaaaacaaaaacaguaacaacccaagacaaaacagaacaaaaacccccaaaccgugucuuucuccagcacucucuuuucaucugcagugaaaaauucuacucccuucauuugaagucggccaauugcugauauuagaagugacauuuaguuggauuucuuucuuuucuuuuuuuuuuuuuuuucucuuuaagcaucggcauagguagggagagguucaaguagggaccucaaaacuaggaugcuaaguagauggaggcugcuuuaaaaagcuaugcuggggucuggggaggaauuugggacugggggugggcugagaagggauuuucaugaagcucagaucuggagcagacaggaggcugcagccuucagagagucugaggccccuccuggagauguaaggaaagccuggcuccauccgacugacccaggaaggagacuaaauggcaccccuugaucucacaauucuguucugcuuucaucucuagggaaaaugcugaguaaaaggggaucaaacguugaacauucccauugaaugcaaagcugggggcggggcagggaagucagaccagccucccucugagagggagggcagugaaguaguggcuaguucauggggggggggggggggggcugggagagugggugucucacaggcccagccccagaagaugcagcagcagcagcagcccugagacagauucaggagucuagagaacagagagaccaagcagacucuggcuggagugagaaagccaggacaagccagaauugguggauaucuccucagggcaggagaagauccgagaacucacuauccccuugaccccaucucugccuuggccucugaaaucuuucucuagauuucugggcuggcaguguucagcaacugcuggcuuuggggguuaauagggaguggacacauuugcuuggauaccacccuucuugucaucugcccuuguuccccaggcaagauuaacaaacauuugcugcaucaggagagaaauggaaagccagagucguuuuccuaaaccucuggcuuccuccauuauuuccauaauccuaaaucagccagauugagggaaggguagagagaaacugagaaaaggguaggagacagaggacaaugagggaaucacaggaacuuucuuagaagcuggggcuuugccuugggacacaggaguuuuuauccccaccccccgcuucuucagcuaagagggcaggcugcucacuaguggaaaauauugcagggggagccagagagggggauggaggagcuaaacucggagggugcucaccucugccccucaaucuggcccaccugccaggcuccgcaggagauucuucuacuccuucucccaaacaccaagucccagaauuccacagguccagaccuucaccuccucagaggauuagccuagucccuucaccccgccuacugccuguuuuuguuuuuuguuuuuguuuuuuguuuuccccaugacauuucaacaacuuucucuccuaccucuagcuuuggacacagaaaaucucuuuuggguagagcccaggagaggacccugcaagcucaaacccugcugauacucuuugccacacaaucuacccacagcugcccuaaaaccaucagagaaggccagcaccuucuaccugggcuccuuccguacuaccagagcagggggccggauugccagcuccuuuucauuagaacacgccguuuguggcagaauucguugacucuguagaaauaccuaaaauacagacagaaaaagaaaggccaaucuuagacccuuucccuaaccgacauaccugaaauagcccggagauaagccaaaccaaaagauguuuucuucuaugaagagccaauccaaauucaaaucaggccaucuagauagagauaauuaacaacaacaacucauugaacacuucgaauuuuagccaggugaucuggguggggagagauuuuucuucuucuucuaaaaucgaggaacacuguguuagcacacaaggccgguucucaaaggggaaaacgauaucuuuuggcuguuaggggaugaaaauaaaguuugguucuuaggagggagacagaugggguuggggagaugagggaggaacggguacuuuaggcucaagcuccccagacaacugagguggaggguaccuuuucaguagcugguuaaaaaaaaaaaaaaaaaaaaaaagacaagcgguuguauuaauacucagaaaaccuggguuuguaaacagcuuccaaagaguagcuauggauucuuucauuaguauuagaucuagacaccagguuaagaaaacagaagucaaaacaacaauaaaauaaaauuucaaaagcauuuuucaauuaccaaguccuguugccccuguggaacucgcugcgcgccuuaagcgcucccuuuucugugugcggaauuccauuugcauccucugugucugggugucucccuuucccagugugugugucucucuguuuucacacucuccuccccauucgagcgaggcccacaccuggcgcaucacugccgagccauuagcugcgggucuccuuucaucuucacuguggcagacguuucuauuuauccacuugcguucgccgaguggcgucaccagcgguacuguaaugacgauugcagcaggaggaugacagcuuagaaagaagagggcaauggggcuuccucccagaggcggugcggcacagaggagcgcucgcaucacaaggugacccuagcuccccacugccaucuccgcggucgccgucgacacggcgcuggggcuacccggcgccugccuugucgccuuagcuccucuucucagccaagaucccagggagccugggauuaggagcuuacuuggggguuuucccccucccccccucuggagaguccggggauggagagccgaaaggacaugguuauguuucuggaugggggucagcuuggcacucugguugguaagagggucucuaauuuguccgaagccgugagcagcccgcugccugaaccgccagagaagauggugccccacgguugccugagcccgcgagccggcccuccgacuucccgggagcguggcgggggaggccaggaggaggagccggucgauggacuagcaggcagugcugcagggcugggcgccgagccacggucugcuggagcggccaugcuuggcccgggacccccaguccccuccgcggacagccucucuggccaagggcaaccuaguagcucagacaccgaaucggauuucuaugaagaaaucgaggugagcugcaccccagacugcgccaccgggaacgccgaguaccagcacagcaaagguagccaccuugccccuccgcuccccgguccgcccacuccacccacaguucccuucaucucaggccaggugcaagaugcuccuuucccuuggggcaggauggcuggggguugggugaguggggcgggggcaccugaacaacucuuuugcucucugcaccuuagugugugugagggcucucguguuaucccauuagagugacaguugugccuggacgaaugucagcguuggcacaagucuugacuugagggguccaaaacgcaccccaaccucccaacccccgaguuuugugggaaugauucagcuaagacggaaagacacauccgucggguagggcaagaucaaacgguuguccgggcaguuugacuggaggggagcaaggcacaaggaggcgcggaagcccggagaauauaaaggaccguaaaaucguggcggacucuggucuccggagggcugcagcccuccgaccaguuugcacgucggucagagguccaaauuaccuugucacuucccgggcuggcggcgccaggucggaaauggucccaauggucuaauugccuuuggucuccgguugcauuugaaaaggcggggauugggcccucccccucccucuuucccucagucucacuucuccacccaaaggaaaagcagcugcaggggggcuggagccccacccuccucuggggugggucuaagggguugguacuuuaauuacacugcuccuucucaccaggggcuaaugggaguggggguggauagcucagaagggagucucucuauaccaacaauauccacuccuaggaaugaaagacuggaagcccaucagcagacacaccuccacaaaaccaugggaaugggugggaaaggcuugccucuaccucuaggccuaggcagccaacaccaccuuguuaaguauccaccuccaucuccuaucaucuuaucaucuaucuaacccagcuucucuaccauaccauguccucacaacccauacucaaaauauaccacuccugcaauaggugcaacccaacacacauccccacaccugguacuggcauacuggugcaca

SEQ ID NO: 11186 - RNA, 5873 nt, Mus musculus
ugugcaccaguaugccaguaccagguguggggauguguguuggguugcaccuauugcaggagugguauauuuugaguauggguugugaggacaugguaugguagagaagcuggguuagauagaugauaagaugauaggagauggagguggauacuuaacaaggugguguuggcugccuaggccuagagguagaggcaagccuuucccacccauucccaugguuuuguggaggugugucugcugaugggcuuccagucuuucauuccuaggaguggauauuguugguauagagagacucccuucugagcuauccacccccacucccauuagccccuggugagaaggagcaguguaauuaaaguaccaaccccuuagacccaccccagaggaggguggggcuccagccccccugcagcugcuuuuccuuuggguggagaagugagacugagggaaagagggagggggagggcccaauccccgccuuuucaaaugcaaccggagaccaaaggcaauuagaccauugggaccauuuccgaccuggcgccgccagcccgggaagugacaagguaauuuggaccucugaccgacgugcaaacuggucggagggcugcagcccuccggagaccagaguccgccacgauuuuacgguccuuuauauucuccgggcuuccgcgccuccuugugccuugcuccccuccagucaaacugcccggacaaccguuugaucuugcccuacccgacggaugugucuuuccgucuuagcugaaucauucccacaaaacucggggguugggagguuggggugcguuuuggaccccucaagucaagacuugugccaacgcugacauucguccaggcacaacugucacucuaaugggauaacacgagagcccucacacacacuaaggugcagagagcaaaagaguuguucaggugcccccgccccacucacccaacccccagccauccugccccaagggaaaggagcaucuugcaccuggccugagaugaagggaacuguggguggagugggcggaccggggagcggaggggcaagguggcuaccuuugcugugcugguacucggcguucccgguggcgcagucuggggugcagcucaccucgauuucuucauagaaauccgauucggugucugagcuacuagguugcccuuggccagagaggcuguccgcggaggggacugggggucccgggccaagcauggccgcuccagcagaccguggcucggcgcccagcccugcagcacugccugcuaguccaucgaccggcuccuccuccuggccucccccgccacgcucccgggaagucggagggccggcucgcgggcucaggcaaccguggggcaccaucuucucuggcgguucaggcagcgggcugcucacggcuucggacaaauuagagacccucuuaccaaccagagugccaagcugacccccauccagaaacauaaccauguccuuucggcucuccauccccggacucuccagagggggggagggggaaaacccccaaguaagcuccuaaucccaggcucccugggaucuuggcugagaagaggagcuaaggcgacaaggcaggcgccggguagccccagcgccgugucgacggcgaccgcggagauggcaguggggagcuagggucaccuugugaugcgagcgcuccucugugccgcaccgccucugggaggaagccccauugcccucuucuuucuaagcugucauccuccugcugcaaucgucauuacaguaccgcuggugacgccacucggcgaacgcaaguggauaaauagaaacgucugccacagugaagaugaaaggagacccgcagcuaauggcucggcagugaugcgccaggugugggccucgcucgaauggggaggagagugugaaaacagagagacacacacacugggaaagggagacacccagacacagaggaugcaaauggaauuccgcacacagaaaagggagcgcuuaaggcgcgcagcgaguuccacaggggcaacaggacuugguaauugaaaaaugcuuuugaaauuuuauuuuauuguuguuuugacuucuguuuucuuaaccuggugucuagaucuaauacuaaugaaagaauccauagcuacucuuuggaagcuguuuacaaacccagguuuucugaguauuaauacaaccgcuugucuuuuuuuuuuuuuuuuuuuuuuuaaccagcuacugaaaagguacccuccaccucaguugucuggggagcuugagccuaaaguacccguuccucccucaucuccccaaccccaucugucucccuccuaagaaccaaacuuuauuuucauccccuaacagccaaaagauaucguuuuccccuuugagaaccggccuugugugcuaacacaguguuccucgauuuuagaagaagaagaaaaaucucuccccacccagaucaccuggcuaaaauucgaaguguucaaugaguuguuguuguuaauuaucucuaucuagauggccugauuugaauuuggauuggcucuucauagaagaaaacaucuuuugguuuggcuuaucuccgggcuauuucagguaugucgguuagggaaagggucuaagauuggccuuucuuuuucugucuguauuuuagguauuucuacagagucaacgaauucugccacaaacggcguguucuaaugaaaaggagcuggcaauccggcccccugcucugguaguacggaaggagcccagguagaaggugcuggccuucucugaugguuuuagggcagcuguggguagauuguguggcaaagaguaucagcaggguuugagcuugcaggguccucuccugggcucuacccaaaagagauuuucuguguccaaagcuagagguaggagagaaaguuguugaaaugucauggggaaaacaaaaaacaaaaacaaaaaacaaaaacaggcaguaggcggggugaagggacuaggcuaauccucugaggaggugaaggucuggaccuguggaauucugggacuugguguuugggagaaggaguagaagaaucuccugcggagccuggcaggugggccagauugaggggcagaggugagcacccuccgaguuuagcuccuccaucccccucucuggcucccccugcaauauuuuccacuagugagcagccugcccucuuagcugaagaagcgggggguggggauaaaaacuccugugucccaaggcaaagccccagcuucuaagaaaguuccugugauucccucauuguccucugucuccuacccuuuucucaguuucucucuacccuucccucaaucuggcugauuuaggauuauggaaauaauggaggaagccagagguuuaggaaaacgacucuggcuuuccauuucucuccugaugcagcaaauguuuguuaaucuugccuggggaacaagggcagaugacaagaagggugguauccaagcaaauguguccacucccuauuaacccccaaagccagcaguugcugaacacugccagcccagaaaucuagagaaagauuucagaggccaaggcagagauggggucaaggggauagugaguucucggaucuucuccugcccugaggagauauccaccaauucuggcuuguccuggcuuucucacuccagccagagucugcuuggucucucuguucucuagacuccugaaucugucucagggcugcugcugcugcugcaucuucuggggcugggccugugagacacccacucucccagccccccccccccccccccaugaacuagccacuacuucacugcccucccucucagagggaggcuggucugacuucccugccccgcccccagcuuugcauucaaugggaauguucaacguuugauccccuuuuacucagcauuuucccuagagaugaaagcagaacagaauugugagaucaaggggugccauuuagucuccuuccugggucagucggauggagccaggcuuuccuuacaucuccaggaggggccucagacucucugaaggcugcagccuccugucugcuccagaucugagcuucaugaaaaucccuucucagcccacccccagucccaaauuccuccccagaccccagcauagcuuuuuaaagcagccuccaucuacuuagcauccuaguuuugaggucccuacuugaaccucucccuaccuaugccgaugcuuaaagagaaaaaaaaaaaaaaaagaaaagaaagaaauccaacuaaaugucacuucuaauaucagcaauuggccgacuucaaaugaagggaguagaauuuuucacugcagaugaaaagagagugcuggagaaagacacgguuuggggguuuuuguucuguuuugucuuggguuguuacuguuuuuguuuuucuuccugcuugggaaguguguuuuaaucuucacuaucguuguauuaugaagguuauuuacugagcagcggaagaaggaaggaaauuucuaauagcgcgugaagcaagguaacccuucgaaagcaaagagaggugacagccaccuuaguggaguccgccccggugcaucucuccgcugcagccccgccgacuugcaguccuucuccugcuggggcgaucggcucagaugcggccaguucuucgaggauuggaauucucugaacuucaaacgcuguggguuuggcuuccgcccggcuaggagggauagaggguggcugagaauccuagggagccaaggggagauaagucgcgccagucguuuuaaauggaaucuaaaccuuugcuugggccaccgaauguggauccccacggaaacagcuucgcuucgcaagaaaauccggcuugggagagaggcggcugcgguugugggagcugucuaagugacccgaggcccguggggcguggucggcagugguccugagcgguccagagcaccuuugcacauggcuggcugaaaggcaagggugaaaguccagggaccugcuuucucccggggagaaggggugaaugcgucgucuagggaaagaaaaagaaaugaacuuuucuuucgucaaauguaagaacaaagagagcauccuucuaaauaguaagagucucccagcugucguagauacuguccccugguccucugugaccuuucagguugugacagggauuauuuccgcaaaguuucugugacucugggucuucgcagcuagagggguuggcagugggaguaucuaucagucagcuccacuucucccaauacagcuguccaggccucuuuuugagcccagacucacugaguggugcgccccuugggggaacaucccccgcccgcgagaaaagguuuacugaaagccaaacuccagagguucaggcuuccaggaguccagagaucaaauaaucuggacggauucccuuccccuggaggcaguguuccgcgcagugggcaacagagaacaguucuccucuucagaagguugagcuggagucuucgcaaacgcaguuaggagaagugcucagccucugggccuccugauguaaagggcacagguaucugaggcaagaaauggggugcuucauggcccccaaugccugauacuucucagaaccccaaagguauccaguccugccuauucuuccucuggaucuguuugcuuagucuacugaaaaccagcgucuaguggcuuccugccccuguucugucucugcagucuagaagcccaucuccccacccccacccccagcucacugugaauacugacagcaguggggaacagacccaccauaggacugacaccccaggcucuucucaccugaggcuaacucugucccuuuggacaaggccuggaugagcccaguguaguuuguucccucccauucaagggaguucuucaaugucuuc

SEQ ID NO: 11187 - RNA, 2927 nt, Mus musculus
gcagccccaccccaggccacuccugguagaagucuuccccgcugcuggggcugcggcugcggcugcagugguagcuccugcgagaggccugcagggggcgucauccccucuucugacgauguggguagcggccacugccuacugccugcuguaggggaaggugagggauccacgcaagacccauucugcagcaguuggucauccagguaauccagguacuugccccgcagggccgggggguggcgacacugcacgaagaccguaaggaggcgacccugagaaugccaguugcccauccagcguuucagaccccgcaaccggcagucgcagguccaaccauugccgucuagauccagccgguagagagccggacuggcggcaaagauguccccagaaagggcgcugagcgcguugucgcgcaggcugagcucacggagccggcccugguggccaaagguggcagggugcagagcagaaagcucauugccacucaggucuagugccuccaagcugugcagaggcuccagcagugucagggggagcugguucagccgguuaccuuccaggcgcagcucacguagggccuccaguccccaaaaggccucuggggcgaggugcgugagcugguuuccacugagggagagcaggccuaggcguggcaggugcuggaagacgcgggggccgaggugcuguaggcuguuggcugagaggaugagaguagagagggagcgcagagggacaaagguggccgcguggcgcagagaggguugcagcucguuggccgagagauugaggaaucgaagcuuacccagcuggcugaaggcguucuugcccaaaaaacggauccgguuagauuccagguguagguagagcagguugcccaggggagcgaagaccgcguccggcagcgcucccagcacguucccguccagccguagcuugaccaaacucuccaggcccucgaaggacccgcgacucaggcguccaaucucguugccguuggcguaaaggaugcgcaacuugcgcagcggagccaacgugccaggaacgagcgccugcaagagguuguuccccagguacagcuccucuagucgugagagcuucucgaaggucuugggguggagagaacggaucugguuguacugcagauccagccgucugagcugccccagacgguggaagucgaaggcggugauguuggugaugaaguugccgccuaggcuguaggugagcacguccuggggacuaggcagcgagcuggucuuggguacagcgcgaaguccccuguuggugcauaggagauguugggggugcuggcagucgcagcgcuccgggcacacggacucggcccgcggcgggaacgccaggcagccgcacaccacgagccagaagcgcacggcacccacacccuccaucgccgcccgcccagcgcgcugcggccggaucgucuucugggccggccggcucugugucuccucugcauuccccucggccgggccugagucgcuaaaaaggccucuuucguacuucgcuggugcuccguccagcccuuccucuuugucccgguggcucgcccgggucuccgcaggccaaguucgcggagccaaaucagaaggcgcugggcgcucggcgaaucuggggugcuacuuguugcauuucugcagaaaacuguuucuucgggugagcgucgggggcgggaggagcgagcaagaguuggugcuuuuuguuugcucuggaguccggagagcuggauucccuggcgcggauucuccccgccaaacggauucccccgcugcaggcgggaucccuuccaagagcugcuggggugcggcuuggcugcagaguaccggccgcuaggcccacgucuccggcgccugcccgcucgcgauccggggggauugggagugcagccggagugagcagccugggggacgcgcaagcagcguccggaagggacccaugucggcguggagcgagcaaaccggcggaaauucguucuucccacacucugccccccgggggaugcaggcggagaaagaggagacggcggaggcaggacagaccccggcugggggaggaggaaacacuaaguggcuccgcgucuggucagcccuagcccggacgccaagugagaaaaguagggauuaaaaacagcuguacgggucggcgcgcaggcugggggcggggguggauuaccgggcgagcaaacggggauugcagacagagaccuuuuuauuuuaggccgguucgccggcggcuucggcgcagaggcagggcgccuacauuuuaccuacucuucucuucccggugccacccugcaagauguugagacaacacggaauucccuggcaucgugcuccaaguuuaggggaacacaagauuuccuggcaaggccaucaguggacuguugacaggacuguugcucaguccuuuuaaaguguuuggguuucugguguccuuugcucauguccaaggagaggcaccgccucuuuuagguuccuaaaccgaauuaucugccgguucucgcucugggaaaaccucugaagaaagcucagaaguggaacuguuacagugacugugacacggacagacuuggcuauucagcuagauuaauucuccugcaguguuaaagcccuucaaauagccucggaacccgggccuguauacaauacgcugcacagagccuuuggagauugcuucuugaggggcccgccuacuuugugccagagcuuauagcaaucuugaacguuuucaggcuccaaggugcucaggcuuagauuucuuggggggugccaggugucggauauuaacuuuuauuauuaauacacaauagugcaccauuuuauccgggguucccuuagggccagugucugauaagaaugaaaacaagcaagagauagcuguugcuuauuauuuguucaugcaaa

SEQ ID NO: 11188 - RNA, 2927 nt, Mus musculus
uuugcaugaacaaauaauaagcaacagcuaucucuugcuuguuuucauucuuaucagacacuggcccuaagggaaccccggauaaaauggugcacuauuguguauuaauaauaaaaguuaauauccgacaccuggcaccccccaagaaaucuaagccugagcaccuuggagccugaaaacguucaagauugcuauaagcucuggcacaaaguaggcgggccccucaagaagcaaucuccaaaggcucugugcagcguauuguauacaggcccggguuccgaggcuauuugaagggcuuuaacacugcaggagaauuaaucuagcugaauagccaagucuguccgugucacagucacuguaacaguuccacuucugagcuuucuucagagguuuucccagagcgagaaccggcagauaauucgguuuaggaaccuaaaagaggcggugccucuccuuggacaugagcaaaggacaccagaaacccaaacacuuuaaaaggacugagcaacaguccugucaacaguccacugauggccuugccaggaaaucuuguguuccccuaaacuuggagcacgaugccagggaauuccguguugucucaacaucuugcaggguggcaccgggaagagaagaguagguaaaauguaggcgcccugccucugcgccgaagccgccggcgaaccggccuaaaauaaaaaggucucugucugcaauccccguuugcucgcccgguaauccacccccgcccccagccugcgcgccgacccguacagcuguuuuuaaucccuacuuuucucacuuggcguccgggcuagggcugaccagacgcggagccacuuaguguuuccuccucccccagccggggucuguccugccuccgccgucuccucuuucuccgccugcaucccccggggggcagagugugggaagaacgaauuuccgccgguuugcucgcuccacgccgacaugggucccuuccggacgcugcuugcgcgucccccaggcugcucacuccggcugcacucccaauccccccggaucgcgagcgggcaggcgccggagacgugggccuagcggccgguacucugcagccaagccgcaccccagcagcucuuggaagggaucccgccugcagcgggggaauccguuuggcggggagaauccgcgccagggaauccagcucuccggacuccagagcaaacaaaaagcaccaacucuugcucgcuccucccgcccccgacgcucacccgaagaaacaguuuucugcagaaaugcaacaaguagcaccccagauucgccgagcgcccagcgccuucugauuuggcuccgcgaacuuggccugcggagacccgggcgagccaccgggacaaagaggaagggcuggacggagcaccagcgaaguacgaaagaggccuuuuuagcgacucaggcccggccgaggggaaugcagaggagacacagagccggccggcccagaagacgauccggccgcagcgcgcugggcgggcggcgauggagggugugggugccgugcgcuucuggcucguggugugcggcugccuggcguucccgccgcgggccgaguccgugugcccggagcgcugcgacugccagcacccccaacaucuccuaugcaccaacaggggacuucgcgcuguacccaagaccagcucgcugccuaguccccaggacgugcucaccuacagccuaggcggcaacuucaucaccaacaucaccgccuucgacuuccaccgucuggggcagcucagacggcuggaucugcaguacaaccagauccguucucuccaccccaagaccuucgagaagcucucacgacuagaggagcuguaccuggggaacaaccucuugcaggcgcucguuccuggcacguuggcuccgcugcgcaaguugcgcauccuuuacgccaacggcaacgagauuggacgccugagucgcggguccuucgagggccuggagaguuuggucaagcuacggcuggacgggaacgugcugggagcgcugccggacgcggucuucgcuccccugggcaaccugcucuaccuacaccuggaaucuaaccggauccguuuuuugggcaagaacgccuucagccagcuggguaagcuucgauuccucaaucucucggccaacgagcugcaacccucucugcgccacgcggccaccuuugucccucugcgcucccucucuacucucauccucucagccaacagccuacagcaccucggcccccgcgucuuccagcaccugccacgccuaggccugcucucccucaguggaaaccagcucacgcaccucgccccagaggccuuuuggggacuggaggcccuacgugagcugcgccuggaagguaaccggcugaaccagcucccccugacacugcuggagccucugcacagcuuggaggcacuagaccugaguggcaaugagcuuucugcucugcacccugccaccuuuggccaccagggccggcuccgugagcucagccugcgcgacaacgcgcucagcgcccuuucuggggacaucuuugccgccaguccggcucucuaccggcuggaucuagacggcaaugguuggaccugcgacugccgguugcggggucugaaacgcuggaugggcaacuggcauucucagggucgccuccuuacggucuucgugcagugucgccaccccccggcccugcggggcaaguaccuggauuaccuggaugaccaacugcugcagaaugggucuugcguggaucccucaccuuccccuacagcaggcaguaggcaguggccgcuacccacaucgucagaagaggggaugacgcccccugcaggccucucgcaggagcuaccacugcagccgcagccgcagccccagcagcggggaagacuucuaccaggaguggccugggguggggcugc

SEQ ID NO: 11189 - RNA, 603 nt, Mus musculus
aagucuauuaaacacgaaugaauuuaggcuuuaaccacaaacacucuuaaaccaauacuuaaguugaaaucuaaauucugaaacgaaaaguaugaaacauaauuugucucugucucuuucaagacaguuuggggugcccuggagaaucuuugauccuccugccucagccucccgaguacugucauacccagcuuguuaauuuuuaauuuuaauuuaauucuguaaucaaacccacacagauuaugaccuuguguuuaauacagugcuaccccuggaaaauggaggagggaacccaaauuuaauauuuuuacaccaauaugccuauuauuuuggcauacacuacuuuuaaguuauaugcaugucauaaaacuacuaacuaaaaaaaaaaaauccuauuuuuuuaaauuucacauuuuauauacaaaaucugacccauauaaaaucugcaauaaaacuguacagauaaagauaucauuaaugaaacacuguuuccugauaaaaauaagcuacaccucagcaucagggcgaggccgcuguaccugcaggaagcaagcuguuucauagagcugcuccacagugcugucguuuacugccaaguucccu

SEQ ID NO: 11190 - RNA, 603 nt, Mus musculus
agggaacuuggcaguaaacgacagcacuguggagcagcucuaugaaacagcuugcuuccugcagguacagcggccucgcccugaugcugagguguagcuuauuuuuaucaggaaacaguguuucauuaaugauaucuuuaucuguacaguuuuauugcagauuuuauaugggucagauuuuguauauaaaaugugaaauuuaaaaaaauaggauuuuuuuuuuuuaguuaguaguuuuaugacaugcauauaacuuaaaaguaguguaugccaaaauaauaggcauauugguguaaaaauauuaaauuuggguucccuccuccauuuuccagggguagcacuguauuaaacacaaggucauaaucuguguggguuugauuacagaauuaaauuaaaauuaaaaauuaacaagcuggguaugacaguacucgggaggcugaggcaggaggaucaaagauucuccagggcaccccaaacugucuugaaagagacagagacaaauuauguuucauacuuuucguuucagaauuuagauuucaacuuaaguauugguuuaagaguguuugugguuaaagccuaaauucauucguguuuaauagacuu

SEQ ID NO: 11191 - RNA, 1882 nt, Mus musculus
gcagcauuaucaaagacacaucuguacaaacauuuuacaaaagagaacucucuaggaucagcuacaucaaggacaagcagaaaaauagaugcaguccaacaaagacauugaaaaugacuucagacguuggaaaugccuuuucuuauacaaacgauggcagaugaacacugcgcaggaucaauuagugagugaacugcucuuccuuuccugaagguugggaggcagggagcgaaugggucaccaacaacccggauagccaaaucgccgcuuucccauuucaaaccguuuaagucuuuggguagauucaagucgcugggaaacaagugggcugccuggcacuagcuucuuaaccaagcuaucuagccuuugcuuaacucucccggucagguuuccagugacuagacaaggaauuucagaaaugcguccuuaaaaaaccaagggcgagggaggugaccugagcucagcaucuagagaacuuguuuguggagagagaaggaagaggucaaagcugggaggaaaauuaccuccugacugagaauuaacaggccaacccaucuggucugaggugccgaggaagucggggcauccuacaggaaaccuacaagcuagguucgcuucucaucucccccagcuccuuaagcuccaccuuuuuguauuugcccgacuuccuccguuuggugaccaccaagaccaccacaccagccacuaccgcuaccgagacgacagcgaugacggcaaugacgccggcggugaggcgcuucauggagaacugggggggcuucucguccagguaguagaugagcguccgcuccacaugcagggguuccccacgcaccugcacguccaggccgcggcggcccaugaacagugacucgccuuuaaugucccuuucgaaguaguaggcggcaucagcgauguccacgucucucaagcccuucugcgacgcguucugccgaagcucuaucugaauggugggcuccucauaguguaccgcggauaggaagcuggggugcagcuuguagcguucuuggaagagccgccgcagcucggagucuaggucagagugguugaaggcucggucggucgggcgguggcgcaacucaaugaggaugugguggguucgcaccacuucgucgcagcgcaggcuuuggucucccuuguccgugcggcgcacgcccaccgaguuuacgcaccagcacaccgaggucugguugcacuggcgcgccuugaagcggcccuugucgucacacuccgggucguagaggccaucguuguccaguaucgcgugcucgcucggcaucaccaggcugcggccgcucuuccgggcgcucaugcgcgccuugagcagcaggcacuuggaaguuagcguggagcagucgaccaauaccugugagcccauugcccgacauuggcagaccccgccugggccauuugugucgcagaccgucaucuuguugguggggcauguacaguugcucugagccgugcaaaagcgggucgccaucgccagcaguagcaguagcagcggugcuagauccaagccccucgccauggugggguggaguagaauggaccuccaacuacagaccagaggcagggauucugaaggaucaggcuggguaggacacugcaggcgacuccugccgggcuuuucccuccagcucuuauaagcuccuguaccuguaggacugguuagcuagugacucacucaauggaauuuggguggcgcucccuauucccaggucccgcggaagaagccggcagcccugagcugccugagauagaaucaggcaggggagauugcuccugccaucugcugaccaaaaccccauagaggaaaccaguacuuaccuggccgcaccccuccucauagcucagaacc

SEQ ID NO: 11192 - RNA, 1882 nt, Mus musculus
gguucugagcuaugaggaggggugcggccagguaaguacugguuuccucuaugggguuuuggucagcagauggcaggagcaaucuccccugccugauucuaucucaggcagcucagggcugccggcuucuuccgcgggaccugggaauagggagcgccacccaaauuccauugagugagucacuagcuaaccaguccuacagguacaggagcuuauaagagcuggagggaaaagcccggcaggagucgccugcaguguccuacccagccugauccuucagaaucccugccucuggucuguaguuggagguccauucuacuccaccccaccauggcgaggggcuuggaucuagcaccgcugcuacugcuacugcuggcgauggcgacccgcuuuugcacggcucagagcaacuguacaugccccaccaacaagaugacggucugcgacacaaauggcccaggcggggucugccaaugucgggcaaugggcucacagguauuggucgacugcuccacgcuaacuuccaagugccugcugcucaaggcgcgcaugagcgcccggaagagcggccgcagccuggugaugccgagcgagcacgcgauacuggacaacgauggccucuacgacccggagugugacgacaagggccgcuucaaggcgcgccagugcaaccagaccucggugugcuggugcguaaacucggugggcgugcgccgcacggacaagggagaccaaagccugcgcugcgacgaaguggugcgaacccaccacauccucauugaguugcgccaccgcccgaccgaccgagccuucaaccacucugaccuagacuccgagcugcggcggcucuuccaagaacgcuacaagcugcaccccagcuuccuauccgcgguacacuaugaggagcccaccauucagauagagcuucggcagaacgcgucgcagaagggcuugagagacguggacaucgcugaugccgccuacuacuucgaaagggacauuaaaggcgagucacuguucaugggccgccgcggccuggacgugcaggugcguggggaaccccugcauguggagcggacgcucaucuacuaccuggacgagaagcccccccaguucuccaugaagcgccucaccgccggcgucauugccgucaucgcugucgucucgguagcgguaguggcuggugugguggucuugguggucaccaaacggaggaagucgggcaaauacaaaaagguggagcuuaaggagcugggggagaugagaagcgaaccuagcuuguagguuuccuguaggaugccccgacuuccucggcaccucagaccagauggguuggccuguuaauucucagucaggagguaauuuuccucccagcuuugaccucuuccuucucucuccacaaacaaguucucuagaugcugagcucaggucaccucccucgcccuugguuuuuuaaggacgcauuucugaaauuccuugucuagucacuggaaaccugaccgggagaguuaagcaaaggcuagauagcuugguuaagaagcuagugccaggcagcccacuuguuucccagcgacuugaaucuacccaaagacuuaaacgguuugaaaugggaaagcggcgauuuggcuauccggguuguuggugacccauucgcucccugccucccaaccuucaggaaaggaagagcaguucacucacuaauugauccugcgcaguguucaucugccaucguuuguauaagaaaaggcauuuccaacgucugaagucauuuucaaugucuuuguuggacugcaucuauuuuucugcuuguccuugauguagcugauccuagagaguucucuuuuguaaaauguuuguacagaugugucuuugauaaugcugc

SEQ ID NO: 11193 - RNA, 496 nt, Mus musculus
cuccacgcguucucucuccuuuggaagaaaaugccuugggcucgccugccgccgcgcuuugucgggugaaaaugacauacaguccagacaagccaggggcgcugccugaaggggucaucgcggagaugaguagccagauggagguggggcacucaaugaagugggaaaauacuccuuuuuagguuuuucaaauagacagaggcaaaggcagguggcaaguacauuagugugcaucuuggaguagaugucuuccuuccucuugccugcucuccuuugcagggguuugagagacaggggcaggcaucucuaggaaugcacagggaaauuuccgagugacagacagcaccccuuccccccaccccccaagggcgguggcagugauaccucccaggcggugcaggagagcagagucaucuggggugaggccuguaugaaguccuugggggaugugugauggggacuuuuguuuuauuuccaauauugccucucaccuuuc

SEQ ID NO: 11194 - RNA, 496 nt, Mus musculus
gaaaggugagaggcaauauuggaaauaaaacaaaaguccccaucacacaucccccaaggacuucauacaggccucaccccagaugacucugcucuccugcaccgccugggagguaucacugccaccgcccuugggggguggggggaaggggugcugucugucacucggaaauuucccugugcauuccuagagaugccugccccugucucucaaaccccugcaaaggagagcaggcaagaggaaggaagacaucuacuccaagaugcacacuaauguacuugccaccugccuuugccucugucuauuugaaaaaccuaaaaaggaguauuuucccacuucauugagugccccaccuccaucuggcuacucaucuccgcgaugaccccuucaggcagcgccccuggcuugucuggacuguaugucauuuucacccgacaaagcgcggcggcaggcgagcccaaggcauuuucuuccaaaggagagagaacgcguggag

SEQ ID NO: 11195 - RNA, 1446 nt, Mus musculus
cuggcccaccuuuccuugggcuuucugcugcuggauggcagccucaacugccugaaagaugucauuucccugagaagucuggaaggugaaggucccagggccugaggggcagcggcgaccagcuucaaaggagaacauuaccugagggggugggggaaacacguuaggcgugucauaaaaaaugagucacaggccugaccaaguuacuguaucugcacagaagagaccaccugagaauggaauugucaccuacagcuacucaaccugguagcccucccugacgggucauccucccagacagccccaugcaccuugucccggccauagcgacgcaacagaguguagggccagaaaaggagcggcuccaggauuugacucugcgcacccaaagucaggagagucagcuucucagcuuccacccucaguauguaggagccuugcaagccgcagcguucagaagccucggucuucugcgagguuacccagaacugggauccuggaagaacacauacgaaggagaaggagcgcuggggcaaguuagggacucgguugacuccaaucacuagcuccccaagggcaccucuucaacccacuccauuccugccagacaucuaccuucccagguggggcuguacagcgaauucuccagcaucuccaaggcagaaaacuuagguugguucuccgucugcgccaaagcccagccgccuuucugcagaaaagggaacauggaagaauuauauauaauucucuugggucuaggguaggugcaagaaguccagugccucuauaauagcuccauccucgcagugucccuuaagcccagagaugcccacccccagucacucaccggaaaggcgguucugcauaaagucugcacccaggcggugcuggauacggcguccgccgccagcaggugcgagcgcugugcgguguccaggcggaaggcaacagcgccgggcucagggggacucuccacagucaccggcaccacgcucacacauucagccaggcguaucaucuugcagucuagacggcgagagccgccucgacccccucuagagcucgaccccuugugaucaaagaauuccagccgcgccacgccgugaggacuggcuggguaaagcacagcccaaguuuuccuccaccucugggaaagaacgaaagacucgagagugcgcggugguagcacgcgccccacaaggaagaagagacccaugaaggccgaucugagucuggggcuucccaggcugagcuacuuucccaaagauaauggcaucccaagaccgcaccaaggagggcacagcccgagacuuuuaagggaacgucuuggggaucuacaauugcccgcgcgccguuccgaccuucuuccggccccuucccucuuucuggauucuuucacccacuucuaguccagagggguuucgccaucccccacgccacaaacaa

SEQ ID NO: 11196 - RNA, 1446 nt, Mus musculus
uuguuuguggcgugggggauggcgaaaccccucuggacuagaagugggugaaagaauccagaaagagggaaggggccggaagaaggucggaacggcgcgcgggcaauuguagauccccaagacguucccuuaaaagucucgggcugugcccuccuuggugcggucuugggaugccauuaucuuugggaaaguagcucagccugggaagccccagacucagaucggccuucaugggucucuucuuccuuguggggcgcgugcuaccaccgcgcacucucgagucuuucguucuuucccagagguggaggaaaacuugggcugugcuuuacccagccaguccucacggcguggcgcggcuggaauucuuugaucacaaggggucgagcucuagagggggucgaggcggcucucgccgucuagacugcaagaugauacgccuggcugaaugugugagcguggugccggugacuguggagagucccccugagcccggcgcuguugccuuccgccuggacaccgcacagcgcucgcaccugcuggcggcggacgccguauccagcaccgccugggugcagacuuuaugcagaaccgccuuuccggugagugacugggggugggcaucucugggcuuaagggacacugcgaggauggagcuauuauagaggcacuggacuucuugcaccuacccuagacccaagagaauuauauauaauucuuccauguucccuuuucugcagaaaggcggcugggcuuuggcgcagacggagaaccaaccuaaguuuucugccuuggagaugcuggagaauucgcuguacagccccaccugggaagguagaugucuggcaggaauggaguggguugaagaggugcccuuggggagcuagugauuggagucaaccgagucccuaacuugccccagcgcuccuucuccuucguauguguucuuccaggaucccaguucuggguaaccucgcagaagaccgaggcuucugaacgcugcggcuugcaaggcuccuacauacugaggguggaagcugagaagcugacucuccugacuuugggugcgcagagucaaauccuggagccgcuccuuuucuggcccuacacucuguugcgucgcuauggccgggacaaggugcauggggcugucugggaggaugacccgucagggagggcuaccagguugaguagcuguaggugacaauuccauucucagguggucucuucugugcagauacaguaacuuggucaggccugugacucauuuuuuaugacacgccuaacguguuucccccacccccucagguaauguucuccuuugaagcuggucgccgcugccccucaggcccugggaccuucaccuuccagacuucucagggaaaugacaucuuucaggcaguugaggcugccauccagcagcagaaagcccaaggaaaggugggccag

SEQ ID NO: 11197 - RNA, 568 nt, Mus musculus
ucuaucuuaccuauagcauaagugcguuaaaacucaagauggagaguccgcagauugggcaggagacaacuggagacugaggcuagaaggaauccuuaguuauuguuuuacagaugagggacgaggucccugucacaguaggccacauucucuacugccagcgccucuuccauuaccccucccccgcuguccuuugauaucugccuuuacaccagcucuguggucccuucccagcaggaccugagcucugagcccacucagggcaaagucgcagccuugcagggucccugcuucauccacaauccugcagguugcucuugcaacccacaucucagcgggguuuuuuuuuuuaaacaaaacaaaacaaaaccuugaagggcggagucagagugugggccaggggccacugaugaccaaagagccucagaggacggccgcgggccgcgggccuucugcuccucacucuucgcuggcgguacggcacccggccacguuggcgcucgucgggcaggugucggucacaccaccgaggcgagcccggacaccgaagccaccuuguugucuuccg

SEQ ID NO: 11198 - RNA, 568 nt, Mus musculus
cggaagacaacaagguggcuucgguguccgggcucgccucgguggugugaccgacaccugcccgacgagcgccaacguggccgggugccguaccgccagcgaagagugaggagcagaaggcccgcggcccgcggccguccucugaggcucuuuggucaucaguggccccuggcccacacucugacuccgcccuucaagguuuuguuuuguuuuguuuaaaaaaaaaaaccccgcugagauguggguugcaagagcaaccugcaggauuguggaugaagcagggacccugcaaggcugcgacuuugcccugagugggcucagagcucagguccugcugggaagggaccacagagcugguguaaaggcagauaucaaaggacagcgggggagggguaauggaagaggcgcuggcaguagagaauguggccuacugugacagggaccucgucccucaucuguaaaacaauaacuaaggauuccuucuagccucagucuccaguugucuccugcccaaucugcggacucuccaucuugaguuuuaacgcacuuaugcuauagguaagauaga

SEQ ID NO: 11199 - RNA, 1935 nt, Mus musculus
cagccggugccgcagguggacaucgugccugggagacucaaugaggcagaauggauugcguuuaugucccuggaggagggcgaggacguagugggugacaucuuggcugaccuuaugacucgaguuauggagugugccuucaaagucuaucugacccagcaggugggccuagaucugggucuuccagaccuaucuucuacccugccucuccuggcaaggcugagacccucccucgcuuccacagugcguuccauucaccauuagccaggcccgagaggccaugcugcagaucacugaguggcgcuuccuggcccgagaugagggagaaucugcaguggcugaggaccccacguggggagaggaugaggagccccuggcaugcacuacggauuccugggcccagggcuccgugccuguucugcacacaccggcgcccguuuguguagaggagcaguuccacaacgaaguaagcccaagcccugagccucuucccgacagaagccuccucuggagccgcucaggaccacgaagugagguccuuucccuccauuuccaacaacucauuacccuuguguguuuccccaggaaccugggaacccggaccaguuccuuuuagguucaucgugggacaaagagucccaaaagccgacacaaccuucagaaccuucugccgagcccaaagucaccccgagacccacggccaccuuggaggcguuugaggaagcugagcccggggaugccuuggaaguaccccacggccaagagggaagccauauguuggcugugcccucgaaggagucuuuacgaucuacggcggaaggcgagcgcgucuacagcccccagucuucucugaagcagccccaaguaguccgucuucaggccucugagaaggaaucauccuucggcucacaccugucgcucgaggaucuuuaccucugcaugccccagccagacgcggcaggggaccggcugagcuugcagagcaagggccagcuccacagcagcccgauagggucggagucccaccucggugcacucaccccggcagagcccuccgcguuccaggagccugaagucuugggagagcggccaaagcacaagaccaccacguugcgcauggauuccucgcggcugccccgccacugggugcgccccguggccgagguccugaucccagaccucgaagugcacccuuuggaaauauaucgcgggcgcccgcgcaggagccaagcugggaccgcaaccucagcaugcgagucccaagcccuuagcucgcgugcucccuccaaaccccaugucucuagcccaagguucccucuccagcguugugcuacauuccgugcuuugggcccggauccuaguuuaaacuuggcccaaaccucaccguccuucgggucaaacgugccauuccucagccccggguuccgcuuccucccuagaaacccaaucccucccgacgucgccagcaccccuacccccaaacuauggccccuagcuaaguggccaaguggcugggagcgggaggcggagcagcugggagagcugugggcgggucggacucgcgugccuccacagggucaggaaccuguggaggugacaccuuuggaggaggacucuggauggccccuagcggcgccccagguccucgaggcuacgucccaagugcuuuggaagcccaugguuauuucagaaaccaugaagcugguuccuggugugaguauguggaaccggggaacccaggagcugcucaauccugcugucauccggaaggaggcugaagaaggcaccccccaggcgccugagcagcaacccauccagacagguguguccaagccucaggugauuaugaaacagauaaggaacgagacccccaaagccuggcugcuccccaccaagccugugccccacucuggguccugagccuccacacuggga

SEQ ID NO: 11200 - RNA, 1935 nt, Mus musculus
ucccaguguggaggcucaggacccagaguggggcacaggcuugguggggagcagccaggcuuugggggucucguuccuuaucuguuucauaaucaccugaggcuuggacacaccugucuggauggguugcugcucaggcgccuggggggugccuucuucagccuccuuccggaugacagcaggauugagcagcuccuggguuccccgguuccacauacucacaccaggaaccagcuucaugguuucugaaauaaccaugggcuuccaaagcacuugggacguagccucgaggaccuggggcgccgcuaggggccauccagaguccuccuccaaaggugucaccuccacagguuccugacccuguggaggcacgcgaguccgacccgcccacagcucucccagcugcuccgccucccgcucccagccacuuggccacuuagcuaggggccauaguuuggggguaggggugcuggcgacgucgggagggauuggguuucuagggaggaagcggaacccggggcugaggaauggcacguuugacccgaaggacggugagguuugggccaaguuuaaacuaggauccgggcccaaagcacggaauguagcacaacgcuggagagggaaccuugggcuagagacaugggguuuggagggagcacgcgagcuaagggcuugggacucgcaugcugagguugcggucccagcuuggcuccugcgcgggcgcccgcgauauauuuccaaagggugcacuucgaggucugggaucaggaccucggccacggggcgcacccaguggcggggcagccgcgaggaauccaugcgcaacgugguggucuugugcuuuggccgcucucccaagacuucaggcuccuggaacgcggagggcucugccggggugagugcaccgaggugggacuccgacccuaucgggcugcuguggagcuggcccuugcucugcaagcucagccgguccccugccgcgucuggcuggggcaugcagagguaaagauccucgagcgacaggugugagccgaaggaugauuccuucucagaggccugaagacggacuacuuggggcugcuucagagaagacugggggcuguagacgcgcucgccuuccgccguagaucguaaagacuccuucgagggcacagccaacauauggcuucccucuuggccgugggguacuuccaaggcauccccgggcucagcuuccucaaacgccuccaagguggccgugggucucggggugacuuugggcucggcagaagguucugaagguugugucggcuuuugggacucuuugucccacgaugaaccuaaaaggaacugguccggguucccagguuccuggggaaacacacaaggguaaugaguuguuggaaauggagggaaaggaccucacuucgugguccugagcggcuccagaggaggcuucugucgggaagaggcucagggcuugggcuuacuucguuguggaacugcuccucuacacaaacgggcgccggugugugcagaacaggcacggagcccugggcccaggaauccguagugcaugccaggggcuccucauccucuccccacgugggguccucagccacugcagauucucccucaucucgggccaggaagcgccacucagugaucugcagcauggccucucgggccuggcuaauggugaauggaacgcacuguggaagcgagggagggucucagccuugccaggagaggcaggguagaagauaggucuggaagacccagaucuaggcccaccugcugggucagauagacuuugaaggcacacuccauaacucgagucauaaggucagccaagaugucacccacuacguccucgcccuccuccagggacauaaacgcaauccauucugccucauugagucucccaggcacgauguccaccugcggcaccggcug

SEQ ID NO: 11201 - RNA, 797 nt, Mus musculus
ggcauagggcccuuugaaggcugaagcagcagcguccagcgcuggcgaagcgggaggcgcccgcagcccuggcuugacgucgggcggggagagcuggggcucgaacaggcacugcgagggagcgcccgccgaaggcgcugccucccaaaacgccuccggaaaggcggccgaacucagaucuggggaguagagguccggcagcaaggcaucggggcccgcggggaaagggacauccaggggggaccgagacgcugccgccucgggaccggggaagggugccaggcccaagaugccagacaugagguugaagagggccuccgggucgugcggguguucgggaaccgccuggaugaagaagcugccgcuguagcugaggcccgaagggggcgugggugcagggcccuccaggaagcaggagucuguuaagucccccccggcgccgcagcugcucaaagcccagcucaagaagucgccugccaaaggagggaccacgcaucagccccgcacaccucaaagggcgugccucggagccuacagcugcgacccccuccacccgaguccuccuggcgcaaggcacccgcagagcgccucgugcacuuccgauccugcagcagagggacccccacggacgccccagggcgcgcacacccaaggcucccgcacaggcgccuguggccuuggugggggugggaaugguacugcgcgcuuggggacccccaccccccaccccgcgcgccucuccuaucacccuucaucgcguucagagucuucgagcucccagacccgcuccuuaccuc

SEQ ID NO: 11202 - RNA, 797 nt, Mus musculus
gagguaaggagcgggucugggagcucgaagacucugaacgcgaugaagggugauaggagaggcgcgcggggugggggguggggguccccaagcgcgcaguaccauucccacccccaccaaggccacaggcgccugugcgggagccuugggugugcgcgcccuggggcguccgugggggucccucugcugcaggaucggaagugcacgaggcgcucugcgggugccuugcgccaggaggacucggguggagggggucgcagcuguaggcuccgaggcacgcccuuugaggugugcggggcugaugcguggucccuccuuuggcaggcgacuucuugagcugggcuuugagcagcugcggcgccgggggggacuuaacagacuccugcuuccuggagggcccugcacccacgcccccuucgggccucagcuacagcggcagcuucuucauccaggcgguucccgaacacccgcacgacccggaggcccucuucaaccucaugucuggcaucuugggccuggcacccuuccccggucccgaggcggcagcgucucgguccccccuggaugucccuuuccccgcgggccccgaugccuugcugccggaccucuacuccccagaucugaguucggccgccuuuccggaggcguuuugggaggcagcgccuucggcgggcgcucccucgcagugccuguucgagccccagcucuccccgcccgacgucaagccagggcugcgggcgccucccgcuucgccagcgcuggacgcugcugcuucagccuucaaagggcccuaugcc

SEQ ID NO: 11203 - RNA, 2717 nt, Mus musculus
ucuucgcuccaauauggcuggguaagguucccauggcaagcgccagacggagucaauacuacauuucugugaaagagagaagaaaagccaguuagcucucaagagcaagcaggucugcccagcaucuuccagaaucaaguucuagggcaccaaagaaaauaguggccaaacaacuguuuaccucaucccagccagcggaaggagcucaggccaagcaaccaccuggagcccaaagguggccgcgguagacaaccacuuuccucucaccaaaacucuaacuucauccacguccaaguuuguuuccuccucgguucuaguuacgaggagggagggagagcuuaggaagcagucuggagaagaggcagagaacggccggccgagggcugggaauugcagaacacaacagcaggcgcaggcgcuccagccucuggugacaauagcggaaaggccuggagagggcaaaagaacugagucaggaacugguuacagugauggggauggggauagggauggggagcgauggggagugcaggucaaggccauuacuagagcgcguagcuccagcgccucccaucgggacaaacacagacguccugcacaguccacgcagcugccuggauacggucccgugccucucuggccugaccguggccgcccagccccucccuccgcggacgcgggcggcugucugaaggcgccgaucugccgagagaaaccgccaggguuugggcauggagagcucggcgggugacccauaccggcgaccugcgcggcgcacucaguggcugcugagugccuuggcucaccacuacgggcuggaccgcggcguggagaaugagaucguggugcuggcuaccggucuggaucaguaucugcaggagguuuuccaccacuuggacugccggggagcgggccgccuaccgcgcgccgacuuccgugcgcucugcgcgguacuggggcugaacgcugacggggagacggccacggaggacgcaaacuccgcggaggcggccuccacgaacccggcugcugggaugaucgcuggcggggacgcggacgucagggaagaggcgcgccuggcucugcgagccgacccuccagagcucaccuuccgccaguuccacgcgcgccucugcggcuauuucaguagccgagcggggccccggcugccccgcggagcucuuagcgagcacaucgagacacagauccgccuccgccgcccgcgccgccgccgccggccuggcucaccgagccugcacgguggcgccuauggcgagcggguggcacaucuagaggaggaaaacaguagccuacgcgagcugguggaggaccuacgggcugcgcugcagagcagugacgcgcguugccuggcccuucaggugcgagggaugccucggguggagacagagacgccccaccgcggcccagccccuccucagcugguucucuccguuccccauuccacccccuucauuccaacuuccaccccaauguaucauuccuuaagaucccaacuuccuacccaagucccuucuaauccuagaaggaaccuguuuaaguagccaaguagugaugggucagcacacauccuucuucgggagguuuaaggaaaacaaaggacugacugcccuuccccaagucagcgaaacuuguugaaucccucacagccaggccucuagcccaggugagaaagacaaugauggccagcaaugagggccaggcucacucugagcuauugagguggagccauugagugagcuggucucugggaucagucaacgaacacuugagcccucgguguucaguguagcucaggugaccagcuaagggagaaaaggggcccuuauaggcguauaggaagaggaccugcguuacauuggugucuccugucuccuaguugcugcagaguacaacuaggugucaaaguggccuucgugguucauaugucugccaggagaguguaagauggggcagaaggaacccugggagugcguagaguagugugugugugugugugugugugugugcgcgcgcguguguguguguguugccugagacuaggucucucauuuaaaagggucucuccgucuuucacgcucaagugccuacugggcacauugucccagcuuccuuuaugcuuuggaacacugcagaaaacaaaacagaucaaccccguuuccaaggacaguccagagcacagaucucagaaagggcggaaauuucagucugcucuuuaaucugugccuugaguccagugaauuaggagcagcguacacuggaugcaggaauuaagccuagaaggcacgacuuugggggauuacugucaccaugcagaaaaacagaggguggacuuccugucccaacuucccucguggggggugggggugagggguauugcauacacuugcuuuagccgcuugugccaguugcucagugagcuagcuuugugguuguaaggggaugaccccguagacuucugcaguggucacucacuguggcuucccgcggacaggucggccucuggaaaagccagucggacaucccagaagcggcggcgcacgagcugcagcgagcgcagggcgcgcuggcagaggcggaggcgcgcgcccggcggcugcagcgcggacagguggaggugcggcugcgcaccgaggaggcucggcaggcggugcgacgcagcuugcaccgagugcgggagcuggaggcgcuggcgcggc

SEQ ID NO: 11204 - RNA, 2717 nt, Mus musculus
gccgcgccagcgccuccagcucccgcacucggugcaagcugcgucgcaccgccugccgagccuccucggugcgcagccgcaccuccaccuguccgcgcugcagccgccgggcgcgcgccuccgccucugccagcgcgcccugcgcucgcugcagcucgugcgccgccgcuucugggauguccgacuggcuuuuccagaggccgaccuguccgcgggaagccacagugagugaccacugcagaagucuacggggucauccccuuacaaccacaaagcuagcucacugagcaacuggcacaagcggcuaaagcaaguguaugcaauaccccucacccccaccccccacgagggaaguugggacaggaaguccacccucuguuuuucugcauggugacaguaaucccccaaagucgugccuucuaggcuuaauuccugcauccaguguacgcugcuccuaauucacuggacucaaggcacagauuaaagagcagacugaaauuuccgcccuuucugagaucugugcucuggacuguccuuggaaacgggguugaucuguuuuguuuucugcaguguuccaaagcauaaaggaagcugggacaaugugcccaguaggcacuugagcgugaaagacggagagacccuuuuaaaugagagaccuagucucaggcaacacacacacacacgcgcgcgcacacacacacacacacacacacacacuacucuacgcacucccaggguuccuucugccccaucuuacacucuccuggcagacauaugaaccacgaaggccacuuugacaccuaguuguacucugcagcaacuaggagacaggagacaccaauguaacgcagguccucuuccuauacgccuauaagggccccuuuucucccuuagcuggucaccugagcuacacugaacaccgagggcucaaguguucguugacugaucccagagaccagcucacucaauggcuccaccucaauagcucagagugagccuggcccucauugcuggccaucauugucuuucucaccugggcuagaggccuggcugugagggauucaacaaguuucgcugacuuggggaagggcagucaguccuuuguuuuccuuaaaccucccgaagaaggaugugugcugacccaucacuacuuggcuacuuaaacagguuccuucuaggauuagaagggacuuggguaggaaguugggaucuuaaggaaugauacauugggguggaaguuggaaugaaggggguggaauggggaacggagagaaccagcugaggaggggcugggccgcgguggggcgucucugucuccacccgaggcaucccucgcaccugaagggccaggcaacgcgcgucacugcucugcagcgcagcccguagguccuccaccagcucgcguaggcuacuguuuuccuccucuagaugugccacccgcucgccauaggcgccaccgugcaggcucggugagccaggccggcggcggcggcgcgggcggcggaggcggaucugugucucgaugugcucgcuaagagcuccgcggggcagccggggccccgcucggcuacugaaauagccgcagaggcgcgcguggaacuggcggaaggugagcucuggagggucggcucgcagagccaggcgcgccucuucccugacguccgcguccccgccagcgaucaucccagcagccggguucguggaggccgccuccgcggaguuugcguccuccguggccgucuccccgucagcguucagccccaguaccgcgcagagcgcacggaagucggcgcgcgguaggcggcccgcuccccggcaguccaagugguggaaaaccuccugcagauacugauccagaccgguagccagcaccacgaucucauucuccacgccgcgguccagcccguaguggugagccaaggcacucagcagccacugagugcgccgcgcaggucgccgguaugggucacccgccgagcucuccaugcccaaacccuggcgguuucucucggcagaucggcgccuucagacagccgcccgcguccgcggagggaggggcugggcggccacggucaggccagagaggcacgggaccguauccaggcagcugcguggacugugcaggacgucuguguuugucccgaugggaggcgcuggagcuacgcgcucuaguaauggccuugaccugcacuccccaucgcuccccaucccuauccccauccccaucacuguaaccaguuccugacucaguucuuuugcccucuccaggccuuuccgcuauugucaccagaggcuggagcgccugcgccugcuguuguguucugcaauucccagcccucggccggccguucucugccucuucuccagacugcuuccuaagcucucccucccuccucguaacuagaaccgaggaggaaacaaacuuggacguggaugaaguuagaguuuuggugagaggaaagugguugucuaccgcggccaccuuugggcuccaggugguugcuuggccugagcuccuuccgcuggcugggaugagguaaacaguuguuuggccacuauuuucuuuggugcccuagaacuugauucuggaagaugcugggcagaccugcuugcucuugagagcuaacuggcuuuucuucucucuuucacagaaauguaguauugacuccgucuggcgcuugccaugggaaccuuacccagccauauuggagcgaaga

SEQ ID NO: 11205 - RNA, 3196 nt, Mus musculus
cuccacccuucuuuagucccuagguggagccccaggcccaaagguccuggccacugcuucacaaauaugauucccagauugcccugagacagaggcaagucucuguugugcacucccuugggugaacaugauaacagaauccaaaucgcuaauuggcuaugugggaaaaguggucgaagcauggccaacacugccuguggcaguggaagguccaaaggacgcugcccaaagccucuagcccuccaagauucagucugcccccucccccgugucuccccacacccggguugggguuguuuugguugaccagaguggaacacaacgaucuauuggcagggcugaacaccaaugggucuauuuguaaagcgccaaugaccacuuucugaagcaggguuuuagggagcggggccuuagggaacucuuugguccuuuuuagaacacuggacuuucuucuggaaaggcaggaaacacugaaguuuaagaaguuguuuccagcuuccauuaacugaacacacauuaaaaccaagcacagagaaucaggacguuucgcgggagugagacccagucauuucuccuccguuuccauucugcagggugagaguuguaaucacccacccacuauucguaccauccacccacccccagucgagagaauagggguacagaggggagguggcaaagaaaauucacgauacugaguaucucugggagaccuguuuggucucuuugcucgguagcgcagcccuacguuagaaugcaucuucccgggaaugacuguagugagacuuuggcugggaauccaaguuauucuaacuguagauugguccacguugcccuaagccuagcaguccacugcggcacagacacccuggacaugaggugggucagcuuaaguuccuggcacgaaagaaaggguacucuggcaacuuuuggaugcggcgaaacagacuguuucgucucucagguucuuauuucacggcuugugccuuugacagccccuuaguuucucuaucugcaggaugggagcauuaagcucuacgacccagccucuuuacaauucagguccaaagagcccgcccaaguuggggacugggaagaucaaaggucucagcacccagcggagccgcggacacugagggcgccaagaaggggguggguagguagggaacuggaagggcggcugcuccgcaggggaugcgcgucagagaccccagccacacuccaggcccgccccuugaugagccccgccccgccccgccugguuuucgccucuaaagcgcccagcgcucgccucccgcugccgcacuuucacucucgguccaccucgguguccucuugcuguccagcucugcagccuccggcgcgcccucccgcccacgccauggacgccaaggucgucgccgugcuggcccuggugcuggccgcgcucugcaucagugacggugagugcaauccgcggccgggcccgggaaaggcucgcagcucugcgccggagcuccuucggguccgcgguuccucugcccgcgccgaagucgcggagaaagaacucggucggcgccguucacuacaagcgaacuuggggcaguccacuuugcagggcgcacucccaccgggugcccuuucccgugucccacgggucgcaccgagguuuugugcucugcgaagugcggccauaggaccuagagagggcugcaggggaggacccgcaggauuguugggcaagaguggguucggcgcggaauggaagcgugggcgauuguguccggggcuugggccccggagcgcgccagcugcacucagcuagugucuaccggcgcccagauguuuccagaggcgaagggcagcgcggucccggaguugaccgugcaagagguucacucggguggugcgugugucagcaaacucucaaagaccggucaaguagcucgaagugcauggcuuggcuauagguucaguggugaggcugaguuucguccccugcggguguagcguguucucuuacagcacccucgaggggcucagggccaccagcagcgcagcgcagcucuugaacucgcgcugccagccagggccgcgcuucugcacaguucguugguccguagcgacgcggaccugagcacgcgucucuucacugccccuuuuucuucuuacccgggucacuagacaaaggcucagcaguuacccaagcuauaugcacaccucuccccaacccccaaacacaccugcaaacgggcgcuuuuguagccagccccggaguccucagcucuggaaugagagcugcagcggaguucagucucccagacccaggguggugucuucuuucacugggaaagggcuuucauuuuguuuucuuuuuuugacacugaagagaaaacucucagcgcuguuacaagacaccguugcugcaaaacaaaacaaaccauugccucugaacacaaaacaaaauccuacuagucgauccccugccuuccuccgcagugguguuuccuggagagaacugagggacagucggggcucuuggugagacugagcucuaaaugcugcccaaguacaccaacucguucguuuggguucuuucccugugacaacgggguacgggaaugguuggaguugccuaguccgagggaaauguucuguaaaagaauagucaguugcugaucggaguaguaaaaaaaaagaaaugaaaggcaguuucgauuuuuuuuuuuuuuuuuuuuuuuuuuuuuguuaccgagaacacccgggaggcugagccuucccacuggucccccagugccccgucauggagcacauugauuugggcauuaauaauugaaugagcuggugauguugcaagggucacagccucuggcaaguuagguauggggcaagaauguaggacucagguccucaagguuggagugcaauuauccagaguaaaaguugucucacccucaacauauucugacccuaggaagagucggauuguugacagugucuggaucagaccuguucucuaggcaggaccccauugugcugcccgaaugaacuuuuuuaccuccuagugccugugugcccucugaucuuacacagcccucaaguugcagcacggcuaaccuugcugugguuccugucuuuucccaucagcuacuccaacucagaagcuagauaguagacaccggaggcuucuuugguuaaacccagagcagcaggcuug

SEQ ID NO: 11206 - RNA, 3196 nt, Mus musculus
caagccugcugcucuggguuuaaccaaagaagccuccggugucuacuaucuagcuucugaguuggaguagcugaugggaaaagacaggaaccacagcaagguuagccgugcugcaacuugagggcuguguaagaucagagggcacacaggcacuaggagguaaaaaaguucauucgggcagcacaaugggguccugccuagagaacaggucugauccagacacugucaacaauccgacucuuccuagggucagaauauguugagggugagacaacuuuuacucuggauaauugcacuccaaccuugaggaccugaguccuacauucuugccccauaccuaacuugccagaggcugugacccuugcaacaucaccagcucauucaauuauuaaugcccaaaucaaugugcuccaugacggggcacugggggaccagugggaaggcucagccucccggguguucucgguaacaaaaaaaaaaaaaaaaaaaaaaaaaaaaaucgaaacugccuuucauuucuuuuuuuuuacuacuccgaucagcaacugacuauucuuuuacagaacauuucccucggacuaggcaacuccaaccauucccguaccccguugucacagggaaagaacccaaacgaacgaguugguguacuugggcagcauuuagagcucagucucaccaagagccccgacugucccucaguucucuccaggaaacaccacugcggaggaaggcaggggaucgacuaguaggauuuuguuuuguguucagaggcaaugguuuguuuuguuuugcagcaacggugucuuguaacagcgcugagaguuuucucuucagugucaaaaaaagaaaacaaaaugaaagcccuuucccagugaaagaagacaccacccugggucugggagacugaacuccgcugcagcucucauuccagagcugaggacuccggggcuggcuacaaaagcgcccguuugcagguguguuuggggguuggggagaggugugcauauagcuuggguaacugcugagccuuugucuagugacccggguaagaagaaaaaggggcagugaagagacgcgugcucagguccgcgucgcuacggaccaacgaacugugcagaagcgcggcccuggcuggcagcgcgaguucaagagcugcgcugcgcugcugguggcccugagccccucgagggugcuguaagagaacacgcuacacccgcaggggacgaaacucagccucaccacugaaccuauagccaagccaugcacuucgagcuacuugaccggucuuugagaguuugcugacacacgcaccacccgagugaaccucuugcacggucaacuccgggaccgcgcugcccuucgccucuggaaacaucugggcgccgguagacacuagcugagugcagcuggcgcgcuccggggcccaagccccggacacaaucgcccacgcuuccauuccgcgccgaacccacucuugcccaacaauccugcggguccuccccugcagcccucucuagguccuauggccgcacuucgcagagcacaaaaccucggugcgacccgugggacacgggaaagggcacccggugggagugcgcccugcaaaguggacugccccaaguucgcuuguagugaacggcgccgaccgaguucuuucuccgcgacuucggcgcgggcagaggaaccgcggacccgaaggagcuccggcgcagagcugcgagccuuucccgggcccggccgcggauugcacucaccgucacugaugcagagcgcggccagcaccagggccagcacggcgacgaccuuggcguccauggcgugggcgggagggcgcgccggaggcugcagagcuggacagcaagaggacaccgagguggaccgagagugaaagugcggcagcgggaggcgagcgcugggcgcuuuagaggcgaaaaccaggcggggcggggcggggcucaucaaggggcgggccuggaguguggcuggggucucugacgcgcauccccugcggagcagccgcccuuccaguucccuaccuacccacccccuucuuggcgcccucaguguccgcggcuccgcugggugcugagaccuuugaucuucccaguccccaacuugggcgggcucuuuggaccugaauuguaaagaggcugggucguagagcuuaaugcucccauccugcagauagagaaacuaaggggcugucaaaggcacaagccgugaaauaagaaccugagagacgaaacagucuguuucgccgcauccaaaaguugccagaguacccuuucuuucgugccaggaacuuaagcugacccaccucauguccagggugucugugccgcaguggacugcuaggcuuagggcaacguggaccaaucuacaguuagaauaacuuggauucccagccaaagucucacuacagucauucccgggaagaugcauucuaacguagggcugcgcuaccgagcaaagagaccaaacaggucucccagagauacucaguaucgugaauuuucuuugccaccuccccucuguaccccuauucucucgacuggggguggguggaugguacgaauagugggugggugauuacaacucucacccugcagaauggaaacggaggagaaaugacugggucucacucccgcgaaacguccugauucucugugcuugguuuuaauguguguucaguuaauggaagcuggaaacaacuucuuaaacuucaguguuuccugccuuuccagaagaaaguccaguguucuaaaaaggaccaaagaguucccuaaggccccgcucccuaaaacccugcuucagaaaguggucauuggcgcuuuacaaauagacccauugguguucagcccugccaauagaucguuguguuccacucuggucaaccaaaacaaccccaacccggguguggggagacacgggggagggggcagacugaaucuuggagggcuagaggcuuugggcagcguccuuuggaccuuccacugccacaggcaguguuggccaugcuucgaccacuuuucccacauagccaauuagcgauuuggauucuguuaucauguucacccaagggagugcacaacagagacuugccucugucucagggcaaucugggaaucauauuugugaagcaguggccaggaccuuugggccuggggcuccaccuagggacuaaagaaggguggag

SEQ ID NO: 11207 - RNA, 537 nt, Mus musculus
ugcgaaggggcggacggcccaggcucuggcgggcccggggaggcugaaaguccgcccuaggggcucggaggacggucccgggcaugggcgcagcguggaggcgcgcuggcagcgacuccgggaguggagucgcggugagggggaguucuagggaaacuacgcgggcggcggagucacugguagcgcgaggcggggugacaauuccgucugggccucggaauuggaagauggaggcaccagaggcuggcagcucgggauggacauggaccuaaccuuggcaggagcugaaauaaucuggacuggccccuaacuccuugcuuccugagcagucaauccuccagcucucccaugcucaggugccccagccuggccucggggguccccacagguuggguagugcgggcgagcccagugcccaggggaaucaaacaggauguggguugaaagaugccguccaucccaucuuuuuuucaccaccacgugugucccagaaccgagccugccaaaauugaguuaacauguguggaagucugccag

SEQ ID NO: 11208 - RNA, 537 nt, Mus musculus
cuggcagacuuccacacauguuaacucaauuuuggcaggcucgguucugggacacacgugguggugaaaaaaagaugggauggacggcaucuuucaacccacauccuguuugauuccccugggcacugggcucgcccgcacuacccaaccuguggggacccccgaggccaggcuggggcaccugagcaugggagagcuggaggauugacugcucaggaagcaaggaguuaggggccaguccagauuauuucagcuccugccaagguuagguccauguccaucccgagcugccagccucuggugccuccaucuuccaauuccgaggcccagacggaauugucaccccgccucgcgcuaccagugacuccgccgcccgcguaguuucccuagaacucccccucaccgcgacuccacucccggagucgcugccagcgcgccuccacgcugcgcccaugcccgggaccguccuccgagccccuagggcggacuuucagccuccccgggcccgccagagccugggccguccgccccuucgca

SEQ ID NO: 11209 - RNA, 815 nt, Mus musculus
cucccaaacacgaguuccucauuucaagaggagucuggggacagcguccugggaccaggccuccagucccuagaggcuacgguggggaaugaugagguagacccaucgcuuuucuacccccggacaaauuccccacuccuccuaucccucccccaaacaucggagaaaaugaaaugucagagagaggggaagagaaggagggaccaaaggacgagucuagagcaagucugaggcagucaaggaagggugagaggguaucuucgcaaacgcaaaagaaaaaaaggacgugccaggauaacaaccaucuccuguggagacaucgaacuuaggaaacaaaucggcaggacccuagacgaauaccggcgcggggagaggggcaggcgaggguggaaccgugcaguuagagaagcggaugcagaaagcugguaccuaaaccaggaggaggugacagccagaaagccgggagcuguccgggaaggccagagauggagggugccagggaaggcaggugacagucagguaugcagcgucacccgcccgggucgcuaagcccaggacaacggggaguggaggcggcaaggagcgaguaaggggaugcggcccgauacgggccucaccucgaggacugcagacucagucgguggcguuggcggcgguggcgguggcaguggcgguggugacggcggcggcgcagagagagcaggaguggcgguggcugcggcucccagcgcgggcggggggugggcagggggcggcgccuauagagccgggagggcgcaugugacccgggggccccgaugagucaagagcugcag

SEQ ID NO: 11210 - RNA, 815 nt, Mus musculus
cugcagcucuugacucaucggggcccccgggucacaugcgcccucccggcucuauaggcgccgcccccugcccaccccccgcccgcgcugggagccgcagccaccgccacuccugcucucucugcgccgccgccgucaccaccgccacugccaccgccaccgccgccaacgccaccgacugagucugcaguccucgaggugaggcccguaucgggccgcauccccuuacucgcuccuugccgccuccacuccccguuguccugggcuuagcgacccgggcgggugacgcugcauaccugacugucaccugccuucccuggcacccuccaucucuggccuucccggacagcucccggcuuucuggcugucaccuccuccugguuuagguaccagcuuucugcauccgcuucucuaacugcacgguuccacccucgccugccccucuccccgcgccgguauucgucuaggguccugccgauuuguuuccuaaguucgaugucuccacaggagaugguuguuauccuggcacguccuuuuuuucuuuugcguuugcgaagauacccucucacccuuccuugacugccucagacuugcucuagacucguccuuuggucccuccuucucuuccccucucucugacauuucauuuucuccgauguuugggggagggauaggaggaguggggaauuuguccggggguagaaaagcgaugggucuaccucaucauuccccaccguagccucuagggacuggaggccuggucccaggacgcuguccccagacuccucuugaaaugaggaacucguguuugggag

SEQ ID NO: 11211 - RNA, 3207 nt, Mus musculus
guaaauccgaagggcuccugggguucggguauucccgcaaagcugaaaaaggugaugaacuaaaaccuccacaaaccccaaggcaaagcccagagccgccgccgccugccguucccucuggcucacuucucagcacaccaacucacucuuuuuuggauuucgucaucuuuucaaaaaaucaauaaaaauauucuggaagcuccgaaagucuacuucuuggucucguucggauccucagauccuauucuaccauucccgacaauugaaaaaaauguccaggguggucucggcgguccaggggccgcuguucgguggguggguggaggagagagggggagggaggaggaggaagcgcgccucggccggccgccgcaguuggagucggagcaggggggagcaguuucaaaaaauuauuaaaaaucgagggaaaauccuagaaacgcucugugggccugaaaaccccagagaggucccaggcucccuggaaaagagguuucggguguccguaaggucgguaucuccaccccaggggcucuagaucucagugggggaaacuugcggaguguucggcugcggcccacaagggcaguagcuaggaaggcugugccugcuggggguugggugagacgaaaccagggaaccccccuccaggaggcaugcgggacucugaccucucauuugggggugcccccuagccugcucuacacaccuccucccccgcuuccuaccccacccaaaucugcgcgcucaagaagcagccaaacuguaaguaaccuuggugaaccgagggcuggggaagagggcacgaucagaaagagggugcccaggaucauggggugcugagagggggugggggcgccggcgaauguugccaguccuuguaaauggaguuugcaaagcaacauggcgaaaccacggcagguccagagcugugcauacgugggcacccugcucucucggcaaagauugcaagcaaggcuaaagcagcgguucuuucagauugcccuaaacgcacguuuuuuucaguaugacuuccggggcucuccugaauucccuguuucucccccacccccaccuccugccaaagugccaacgcggaguccuaaggcucagacgguuugccccaacccugagagucgggggcgggggggggcucuuuauauguugguauggauuguuaggucgcaacacccucuggggccucacugaaggcagccgggguugcuuccacaccacaggucagaaauggagaugggaagacgaggaagccacaugcaggcacacgcgcgggaugccaaccccccgggggggggaggacauccucacucacccaaguuuuccuccacuaguuaaucuagcaagggacagaauuagcgucucgcccaagggugcggggcuaccucgcgcacgagcgggggaggccagcgcagggguaguucucccgcaguuuuuaggaucucugcguguuggagguagggauggagcggcugggcuugccucucccugagagcgucgcccgcacaccuaccucuagcauccagguggccaccauccugcgcauguacgguuggauguccuucugcacgcacuugaaauaggaacacugcgggagguagcgcuccucgauggucaacagguucugcagaacgcggucuuccagcagguugcgguccggcacggcccugcggaccggguccaccucgcagcacagcagcuccauagccagccggccaccacucggucccgacuguaaauuuuuuuuauuauuauuauuuuuuggaggugcgggggggucggggagugcuucccuuaccuccuuccuuuggcugaaugggagauuugggagaggaaagaaauggcaaagagagagagggagagagagagagaagaguggaaggugggcgagcggagccucaagggccgccugacucgcaccgguccuucccuccgaacugcccggcucuccucagcucgcucuccucucucgcucaggcagugacgcaagcuggaagggcaguuagaucuccucccccucucagguuccuccucccccuuuccuccccuccucuagcgucccuccccuccuuucaaucuuucccucccucuccccccccccuucccucuuguuauuaaggagcacagcagcuggccugaccaaacuucaaacacgauccccgcuccccacccccaaccccucucccuacuucuccgaggcccucuccccauccagccccgcaugcuaggggccucggauaggggaacccacaaaccccauggauuccuauugauuauccuuucugacauucuguaggcauaccaugggggcauaaaggguguguacgugugugcucucuaacuucggaggcuugcaaugugaucagaaaaacagcccauuauucaagauucagguagauagauuuaccauguggaugaguucagauaacuuagaaguagaccccuaaaugaggaacaaggaaaggcuuauuugagaaaauugcaaccucgccaaaccagggauaaagguuaugccccucaagcuuagacuccugauaacuuucaagcuguuguccgccccgagccacgugcguggagaggaagaggaggaagggguggauguuggagaaaggggugcuucuuaagccuaguagaauaugacccuccugcagaaaccuuucuguucuugggggcgccauugggcaacgcggccagccucucagagcggccccagaccgggggcagggcuagcagcgguuccuccgcgggccucggccacgcaggaaaaacccgcuuccucgccccugcaucugcugacaagccgcccuaggugucugcgcggagcguggccacauugauacagcuuucuaggaaauggcucgggaggggccagggagggggagagggaggguuuagguuuggcucucccugcgccagcaaggccacccuuccuuuccccgggggcuccugaguccugcaccccucaauccccgaccccguggggucucgcgccucauccuuccgccaggauuuuggggucggcucugacaugugcucuaaagcauccuguggucaaggcuguugguagagggggacacguuggcguuuccucaccuccuuccugcucccacccugccuuuaacuauauuaaaggagggaggaaggggcgaggaaccacuggcccccgcaugguggccacgcuggcacgugcag

SEQ ID NO: 11212 - RNA, 3207 nt, Mus musculus
cugcacgugccagcguggccaccaugcgggggccagugguuccucgccccuuccucccuccuuuaauauaguuaaaggcagggugggagcaggaaggaggugaggaaacgccaacgugucccccucuaccaacagccuugaccacaggaugcuuuagagcacaugucagagccgaccccaaaauccuggcggaaggaugaggcgcgagaccccacggggucggggauugaggggugcaggacucaggagcccccggggaaaggaaggguggccuugcuggcgcagggagagccaaaccuaaacccucccucucccccucccuggccccucccgagccauuuccuagaaagcuguaucaauguggccacgcuccgcgcagacaccuagggcggcuugucagcagaugcaggggcgaggaagcggguuuuuccugcguggccgaggcccgcggaggaaccgcugcuagcccugcccccggucuggggccgcucugagaggcuggccgcguugcccaauggcgcccccaagaacagaaagguuucugcaggagggucauauucuacuaggcuuaagaagcaccccuuucuccaacauccaccccuuccuccucuuccucuccacgcacguggcucggggcggacaacagcuugaaaguuaucaggagucuaagcuugaggggcauaaccuuuaucccugguuuggcgagguugcaauuuucucaaauaagccuuuccuuguuccucauuuaggggucuacuucuaaguuaucugaacucauccacaugguaaaucuaucuaccugaaucuugaauaaugggcuguuuuucugaucacauugcaagccuccgaaguuagagagcacacacguacacacccuuuaugcccccaugguaugccuacagaaugucagaaaggauaaucaauaggaauccaugggguuuguggguuccccuauccgaggccccuagcaugcggggcuggauggggagagggccucggagaaguagggagagggguuggggguggggagcggggaucguguuugaaguuuggucaggccagcugcugugcuccuuaauaacaagagggaaggggggggggagagggagggaaagauugaaaggaggggagggacgcuagaggaggggaggaaagggggaggaggaaccugagagggggaggagaucuaacugcccuuccagcuugcgucacugccugagcgagagaggagagcgagcugaggagagccgggcaguucggagggaaggaccggugcgagucaggcggcccuugaggcuccgcucgcccaccuuccacucuucucucucucucucccucucucucuuugccauuucuuuccucucccaaaucucccauucagccaaaggaaggagguaagggaagcacuccccgacccccccgcaccuccaaaaaauaauaauaauaaaaaaaauuuacagucgggaccgagugguggccggcuggcuauggagcugcugugcugcgagguggacccgguccgcagggccgugccggaccgcaaccugcuggaagaccgcguucugcagaaccuguugaccaucgaggagcgcuaccucccgcaguguuccuauuucaagugcgugcagaaggacauccaaccguacaugcgcaggaugguggccaccuggaugcuagagguaggugugcgggcgacgcucucagggagaggcaagcccagccgcuccaucccuaccuccaacacgcagagauccuaaaaacugcgggagaacuaccccugcgcuggccucccccgcucgugcgcgagguagccccgcacccuugggcgagacgcuaauucugucccuugcuagauuaacuaguggaggaaaacuugggugagugaggauguccucccccccccgggggguuggcaucccgcgcgugugccugcauguggcuuccucgucuucccaucuccauuucugaccugugguguggaagcaaccccggcugccuucagugaggccccagaggguguugcgaccuaacaauccauaccaacauauaaagagcccccccccgcccccgacucucaggguuggggcaaaccgucugagccuuaggacuccgcguuggcacuuuggcaggaggugggggugggggagaaacagggaauucaggagagccccggaagucauacugaaaaaaacgugcguuuagggcaaucugaaagaaccgcugcuuuagccuugcuugcaaucuuugccgagagagcagggugcccacguaugcacagcucuggaccugccgugguuucgccauguugcuuugcaaacuccauuuacaaggacuggcaacauucgccggcgcccccacccccucucagcaccccaugauccugggcacccucuuucugaucgugcccucuuccccagcccucgguucaccaagguuacuuacaguuuggcugcuucuugagcgcgcagauuugggugggguaggaagcgggggaggagguguguagagcaggcuagggggcacccccaaaugagaggucagagucccgcaugccuccuggagggggguucccugguuucgucucacccaacccccagcaggcacagccuuccuagcuacugcccuugugggccgcagccgaacacuccgcaaguuucccccacugagaucuagagccccugggguggagauaccgaccuuacggacacccgaaaccucuuuuccagggagccugggaccucucugggguuuucaggcccacagagcguuucuaggauuuucccucgauuuuuaauaauuuuuugaaacugcuccccccugcuccgacuccaacugcggcggccggccgaggcgcgcuuccuccuccucccucccccucucuccuccacccacccaccgaacagcggccccuggaccgccgagaccacccuggacauuuuuuucaauugucgggaaugguagaauaggaucugaggauccgaacgagaccaagaaguagacuuucggagcuuccagaauauuuuuauugauuuuuugaaaagaugacgaaauccaaaaaagagugaguuggugugcugagaagugagccagagggaacggcaggcggcggcggcucugggcuuugccuugggguuuguggagguuuuaguucaucaccuuuuucagcuuugcgggaauacccgaaccccaggagcccuucggauuuac

SEQ ID NO: 11213 - RNA, 550 nt, Mus musculus
aguugagcaaguguuaaaaucccgaaguaggaagagaccccgcaggguauaaacucuggcugaggguggagcggaggacuuuuaagagagaaaggaaaggagagagggagagggagagggagagagagagagagaaagagaaaaggagaggaguggggguugaaaauuccaaggcugauccugcuagcugccaacuugaagucuucagcucgcacucuugaguucucugcaaggcugaaacuucgcguagauccggaagaagugauuccgagagugggcucgagaagagcgcggacgcgcgagugggacggguggggguuguccgcagagcauggcagugcggggcgaggccgcccaagaccuagccaagccgggccucggaggggcgagucccgcccguguggcaagagggaaccaccgccaucguggcgaguccucuccauccccucggggcuccggcuguuguuggagagcccuggcgcugcagccgcuccggcgcucgccucaacucuccucggcgcugugcgcgggcucccuguccgugcugcug

SEQ ID NO: 11214 - RNA, 550 nt, Mus musculus
cagcagcacggacagggagcccgcgcacagcgccgaggagaguugaggcgagcgccggagcggcugcagcgccagggcucuccaacaacagccggagccccgaggggauggagaggacucgccacgauggcggugguucccucuugccacacgggcgggacucgccccuccgaggcccggcuuggcuaggucuugggcggccucgccccgcacugccaugcucugcggacaacccccacccgucccacucgcgcguccgcgcucuucucgagcccacucucggaaucacuucuuccggaucuacgcgaaguuucagccuugcagagaacucaagagugcgagcugaagacuucaaguuggcagcuagcaggaucagccuuggaauuuucaacccccacuccucuccuuuucucuuucucucucucucucucccucucccucucccucucuccuuuccuuucucucuuaaaaguccuccgcuccacccucagccagaguuuauacccugcggggucucuuccuacuucgggauuuuaacacuugcucaacu

SEQ ID NO: 11215 - RNA, 1635 nt, Mus musculus
cgcagcgggcgacgcgcucgggacccgaggcggccgcagcccccgcgcugcagggcgcgcgcccagagccccugccggagggcaccuguggcgucaggagcuggguggccacggcaugcagguggcugacgagcugugcgcagcgcggcucccuggguguccagcucucaaagcgcgcgagguauugcaagacuucuuuggcgcagguuugaaaccccgaguggaacgcauccaagucggccuggaccggcgauuucagagagcgcuccccuagggugcacgggggagggaggcgagaagaaaaaccgcggcguuaagacaucugcucaucacgugggcccugcgcugccuacagugagcucggcuuuuccugggcauuccagcgauauaauccgcagacugccgagagaggaggggguggcgcggugaggcgcucucuuccuggcugaaaaacccaacugaagaggugcagccgccacuuuaaauaaaaacggggcuccuccagcucugcgggaagccuuugggaugcucuggguacuugccaccaaagggaaagaggcgacguucaccaggagaggacgcagcgggggaguccuagcguugcgcccccagcguuacccccuuuuguaucagggcaggcuggcuuccucagacccacuuaccauucuguaaagcaauuaucuucugaugcugcugcucaguuaaggcuguuagcgcuuucaagugcuuuaaaguuaauuccaagacuacugcuuucuccaaaugccccagugucugcaguggugcgacaaagggggacagggguuacuuuaaaacacgcauuuuuauuuccacgcagcccagcaacuuaagacaggcacacacacacacacacacacacacacacaccacugggaaggaagcgcugcucagcuccccacagucaggucgucaaugaucucugccauuagcccggagccccuguucugagucucugggaaacucuuaguuacagcacaaguuagaaggcaggccucuuaauauuuacauuuauuauccuaucucugggaauuuuaucagguaaauacaccccggaguccaucaggagaaugaaaaugugcaucuuacugucaauuucagauguucgggcaguaaaucuuucagcugagcaaugcauucauuaauucggucucgucucuucuuuucuauuaaucugugcgguaacuuguagguauccuucauacacgagccagagaaaagauacagcagugagcuaaacauucauucacuuacuggauagaacccucccaccccaacccccaaacacacuauguaaugaacuaaugcccagaacucucuccucuagacuucuaaaaugcaauuuaaauucaggugcgguguugaauaucccccggaguauccagcaagccacuuaaaauucacaguuaggaaagcucagggcuggaauauauuugcgggcagaguuuccuugcgaaaucaauggcccuaauuaacuauccaggcagguuaugggaaacuuaagacuuaccuugguaucgucucgcuucaagcuccuuuuggguuuacacauauacaaagaggaauaguccagucugcaaaaacagaaaucagcaucaggcccccauuccgggaggg

SEQ ID NO: 11216 - RNA, 1635 nt, Mus musculus
cccucccggaaugggggccugaugcugauuucuguuuuugcagacuggacuauuccucuuuguauauguguaaacccaaaaggagcuugaagcgagacgauaccaagguaagucuuaaguuucccauaaccugccuggauaguuaauuagggccauugauuucgcaaggaaacucugcccgcaaauauauuccagcccugagcuuuccuaacugugaauuuuaaguggcuugcuggauacuccgggggauauucaacaccgcaccugaauuuaaauugcauuuuagaagucuagaggagagaguucugggcauuaguucauuacauaguguguuuggggguuggggugggaggguucuauccaguaagugaaugaauguuuagcucacugcuguaucuuuucucuggcucguguaugaaggauaccuacaaguuaccgcacagauuaauagaaaagaagagacgagaccgaauuaaugaaugcauugcucagcugaaagauuuacugcccgaacaucugaaauugacaguaagaugcacauuuucauucuccugauggacuccgggguguauuuaccugauaaaauucccagagauaggauaauaaauguaaauauuaagaggccugccuucuaacuugugcuguaacuaagaguuucccagagacucagaacaggggcuccgggcuaauggcagagaucauugacgaccugacuguggggagcugagcagcgcuuccuucccaguggugugugugugugugugugugugugugugugccugucuuaaguugcugggcugcguggaaauaaaaaugcguguuuuaaaguaaccccugucccccuuugucgcaccacugcagacacuggggcauuuggagaaagcaguagucuuggaauuaacuuuaaagcacuugaaagcgcuaacagccuuaacugagcagcagcaucagaagauaauugcuuuacagaaugguaagugggucugaggaagccagccugcccugauacaaaaggggguaacgcugggggcgcaacgcuaggacucccccgcugcguccucuccuggugaacgucgccucuuucccuuugguggcaaguacccagagcaucccaaaggcuucccgcagagcuggaggagccccguuuuuauuuaaaguggcggcugcaccucuucaguuggguuuuucagccaggaagagagcgccucaccgcgccacccccuccucucucggcagucugcggauuauaucgcuggaaugcccaggaaaagccgagcucacuguaggcagcgcagggcccacgugaugagcagaugucuuaacgccgcgguuuuucuucucgccucccucccccgugcacccuaggggagcgcucucugaaaucgccgguccaggccgacuuggaugcguuccacucgggguuucaaaccugcgccaaagaagucuugcaauaccucgcgcgcuuugagagcuggacacccagggagccgcgcugcgcacagcucgucagccaccugcaugccguggccacccagcuccugacgccacaggugcccuccggcaggggcucugggcgcgcgcccugcagcgcgggggcugcggccgccucgggucccgagcgcgucgcccgcugcg

SEQ ID NO: 11217 - RNA, 954 nt, Mus musculus
ccgcuugugcucugggaaggagaagggcguguuuccgcuugcuccuccgccauggcucguggucccaagaaacaccugaagcguguggcggccccacgccacuggaugcuggacaaacugaccgguguguucgcgccccguccgucugccggcccgcaccgccugcgggagugccugccgcucgccaucuuccugaggaacaggcucaaguacgcccugaccggcgacgaggugaagaagaucugcaugcagcggcucauuaaggucgacggcaaggucagaaccgauguggccuacccagcuggcuucauggaugucaucagcaucgacaagagcggcgagaacuuccgccucgucuacgacaccaagggccgcuucgcgguacaccgcaucacgcccgaggaggccaaguacaagcugugcaaggugaggaaagucuucguggguaccaagggcaucccgcaccucgucacgcacgacgcgcguaccauccgcuacccugacccgcucaucaaggucaacgacaccgugcagaucucgcuagacagcggaaaaaucaccgaugccaucaaguuugauaccggcaaccugugcaugguaaccggaggcgccaaccugggucgcaucggcgucaucaccaaccgcgagcgccaccccggcuccuuugacgugguccacgugaaagaugccaacggcaauggcuucgcuacccgccucuccaacaucuucgugaucgggaagggcaacaagccguggaucucccuuccccggggaaaaggaauccgccucaccauugccgaagagagagacaagaggcuggcggccaagcagagcgggugaaguggacucugagggacauugcggggaaggggcguuuacguuuguuuauacuuaaaaguuuuuuaagcagcauguugaauuaaaaaagaaagcaagcuucuuucugguugcaua

SEQ ID NO: 11218 - RNA, 954 nt, Mus musculus
uaugcaaccagaaagaagcuugcuuucuuuuuuaauucaacaugcugcuuaaaaaacuuuuaaguauaaacaaacguaaacgccccuuccccgcaaugucccucagaguccacuucacccgcucugcuuggccgccagccucuugucucucucuucggcaauggugaggcggauuccuuuuccccggggaagggagauccacggcuuguugcccuucccgaucacgaagauguuggagaggcggguagcgaagccauugccguuggcaucuuucacguggaccacgucaaaggagccgggguggcgcucgcgguuggugaugacgccgaugcgacccagguuggcgccuccgguuaccaugcacagguugccgguaucaaacuugauggcaucggugauuuuuccgcugucuagcgagaucugcacggugucguugaccuugaugagcgggucaggguagcggaugguacgcgcgucgugcgugacgaggugcgggaugcccuugguacccacgaagacuuuccucaccuugcacagcuuguacuuggccuccucgggcgugaugcgguguaccgcgaagcggcccuuggugucguagacgaggcggaaguucucgccgcucuugucgaugcugaugacauccaugaagccagcuggguaggccacaucgguucugaccuugccgucgaccuuaaugagccgcugcaugcagaucuucuucaccucgucgccggucagggcguacuugagccuguuccucaggaagauggcgagcggcaggcacucccgcaggcggugcgggccggcagacggacggggcgcgaacacaccggucaguuuguccagcauccaguggcguggggccgccacacgcuucagguguuucuugggaccacgagccauggcggaggagcaagcggaaacacgcccuucuccuucccagagcacaagcgg

SEQ ID NO: 11219 - RNA, 815 nt, Mus musculus
cgcccgcuuugccuugccuuccaucuacgcuuucugcugccucuucugcucacugccccugcugggccugggcgagcaucagcaguauugcccagggagcuggugcuucauccgcaugcguuccgcccagccuggcggcugugccuucucccuggccuacgccagucucauggcccuguuggugaccuccaucuucuucugcaacggcuccgucacucucagccucuaucacauguaccgccaacagagacgccaccauggcucguuuguaccgaccucucgggcacgagaggaugaaguuuaccaccugauucugcuggcccucaugaccgucaucauggccgugugcucccugccucucauggugagugucccucggagcuggggugcagggggaggaguggagggcagcauccaucugugcucuccacuugucgugucuauuugacagaugugaaaaccgaggcucagaaagggucagauggugacuuuguguuccauguacuccugaguacuccaagaagucucucugcuuucuuuuccuccacuagacaaucucuagcccuuagcuguccugucaacaccucucagccggcuccccuauccaacacaccguugugauaacaggauccacaacucacgggcacuugcuuucugccgacacaacgcuuaauggcauuccaaaugccucuucagaugaauuucaaauugaccuuacacaaucauuucagaagcacugggcaggaaaugacacugaagucccauccugucaaccucuuuauagaaagaugauagugcuugcugcccgagaucac

SEQ ID NO: 11220 - RNA, 815 nt, Mus musculus
gugaucucgggcagcaagcacuaucaucuuucuauaaagagguugacaggaugggacuucagugucauuuccugcccagugcuucugaaaugauuguguaaggucaauuugaaauucaucugaagaggcauuuggaaugccauuaagcguugugucggcagaaagcaagugcccgugaguuguggauccuguuaucacaacgguguguuggauaggggagccggcugagagguguugacaggacagcuaagggcuagagauugucuaguggaggaaaagaaagcagagagacuucuuggaguacucaggaguacauggaacacaaagucaccaucugacccuuucugagccucgguuuucacaucugucaaauagacacgacaaguggagagcacagauggaugcugcccuccacuccucccccugcaccccagcuccgagggacacucaccaugagaggcagggagcacacggccaugaugacggucaugagggccagcagaaucaggugguaaacuucauccucucgugcccgagaggucgguacaaacgagccaugguggcgucucuguuggcgguacaugugauagaggcugagagugacggagccguugcagaagaagauggaggucaccaacagggccaugagacuggcguaggccagggagaaggcacagccgccaggcugggcggaacgcaugcggaugaagcaccagcucccugggcaauacugcugaugcucgcccaggcccagcaggggcagugagcagaagaggcagcagaaagcguagauggaaggcaaggcaaagcgggcg

SEQ ID NO: 11221 - RNA, 898 nt, Mus musculus
cuggccauugguacauuuauguucuauucauucuauuuuuuugacacagagucucacugugugagcucuggccugccagaaacucacucaauagaccaggcuggccucaaacucacagagaucugccugccugccucugccuccugagugcugggauucaaggcaagcacagccacgccccgcucaucucuuuugaucaucuuuauucuuugagaugaaauccaucaagucccauguacccuguagcugcugcaagagucugccggauucaaggggcagcuucuccaguguggguguggcagcccgccggucacuggcauaagaccguggcuucuagauucaggaagcugacuugcaucuucaccuccaauucgaggcucuuccaggucuugacgaaguccucgaaggugaugcccucauacugcuggcccgccaucagcggcugguccgacgcccuggccgccuccuucaaggcgcccugggcgauggcauuggcgacggagcgcacagugucucucuccacuugcgggugcgccgacagcaggcucuccaccacccggcgguacuccugcaggguaaugaucccaucgccguccuggucguacauguugaagaggaaccgcaucuuguccuugcgguucugcuccgccuccucuuuguugagacugggccgcagcggccggaaguaggagaugauggucaggaaguccuggaaggugaucuccuccgccagaccgcuggucccuuugcccagguuccgguugucgaagaaggcgcggacgauccuggagcggaucggauugaacuccaaguccaggauguugucgaagcucucuggcuguagggugggcugguccccgcucagcagccugaaccucuggugcagcugcuugaucug

SEQ ID NO: 11222 - RNA, 898 nt, Mus musculus
cagaucaagcagcugcaccagagguucaggcugcugagcggggaccagcccacccuacagccagagagcuucgacaacauccuggacuuggaguucaauccgauccgcuccaggaucguccgcgccuucuucgacaaccggaaccugggcaaagggaccagcggucuggcggaggagaucaccuuccaggacuuccugaccaucaucuccuacuuccggccgcugcggcccagucucaacaaagaggaggcggagcagaaccgcaaggacaagaugcgguuccucuucaacauguacgaccaggacggcgaugggaucauuacccugcaggaguaccgccgggugguggagagccugcugucggcgcacccgcaaguggagagagacacugugcgcuccgucgccaaugccaucgcccagggcgccuugaaggaggcggccagggcgucggaccagccgcugauggcgggccagcaguaugagggcaucaccuucgaggacuucgucaagaccuggaagagccucgaauuggaggugaagaugcaagucagcuuccugaaucuagaagccacggucuuaugccagugaccggcgggcugccacacccacacuggagaagcugccccuugaauccggcagacucuugcagcagcuacaggguacaugggacuugauggauuucaucucaaagaauaaagaugaucaaaagagaugagcggggcguggcugugcuugccuugaaucccagcacucaggaggcagaggcaggcaggcagaucucugugaguuugaggccagccuggucuauugagugaguuucuggcaggccagagcucacacagugagacucugugucaaaaaaauagaaugaauagaacauaaauguaccaauggccag

SEQ ID NO: 11223 - RNA, 531 nt, Mus musculus
uccgcugcuacugcaagucagagacguggggacuucuuggcacugcgcugucucgcaaggaggcaggaccugaggacuccagacagcccugcucaccgucguggacacucgaucgcuacccggcguuccucagacgccccuauuccggaccagcccucgggagccacaaaccccgccucccgcgaagacuucaccccaaagcuggggcgcaccccuugcacgccgcccuccccccagccugccucuugagucccucgcaucccaggacccucucucccccgagaggcagaucucccucggaccugcuggcaguagcuccccuauuuaagaacacccacuuuuggaucucagagagcgcucaucucgauuuuuacccuggugguauacugagacaccuuggugucagagccucaccgcgacuccugcugcuuucucccucaaccucaaauuauucaggacuaucaccuaccuuuccuugggagaccccaccccacaagcccugcaggggcggggccuccgcaucccaccuuu

SEQ ID NO: 11224 - RNA, 531 nt, Mus musculus
aaaggugggaugcggaggccccgccccugcagggcuugugggguggggucucccaaggaaagguaggugauaguccugaauaauuugagguugagggagaaagcagcaggagucgcggugaggcucugacaccaaggugucucaguauaccaccaggguaaaaaucgagaugagcgcucucugagauccaaaaguggguguucuuaaauaggggagcuacugccagcagguccgagggagaucugccucucgggggagagaggguccugggaugcgagggacucaagaggcaggcuggggggagggcggcgugcaaggggugcgccccagcuuuggggugaagucuucgcgggaggcgggguuuguggcucccgagggcugguccggaauaggggcgucugaggaacgccggguagcgaucgaguguccacgacggugagcagggcugucuggaguccucagguccugccuccuugcgagacagcgcagugccaagaaguccccacgucucugacuugcaguagcagcgga

SEQ ID NO: 11225 - RNA, 538 nt, Mus musculus
ggggagcccugggggcaccgggacaacugugugggugucccaaagaggcuggcacuuucccguaccccaggugucuuugagaggaauagacagccugccaaagugauccucuccuagaaaagcaaggucguggggagaguccccucuagaagaggagcauuuggcagguuuuguuuuaaguuccccuaauggugccuaaaaaugcagggcucgcuggguggucucuuuccagaaagguagaacccagcucaagagaauggaagguguccaacauuucggaauggagaugcaauguggaaagccgaccccagaccgggucgugagauggagagaaaaccuaggggauggguacccuagaacugccaaauaaaaucucuagugggcuuacucucagaaagcgacaggcgcacgcuagagagugugaucuguggagucacuacgggguuacaagugaaaaaggaaagcgacguuguugggagaaggacucuagagaggagcagagagggugcggaaaaugagcccggaggugucacgagug

SEQ ID NO: 11226 - RNA, 538 nt, Mus musculus
cacucgugacaccuccgggcucauuuuccgcacccucucugcuccucucuagaguccuucucccaacaacgucgcuuuccuuuuucacuuguaaccccguagugacuccacagaucacacucucuagcgugcgccugucgcuuucugagaguaagcccacuagagauuuuauuuggcaguucuaggguacccauccccuagguuuucucuccaucucacgacccggucuggggucggcuuuccacauugcaucuccauuccgaaauguuggacaccuuccauucucuugagcuggguucuaccuuucuggaaagagaccacccagcgagcccugcauuuuuaggcaccauuaggggaacuuaaaacaaaaccugccaaaugcuccucuucuagaggggacucuccccacgaccuugcuuuucuaggagaggaucacuuuggcaggcugucuauuccucucaaagacaccugggguacgggaaagugccagccucuuugggacacccacacaguugucccggugcccccagggcucccc

SEQ ID NO: 11227 - RNA, 1340 nt, Mus musculus
gacccccucauccccugccaugcgccuggcucgagggcugggcgucugguucccuggcaguuccgggcccccgggacuccugauacccccggagccccaggccucauccucgccccugccccugaccuuagaacugcccucgccagugacacccccuccagaggaggcggcugcggucuccacaccacccccgccccccguggggacccugcugccugcgccaucuaaguggcgaaaacccacgggcacuucagugccucggauccgcggucuucuggaggcgagccaucguggucagggugacccuccaagccuccgcccgcugccaccgcugccccggcaacugaccgaaaaagacccgguccugagggccccagccccaccuccgacgccccuggaaccucggaaacaacuaccgccagcaccaucaacuugcgauccgcagccccugagccgcagaaucacucuggccucgucggccacaagccccacagaaagucaggucagacacagcagcgagggucaggcggccgggggagcccacggagggguaccuccccaagcuggagagggcgaaauggcucggucugcuacuuccgagucuggccugagucugcuguguaaagucaccuucaagucggggccccauuugucccccacaucggccucgggucccuuagcagccaaagccucacccggggccggugguggcggacuguuugccucuucuggggccaucuccuaugcugagguccugaagcaagggccccaaccuccuggagccacucgucccuugggagaggucccuccuggagccacucgucccuugggagaggucccucgugcagcucaggaaaccgaggguggugacggagauggcgaaggguguucuggucccccuucggugccugcuccccuugcccgggcucuaccgccgcccccuuacaccaccuucccagguucaaagcccaaauucgacugggugagcccuccugauggcacugaacggcauuuccgauucaauggggcugucgggggaaucggggcaccccgacggcgcacgaccacgcucucagggccuuggggauccccuccacccaggucaggucagacacauccaucuucagggccucggaggcccacaccugccuuguuggcaccacccauguucaucuucccagcgccaaacaauggcgagccuguucgcccagugccuccaaguccacagcagauaccuccucugccgccaccaccacccacgccaccagccacgccaccaccggcgccaccacccacaccacagccaccagcgcucccaaggacgccgauacugguggccc

SEQ ID NO: 11228 - RNA, 1340 nt, Mus musculus
gggccaccaguaucggcguccuugggagcgcugguggcuguggugugggugguggcgccggugguggcguggcugguggcguggguggugguggcggcagaggagguaucugcuguggacuuggaggcacugggcgaacaggcucgccauuguuuggcgcugggaagaugaacauggguggugccaacaaggcaggugugggccuccgaggcccugaagauggaugugucugaccugaccuggguggaggggauccccaaggcccugagagcguggucgugcgccgucggggugccccgauucccccgacagccccauugaaucggaaaugccguucagugccaucaggagggcucacccagucgaauuugggcuuugaaccugggaaggugguguaagggggcggcgguagagcccgggcaaggggagcaggcaccgaagggggaccagaacacccuucgccaucuccgucaccacccucgguuuccugagcugcacgagggaccucucccaagggacgaguggcuccaggagggaccucucccaagggacgaguggcuccaggagguuggggcccuugcuucaggaccucagcauaggagauggccccagaagaggcaaacaguccgccaccaccggccccgggugaggcuuuggcugcuaagggacccgaggccgaugugggggacaaauggggccccgacuugaaggugacuuuacacagcagacucaggccagacucggaaguagcagaccgagccauuucgcccucuccagcuuggggagguaccccuccgugggcucccccggccgccugacccucgcugcugugucugaccugacuuucuguggggcuuguggccgacgaggccagagugauucugcggcucaggggcugcggaucgcaaguugauggugcuggcgguaguuguuuccgagguuccaggggcgucggagguggggcuggggcccucaggaccgggucuuuuucggucaguugccggggcagcgguggcagcgggcggaggcuuggagggucacccugaccacgauggcucgccuccagaagaccgcggauccgaggcacugaagugcccguggguuuucgccacuuagauggcgcaggcagcaggguccccacggggggcgggggugguguggagaccgcagccgccuccucuggagggggugucacuggcgagggcaguucuaaggucaggggcaggggcgaggaugaggccuggggcuccggggguaucaggagucccgggggcccggaacugccagggaaccagacgcccagcccucgagccaggcgcauggcaggggaugaggggguc

SEQ ID NO: 11229 - RNA, 941 nt, Mus musculus
auggagcugcggaaaguucccuccucuucgucggguuccccaguucuaaaaaggaacagauagaggaauucggauggaccaggagaggcagccgcuuccgagaagcccccuaaugcaggccuuauuucccgacccccaccguggacuugauaugaacgcgguccgucagaaacaagagcgcccggcugcuguuucggggugcggcaggaggugcucccagccugucacgggugaaggccuccgggauauuggggaagguacuugacuuuguugggagagggacggucacagcgucuugggagacuugggacuuggguccagugagugacccuaagucaccuuaccgccccgugccucaguuuccucauaugcaaaaugggauugaugauggagcgcaccucauccgggugggguaaggaguacauaauagagaaggaaucgggcaccuggcgcguagugcgcacucaagcaugccagagggucggcauggaggcaucugugaucaucuuagcacgcagaaggcaugccuacguuuucugcgcuuuaaagguuuauuucgagaggaauccugcgcgaggaucgggacuggagcuaaacugggccgcccugugaggugaucucauuucagcgcggcugcuucugcccagcuucgccucaccacgcuugaguuuccaucugcggggcuggugggagcccagcgcccccacuggcugggcgcuaggccaggcagagagggagcuugaccaucgcuccggcccaggagccugucuuaggguuuaacacacacuaagcgcuuaauacauguucacugcaggaugggugcacuugcugccucgccccaaccgccucuccacugcggaaggagcgagggaggcccagagggaccacucaccucugcuguugguugaauuugcaucgacaucucuugccuguggaguggg

SEQ ID NO: 11230 - RNA, 941 nt, Mus musculus
cccacuccacaggcaagagaugucgaugcaaauucaaccaacagcagaggugaguggucccucugggccucccucgcuccuuccgcaguggagaggcgguuggggcgaggcagcaagugcacccauccugcagugaacauguauuaagcgcuuaguguguguuaaacccuaagacaggcuccugggccggagcgauggucaagcucccucucugccuggccuagcgcccagccagugggggcgcugggcucccaccagccccgcagauggaaacucaagcguggugaggcgaagcugggcagaagcagccgcgcugaaaugagaucaccucacagggcggcccaguuuagcuccagucccgauccucgcgcaggauuccucucgaaauaaaccuuuaaagcgcagaaaacguaggcaugccuucugcgugcuaagaugaucacagaugccuccaugccgacccucuggcaugcuugagugcgcacuacgcgccaggugcccgauuccuucucuauuauguacuccuuaccccacccggaugaggugcgcuccaucaucaaucccauuuugcauaugaggaaacugaggcacggggcgguaaggugacuuagggucacucacuggacccaagucccaagucucccaagacgcugugaccgucccucucccaacaaagucaaguaccuuccccaauaucccggaggccuucacccgugacaggcugggagcaccuccugccgcaccccgaaacagcagccgggcgcucuuguuucugacggaccgcguucauaucaaguccacggugggggucgggaaauaaggccugcauuagggggcuucucggaagcggcugccucuccugguccauccgaauuccucuaucuguuccuuuuuagaacuggggaacccgacgaagaggagggaacuuuccgcagcuccau

SEQ ID NO: 11231 - RNA, 583 nt, Mus musculus
cagcucuuacgcccagggcgcuugcccgaggcagcagugccaggggccugcaggacuguccagggguggaacgggagggacgcagcgggccaccuggugcgcgccagcggggccgcaaagccagccggccggugugaacuucggggcuacaggauccgcugggccgaaccuccggccccgcgggcgggguggccaagguacccgaagggcccagcgaagaaggggugggagugcgguggggggcggagacaaaguuaaaucaagaggcagacacuucaagaccacagaugggaagcucgccuaauuaaggacguaaaagcgcuuuuguucucaaaguuuauuguugccgggauuuaaaaaaaauuaauugaaacuaaugcuguuauucacucgcgcaguuaaauuccuucaugcacauuugagacacggagugaaaacuugaagguuuaucuuucuacagucgggggcuucucgagggaggguagagaggugcuacugugacgcgagagugggagaaugaggguguucgcauccagaugagggggugcgugugggcaguggaaaucuagagaccgcgguccgg

SEQ ID NO: 11232 - RNA, 583 nt, Mus musculus
ccggaccgcggucucuagauuuccacugcccacacgcacccccucaucuggaugcgaacacccucauucucccacucucgcgucacaguagcaccucucuacccucccucgagaagcccccgacuguagaaagauaaaccuucaaguuuucacuccgugucucaaaugugcaugaaggaauuuaacugcgcgagugaauaacagcauuaguuucaauuaauuuuuuuuaaaucccggcaacaauaaacuuugagaacaaaagcgcuuuuacguccuuaauuaggcgagcuucccaucuguggucuugaagugucugccucuugauuuaacuuugucuccgccccccaccgcacucccaccccuucuucgcugggcccuucggguaccuuggccaccccgcccgcggggccggagguucggcccagcggauccuguagccccgaaguucacaccggccggcuggcuuugcggccccgcuggcgcgcaccagguggcccgcugcgucccucccguuccaccccuggacaguccugcaggccccuggcacugcugccucgggcaagcgcccugggcguaagagcug

SEQ ID NO: 11233 - RNA, 970 nt, Mus musculus
cgcaccccgaccuccgcacgggaggcggcggcgguggcagcggugccggugcgggcaaagccaagaagucgguggacaagaacagcaacgaguaccggguacggcgggaacgcaacaacaucgcggugcgcaagagccgagauaaagccaaacaacgcaacguggagacgcaacagaaggugcuggaguugaccagugacaaugaccgccugcgcaagcggguggaacagcugagccgugaacuggacacgcugcggggcaucuuccgccagcugccugagagcuccuuggucaaggccaugggcaacugcgcgugaggcgcgcggcugcgggaccgccuugggccggcccccuggcuggagacccagaggaugguuucgggucgcuggaucucuaggcugcccgggccgcgcaagccaggacuaggagauuccgguguggccugaaagccuggccugcuccgcguguccccucccuuccucugagccggacucggugcgucuaagaugagggagucaggccguggugguuucuccuugagaccgagagacuuuccgcggagcugagcugggggcccggcaguacuaguauuaaggaaguaaccuugugccuuggauacucaaaacucgcuccuuuuccuaccgaguagggggagcaaaaaugugccuugauauuuuauuuggaggauuccugcuuccucucgggccucagcuggccccgugagaaaaaugaagggugcaggcccagggcaggaggaagauacaggaagcugagaucccggcagugcccugagcugccccucagucccugucuuuagaggggagggacuuagguguuggggauuugagucuguguccucacccccagcuacagggagguggagggcuccuaaucccuugcuuuuugcaccuccaccuacauccccccccccccacucagcuuacaacaggccagguuuccugggugaguu

SEQ ID NO: 11234 - RNA, 970 nt, Mus musculus
aacucacccaggaaaccuggccuguuguaagcugaguggggggggggggauguagguggaggugcaaaaagcaagggauuaggagcccuccaccucccuguagcugggggugaggacacagacucaaauccccaacaccuaagucccuccccucuaaagacagggacugaggggcagcucagggcacugccgggaucucagcuuccuguaucuuccuccugcccugggccugcacccuucauuuuucucacggggccagcugaggcccgagaggaagcaggaauccuccaaauaaaauaucaaggcacauuuuugcucccccuacucgguaggaaaaggagcgaguuuugaguauccaaggcacaagguuacuuccuuaauacuaguacugccgggcccccagcucagcuccgcggaaagucucucggucucaaggagaaaccaccacggccugacucccucaucuuagacgcaccgaguccggcucagaggaagggaggggacacgcggagcaggccaggcuuucaggccacaccggaaucuccuaguccuggcuugcgcggcccgggcagccuagagauccagcgacccgaaaccauccucugggucuccagccagggggccggcccaaggcggucccgcagccgcgcgccucacgcgcaguugcccauggccuugaccaaggagcucucaggcagcuggcggaagaugccccgcagcguguccaguucacggcucagcuguuccacccgcuugcgcaggcggucauugucacuggucaacuccagcaccuucuguugcgucuccacguugcguuguuuggcuuuaucucggcucuugcgcaccgcgauguuguugcguucccgccguacccgguacucguugcuguucuuguccaccgacuucuuggcuuugcccgcaccggcaccgcugccaccgccgccgccucccgugcggaggucggggugcg

SEQ ID NO: 11235 - RNA, 506 nt, Mus musculus
gaaaaacuuucauauaguuaaccucagcaauuuuucuaaccacauuucaugaaaaguuuuacauagguauaugaauaaaaaggaguuuggguuucauagcaaaaauucaagcuuacaugaaauaggagcucccaagauccacccuuaacugaggagcuacuggaaguugacaacagcuaagggacaaagacugacacaugggauuuguggugcccgugcuccuuggaugguucuaucuaacacauaugggcaagcacuagcuggacugagauauuuaaaaaaaaaaaaaaaaaaaaaaaggacaugaaguuggaagggggaugugugggagggaaagggaguuaaguugaagggacgaaauagauuuaacugacugcauguacaauucuccaggaguaaauuccaaauaaauaacauaaaguuuacacgcaaaaauauuuaaauauagaaaaauagagcuucucaaauguuuaugcaacuuccuaaaccuuuauuaauaccucacu

SEQ ID NO: 11236 - RNA, 506 nt, Mus musculus
agugagguauuaauaaagguuuaggaaguugcauaaacauuugagaagcucuauuuuucuauauuuaaauauuuuugcguguaaacuuuauguuauuuauuuggaauuuacuccuggagaauuguacaugcagucaguuaaaucuauuucgucccuucaacuuaacucccuuucccucccacacaucccccuuccaacuucauguccuuuuuuuuuuuuuuuuuuuuuuuaaauaucucaguccagcuagugcuugcccauauguguuagauagaaccauccaaggagcacgggcaccacaaaucccaugugucagucuuugucccuuagcuguugucaacuuccaguagcuccucaguuaaggguggaucuugggagcuccuauuucauguaagcuugaauuuuugcuaugaaacccaaacuccuuuuuauucauauaccuauguaaaacuuuucaugaaaugugguuagaaaaauugcugagguuaacuauaugaaaguuuuuc

SEQ ID NO: 11237 - RNA, 835 nt, Mus musculus
cccuaggcugagucugaacuccagauuccccagggauggauacuuaagccagacagcuggauucggcaccccgugagggaguccccaaaccacgucugugggaaugggcuucaggcggcguuagcuggacuucaaccccacaucuggggccuagaagcagggcaaggcaaccacagggggagauggaagggggagggggucgauauauauagccgagauggcucggaagcaucugcucuguugacaccuuugcgcagggcucuccuuuguaccuuugcugacucaaauagacucggaucugcaucugcuggagggggcuggggacagucuuggagccuugcggugggggcuagcaggcaccuccucuuugauucuaaggguuguguagaaucuauaacucccuaguggggagagaugagagagggcuggggagaagucgacugaagaucuugaccccagaguugaggcaggagagagccgauggccuggacucccgggacuggaaggaauucggacucagauucugggucuggcaaaagacguggguuuugccgugcacuccugugucacggggaagagagggaacucugaguucuuggacagagggagggaaacacagauccagaguugccugcaucauagugagggcagccaagcaagguuaagccuaggaccccuguugucaccgggaggagucugagucuuugcuucucgcuucccugcagguuacuggagaagcggcaggaaggcgcggagacacuggagcugagugccgacgggcggccagugaccacgcacacucgggacccgccugugguggacugcaccugcuuug

SEQ ID NO: 11238 - RNA, 835 nt, Mus musculus
caaagcaggugcaguccaccacaggcgggucccgagugugcguggucacuggccgcccgucggcacucagcuccagugucuccgcgccuuccugccgcuucuccaguaaccugcagggaagcgagaagcaaagacucagacuccucccggugacaacagggguccuaggcuuaaccuugcuuggcugcccucacuaugaugcaggcaacucuggaucuguguuucccucccucuguccaagaacucagaguucccucucuuccccgugacacaggagugcacggcaaaacccacgucuuuugccagacccagaaucugaguccgaauuccuuccagucccgggaguccaggccaucggcucucuccugccucaacucuggggucaagaucuucagucgacuucuccccagcccucucucaucucuccccacuagggaguuauagauucuacacaacccuuagaaucaaagaggaggugccugcuagcccccaccgcaaggcuccaagacuguccccagcccccuccagcagaugcagauccgagucuauuugagucagcaaagguacaaaggagagcccugcgcaaaggugucaacagagcagaugcuuccgagccaucucggcuauauauaucgacccccucccccuuccaucucccccugugguugccuugcccugcuucuaggccccagaugugggguugaaguccagcuaacgccgccugaagcccauucccacagacgugguuuggggacucccucacggggugccgaauccagcugucuggcuuaaguauccaucccuggggaaucuggaguucagacucagccuaggg

SEQ ID NO: 11239 - RNA, 1877 nt, Mus musculus
uucuccaacucaccacaucugccugccugccucccucuguccucggugcucuccucaagucauuuggucugugacuaggcccucuccucugccugggcuucuguccuucugucuugcucugugcaugagcaacucuguauauggggccccuucugugaggcuccaggucuccuucucuguucuuuuauacuugguguuuguguaucuuugggucucugucugcccuccauuuccugccuaaaugaucuuucucucucuauucugugccuugguaucucccgaugugucucuguaucugcauuuauuccacuccgucuucauccuucuugcuggcccaccuggcuccucuaaucccaugggugggucuccuugugucuaucucuacuguauuucuuggugguugccucucuccaccucucuguccuucugugacuuauucauucuuuuuuuuuuuuuuuuuccugugagcuguuaguuguuuuguucagacaaggucuuacuguguagcacaggauggcuuccaaucagccuccugcaugcagggaugggaagugagaaccaccaugcucccucuauguaguuaugccuuugucucuuuuucuaugacccgacaucaugcuuuuuagucucuaucucucuuuccuuucugcauagcaucuugcucgcuugucucuaagcacucucucugugucucugugacucuguaaugugucucuuuauuugucucuccuucuugcccagcccugaccauaaagucucccugugucuauuucugucuuucccugccacuugacaucuugcucccccugguccccuuucagggcaccuugucccuccuucccagcaucagcucaccuccagccuucucacccuccagucccgcaagccucugccuccccguccugaccagcugguuuucugcacgccaggccccuagcgcccgguccuuucuagccuuggcaccuggagcugggggccucgggcuccgucggcuacacugcaccucccuuuccagggcugggcccaggggugcggcccuuucuacugcggagaccccccaaccaaacaucaaaccagugggagcaaguggguggggaagagggaagcaggaccagaggugauggaagaggggguggggaagaagacgagaggagguggagauggaaagagggagaggcagcgcagggugagggaggaggugagauagaaggaagaagggaaggcagagucgaauagggaggaggaagaggacagagggaagaagagaaggcagggugagggaggaggcggagggagaggagcgcacgcggcgagugcgcggccggguucgcugguugagagcgaagaaggggugugcauuggcaccgagagggacccggggccggcgagggcgaucgcagcuucgggagguagagcgagugcagggagcgggcccaggcgggcggaggagugagcgucaaacgggcucugggguacacggucccagccccuguaucccgggagcuggggcucccguucuggugacagccaggcuggaagucccaagaggaggggagggaagagcuagggggucgggcgcugggaaagggucgcuccgaggccucuuggauggggggugccgcucgccugagcgccccucaagcgcugguacucugggccgcacugggagcggcagguaagaccuggggguccuggcagcauccucugagggagggacaggguggggugccuaggagagggaugcagcugcucucuucccagcucacaucggaccugcaccugaucccgaggacugguggagcuacaaggagaaucuccagggaaacuucgugccaggugcaaacaggguggagacccagagcccgaccccauauccc

SEQ ID NO: 11240 - RNA, 1877 nt, Mus musculus
gggauauggggucgggcucugggucuccacccuguuugcaccuggcacgaaguuucccuggagauucuccuuguagcuccaccaguccucgggaucaggugcagguccgaugugagcugggaagagagcagcugcaucccucuccuaggcaccccacccugucccucccucagaggaugcugccaggacccccaggucuuaccugccgcucccagugcggcccagaguaccagcgcuugaggggcgcucaggcgagcggcaccccccauccaagaggccucggagcgacccuuucccagcgcccgacccccuagcucuucccuccccuccucuugggacuuccagccuggcugucaccagaacgggagccccagcucccgggauacaggggcugggaccguguaccccagagcccguuugacgcucacuccuccgcccgccugggcccgcucccugcacucgcucuaccucccgaagcugcgaucgcccucgccggccccgggucccucucggugccaaugcacaccccuucuucgcucucaaccagcgaacccggccgcgcacucgccgcgugcgcuccucucccuccgccuccucccucacccugccuucucuucuucccucuguccucuuccuccucccuauucgacucugccuucccuucuuccuucuaucucaccuccucccucacccugcgcugccucucccucuuuccaucuccaccuccucucgucuucuuccccacccccucuuccaucaccucugguccugcuucccucuuccccacccacuugcucccacugguuugauguuugguuggggggucuccgcaguagaaagggccgcaccccugggcccagcccuggaaagggaggugcaguguagccgacggagcccgaggcccccagcuccaggugccaaggcuagaaaggaccgggcgcuaggggccuggcgugcagaaaaccagcuggucaggacggggaggcagaggcuugcgggacuggagggugagaaggcuggaggugagcugaugcugggaaggagggacaaggugcccugaaaggggaccagggggagcaagaugucaaguggcagggaaagacagaaauagacacagggagacuuuauggucagggcugggcaagaaggagagacaaauaaagagacacauuacagagucacagagacacagagagagugcuuagagacaagcgagcaagaugcuaugcagaaaggaaagagagauagagacuaaaaagcaugaugucgggucauagaaaaagagacaaaggcauaacuacauagagggagcauggugguucucacuucccaucccugcaugcaggaggcugauuggaagccauccugugcuacacaguaagaccuugucugaacaaaacaacuaacagcucacaggaaaaaaaaaaaaaaaaagaaugaauaagucacagaaggacagagagguggagagaggcaaccaccaagaaauacaguagagauagacacaaggagacccacccaugggauuagaggagccaggugggccagcaagaaggaugaagacggaguggaauaaaugcagauacagagacacaucgggagauaccaaggcacagaauagagagagaaagaucauuuaggcaggaaauggagggcagacagagacccaaagauacacaaacaccaaguauaaaagaacagagaaggagaccuggagccucacagaaggggccccauauacagaguugcucaugcacagagcaagacagaaggacagaagcccaggcagaggagagggccuagucacagaccaaaugacuugaggagagcaccgaggacagagggaggcaggcaggcagauguggugaguuggagaa

SEQ ID NO: 11241 - RNA, 5266 nt, Mus musculus
auauaggguugggaaaucaaauuggcaagauaagguuggggucgcgggaggaucuagacuuccuacccuuagguaacccccaagcaucgcacacaagagggcaccccaugcggucuuguggagggaaaaaaaagcagcccugaaugaauguuaacaggaaauuagcugcggcugguagguguuuuucggcggcguggaggggcgagggccggucugcguguggcugccggaggagcuggccaauuggucacggugcugagaccuuuguggcgaaugguggccaagugcaccaacucugugggaaacggcggcaugaagggaugccaacagcuccucgccgggaagggaaccgccucaaauguggaccaugacaauucuugcuaauuuguagagcagggaauuggugcauagugucaagcagucacugcuugugcuaaaugggguaucaaauuggcgcgacggauucgugaauguuguacgccucgcaaccucugaaccagagcguaaccccgagggguggacggagaaauacgacuucgggguagggagcgaccggccgggacuggaacgggcuguccagcccggagcgggaaaaacacgaaagagaccuaccugggaaauaggaggaucugauaaaggguuggaacgagccuucgaaguauggaaaggcgaacgucuugggaggagggcucugcagcaaagcgggcgaaguuucugguagggcgagggaagagagagagagagagagagagagagagagagagagagagaaugaauuugaucauguguuugaauacuguguggagcaucgcguacacgaucuaauucacacugcagcagguaucagaggcaucuuuuagaacguauucacuaaguaaaauaaauuugcgcagcgucgucucauuugugcccccauuucaucaccauuccagagacuuaggaaaauagggagggguggggugggcuauugcagaucuauccauaauaguacaaaccaacacaauaaacguacuuguuggguuuaaagcaaaaagucucuuuccuagucuugagggcgggaacgcaggcaccaaagcgcgugcgcugagacgcccgacuaaggaacugcacucacuggcccggggcucaaguucauuuugaggauacucguaaggccugagacuuuucuuccccuuaaaaccucaguaccaucguuucauaaucaguaaccuggcccuugaggucugaguuccugcguggaaaugugcacuaacaagcgcggaggaacaaguuugugaaggauugaguggcugucaggccgcggaacgcacgucgagggcacggcuguaucuuaccucuucuaggcgccgaggaaaggauggcauucaccccaaacuucagaaacgugggcucgcuggcaggggagagggcggucuguggagaacugccucgccggcucccggacccaggagagcccaggucugagguccccgagucggcgagggcugcaggggccucuugacuggggggugacaggcuggcagcggguaugcugcgggacagguaggugggaggccggcugaugcggaucaaaucuucuacuaggaaacuagaguggccggaaaaugcggauugaagggacuggggcaguguuaaggugggcgugggucgcaggaggcuaggguaucccgcgggaggcgcaaggaggccggggaacaucaugguuagagcgggucuggcaguagcucccuuucccugggccggagggcaagcgccuggcuucccgccccucccccgaugcccucuuuggcucaguauccugguaaccguccuacuugggcgucugcgagucuucuguggcucuccgguccaggagaugguuuuauaguggcccgcccgcuccagcucuuugaaaacugacagcucugacaaugaaguucaacaaaguucuccacucgggcuucauucgcgggaggcuccaggcucucugauugguucagggaugcaauuuaugauuggauuagucuucauaagcauggcccucacaauggggcggcaacaaaggccggcgcucaucaacgcugugcaucgacggccucucugcuauacagugaguccccaaagcucucgcuggagguuuuuguucugaagcaacacccgggcuaauuaaaugccuauuuagaaguuucagaugacaucuugccucauagaaaaggaauuauuuaaagaacgcacuaaauuuaucugcggccuccugcugagacuagaaaauaaaucaauaaauauucauagaacuacaucuccaggcuaucgguaaaauaacucucccuugugugugaggggccguguggaaaauuucaagcccuuaaguaugaaaacauaccggucuccagcuauuucucacucaaugggacucguagagcagaugcgagggauggguuagaagucccacucccacacccagggagacuuggaaauauagaaacuccggugccauccgaugacaguccgucaggguugggaagauuugagggguguuguuuuguuuuguuuuguuuccggagaauaguugaauuccaaaguuagugggaaaacuauuuauuucuaauucccaauaaccugaaaagaggaagagagggagggaaggagugagggagcagggagaggggagagggagagagaagagagagggggaaagaggagggagggagggagagagggagagagagagagagagagagagaagagagagagagagagagagagagagagagagagagagagagaggagagagagaggagggagggagggagagagagagagagagagagagagagagagaguguuuucagagaacuucuuugggacuccgcccagagugcaaggccguucacuugaaggaggaaggagccuggcagagcccugaaccuaaccgggcugggaauuccacuugggaagggcucaaaaccuugagagcuccguuccuccgguagcuagcgcaaaccugucagggucucuuuuucccaaccuuuagaaacauugacguucaccaccuaacucuuuguuuaagccagagagcccuugaaaguucagacacaacuccagcuauuucgaggcgcuuaacuccugcacauuuauuugugccagcuucuggguucacugcaagggagcaaugaauaaaaauuacgaggaagaacuaaguucacacagggaaaaggguuuccuaaguuuaaugucuccaaccaaaauccuggagagccucucuuggcuuucgugugauggugcugagguggcucugagccuccacugcccgguuucuggcucggcgagaugacagauguguuaaaugucccauucauuucuuuagugcgauugaacccucccccaagagaagugugcagcccugccaggcugcccugauccuauuagccaugaacuaacugucacuuucagcugguuuuccuuuuugcuuuuuaacacaaagcuuucuccaaaaaaaaaaaaaaaaaaaaaaucuuauuaaccagccuauuucuuucgaugguuuuguucaggacguuuuguguugaugaucgccaugucgcugcuuuaaccauucauggaagugcaucugcgauuuauaucacauuaaaccagaaaccgagcacacuaaagcucucccuugauucaaauuaaaaaguuauuuagggccagacucugggggugaauucaugcuugaagacuggugaaacugcagaguuucugaacccaggacuguuccuguguuaggaggaaaagccuucuagaaugaccagaucaaaaaaguggccauuuaaauauagacguggcacggcaggauuguguacgugcaagaucuguugggggaguuuugaaaguucuuuuuaaaaguucuucagcaaaauagacuaaaacccccuuuucuuccucuccuccuucucucccccuuuucuuuauuuccuguuuuuccuccccaaacuccuccucuccucccucccucccacgcccuucuuauucccuaccccuuuccuuuaccggcucacuucccccaacccccagccccaucagcacauccgagguagcucgaaguucugaagauccuugcgacuauaggugcgggaauuucuauccauccgguacuuccuccucuucggaugagcggaguucaaccucuaccuuuagaauucgcuagguuucugccaagaaagaaaagauuagacagcacagugggucuucccaggucccgccucccgagguuacuuccguggaggugugguuucugcagcccuggaaggcuagcuacccuccucauccuccggcaguuuugcucuccacaauccaaacguaucuaaagcucuguuuuuacgaggccaccuugacucacuauaagguaggucuacccguucaugauccacauagacccuuuccacugguggcaaagagcgaaagugaggguucgcggaggugggggaagcaaggcuggccgccauugaaagaacaaaauuaaauccuaagggaggaaaaaacaaaacaaaauaaaacaaaagccaggaacggaucuuacuuuaaagugauuucugaacgcgccuuuucaaacucguggccaccgagggccacgcgcauggcggccgcgccuaaguccugugacuaauuccauuugaccugagcuugagggguuuugugaguccugacauucacuguaaagucgucguuaucuuuaaguuuaugucggagaaaacauucccauucuuaaaccgcacuucagcuuucugccuuucucuuuccagggaagaaggugcacaccuuuaauccuggcauccaauugguaaaggcaagaggaucucugagaguucgagaccagccuacucuaggcagugaguuccaggcuggccaagucugcaaaguaagacccugucucaaaaagcaaaaccaaagaaaaaagauaagaggagacucgggcuagggggucagguccuacucugcuuugcagcaccaggcugcugcagauccagccccagccccaggcccuagccagagaagcugagugucccuuuugguuaggcaaguaagugccuuuaggaccuccuggcucucaacagaccucuccagccggggagugucuagacuaaggaaacuugggccaccuggcgaggagcuucacagcucucagggaaugaaaguggugccagcuucaggguugcaggaugcuaaggcugccuuuugcaagcugcaaacccacaggcuuugguccuccgcaccgcacuggaacauggagaaaguacacuagaa

SEQ ID NO: 11242 - RNA, 5266 nt, Mus musculus
uucuaguguacuuucuccauguuccagugcggugcggaggaccaaagccuguggguuugcagcuugcaaaaggcagccuuagcauccugcaacccugaagcuggcaccacuuucauucccugagagcugugaagcuccucgccagguggcccaaguuuccuuagucuagacacuccccggcuggagaggucuguugagagccaggagguccuaaaggcacuuacuugccuaaccaaaagggacacucagcuucucuggcuagggccuggggcuggggcuggaucugcagcagccuggugcugcaaagcagaguaggaccugacccccuagcccgagucuccucuuaucuuuuuucuuugguuuugcuuuuugagacagggucuuacuuugcagacuuggccagccuggaacucacugccuagaguaggcuggucucgaacucucagagauccucuugccuuuaccaauuggaugccaggauuaaaggugugcaccuucuucccuggaaagagaaaggcagaaagcugaagugcgguuuaagaaugggaauguuuucuccgacauaaacuuaaagauaacgacgacuuuacagugaaugucaggacucacaaaaccccucaagcucaggucaaauggaauuagucacaggacuuaggcgcggccgccaugcgcguggcccucgguggccacgaguuugaaaaggcgcguucagaaaucacuuuaaaguaagauccguuccuggcuuuuguuuuauuuuguuuuguuuuuuccucccuuaggauuuaauuuuguucuuucaauggcggccagccuugcuucccccaccuccgcgaacccucacuuucgcucuuugccaccaguggaaagggucuauguggaucaugaacggguagaccuaccuuauagugagucaagguggccucguaaaaacagagcuuuagauacguuuggauuguggagagcaaaacugccggaggaugaggaggguagcuagccuuccagggcugcagaaaccacaccuccacggaaguaaccucgggaggcgggaccugggaagacccacugugcugucuaaucuuuucuuucuuggcagaaaccuagcgaauucuaaagguagagguugaacuccgcucauccgaagaggaggaaguaccggauggauagaaauucccgcaccuauagucgcaaggaucuucagaacuucgagcuaccucggaugugcugauggggcuggggguugggggaagugagccgguaaaggaaagggguagggaauaagaagggcgugggagggagggaggagaggaggaguuuggggaggaaaaacaggaaauaaagaaaagggggagagaaggaggagaggaagaaaaggggguuuuagucuauuuugcugaagaacuuuuaaaaagaacuuucaaaacucccccaacagaucuugcacguacacaauccugccgugccacgucuauauuuaaauggccacuuuuuugaucuggucauucuagaaggcuuuuccuccuaacacaggaacaguccuggguucagaaacucugcaguuucaccagucuucaagcaugaauucacccccagagucuggcccuaaauaacuuuuuaauuugaaucaagggagagcuuuagugugcucgguuucugguuuaaugugauauaaaucgcagaugcacuuccaugaaugguuaaagcagcgacauggcgaucaucaacacaaaacguccugaacaaaaccaucgaaagaaauaggcugguuaauaagauuuuuuuuuuuuuuuuuuuuuuggagaaagcuuuguguuaaaaagcaaaaaggaaaaccagcugaaagugacaguuaguucauggcuaauaggaucagggcagccuggcagggcugcacacuucucuugggggaggguucaaucgcacuaaagaaaugaaugggacauuuaacacaucugucaucucgccgagccagaaaccgggcaguggaggcucagagccaccucagcaccaucacacgaaagccaagagaggcucuccaggauuuugguuggagacauuaaacuuaggaaacccuuuucccugugugaacuuaguucuuccucguaauuuuuauucauugcucccuugcagugaacccagaagcuggcacaaauaaaugugcaggaguuaagcgccucgaaauagcuggaguugugucugaacuuucaagggcucucuggcuuaaacaaagaguuagguggugaacgucaauguuucuaaagguugggaaaaagagacccugacagguuugcgcuagcuaccggaggaacggagcucucaagguuuugagcccuucccaaguggaauucccagcccgguuagguucagggcucugccaggcuccuuccuccuucaagugaacggccuugcacucugggcggagucccaaagaaguucucugaaaacacucucucucucucucucucucucucucucucucccucccucccuccucucucucuccucucucucucucucucucucucucucucucucucucucucucuucucucucucucucucucucucucccucucucccucccucccuccucuuucccccucucucuucucucucccucuccccucucccugcucccucacuccuucccucccucucuuccucuuuucagguuauugggaauuagaaauaaauaguuuucccacuaacuuuggaauucaacuauucuccggaaacaaaacaaaacaaaacaacaccccucaaaucuucccaacccugacggacugucaucggauggcaccggaguuucuauauuuccaagucucccugggugugggagugggacuucuaacccaucccucgcaucugcucuacgagucccauugagugagaaauagcuggagaccgguauguuuucauacuuaagggcuugaaauuuuccacacggccccucacacacaagggagaguuauuuuaccgauagccuggagauguaguucuaugaauauuuauugauuuauuuucuagucucagcaggaggccgcagauaaauuuagugcguucuuuaaauaauuccuuuucuaugaggcaagaugucaucugaaacuucuaaauaggcauuuaauuagcccggguguugcuucagaacaaaaaccuccagcgagagcuuuggggacucacuguauagcagagaggccgucgaugcacagcguugaugagcgccggccuuuguugccgccccauugugagggccaugcuuaugaagacuaauccaaucauaaauugcaucccugaaccaaucagagagccuggagccucccgcgaaugaagcccgaguggagaacuuuguugaacuucauugucagagcugucaguuuucaaagagcuggagcgggcgggccacuauaaaaccaucuccuggaccggagagccacagaagacucgcagacgcccaaguaggacgguuaccaggauacugagccaaagagggcaucgggggaggggcgggaagccaggcgcuugcccuccggcccagggaaagggagcuacugccagacccgcucuaaccaugauguuccccggccuccuugcgccucccgcgggauacccuagccuccugcgacccacgcccaccuuaacacugccccagucccuucaauccgcauuuuccggccacucuaguuuccuaguagaagauuugauccgcaucagccggccucccaccuaccugucccgcagcauacccgcugccagccugucaccccccagucaagaggccccugcagcccucgccgacucggggaccucagaccugggcucuccuggguccgggagccggcgaggcaguucuccacagaccgcccucuccccugccagcgagcccacguuucugaaguuuggggugaaugccauccuuuccucggcgccuagaagagguaagauacagccgugcccucgacgugcguuccgcggccugacagccacucaauccuucacaaacuuguuccuccgcgcuuguuagugcacauuuccacgcaggaacucagaccucaagggccagguuacugauuaugaaacgaugguacugagguuuuaaggggaagaaaagucucaggccuuacgaguauccucaaaaugaacuugagccccgggccagugagugcaguuccuuagucgggcgucucagcgcacgcgcuuuggugccugcguucccgcccucaagacuaggaaagagacuuuuugcuuuaaacccaacaaguacguuuauuguguugguuuguacuauuauggauagaucugcaauagcccaccccaccccucccuauuuuccuaagucucuggaauggugaugaaaugggggcacaaaugagacgacgcugcgcaaauuuauuuuacuuagugaauacguucuaaaagaugccucugauaccugcugcagugugaauuagaucguguacgcgaugcuccacacaguauucaaacacaugaucaaauucauucucucucucucucucucucucucucucucucucucucucuucccucgcccuaccagaaacuucgcccgcuuugcugcagagcccuccucccaagacguucgccuuuccauacuucgaaggcucguuccaacccuuuaucagauccuccuauuucccagguaggucucuuucguguuuuucccgcuccgggcuggacagcccguuccagucccggccggucgcucccuaccccgaagucguauuucuccguccaccccucgggguuacgcucugguucagagguugcgaggcguacaacauucacgaauccgucgcgccaauuugauaccccauuuagcacaagcagugacugcuugacacuaugcaccaauucccugcucuacaaauuagcaagaauugucaugguccacauuugaggcgguucccuucccggcgaggagcuguuggcaucccuucaugccgccguuucccacagaguuggugcacuuggccaccauucgccacaaaggucucagcaccgugaccaauuggccagcuccuccggcagccacacgcagaccggcccucgccccuccacgccgccgaaaaacaccuaccagccgcagcuaauuuccuguuaacauucauucagggcugcuuuuuuuucccuccacaagaccgcauggggugcccucuugugugcgaugcuuggggguuaccuaaggguaggaagucuagauccucccgcgaccccaaccuuaucuugccaauuugauuucccaacccuauau

SEQ ID NO: 11243 - RNA, 1372 nt, Mus musculus
aagaaagcgacaaaguagguacuugguaauccuuacaaguggauucccugggcauaguagguguccaugggccuuugggcaucaauaaucccuuucuggagacaaauaaagcaaauacauauuguacagaugauccacuccccgugugggcgagcgaccaugauggggaauuaagguagaacuacagaaacucgcagcugcucuccagguacuauaacuuuaucccuccacagaaagauggcuauugggaucugggugggacuagucccccugcaguuaccgcugagcucagggccacacucgggcgccuuuuaaauucccccagcaauugguggauggagaaagagccagggggaaaaaagaugcauaaugauucguucaccgggcggaugaaacggagaguagaggacgcaggaugcuaacuggcuuuuccucccaugugcaggucaccugaaccgcgaugccuuccagucucugaggaggcucccugaacucgccauauggcuccguuuucaagaggggagaagaaacaguuucaugcccaccugccugcggcaucuccuuucaggcaccccuucccuagccccugcccggcgcgcgagcugccggcauccacggucccgcccgcuccgagcuccggccggcagcucccccggcggccgccucugcaccagucgccaaccuccgugccgggccgaggucaugcccgccugcccccggagccggcgaggccccuucccggugccaggcggcaagcccgagaagcgccggcagggaaggggguccgccgcagaguuggcacccggacucaccagguaggcgcccaccguacccugcgccagcaucaaggcgcacucagacaccaggaagaucuugauguuggagaagcaggacaccuucuuuuucuucuucuuguuccucugcgccucgucccccugcagcucgccgcuccggccgccgcccgacgagccgcccggcuucuuucccugcauccuucccccgccgccgccgccgccgccgcuuucccgcucgccccgggugucguggccguugccgggcgggggugcgugccgcgaggcugcguacuguccccgccccgggcccgcggcggccgcccccguccugccgcggcuagagagguugaaggcuccgcuccucgcugccgccgcgcuagcucccuuccuccuccuccuccuucuccuccuccuccuccuccgcccucccuucgccgccuccuccggcucgggcugugccaaucacagggacuccucgcgucgcccgcugcugccgccgccuagccucucucggacucucgccguugccuucaccggcuuccccuggcccgccggcuucgcuugccuucaccccuagc

SEQ ID NO: 11244 - RNA, 1372 nt, Mus musculus
gcuaggggugaaggcaagcgaagccggcgggccaggggaagccggugaaggcaacggcgagaguccgagagaggcuaggcggcggcagcagcgggcgacgcgaggagucccugugauuggcacagcccgagccggaggaggcggcgaagggagggcggaggaggaggaggaggagaaggaggaggaggaggaagggagcuagcgcggcggcagcgaggagcggagccuucaaccucucuagccgcggcaggacgggggcggccgccgcgggcccggggcggggacaguacgcagccucgcggcacgcacccccgcccggcaacggccacgacacccggggcgagcgggaaagcggcggcggcggcggcggcgggggaaggaugcagggaaagaagccgggcggcucgucgggcggcggccggagcggcgagcugcagggggacgaggcgcagaggaacaagaagaagaaaaagaagguguccugcuucuccaacaucaagaucuuccuggugucugagugcgccuugaugcuggcgcaggguacggugggcgccuaccuggugaguccgggugccaacucugcggcggacccccuucccugccggcgcuucucgggcuugccgccuggcaccgggaaggggccucgccggcuccgggggcaggcgggcaugaccucggcccggcacggagguuggcgacuggugcagaggcggccgccgggggagcugccggccggagcucggagcgggcgggaccguggaugccggcagcucgcgcgccgggcaggggcuagggaaggggugccugaaaggagaugccgcaggcaggugggcaugaaacuguuucuucuccccucuugaaaacggagccauauggcgaguucagggagccuccucagagacuggaaggcaucgcgguucaggugaccugcacaugggaggaaaagccaguuagcauccugcguccucuacucuccguuucauccgcccggugaacgaaucauuaugcaucuuuuuucccccuggcucuuucuccauccaccaauugcugggggaauuuaaaaggcgcccgaguguggcccugagcucagcgguaacugcagggggacuagucccacccagaucccaauagccaucuuucuguggagggauaaaguuauaguaccuggagagcagcugcgaguuucuguaguucuaccuuaauuccccaucauggucgcucgcccacacggggaguggaucaucuguacaauauguauuugcuuuauuugucuccagaaagggauuauugaugcccaaaggcccauggacaccuacuaugcccagggaauccacuuguaaggauuaccaaguaccuacuuugucgcuuucuu

SEQ ID NO: 11245 - RNA, 546 nt, Mus musculus
uuuccaggcuggagauuacaagacuccuccuccacaaucccaugucagcuuucccugacacauagcagaacuuccagcaggguaugggagcauggggcaaugggggcucgugccaccaugaguuugggccagccugggccguacagugugagguucccccucccacacacccccaaauaaggaagaaagaaaaauaaacccuccaaaugacacuagcacaaucgguuuauucacaaauaaauaaauacacaccaggcaaagcuugugccugcuucaucuuuagagcguguacccuauugggcgccuccuuccaaggaggguuggaaugguacagucuggaugagggccagcucccaccccgggaugcccauguugguaucacugccgccucuuccaggaucuacucccuccgaaggugccaagaccaaaggaaaagugucugugcucagacagggugacaaucauccguugcauuguccccuccacucuucaggcaggcggccacuccugcggcggcguccagguuucuagaagagccagcauguc

SEQ ID NO: 11246 - RNA, 546 nt, Mus musculus
gacaugcuggcucuucuagaaaccuggacgccgccgcaggaguggccgccugccugaagaguggaggggacaaugcaacggaugauugucacccugucugagcacagacacuuuuccuuuggucuuggcaccuucggagggaguagauccuggaagaggcggcagugauaccaacaugggcaucccggggugggagcuggcccucauccagacuguaccauuccaacccuccuuggaaggaggcgcccaauaggguacacgcucuaaagaugaagcaggcacaagcuuugccugguguguauuuauuuauuugugaauaaaccgauugugcuagugucauuuggaggguuuauuuuucuuucuuccuuauuugggggugugugggagggggaaccucacacuguacggcccaggcuggcccaaacucaugguggcacgagcccccauugccccaugcucccauacccugcuggaaguucugcuaugugucagggaaagcugacaugggauuguggaggaggagucuuguaaucuccagccuggaaa

SEQ ID NO: 11247 - RNA, 835 nt, Mus musculus
gcgucccgcgccuacccggggucccagcacgccgggccgggcgggcgcaggguggugcagggcugcuggccugggcaccgucccacggguccgaggaccaggcuggggagcagacgcuguucccaucggaaggcaucgguggcugccgaccagcgggacucaggauccaggacucggagcgcggcucgcacaggggcugggccauggcagcggaggccugaccauuggguccgcuguagcuuuauccugagcccuaggugugaagcgggccccuuccagaauucaucagcauaucaaagccggcucgagccaggaggggggcagggccugaacccuuugaaccauagcaggggcucugaggugcaggaccccuuaguccagucugcuccaccuggaccauauuuggggccucaguaagucaggcaccuauggccaggacugccaguugaaagaaccaugcucagagaacugaagucuagcuccuaggcuuaggguacaccuucauuuauuagggacccuacgccauuuuuuuccaucacuuuaauuuacaaauuguauaacaagagacuucgggauugcauuggccaacuguggacuagggaccucuagacacggagagaacucuaguucaguccuucccagaggcuuggauguggccuguaguccucccugauguccaggcuaugggaggcacauugaagaaaccaucccgaccgaccugugagguugcugggguguccgggcagggggagaggugagccugccuccccacacuacaagucacuucuagucuuggcaagauggggagcuugguccccuucccagcccucccaug

SEQ ID NO: 11248 - RNA, 835 nt, Mus musculus
caugggagggcugggaaggggaccaagcuccccaucuugccaagacuagaagugacuuguaguguggggaggcaggcucaccucucccccugcccggacaccccagcaaccucacaggucggucgggaugguuucuucaaugugccucccauagccuggacaucagggaggacuacaggccacauccaagccucugggaaggacugaacuagaguucucuccgugucuagaggucccuaguccacaguuggccaaugcaaucccgaagucucuuguuauacaauuuguaaauuaaagugauggaaaaaaauggcguagggucccuaauaaaugaagguguacccuaagccuaggagcuagacuucaguucucugagcaugguucuuucaacuggcaguccuggccauaggugccugacuuacugaggccccaaauaugguccagguggagcagacuggacuaagggguccugcaccucagagccccugcuaugguucaaaggguucaggcccugccccccuccuggcucgagccggcuuugauaugcugaugaauucuggaaggggcccgcuucacaccuagggcucaggauaaagcuacagcggacccaauggucaggccuccgcugccauggcccagccccugugcgagccgcgcuccgaguccuggauccugagucccgcuggucggcagccaccgaugccuuccgaugggaacagcgucugcuccccagccugguccucggacccgugggacggugcccaggccagcagcccugcaccacccugcgcccgcccggcccggcgugcugggaccccggguaggcgcgggacgc

SEQ ID NO: 11249 - RNA, 435 nt, Mus musculus
augaaaaaagccuuccaucucccacggaaaaaaaaucacaaguuuuaauacuguauauguaucuucuauaaauggaauaauaucauaucugggaguauggcucauaacuggcacugcacucauguuuuaaaacacacauuaaacauaagggucacauucuaaggucacucaagaaauacaaaccaagauuguucaucauucaguuuauuacauguaugaauauuaacaucucauguuacccaucuaauucaaucaaaaccaacaaagaaaaaaaguuaaccauguuuuucauaugaacauucuuauacagaaucccuguaacuuaaaauagaaauguguucaucugcauuaaauugacaauuuuaaaaauauuuucuaaaaaguaaaaucacuuuuaguacuuaaauauauuuguuaguugcuugauggcaucag

SEQ ID NO: 11250 - RNA, 435 nt, Mus musculus
cugaugccaucaagcaacuaacaaauauauuuaaguacuaaaagugauuuuacuuuuuagaaaauauuuuuaaaauugucaauuuaaugcagaugaacacauuucuauuuuaaguuacagggauucuguauaagaauguucauaugaaaaacaugguuaacuuuuuuucuuuguugguuuugauugaauuagauggguaacaugagauguuaauauucauacauguaauaaacugaaugaugaacaaucuugguuuguauuucuugagugaccuuagaaugugacccuuauguuuaauguguguuuuaaaacaugagugcagugccaguuaugagccauacucccagauaugauauuauuccauuuauagaagauacauauacaguauuaaaacuugugauuuuuuuuccgugggagauggaaggcuuuuuucau

SEQ ID NO: 11251 - RNA, 444 nt, Mus musculus
acaggccaacugcagcucuacauuccuaguauacagugauuuauuauuuauuauauugauagaaaauuucuagaaacacuaacucagaacauucuaauguggaaaguaaguacuaacucuaaaauaauaucccuggcuucaucuuccucuaaaauacucaauacccacaacaaacacacauacaaauucccuaugucauccagauguagugacaucuaccuuuaacccuagccuuuaggaggcacagacagguggaucucugaguuaaaaguaggccuggucuacaaagagauugccaggaaagccagagcuacagaaugaaacacuaucuugaaaauaaaaaaaaaaagucaaacaaacaaaacaucacauauuucugugacuuuuaaaauuuccaguaauaaauauucuauuuuaucugaaguacaagaauucaaagaaugu

SEQ ID NO: 11252 - RNA, 444 nt, Mus musculus
acauucuuugaauucuuguacuucagauaaaauagaauauuuauuacuggaaauuuuaaaagucacagaaauaugugauguuuuguuuguuugacuuuuuuuuuuuauuuucaagauaguguuucauucuguagcucuggcuuuccuggcaaucucuuuguagaccaggccuacuuuuaacucagagauccaccugucugugccuccuaaaggcuaggguuaaagguagaugucacuacaucuggaugacauagggaauuuguauguguguuuguuguggguauugaguauuuuagaggaagaugaagccagggauauuauuuuagaguuaguacuuacuuuccacauuagaauguucugaguuaguguuucuagaaauuuucuaucaauauaauaaauaauaaaucacuguauacuaggaauguagagcugcaguuggccugu

SEQ ID NO: 11253 - RNA, 574 nt, Mus musculus
gcugauacugugguuaucacugcggccacugcggcagaacucgguaacugcggcuccagacaaacuaaggcaccugcucuguagcggggacccugggacucaaaccggaucaccaccgccaucaccacgucuucuaaaccaccaaagaaagaugcuggaccgcacagcagcuaccccaucacaccauccccuccagcaggcgcacguguaaacacacacacacacacacacacgaauuuccagaacuggggacauugguaugagaggugggcagaaaagacauuucuaagagaaggagaaccuagcgcgggggcgagccugccuggagugcagucacccaggagcgcgcgcacggaacucuggagccaaggaggcgcgccaagagucaccuggugggacaaaagccgcccagagcuugggaccggcugggucuaagggaaggcugguggcagaguggaggaguaggggccagggcagggggcggaaacuaggaggggcuggcgauguggugggcgggagccugagcgagcagcgccgcgggagcagguggaaccggugcuggagcuagcuuagu

SEQ ID NO: 11254 - RNA, 574 nt, Mus musculus
acuaagcuagcuccagcaccgguuccaccugcucccgcggcgcugcucgcucaggcucccgcccaccacaucgccagccccuccuaguuuccgcccccugcccuggccccuacuccuccacucugccaccagccuucccuuagacccagccggucccaagcucugggcggcuuuugucccaccaggugacucuuggcgcgccuccuuggcuccagaguuccgugcgcgcgcuccugggugacugcacuccaggcaggcucgcccccgcgcuagguucuccuucucuuagaaaugucuuuucugcccaccucucauaccaauguccccaguucuggaaauucguguguguguguguguguguguuuacacgugcgccugcuggaggggauggugugaugggguagcugcugugcgguccagcaucuuucuuuggugguuuagaagacguggugauggcgguggugauccgguuugagucccaggguccccgcuacagagcaggugccuuaguuugucuggagccgcaguuaccgaguucugccgcaguggccgcagugauaaccacaguaucagc

SEQ ID NO: 11255 - RNA, 1359 nt, Mus musculus
gugggggagauaagcagcugagccaggaagagcgcugccaagcggcuccccguccugccgccacccuucgcgugcugacgggaucgugcugcuggcccgguugcucacacucggugucuuguuccuuuccaggguaucagagcaucgccacagaaugaagcugguuuccaucacccugauguuauuggguucacucgcuuuccuaggcgcggacacugcagggccagauacuccuucgcaguuccgaaagaagugaguuugggccgugcuuucuuucuucacuuugaauaccuggcaaugagagaaaacugagagauggucuggagguguuacaaagggaguggagcuggcugggacaucacuugaacuuaggccaaacgcaucugcuuguguuuucuagguggaauaagugggcgcuaagucgugggaagagggaacuacaagcauccagcagcuacccuacgggacucgcugaugagacgacaguuccuacccagacucuugauccauuccuggacgagcagaacacaacuggcccccuacaagccagguaacuaugcucucugcagaggaugugcccucuccacuacucugacccuggggauuguccuggcugcacugcagcugaggcuccggcggagggaacggguuccaggucccucggguacugcauggcuccggucccaggugguugggaccaaagccccgguugaugagguguccuuccuucuucacagcaaucagagcgaagcccacauucgugucaaacgcuaccgccagagcaugaaccaggguucccgcagcaauggaugccgcuucgggaccugcacauuucagaaauuggcccaccagaucuaccagcuaacagacaaagacaaggacggcauggcucccagaaacaagaucagcccucaaggcuauggccgccggcgccggcguucccugcuggagguccuccggucccggacuguggaguccucccaggagcagacacacacagccccaggccccugggcgcacaucuccagacucuuuaggauauaggugcgggugacagcauugaacagucgggcgaguaucccguuggcgccugcggaaucagagaacuucgcaccggggcggacugagacaauccugcagagaucugccuggcugccccuaggggaggcagaggaacccaagaccaagccaggcucaugccagaaaccgagacuuacaggcugauacucuccgggcaggggucugagccacugccuugcccgcucauaaacugguuucucacggggcauaagccucauuacuacuugaacuuuccaaaaccuagcgaggaacgugcaaugcuuguuguccagccaaagg

SEQ ID NO: 11256 - RNA, 1359 nt, Mus musculus
ccuuuggcuggacaacaagcauugcacguuccucgcuagguuuuggaaaguucaaguaguaaugaggcuuaugccccgugagaaaccaguuuaugagcgggcaaggcaguggcucagaccccugcccggagaguaucagccuguaagucucgguuucuggcaugagccuggcuuggucuuggguuccucugccuccccuaggggcagccaggcagaucucugcaggauugucucaguccgccccggugcgaaguucucugauuccgcaggcgccaacgggauacucgcccgacuguucaaugcugucacccgcaccuauauccuaaagagucuggagaugugcgcccaggggccuggggcugugugugucugcuccugggaggacuccacaguccgggaccggaggaccuccagcagggaacgccggcgccggcggccauagccuugagggcugaucuuguuucugggagccaugccguccuugucuuugucuguuagcugguagaucuggugggccaauuucugaaaugugcaggucccgaagcggcauccauugcugcgggaacccugguucaugcucuggcgguagcguuugacacgaaugugggcuucgcucugauugcugugaagaaggaaggacaccucaucaaccggggcuuuggucccaaccaccugggaccggagccaugcaguacccgagggaccuggaacccguucccuccgccggagccucagcugcagugcagccaggacaauccccagggucagaguaguggagagggcacauccucugcagagagcauaguuaccuggcuuguagggggccaguuguguucugcucguccaggaauggaucaagagucuggguaggaacugucgucucaucagcgagucccguaggguagcugcuggaugcuuguaguucccucuucccacgacuuagcgcccacuuauuccaccuagaaaacacaagcagaugcguuuggccuaaguucaagugaugucccagccagcuccacucccuuuguaacaccuccagaccaucucucaguuuucucucauugccagguauucaaagugaagaaagaaagcacggcccaaacucacuucuuucggaacugcgaaggaguaucuggcccugcaguguccgcgccuaggaaagcgagugaacccaauaacaucagggugauggaaaccagcuucauucuguggcgaugcucugauacccuggaaaggaacaagacaccgagugugagcaaccgggccagcagcacgaucccgucagcacgcgaaggguggcggcaggacggggagccgcuuggcagcgcucuuccuggcucagcugcuuaucucccccac

SEQ ID NO: 11257 - RNA, 769 nt, Mus musculus
auggagagggaaucuuucugccuugaaaucugagaaacugacggcugcacugcucagcugcuccacccucuggcaacucaguugccuacaagaaccaaucuaaaguugagguggaaaacacuucucuguuaaucccagggucccaaaucgggguuugcaauugcggcaacugacucuuguucgcuacauauuggcccuaggcucggacucaggaccaauuucucaggaaacgagaauacugaaagcaccaucuaagaagagcuacgcccgacugcgcgcgugaagccuaggagcucagcgucccaagauugguggaucagguguacagagagagagaaacgugagacuggagccugcgcuccagcgaaacugaaggaaggcucugcggaccaguucuguagggaccuaucuggaucgggaucuaacacgaaccacgcuaggacuaaugacuaacggggacugggauugucaggaaagacaaaccaaggacuaacagcgagagcgggagagaagagggagaggaagagaaaaguagaacuacacaccugaacaggaauuuuagggcucaccuggugagcggugccuuggagcugagccugcggggauccugauggagccaggcagugcuugcgaagcggugacucuugauccuggcaguggcuccugugccucccagcgccugcagcugcucuuauucccgccguggugagucgggaggggucucggggcuccaggcagccaauagguggaagggccccaugccccagac

SEQ ID NO: 11258 - RNA, 769 nt, Mus musculus
gucuggggcauggggcccuuccaccuauuggcugccuggagccccgagaccccucccgacucaccacggcgggaauaagagcagcugcaggcgcugggaggcacaggagccacugccaggaucaagagucaccgcuucgcaagcacugccuggcuccaucaggauccccgcaggcucagcuccaaggcaccgcucaccaggugagcccuaaaauuccuguucagguguguaguucuacuuuucucuuccucucccucuucucucccgcucucgcuguuaguccuugguuugucuuuccugacaaucccaguccccguuagucauuaguccuagcgugguucguguuagaucccgauccagauaggucccuacagaacugguccgcagagccuuccuucaguuucgcuggagcgcaggcuccagucucacguuucucucucucuguacaccugauccaccaaucuugggacgcugagcuccuaggcuucacgcgcgcagucgggcguagcucuucuuagauggugcuuucaguauucucguuuccugagaaauugguccugaguccgagccuagggccaauauguagcgaacaagagucaguugccgcaauugcaaaccccgauuugggacccugggauuaacagagaaguguuuuccaccucaacuuuagauugguucuuguaggcaacugaguugccagaggguggagcagcugagcagugcagccgucaguuucucagauuucaaggcagaaagauucccucuccau

SEQ ID NO: 11259 - RNA, 1023 nt, Mus musculus
caauuugcauucuauuuacauguaauuugcaugcaguuuaacuccaagugcgguuauucccaaagcucugagugcccaccaaagaaacuuaggaaauaacguucucaagugcuuugucuacggggugugcuuagccucuucugcauccucuugucuuuguggggacccccggagcuuucuggacgcugcucaggugcccccaccccggcgcaguccggcggccgaugcggcgcgugugcuugggggccccaggcagggacgauggugcccgccacacucccggggccuuugucccucuuccaaagagccgcccccuuggcgaacagaagaagaaggggguaacuggcuaggccgagcuagaacagggggaugaacacucugaucugggggcguccucuggagcaaggucggugggccgauccaaaacuguuuaaucagcuaccgccggccaaggaggggugcuggauccucaucugugcucaucucucccaccagguccaugaaaugugugggguccuuuggggcuucgagccccaguccccuaggaagaggggacguugcacuggguaguccuuaccccuagccuggcugcuuuccucagaggcccaagugcccucgccugggauagaaauucuuccgcuucaccauaagcagccgccccuagauugccagcccacuauuugucccccagcuucagauucccucccuguggugcccacccucucgcgccuuuuuccaagagugcguggccacugcgggcugcaagcuggguuccccagacccugcggcaggugagauuucaggucuccaaaggccggccccugccucaggccauguagugcuuaguucaggaccagcacccuggcuguccucgcaccccaccaaccgccaggcccccuggaaccugcaggcgacgucccucacaggggucacuagcacagggccagauuccccuuuauucccagacgcuuguagucuguccucaccccggaccauagucagagccuuaguucguggauuccc

SEQ ID NO: 11260 - RNA, 1023 nt, Mus musculus
gggaauccacgaacuaaggcucugacuaugguccggggugaggacagacuacaagcgucugggaauaaaggggaaucuggcccugugcuagugaccccugugagggacgucgccugcagguuccagggggccuggcgguugguggggugcgaggacagccagggugcugguccugaacuaagcacuacauggccugaggcaggggccggccuuuggagaccugaaaucucaccugccgcagggucuggggaacccagcuugcagcccgcaguggccacgcacucuuggaaaaaggcgcgagagggugggcaccacagggagggaaucugaagcugggggacaaauagugggcuggcaaucuaggggcggcugcuuauggugaagcggaagaauuucuaucccaggcgagggcacuugggccucugaggaaagcagccaggcuagggguaaggacuacccagugcaacguccccucuuccuaggggacuggggcucgaagccccaaaggaccccacacauuucauggaccuggugggagagaugagcacagaugaggauccagcaccccuccuuggccggcgguagcugauuaaacaguuuuggaucggcccaccgaccuugcuccagaggacgcccccagaucagaguguucaucccccuguucuagcucggccuagccaguuacccccuucuucuucuguucgccaagggggcggcucuuuggaagagggacaaaggccccgggaguguggcgggcaccaucgucccugccuggggcccccaagcacacgcgccgcaucggccgccggacugcgccggggugggggcaccugagcagcguccagaaagcuccggggguccccacaaagacaagaggaugcagaagaggcuaagcacaccccguagacaaagcacuugagaacguuauuuccuaaguuucuuuggugggcacucagagcuuugggaauaaccgcacuuggaguuaaacugcaugcaaauuacauguaaauagaaugcaaauug

SEQ ID NO: 11261 - RNA, 999 nt, Mus musculus
gccgccagccgccgcuccgagaagcuucgccagccgccggucaucguccugcagcgcggcgccugcggccaagguacccgccccgcccugcgcugcacuccuggguggcuccccacucucgccaacucagcccgaccagucaggaccgucgggaggggaugcggaggugcagagaagcacugcgggguguucuaggcauccaguuagugggagagagagacgauggggcucgggguagcuguguuucaaaggcucccuccggcccuauuucugcgccaagcaucgggucguuucgagaaacgccaagcaggugcuuugcgcgcuuugguccagcacccccuggccggggugacuaggcaucgcgcuggggaaagccgcguaucauaccagggaucuuggcaauguugagauacauggcuuugggaucgcaagaacucuugucgccuucccuuccuucucccuuucugcugaguccucucuucuuggaacuaucuaagcaguguuuuucuuauagaaccucuucgugaaaacuuucacuuuggggagagggaacaucucugcucaacucagcaagcauuuuucucaccccgccuccuaagcagaaaacgauuuaguaacuccggcccucuuccuccauugauuuaaaucaacuuuacaaaaacgcccacgauuugguccuuuuuugguccuuugguccuuuugccugaguucaaccagguaguggaccgugaaauuugagguagaggaggggcccacuggggaugaagaaaaaaaugcacccucuacccucucucuccuugugggaccuuucuguacccacaagagcuggacguggugguggcgacaggguaaaggggcuuggagaacugcccagcucccugcaggaccuuccagagaaaagcuucgguuaaauccagagauacccuguggaaaaacaguaaauucauacuggccacuacagcgcuguggggaccagccagcugggcuccaguacauuug

SEQ ID NO: 11262 - RNA, 999 nt, Mus musculus
caaauguacuggagcccagcuggcugguccccacagcgcuguaguggccaguaugaauuuacuguuuuuccacaggguaucucuggauuuaaccgaagcuuuucucuggaagguccugcagggagcugggcaguucuccaagccccuuuacccugucgccaccaccacguccagcucuuguggguacagaaaggucccacaaggagagagaggguagagggugcauuuuuuucuucauccccagugggccccuccucuaccucaaauuucacgguccacuaccugguugaacucaggcaaaaggaccaaaggaccaaaaaaggaccaaaucgugggcguuuuuguaaaguugauuuaaaucaauggaggaagagggccggaguuacuaaaucguuuucugcuuaggaggcggggugagaaaaaugcuugcugaguugagcagagauguucccucuccccaaagugaaaguuuucacgaagagguucuauaagaaaaacacugcuuagauaguuccaagaagagaggacucagcagaaagggagaaggaagggaaggcgacaagaguucuugcgaucccaaagccauguaucucaacauugccaagaucccugguaugauacgcggcuuuccccagcgcgaugccuagucaccccggccagggggugcuggaccaaagcgcgcaaagcaccugcuuggcguuucucgaaacgacccgaugcuuggcgcagaaauagggccggagggagccuuugaaacacagcuaccccgagccccaucgucucucucucccacuaacuggaugccuagaacaccccgcagugcuucucugcaccuccgcauccccucccgacgguccugacuggucgggcugaguuggcgagaguggggagccacccaggagugcagcgcagggcggggcggguaccuuggccgcaggcgccgcgcugcaggacgaugaccggcggcuggcgaagcuucucggagcggcggcuggcggc

SEQ ID NO: 11263 - RNA, 4137 nt, Mus musculus
agcuggguagaggguucucacagggaccuacuugcuaagcaggggacaguccccuggaucggcugggggggggggggggagcgcgcagccuccaccugccugagcaggcagggcgggcugugaggcaccucgaauagcagccagauagaucuuacuaagcgccccuaaccucugcuuugccugggaucuccuagcagccuuuggggggccaccaggugcaccaugaagggaaggcuggcuuggccacgccaaaucugggccccgcguggagcccccgcacaaugucugcgcccuucagcagaaaaagaagcagggcgggaaacguagcucaaaccagaccuguaaaccagagcucacugaagugcuucuaagcggcgcgccuuugggaccccacccaguaugagcagauaacaguucccuguccucagcacuuugaauuugcuuaguugcagguucggccccaggggccaaugcgauaauuccgggcuauuaagaaacucuccccgggugguuucagauauaagaagccauugugauuuuuaccaagucaaaaucacuucuaaaccggugcaccuuguuucccucucccgaccuccgcaccucuaggccucuaaagggccacuacuggcggaaaccagugcacccggggcuaaccucccggcccgaccaucaaucaccgcgcccgcgcucuacacucgcuuccccaagcccucgaccuguaggguuggaggcuccaagccgcccgagcgcucugcccuucccgcuuccuggccgcccaggcgcuuucccuaccaccgcguuguuugcagagugcacacaaaguggcgcgcguuucggagcgcccagcccaaaggagcgcugccgccgagggagaagccagcagcccgcucccgcgcuacuccgcagcagcccugaggacaaacugcgagguagccggugccccgcaguggaagagcuggggcacgagggagcgcgccacggggagcucaccacaaggccgaaggucggguccgcuggcgcaggaggaucggaggagaagggcgggagagcggaugaagugggagcugcugaaguggacgcugcugaaggugagcgagaccccaagggcaguccccagugaaccggggcaacgcccaguccguuggaagacccggggacaaugcccaaauuugggggaaacugggggcaaugcccagucguuuuccuggacacgggagcaacacugcccacguccuggccgccgcgcaguguccagugcguguuuggggcacacacacuuuuccaaaaucugugcugccgcugggacaccguaggagaagugacgaggccgauaccacuguuaugcgcaggacgggaagcugccgaaaguggccagcggaaacaaugaucaaauuucggggaucccaagucagacccuugucugauuugcgguccugggaaugagcggcccaaaguagggggacucgaaggcgacuccauaaaugggaaaacuguggcgaaugacuaaauuugagauuccagaaaaauuagaauccaaguuggggaaugaggaaaauuauucuaugcaaaaauggggggcaucuugauccaggccuaacgaggggaacccaauaucuugguuagaaagcuuggggaacccacaaaauccuagacuaauuuguagaaguuaggugguuuguuguugcuguuggguuuaagaaaauucccaacaugaaauuuaggggagcuuaauuuuaauugcuuaaaaaugggagaugaaaaacaacagauggauuuuagggaauucaggucaguucuuuugaggggugggaguggagacuaggguucacccugaagccagugggcccuacaacacccgggaaaaaucaccucuaauuucuguggcuucagagaaguccucuagagaaugaggaaaugcugucuaaaugugguggaauuagaaaugcaagaaguccauuugagaaagccagaaaaaaucaaugucuuuuaauauuuuaauuuccuaaacagauuccuauugaucuuuuuguugaacaagggggaguuuguauguuuucuuggacaauguuuguucuuggagaaacauacucccuguuuuguggaucaauaaaaauuacccaauggaugaugaaaucuaaauugcagggaauagaauuaguagcuaggaaauuuguaagacacagaccuuuaaaaccuaggaauugggggaucugggacuuuuuuuuucagugugcuuuggggaccauaaaacauuauccaaauauagggagacuccaguagaagucauaaauucaacaaaguucauuaaaguuuaauaaaaaccgaacucuuuggaagaaaaaaaucucaauuuguuuuggaguaccugaauuugggggggcccaggaagauaauuucugaaucuaaaguuuccugguccuucagggccagucucuacauuacaaggaauagagauuauggguuccuaaauuauggggccugagaaccaaucccccaaauuugcaaucugcagagauugugcaagauagugugugugugugugugggggggguguguuugaaauguaggggggcugaguggguguauagcugguauugcagugggagaaaucagaaccuuuuugugacccaaggcuaacacuaaguguguuuuggggggccuggaaaauauugccuaauguuugaggacaccaggcaugagccaacacgggggaugaaaaggauacaggaugguacuggauuuugcaauuggugucugaguuaaaaaaaauuuuuuuuuccaaauuguuaaguuaaagggacccagauuugaugcagaaaaaaaugaucaguguucaaggauuggagacauucaacauucuaauauaaagaaaaaggacuuggccaagaguuaauuuugugccaucugugacccagaaagacauggaacagucauauaagacuugggauagcauggaaagcccucugccacauagaaguucaugccuuacaucauugcucagccugcuuugggggcuuuagugagagaguuuauauuuuauauuuuaaagaacccuaaccauggccagaaugcuugcaggagcucuagggagccccaaagccuugugaccaguguguauucguggaauuuuuugggggggggucuuguuaagugaauuuuagaugugauuggugaauguacucuuuccauuuucuggaauccgagaaaugagagugagggcuauuugaggugucuacauuuaggggaggacauagaaaaaaagguugggacuuugaaggugccaggaaaauuguuaaagcugucugggugggauucaacuuguaaaauuuggaguuagggcaauagacuacagaaucuaguguuccacguuaauaaaaccagaggacggguggcgggggaagagagucagcaggaacauuacugcagauauaaaaugauaggaacauggggaaaacaccccgcuaccucauccccuggagacagugccuaaaugcugucaaaauguccgcucucccaaguaaggaaauuuugucaaaaggacuaaggacccaggcuuacuuuaaauuuuagggaacugagaauggugguuuuauaucuauauauaggagcuugcauuuaaaaugguuaggagccagaagcaaacuugggggcccaagccaaaauauucuaauugugaggagucagcagaggcagaauucccacccuuuaaaauauuuggaaagcaaguaucaaaaacaaaacaaaacaaaacaaaauaaaaaccaaacaacaacaacaacaaaaccuuuucccugugaacagaacaaaugcugaccgauuuuggagcccccacccccaccccccaaagcaaugcuuaaauuucaaggaucucagucaaacuaaguccugagguucagagaagccgguaaguuccucggguuguagggggaccacagagaacuagagcugaauuugagaaagugagcucccgggccgggaaggacagggcgccaggauccgcggugccaaggaacucacacggagcaggggcgcccucacgggggaacccagacgcgggaaaggggcacaggcgacgcagauugggagcacggacgccacagagcgcgcgcccgagccagcuucauuuuucguucuuuc

SEQ ID NO: 11264 - RNA, 4137 nt, Mus musculus
gaaagaacgaaaaaugaagcuggcucgggcgcgcgcucuguggcguccgugcucccaaucugcgucgccugugccccuuucccgcgucuggguucccccgugagggcgccccugcuccgugugaguuccuuggcaccgcggauccuggcgcccuguccuucccggcccgggagcucacuuucucaaauucagcucuaguucucuguggucccccuacaacccgaggaacuuaccggcuucucugaaccucaggacuuaguuugacugagauccuugaaauuuaagcauugcuuuggggggugggggugggggcuccaaaaucggucagcauuuguucuguucacagggaaaagguuuuguuguuguuguuguuugguuuuuauuuuguuuuguuuuguuuuguuuuugauacuugcuuuccaaauauuuuaaagggugggaauucugccucugcugacuccucacaauuagaauauuuuggcuugggcccccaaguuugcuucuggcuccuaaccauuuuaaaugcaagcuccuauauauagauauaaaaccaccauucucaguucccuaaaauuuaaaguaagccuggguccuuaguccuuuugacaaaauuuccuuacuugggagagcggacauuuugacagcauuuaggcacugucuccaggggaugagguagcgggguguuuuccccauguuccuaucauuuuauaucugcaguaauguuccugcugacucucuucccccgccacccguccucugguuuuauuaacguggaacacuagauucuguagucuauugcccuaacuccaaauuuuacaaguugaaucccacccagacagcuuuaacaauuuuccuggcaccuucaaagucccaaccuuuuuuucuauguccuccccuaaauguagacaccucaaauagcccucacucucauuucucggauuccagaaaauggaaagaguacauucaccaaucacaucuaaaauucacuuaacaagacccccccccaaaaaauuccacgaauacacacuggucacaaggcuuuggggcucccuagagcuccugcaagcauucuggccaugguuaggguucuuuaaaauauaaaauauaaacucucucacuaaagcccccaaagcaggcugagcaaugauguaaggcaugaacuucuauguggcagagggcuuuccaugcuaucccaagucuuauaugacuguuccaugucuuucugggucacagauggcacaaaauuaacucuuggccaaguccuuuuucuuuauauuagaauguugaaugucuccaauccuugaacacugaucauuuuuuucugcaucaaaucugggucccuuuaacuuaacaauuuggaaaaaaaaauuuuuuuuaacucagacaccaauugcaaaauccaguaccauccuguauccuuuucaucccccguguuggcucaugccugguguccucaaacauuaggcaauauuuuccaggccccccaaaacacacuuaguguuagccuugggucacaaaaagguucugauuucucccacugcaauaccagcuauacacccacucagccccccuacauuucaaacacaccccccccacacacacacacacacuaucuugcacaaucucugcagauugcaaauuugggggauugguucucaggccccauaauuuaggaacccauaaucucuauuccuuguaauguagagacuggcccugaaggaccaggaaacuuuagauucagaaauuaucuuccugggcccccccaaauucagguacuccaaaacaaauugagauuuuuuucuuccaaagaguucgguuuuuauuaaacuuuaaugaacuuuguugaauuuaugacuucuacuggagucucccuauauuuggauaauguuuuaugguccccaaagcacacugaaaaaaaaagucccagaucccccaauuccuagguuuuaaaggucugugucuuacaaauuuccuagcuacuaauucuauucccugcaauuuagauuucaucauccauuggguaauuuuuauugauccacaaaacagggaguauguuucuccaagaacaaacauuguccaagaaaacauacaaacucccccuuguucaacaaaaagaucaauaggaaucuguuuaggaaauuaaaauauuaaaagacauugauuuuuucuggcuuucucaaauggacuucuugcauuucuaauuccaccacauuuagacagcauuuccucauucucuagaggacuucucugaagccacagaaauuagaggugauuuuucccggguguuguagggcccacuggcuucagggugaacccuagucuccacucccaccccucaaaagaacugaccugaauucccuaaaauccaucuguuguuuuucaucucccauuuuuaagcaauuaaaauuaagcuccccuaaauuucauguugggaauuuucuuaaacccaacagcaacaacaaaccaccuaacuucuacaaauuagucuaggauuuuguggguuccccaagcuuucuaaccaagauauuggguuccccucguuaggccuggaucaagaugccccccauuuuugcauagaauaauuuuccucauuccccaacuuggauucuaauuuuucuggaaucucaaauuuagucauucgccacaguuuucccauuuauggagucgccuucgagucccccuacuuugggccgcucauucccaggaccgcaaaucagacaagggucugacuugggauccccgaaauuugaucauuguuuccgcuggccacuuucggcagcuucccguccugcgcauaacagugguaucggccucgucacuucuccuacggugucccagcggcagcacagauuuuggaaaagugugugugccccaaacacgcacuggacacugcgcggcggccaggacgugggcaguguugcucccguguccaggaaaacgacugggcauugcccccaguuucccccaaauuugggcauuguccccgggucuuccaacggacugggcguugccccgguucacuggggacugcccuuggggucucgcucaccuucagcagcguccacuucagcagcucccacuucauccgcucucccgcccuucuccuccgauccuccugcgccagcggacccgaccuucggccuuguggugagcuccccguggcgcgcucccucgugccccagcucuuccacugcggggcaccggcuaccucgcaguuuguccucagggcugcugcggaguagcgcgggagcgggcugcuggcuucucccucggcggcagcgcuccuuugggcugggcgcuccgaaacgcgcgccacuuugugugcacucugcaaacaacgcggugguagggaaagcgccugggcggccaggaagcgggaagggcagagcgcucgggcggcuuggagccuccaacccuacaggucgagggcuuggggaagcgaguguagagcgcgggcgcggugauugauggucgggccgggagguuagccccgggugcacugguuuccgccaguaguggcccuuuagaggccuagaggugcggaggucgggagagggaaacaaggugcaccgguuuagaagugauuuugacuugguaaaaaucacaauggcuucuuauaucugaaaccacccggggagaguuucuuaauagcccggaauuaucgcauuggccccuggggccgaaccugcaacuaagcaaauucaaagugcugaggacagggaacuguuaucugcucauacuggguggggucccaaaggcgcgccgcuuagaagcacuucagugagcucugguuuacaggucugguuugagcuacguuucccgcccugcuucuuuuucugcugaagggcgcagacauugugcgggggcuccacgcggggcccagauuuggcguggccaagccagccuucccuucauggugcaccugguggccccccaaaggcugcuaggagaucccaggcaaagcagagguuaggggcgcuuaguaagaucuaucuggcugcuauucgaggugccucacagcccgcccugccugcucaggcagguggaggcugcgcgcucccccccccccccccagccgauccaggggacuguccccugcuuagcaaguaggucccugugagaacccucuacccagcu

SEQ ID NO: 11265 - RNA, 602 nt, Mus musculus
caguucucuugcgcuuggcgaagaagucugcgggcgacaacgcgcgucggucagggcggggccggcccagagacccgcgaggagacccgcggagugcgcagggcgcggggccggggugggggcgccauccccgcccgcgccgagguccgcggcgggucagcuuuguuuacgucgccgcgcaaugugcuguguaagcauuuccccuugucccgcggccaagccccccggggcugccgccgcacuuaacccccuccaugccgcacacacggcucccuaaggggcucccgcggcccgagccaaagaccgcgauccgagugggucgcggccaggcucgcccucccacugcacgcucgggagccuuagcugcaccccuaccaguaggaaaggggugcgggcgcaaccgcgcccuaagcgccgcgggcccuuuaaugccacgggaggaggcggggaccgggcgaggcccccgagggcgagggagagcccggccggccggacaaagcgaggccgggccggggcggggccgugcggggcucaccggagaugagaggccccgacagcuucuugaucgcaccguucgcauuggccgcagcagucccgggugc

SEQ ID NO: 11266 - RNA, 602 nt, Mus musculus
gcacccgggacugcugcggccaaugcgaacggugcgaucaagaagcugucggggccucucaucuccggugagccccgcacggccccgccccggcccggccucgcuuuguccggccggccgggcucucccucgcccucgggggccucgcccgguccccgccuccucccguggcauuaaagggcccgcggcgcuuagggcgcgguugcgcccgcaccccuuuccuacugguaggggugcagcuaaggcucccgagcgugcagugggagggcgagccuggccgcgacccacucggaucgcggucuuuggcucgggccgcgggagccccuuagggagccgugugugcggcauggaggggguuaagugcggcggcagccccggggggcuuggccgcgggacaaggggaaaugcuuacacagcacauugcgcggcgacguaaacaaagcugacccgccgcggaccucggcgcgggcggggauggcgcccccaccccggccccgcgcccugcgcacuccgcgggucuccucgcgggucucugggccggccccgcccugaccgacgcgcguugucgcccgcagacuucuucgccaagcgcaagagaacug

SEQ ID NO: 11267 - RNA, 560 nt, Mus musculus
gccacggcgccgcaagcucuacugcgcuaccaaguaccaccuccagcugcacccaagcggccgcgugaacggcagccuugagaacagcgccuauagugaguguucagguccggacagggaggggaggguggcggaagagaccggagggcucgguccccugccgccacguccuagauagaggcagagcugaggucaguccgaagacgccgccgcggucccagcuaccgaacucagcaagcugccccgcccgucccgcucccccaggagcugcgcgggaggcgaccccgguucugacacguuucuauuacucaaugaaaagccguuggacaaggauuuaucgcccucuuuauuguuuugacgaccccggggugcauggccagucccuuucguucucuuugcucucagccgaugcgcggaggacacuccacuaggcagagcucgguuuccgcaacgcggcaucugacgacaggcuugucccgcguccugcgcccugcaagagagcgcgacaggacaaacaggcguccccucguguuccggaugcugcugacacgcacccacag

SEQ ID NO: 11268 - RNA, 560 nt, Mus musculus
cugugggugcgugucagcagcauccggaacacgaggggacgccuguuuguccugucgcgcucucuugcagggcgcaggacgcgggacaagccugucgucagaugccgcguugcggaaaccgagcucugccuaguggaguguccuccgcgcaucggcugagagcaaagagaacgaaagggacuggccaugcaccccggggucgucaaaacaauaaagagggcgauaaauccuuguccaacggcuuuucauugaguaauagaaacgugucagaaccggggucgccucccgcgcagcuccugggggagcgggacgggcggggcagcuugcugaguucgguagcugggaccgcggcggcgucuucggacugaccucagcucugccucuaucuaggacguggcggcaggggaccgagcccuccggucucuuccgccacccuccccucccuguccggaccugaacacucacuauaggcgcuguucucaaggcugccguucacgcggccgcuugggugcagcuggaggugguacuugguagcgcaguagagcuugcggcgccguggc

SEQ ID NO: 11269 - RNA, 830 nt, Mus musculus
aagcgcccaguugcuuuguggguugugccugcccugcgccugcaacuugaguccccgccgcaucgcagucuccgcgccaccuuuguaacggccuucaggaccccgaggugucauggcgagaaaguggaacgggcgugcgguggcccgagcccugguccuggccacucuguggcuggcugugucugggcguccccuggcucagcaaucccagucugugucagaugaagauccacucuuucucuacggcuggggcaagauuacccgccugcaguaccuguacuccgcuggucccuaugucuccaacugcuuccuccgaauccggagcgacggcucuguggacugcgaggaggaccaaaacgaacgaagugaguaucauucagcccguccccuccggucccuuaggacccagaagcacgugggugugucgccguggccuuaacauccucccaccccugacuuccagacuggagcuggggaagggcgaugcaguguggccccgcuguacucacguguugcuggggcccggcaacaucuuucucuugcucgcagauuuguuggaauuccgcgcggucgcucugaagacgauugccaucaaggacgucagcagcgugcgguaccucugcaugagcgcggacggcaagauauacgggcuggugaguguuccuccacgcggcgggaugcucgcggccgcguuggguccguauuguuuuuguuuguuuguuuguucuuucgccuccugcucagguccaaaaggaacuucgagggcaagguaccaaugauaguggggcuaauauugcucuugcccgcccugcguaaagugauggccccag

SEQ ID NO: 11270 - RNA, 830 nt, Mus musculus
cuggggccaucacuuuacgcagggcgggcaagagcaauauuagccccacuaucauugguaccuugcccucgaaguuccuuuuggaccugagcaggaggcgaaagaacaaacaaacaaacaaaaacaauacggacccaacgcggccgcgagcaucccgccgcguggaggaacacucaccagcccguauaucuugccguccgcgcucaugcagagguaccgcacgcugcugacguccuugauggcaaucgucuucagagcgaccgcgcggaauuccaacaaaucugcgagcaagagaaagauguugccgggccccagcaacacgugaguacagcggggccacacugcaucgcccuuccccagcuccagucuggaagucaggggugggaggauguuaaggccacggcgacacacccacgugcuucuggguccuaagggaccggaggggacgggcugaaugauacucacuucguucguuuugguccuccucgcaguccacagagccgucgcuccggauucggaggaagcaguuggagacauagggaccagcggaguacagguacugcaggcggguaaucuugccccagccguagagaaagaguggaucuucaucugacacagacugggauugcugagccaggggacgcccagacacagccagccacagaguggccaggaccagggcucgggccaccgcacgcccguuccacuuucucgccaugacaccucgggguccugaaggccguuacaaagguggcgcggagacugcgaugcggcggggacucaaguugcaggcgcagggcaggcacaacccacaaagcaacugggcgcuu

SEQ ID NO: 11271 - RNA, 523 nt, Mus musculus
cuguggaagagcggcuuugcagacgccuggggcucgcuccaccagggaccuucgccccauagcuccguuugcuuccaagacucgaagggcagcaguggucacagggggaggaggucgagcggacccagaaggaggccuaggggucagaaggccagggggucgugaagacggcauucgcggggcaguuccugauuugacgcuaucccucuuguccauaccgcaccuaaugaggaagacaggaggcuugguaucccagguccugaaccaaucacuacaaaccauccugaagccucccugugcuuccuucuagcaucgccacccaugggugccuaaaccucagccuaaagagccucgauuuguuuuucuucuaagcacccacacccgcucaccaaccuggccgcuuucaaguccuacggcuaccuccauccccaaggcuaagacgcccuguucaguccccacccuccgacccccgaccccgccucugcccuauuacaagaacaacauccacuccccuacccccucg

SEQ ID NO: 11272 - RNA, 523 nt, Mus musculus
cgaggggguaggggaguggauguuguucuuguaauagggcagaggcggggucgggggucggaggguggggacugaacagggcgucuuagccuuggggauggagguagccguaggacuugaaagcggccagguuggugagcgggugugggugcuuagaagaaaaacaaaucgaggcucuuuaggcugagguuuaggcacccauggguggcgaugcuagaaggaagcacagggaggcuucaggaugguuuguagugauugguucaggaccugggauaccaagccuccugucuuccucauuaggugcgguauggacaagagggauagcgucaaaucaggaacugccccgcgaaugccgucuucacgacccccuggccuucugaccccuaggccuccuucuggguccgcucgaccuccucccccugugaccacugcugcccuucgagucuuggaagcaaacggagcuauggggcgaaggucccugguggagcgagccccaggcgucugcaaagccgcucuuccacag

SEQ ID NO: 11273 - RNA, 2466 nt, Mus musculus
ccuucuucagaaagggaggcaaaacccaauuaagaaaaccccuaguaacguuaccaguuuauucuaguauguaacaguuaauaauuuauagcauaguugaucaguaucgcuccugcaggaaagaggugaaauucuuaaaaggaaaggaaaaugcacaauuaagcaacgguuucuuuuaaaacuuggaagcuucggugagaagcaaacgucguuuuuuaggcauuugaggggaaggcaaacuguggagaggccacaccuuguggccuuugggccugcauggcugucacagcagcagcagcagcugaaguguauucucuaggggcgaaggcagaaagucuggccggguuccuccagagcuggaagucuggcucuugcaaacaucucccagcgcccuccuggccaagcacagcaccagaggaaacaaaaacuuaaaaaaaacaauuugcgcagggaacaaugcgacggaguuucgcuuugguuucacacucaagucuaaaugugguuauaauuuucaggcacgcacucauaaaaggcaagagucgaggcagagacuuuuaggaugcggagaagagccccgcgucuguucucaagcgugccguaggcuacacaaaagucgugggaaagcaaaaauacagauguuuccaggcaaacggcccaaagcuguucagccucaaccaucacggucuccaaacaaccagaaacacacccaaagcgguucccccugcacaugaguguaggacucugaguggcguggggugugccuggccacccuuccagccccgacccacucgcgcgccccgccgcugagagccuuggcgaugaggguucaaaucucacuggcuccucgguacccucaccccgccgugguacacgcuaagcuucagucccuuccuaacucucccgcacccaguguauaacaaaggagguuccguaauggaugugcgaucgcugcccacagggacuaggagagggagacccgggggaagaaugcaccuggccgugccacccgcgguacccucgagggccaggcggcuugacugcgccaggcgcuggacaaagaggccucgcggggcgucaggggugcagggagggaggcuggggagcgcagcccgcagggaacucaccuucgcagcugcucggcugcgcuccucguggagcagaagggcggcgaagagcagcagaagccagacgcugagccggggccccaugguggcgcgcccggggcggcaggggaccagcagagacggcggggaaaugcagcccaguucccgugggccacggcgaggugcucagucucggagggcccgggcgugagcccugcucaccgucccgggugcggugacucugcgcagagaccugagcgcgccgcccgaggagcuccccaauuuguuggcgcugcccccuccccucggcagugcgcgggcggcgucuccaaggggaggacccugcggcgcggguaagaggcggaggcugcgcgccgcucgggacuuggugucgcagggaguccgaacgccggggcucugcgcuccgcacccagcuccucccgcgccccgauuccacgagccccuuggcucgccaaucccgggcaagcaccagcaaggcacgccggggccgagaguccggcgcccacggagcagagccaggccggccuggccgccggugugccacgggccaacgcuucuucaggggcccaugcgcgcgggcagcagcuccugacccugaggugagagcgacccccgggaggcacagagagccaggccccaagucgcggaccuguagcgccggaguaggcugaggcugcgcgcuccguuggaucggagcugggggaauagggaucgcgcugcaugggcugaggagcuccaggcagggccuacggagaagaaucucccuuuuucugucuccugaugggacagaacuuuggucaccccgcaaggaaacgagggacauuaugcggagucagggugcuaagaugacgaugcucucucugccugccaccuuugcuaacccgcuuugucucuugccuccagguuaggaagggaucgagccgagucuagagcucaaagacugggaucauggaccgagugcgguucaaagcgucuggcccuccccugcgaggguaagucgccuucugccuggucuccuaggugaaggggaccuugcaugcauauuucaggaguugacaaguuggggcccgcauguuuuggucgcuuucuuacccucccucccucuccugugcagguggcugcugcuagcaacugugacagugggacuccuggcucagagcgucuuggggguaaguaccgcuugaacuccacggcgcuuggaguuccgcgcccgugacggguugggacgcucgcggagccucguggaagacaggcucgucgagcccaccugagugugcgugugcauuguaggugugugcuacugugucugccagccgcucgucccgugcagugcaggagucgg

SEQ ID NO: 11274 - RNA, 2466 nt, Mus musculus
ccgacuccugcacugcacgggacgagcggcuggcagacacaguagcacacaccuacaaugcacacgcacacucaggugggcucgacgagccugucuuccacgaggcuccgcgagcgucccaacccgucacgggcgcggaacuccaagcgccguggaguucaagcgguacuuacccccaagacgcucugagccaggagucccacugucacaguugcuagcagcagccaccugcacaggagagggagggaggguaagaaagcgaccaaaacaugcgggccccaacuugucaacuccugaaauaugcaugcaagguccccuucaccuaggagaccaggcagaaggcgacuuacccucgcaggggagggccagacgcuuugaaccgcacucgguccaugaucccagucuuugagcucuagacucggcucgaucccuuccuaaccuggaggcaagagacaaagcggguuagcaaagguggcaggcagagagagcaucgucaucuuagcacccugacuccgcauaaugucccucguuuccuugcggggugaccaaaguucugucccaucaggagacagaaaaagggagauucuucuccguaggcccugccuggagcuccucagcccaugcagcgcgaucccuauucccccagcuccgauccaacggagcgcgcagccucagccuacuccggcgcuacagguccgcgacuuggggccuggcucucugugccucccgggggucgcucucaccucagggucaggagcugcugcccgcgcgcaugggccccugaagaagcguuggcccguggcacaccggcggccaggccggccuggcucugcuccgugggcgccggacucucggccccggcgugccuugcuggugcuugcccgggauuggcgagccaaggggcucguggaaucggggcgcgggaggagcugggugcggagcgcagagccccggcguucggacucccugcgacaccaagucccgagcggcgcgcagccuccgccucuuacccgcgccgcaggguccuccccuuggagacgccgcccgcgcacugccgaggggagggggcagcgccaacaaauuggggagcuccucgggcggcgcgcucaggucucugcgcagagucaccgcacccgggacggugagcagggcucacgcccgggcccuccgagacugagcaccucgccguggcccacgggaacugggcugcauuuccccgccgucucugcugguccccugccgccccgggcgcgccaccauggggccccggcucagcgucuggcuucugcugcucuucgccgcccuucugcuccacgaggagcgcagccgagcagcugcgaaggugaguucccugcgggcugcgcuccccagccucccucccugcaccccugacgccccgcgaggccucuuuguccagcgccuggcgcagucaagccgccuggcccucgaggguaccgcggguggcacggccaggugcauucuucccccgggucucccucuccuagucccugugggcagcgaucgcacauccauuacggaaccuccuuuguuauacacugggugcgggagaguuaggaagggacugaagcuuagcguguaccacggcggggugaggguaccgaggagccagugagauuugaacccucaucgccaaggcucucagcggcggggcgcgcgagugggucggggcuggaaggguggccaggcacaccccacgccacucagaguccuacacucaugugcagggggaaccgcuuuggguguguuucugguuguuuggagaccgugaugguugaggcugaacagcuuugggccguuugccuggaaacaucuguauuuuugcuuucccacgacuuuuguguagccuacggcacgcuugagaacagacgcggggcucuucuccgcauccuaaaagucucugccucgacucuugccuuuuaugagugcgugccugaaaauuauaaccacauuuagacuugagugugaaaccaaagcgaaacuccgucgcauuguucccugcgcaaauuguuuuuuuuaaguuuuuguuuccucuggugcugugcuuggccaggagggcgcugggagauguuugcaagagccagacuuccagcucuggaggaacccggccagacuuucugccuucgccccuagagaauacacuucagcugcugcugcugcugugacagccaugcaggcccaaaggccacaagguguggccucuccacaguuugccuuccccucaaaugccuaaaaaacgacguuugcuucucaccgaagcuuccaaguuuuaaaagaaaccguugcuuaauugugcauuuuccuuuccuuuuaagaauuucaccucuuuccugcaggagcgauacugaucaacuaugcuauaaauuauuaacuguuacauacuagaauaaacugguaacguuacuagggguuuucuuaauuggguuuugccucccuuucugaagaagg

SEQ ID NO: 11275 - RNA, 1173 nt, Mus musculus
ucauauccucggccuugacgaagaaaguggcuccacccaccaaauugaaacagcuagcggggacacaguuacccugugcugugucggccacacaucuaucgcuacuccagaaacauuaagagguguggggaaagcugaccaauucugcuuucuccucuuacaaacccagagcagcaggcaagccauuuaagccaagcguagaggcggagcucugucggaggcuggaaaaggaguccagagucugacuagucuugacucugagauauugcauucaugagugcucaguggcagguagacagccugagaaaacucggaggcucugccugcaacgcggaguaaagaccagagccaaaggaaagacagggaaaguagaaaucaguccauuucccacgguggcuaaguaaggaacggggaagacagaggagggagggaagcuccccagaccuucacuaacucagcuugaucagaauguauuacauagccaacagauugauacgcgcaagacaaggagucagggauuaggagcgaggcuuuugaguacaucacucuuuuuugguuuuucaagacggguuucucuguauagcccuggcuguccuggaacucacucuguagaccaggguggccucgaacucagaaauccuccugccucugccucccaagugcugggauuaaaggcgugcgccaccacacuuuacacaacauaaaaagucagaacuugggaguuucauacauuggaaaccucucucccugaaacuauaccauacuauuuccggguucguuuguuucacuuaaaguaucuuauuucuuuaucauggaaaagggagaagacagaagcaaauuaaucgggaaaguccaagacgaaguuguacacgcacuaaaaauaauucacuaccuaucuuaaaaaugccaguacaggaagcuauuccacucacgugacuugcgcaccagccaagacucggcacuggguaaauaaccgugagucgaggaggcugggcgauuccaacucuacuucccagucgccuuacauccagcagagugguccaacgcucucugacucaguuuccucguucauaaagaagucgguaauagcagcggugcucaacucccaaggcugcuuuguacaccaaaggagggcacccugagggggacauuaaagcaccuaagaagcgagag

SEQ ID NO: 11276 - RNA, 1173 nt, Mus musculus
cucucgcuucuuaggugcuuuaaugucccccucagggugcccuccuuugguguacaaagcagccuugggaguugagcaccgcugcuauuaccgacuucuuuaugaacgaggaaacugagucagagagcguuggaccacucugcuggauguaaggcgacugggaaguagaguuggaaucgcccagccuccucgacucacgguuauuuacccagugccgagucuuggcuggugcgcaagucacgugaguggaauagcuuccuguacuggcauuuuuaagauagguagugaauuauuuuuagugcguguacaacuucgucuuggacuuucccgauuaauuugcuucugucuucucccuuuuccaugauaaagaaauaagauacuuuaagugaaacaaacgaacccggaaauaguaugguauaguuucagggagagagguuuccaauguaugaaacucccaaguucugacuuuuuauguuguguaaagugugguggcgcacgccuuuaaucccagcacuugggaggcagaggcaggaggauuucugaguucgaggccacccuggucuacagagugaguuccaggacagccagggcuauacagagaaacccgucuugaaaaaccaaaaaagagugauguacucaaaagccucgcuccuaaucccugacuccuugucuugcgcguaucaaucuguuggcuauguaauacauucugaucaagcugaguuagugaaggucuggggagcuucccucccuccucugucuuccccguuccuuacuuagccaccgugggaaauggacugauuucuacuuucccugucuuuccuuuggcucuggucuuuacuccgcguugcaggcagagccuccgaguuuucucaggcugucuaccugccacugagcacucaugaaugcaauaucucagagucaagacuagucagacucuggacuccuuuuccagccuccgacagagcuccgccucuacgcuuggcuuaaauggcuugccugcugcucuggguuuguaagaggagaaagcagaauuggucagcuuuccccacaccucuuaauguuucuggaguagcgauagauguguggccgacacagcacaggguaacuguguccccgcuagcuguuucaauuugguggguggagccacuuucuucgucaaggccgaggauauga

SEQ ID NO: 11277 - RNA, 552 nt, Mus musculus
cugaagcagggagaaaagcaaaaaaccucgagaaugauguuugugaaggcucacgguaacuuagaauacuguacguucagggacguuuuaaagccuguuggcugauugcaauuuuguugcuacugcgaugaacaguaugcaaagaaaacacuacgcacucuugucacugcauaagaagaccuggucccucuggagagaaaaguaaaacuccuuaaaagauaaaugaacccaaccuaguauuuggagaggaguuuggcccuagaaaaggaaggcuugcccuccaguuagaggaaggcgaccaggguucuaguugcagauguacuggcagaaguucaagucacccucagacuccaggcagagcucaggugaacccugucuacaggucggagucacagggcagcgaauuuuggcagggccgagugcugcgagaggaggaaccaccuugggagguggcugucuucuuuucuucucccucaagcacauccaucggguugguguaggacuuggguggcggucguggcaucgggaauccaaccuugagcuugcuggugu

SEQ ID NO: 11278 - RNA, 552 nt, Mus musculus
acaccagcaagcucaagguuggauucccgaugccacgaccgccacccaaguccuacaccaacccgauggaugugcuugagggagaagaaaagaagacagccaccucccaaggugguuccuccucucgcagcacucggcccugccaaaauucgcugcccugugacuccgaccuguagacaggguucaccugagcucugccuggagucugagggugacuugaacuucugccaguacaucugcaacuagaacccuggucgccuuccucuaacuggagggcaagccuuccuuuucuagggccaaacuccucuccaaauacuagguuggguucauuuaucuuuuaaggaguuuuacuuuucucuccagagggaccaggucuucuuaugcagugacaagagugcguaguguuuucuuugcauacuguucaucgcaguagcaacaaaauugcaaucagccaacaggcuuuaaaacgucccugaacguacaguauucuaaguuaccgugagccuucacaaacaucauucucgagguuuuuugcuuuucucccugcuucag

SEQ ID NO: 11279 - RNA, 1415 nt, Mus musculus
cuccaauucuccccaacucugcccgugggcccugccaacacaagucucuuuucacucccagcuggugaccagcaucccucgaaaguuuugcgcugccaucugcagccacguagggcacaguggugcgcucaggaugcacgggaccugugugcaccacgguuuccaggcucaggguguauccaaacaguugcauuauggaaacuuugcuagacuugcuuaauaaagucuccacgcucugccugaaguuuaacucauaugaaagggagaguauuucuggguugaagaguugcgaaagaguuuucucuucagucuuguaaaguccugcagugacuuauguguguguguugggggguggggguggcacccuucucagaggagaaugagggaaggaacuaaauggggguacugggaggagaaggggagcuguuugggauguaaagugaauacauuuaaaaauuaauaacaaaccguuuuuuuuucaaguggauaagaggcugacucgauuuucccguucagaacuuggcgggccuaugauguauuggagaaacccagagguucugcgaggauggaauauaauugguuauuauccaaagaaugucaauuagcuuuuuuuauuuucauggaaaagggcaaauuuguaaccaaugaaauauaauuagaaggagcacgauauucaccuugauugguuaaaaacgacagcuugaaaaucugcaucggcaaaggcaggagccagugaucccugaugucacugguuuagugugcagccuuuaauuagccaauuugacagaauacaauguuuacaauccacgugcuuagguuucuuuuuuaaaagguuuuuauaaugagcguauaauuacccacaauaacguaauauguuuugcucauugaauaccaccuacuuuggcacugccugucaaacucaucuuaacauuccuguuggucuagguaugagcuguucacauucuccuuaaauaccuuuacauauuuagaacauauucacuuuauauugggcgagagucaugcuuuuccuugaaaaaugcuuucuuaacauauuuuucucuguucuauauauuucuuacaauggaaauguauuuuuuauauaauuugcuguaauuaaaacuauuuacuaaaaucagccuguucagugcuguagaucauacugcaucccuggagagcuacagacucuggaucuuuccaaacucaaacugaccguuuagcagugacaaguguguuccuucaucccugaaccccucuaccuucacaggguuagcuggauacuccagguaaacggaagccagaugcgccugggucuagcuuauuucacuaggcagaauguccucaagguguaugcaucuugugacucuauaaacugaccucaugaccaguccauggugugguuaaaagggaguuguugg

SEQ ID NO: 11280 - RNA, 1415 nt, Mus musculus
ccaacaacucccuuuuaaccacaccauggacuggucaugaggucaguuuauagagucacaagaugcauacaccuugaggacauucugccuagugaaauaagcuagacccaggcgcaucuggcuuccguuuaccuggaguauccagcuaacccugugaagguagagggguucagggaugaaggaacacacuugucacugcuaaacggucaguuugaguuuggaaagauccagagucuguagcucuccagggaugcaguaugaucuacagcacugaacaggcugauuuuaguaaauaguuuuaauuacagcaaauuauauaaaaaauacauuuccauuguaagaaauauauagaacagagaaaaauauguuaagaaagcauuuuucaaggaaaagcaugacucucgcccaauauaaagugaauauguucuaaauauguaaagguauuuaaggagaaugugaacagcucauaccuagaccaacaggaauguuaagaugaguuugacaggcagugccaaaguaggugguauucaaugagcaaaacauauuacguuauuguggguaauuauacgcucauuauaaaaaccuuuuaaaaaagaaaccuaagcacguggauuguaaacauuguauucugucaaauuggcuaauuaaaggcugcacacuaaaccagugacaucagggaucacuggcuccugccuuugccgaugcagauuuucaagcugucguuuuuaaccaaucaaggugaauaucgugcuccuucuaauuauauuucauugguuacaaauuugcccuuuuccaugaaaauaaaaaaagcuaauugacauucuuuggauaauaaccaauuauauuccauccucgcagaaccucuggguuucuccaauacaucauaggcccgccaaguucugaacgggaaaaucgagucagccucuuauccacuugaaaaaaaaacgguuuguuauuaauuuuuaaauguauucacuuuacaucccaaacagcuccccuucuccucccaguacccccauuuaguuccuucccucauucuccucugagaagggugccacccccaccccccaacacacacacauaagucacugcaggacuuuacaagacugaagagaaaacucuuucgcaacucuucaacccagaaauacucucccuuucauaugaguuaaacuucaggcagagcguggagacuuuauuaagcaagucuagcaaaguuuccauaaugcaacuguuuggauacacccugagccuggaaaccguggugcacacaggucccgugcauccugagcgcaccacugugcccuacguggcugcagauggcagcgcaaaacuuucgagggaugcuggucaccagcugggagugaaaagagacuuguguuggcagggcccacgggcagaguuggggagaauuggag

SEQ ID NO: 11281 - RNA, 776 nt, Mus musculus
gcuuucgaucuggacuguucucaggcaagccggggacuaacuuuuaguuuugcuccugcgauuauucaacugacgggcuuucauuuccauuuuacacacccuaacaacacucacaccuugcgggauuguauugguagcguggaaaaaaaaaagcacauugagagguaacauuuuuuuuuuucaaauaauaguuguggcugugcguguguuuucucucgagggcauguugacggggacaggaggagcuauguauguaugugcguccugaugcuuugacacgauguuuugcagacggaaaaaugccgggguucauaaauauuaauaccgauuuuuggaggaagagucggcgcaguuauggaucaucugauuuuaggggaagcaggggucugcugcuguugccgcugguacuggggcugcugaggcugcaaagaggaggagguagagagggaggaggaggagguuagugaagguuuaauuucacuuuuggauuugcagaugagaagagguggcuccauggacacagaucugcucugugugauucugcgcuccaggugucguguguuguggguacagguccguuggaguccggccucauuuaaaauaaaauugguguguguguguguguguguguguuguauguguaugaguguuuacagacacugucgccaccagguccgaggaagggaaccggguucuucucggugcccagcggcccuucuuucccggcggucucugguguaaauagacuggcacccgcggucccuagaugcccgugc

SEQ ID NO: 11282 - RNA, 776 nt, Mus musculus
gcacgggcaucuagggaccgcgggugccagucuauuuacaccagagaccgccgggaaagaagggccgcugggcaccgagaagaacccgguucccuuccucggaccugguggcgacagugucuguaaacacucauacacauacaacacacacacacacacacacacaccaauuuuauuuuaaaugaggccggacuccaacggaccuguacccacaacacacgacaccuggagcgcagaaucacacagagcagaucuguguccauggagccaccucuucucaucugcaaauccaaaagugaaauuaaaccuucacuaaccuccuccuccucccucucuaccuccuccucuuugcagccucagcagccccaguaccagcggcaacagcagcagaccccugcuuccccuaaaaucagaugauccauaacugcgccgacucuuccuccaaaaaucgguauuaauauuuaugaaccccggcauuuuuccgucugcaaaacaucgugucaaagcaucaggacgcacauacauacauagcuccuccuguccccgucaacaugcccucgagagaaaacacacgcacagccacaacuauuauuugaaaaaaaaaaauguuaccucucaaugugcuuuuuuuuuuccacgcuaccaauacaaucccgcaaggugugaguguuguuaggguguguaaaauggaaaugaaagcccgucaguugaauaaucgcaggagcaaaacuaaaaguuaguccccggcuugccugagaacaguccagaucgaaagc

SEQ ID NO: 11283 - RNA, 300 nt, Mus musculus
acauaaacaaacccagaggcuagggggaaggagaggaggaugaaggcggggacagagaaaucgauuugcagcuccgggacaaucggauccucucuucucggguaaucucgaaccggcagggagacugguucgucucugagcucacccgaaaggcgccaggccagaaauuccggaguacaagucgcccugagcgggagggcaauggaagaauuccuccaugguccugaugggaucgcagcgaggaaggcgcggcagcgacagcgagcagaggcaacccagucuggacuggucccugagagg

SEQ ID NO: 11284 - RNA, 300 nt, Mus musculus
ccucucagggaccaguccagacuggguugccucugcucgcugucgcugccgcgccuuccucgcugcgaucccaucaggaccauggaggaauucuuccauugcccucccgcucagggcgacuuguacuccggaauuucuggccuggcgccuuucgggugagcucagagacgaaccagucucccugccgguucgagauuacccgagaagagaggauccgauugucccggagcugcaaaucgauuucucuguccccgccuucauccuccucuccuucccccuagccucuggguuuguuuaugu

SEQ ID NO: 11285 - RNA, 1603 nt, Mus musculus
augccggcagaguauuucauucucuucuguuucugccucugguugcagaaccagacgcgcaccacauuuuucuugagauccagcuuuucggcgauggccgcgaucuucuccgaggagggccuuggcuggauggcgaaguaggcuuccagagagcgcuucuccggcgccgcgauggacgugcgcuugcgcuucuucuccgcgccauugaagagcuccggcuuagugagcuucucgcggugggauuucucagcuuccuccagccacgccugcaggaugggcuugagcgcgaucauguuguugugugacagcgugagagacucaaaccugcagauggugcucuggcugagcgagcccacgcccgggaucuugagguuggccagcgccgagcccacaucugccugggucacucccagcuugaugcgucgcugcuugaaacgcucggcgaacgccuccaggucccgcgggucugcauccacgucgcucaugcagcccaugugcgagggcagcccaugugcgugggccaugcucagggcugcuuggugcaugggguucaugguggccauguguggugcgugagccggaguggacaccaccgugccgucggggcccgccauagcucccagggccagcccggggcuuaggugcucaagcagcucgcccuccagcgccuggugcggcuggugaugguggugaugguggugguggugguggugaugggugccagccagagcggacgggugcgagaugggcacagaagaagaggaggcugccgacgugcacgggaugguguucauggugugguaaguggcguccggcuugaaggggcugugguggggcggaugguggugguggcucuuacucugggagacgauguccacggcggccagagccucggcacgggccagcagacucucauccagcccgccgaauauauugcucugcaauuguaaguagaaggcacacauuacgcucagcagggaauugugagcgcucucuccggaagcccccggcccagggcucgccaccgccaccgugccuacagcauucccagaacguuaaaauaauaauaaugacagugauccugaaacucggcagcgagaagagaggggaagccugcgcgagaagccaaugugcagggggaggaaaagugagccacagacaacacaacacaacacaacacaacacgcgcacaggcagcaucccaggucauaaaaauuaauaugaaaggcaagacccguugaauacuuaagagaggggggauugguuggagguguggggugauuugcugugcagacaugaaaaaaacaucaagcagauaaaggaggcugucaaaaugugccuuuaagcggugauuaugcagacauacgcaccggugggguuggaagacaagcucuccgcaucgccuccgagcccccgccgccgccgcugccgccgcugccacugcugcuggaacugcugcuccggccgccgccgccuccgccuccgccgccaccgccgccgccgccagcguugcuggagcugcuaggggaacuggccgagggcgccgcgggcgcagaggagcccggggaggcacuguguagcgccgaguacuugggcuccacgu

SEQ ID NO: 11286 - RNA, 1603 nt, Mus musculus
acguggagcccaaguacucggcgcuacacagugccuccccgggcuccucugcgcccgcggcgcccucggccaguuccccuagcagcuccagcaacgcuggcggcggcggcgguggcggcggaggcggaggcggcggcggccggagcagcaguuccagcagcaguggcagcggcggcagcggcggcggcgggggcucggaggcgaugcggagagcuugucuuccaaccccaccggugcguaugucugcauaaucaccgcuuaaaggcacauuuugacagccuccuuuaucugcuugauguuuuuuucaugucugcacagcaaaucaccccacaccuccaaccaauccccccucucuuaaguauucaacgggucuugccuuucauauuaauuuuuaugaccugggaugcugccugugcgcguguuguguuguguuguguuguguugucuguggcucacuuuuccucccccugcacauuggcuucucgcgcaggcuuccccucucuucucgcugccgaguuucaggaucacugucauuauuauuauuuuaacguucugggaaugcuguaggcacgguggcgguggcgagcccugggccgggggcuuccggagagagcgcucacaauucccugcugagcguaaugugugccuucuacuuacaauugcagagcaauauauucggcgggcuggaugagagucugcuggcccgugccgaggcucuggccgccguggacaucgucucccagaguaagagccaccaccaccauccgccccaccacagccccuucaagccggacgccacuuaccacaccaugaacaccaucccgugcacgucggcagccuccucuucuucugugcccaucucgcacccguccgcucuggcuggcacccaucaccaccaccaccaccaccaucaccaccaucaccagccgcaccaggcgcuggagggcgagcugcuugagcaccuaagccccgggcuggcccugggagcuauggcgggccccgacggcacggugguguccacuccggcucacgcaccacacauggccaccaugaaccccaugcaccaagcagcccugagcauggcccacgcacaugggcugcccucgcacaugggcugcaugagcgacguggaugcagacccgcgggaccuggaggcguucgccgagcguuucaagcagcgacgcaucaagcugggagugacccaggcagaugugggcucggcgcuggccaaccucaagaucccgggcgugggcucgcucagccagagcaccaucugcagguuugagucucucacgcugucacacaacaacaugaucgcgcucaagcccauccugcaggcguggcuggaggaagcugagaaaucccaccgcgagaagcucacuaagccggagcucuucaauggcgcggagaagaagcgcaagcgcacguccaucgcggcgccggagaagcgcucucuggaagccuacuucgccauccagccaaggcccuccucggagaagaucgcggccaucgccgaaaagcuggaucucaagaaaaauguggugcgcgucugguucugcaaccagaggcagaaacagaagagaaugaaauacucugccggcau

SEQ ID NO: 11287 - RNA, 296 nt, Mus musculus
ccuacccacggggcuaacgcuucccuaacuaggaagccgcuuucccgcgccggucgccacacgcgucugccgccgccgcucccgccgagaaccagaggccgcgaauggcuuccccuccccccgcgcaacgucaacgcgacgucggucgucgccguaaugucucgaguauacgcgcauagacauagcaggcauuggcgcgcgcagccgccgccacggcgcagcccgguaccggcccagcgcacgccgcgggucucucgggcucagggcagagugagagacgcucucugcaaggcaug

SEQ ID NO: 11288 - RNA, 296 nt, Mus musculus
caugccuugcagagagcgucucucacucugcccugagcccgagagacccgcggcgugcgcugggccgguaccgggcugcgccguggcggcggcugcgcgcgccaaugccugcuaugucuaugcgcguauacucgagacauuacggcgacgaccgacgucgcguugacguugcgcggggggaggggaagccauucgcggccucugguucucggcgggagcggcggcggcagacgcguguggcgaccggcgcgggaaagcggcuuccuaguuagggaagcguuagccccguggguagg

SEQ ID NO: 11289 - RNA, 315 nt, Mus musculus
aauucuuugaaauagucugcucuuaaagugauugaaacguuuuggguuaaauaaaauuaguauauaauuaauaucacagacuggagagguggcucagccauuaaaggcuaggcucaaaaccaaaagcauaauuaauauaccucuuaauaaauauuuaagaagaauaauacugaauuuaaaauguguguuuuucuuuucaaaggcauauuuaauuaggcucucugguuugaacaagaugguguaucagagcugucuuaaaucuuuugaguguuuacuaggauuaaauucaaauguuggaaucagagaccuagcugu

SEQ ID NO: 11290 - RNA, 315 nt, Mus musculus
acagcuaggucucugauuccaacauuugaauuuaauccuaguaaacacucaaaagauuuaagacagcucugauacaccaucuuguucaaaccagagagccuaauuaaauaugccuuugaaaagaaaaacacacauuuuaaauucaguauuauucuucuuaaauauuuauuaagagguauauuaauuaugcuuuugguuuugagccuagccuuuaauggcugagccaccucuccagucugugauauuaauuauauacuaauuuuauuuaacccaaaacguuucaaucacuuuaagagcagacuauuucaaagaauu

SEQ ID NO: 11291 - RNA, 2954 nt, Mus musculus
uugcaccuauaaggagccguuggagagggaaccacggcgagaaaggccuaggcauugagcguuuaaagacagccccuauacuccaggcugagaaacuucaguugagcgcagucagaagggagcagggagggcgagucucccagcccacgcccugaacuccuggaagcuucccuaagucuuucugcuaagucaucagaggaggccccaaggcuccaugguuacuccuguggacccgugggcagagccuaguuuuccagcuccuaguaaggaaccaacaucauuuucuccuuggucuuugcccuuuuuucucggucgcccagcgacucucaucaccccuucuuggagaggcuucuaagccuggcuaccuaagcccgaacgacuucugccauugcuguccucagacccagcucaucuuuuccuguagauucuuuaaacaacggccgggggugggggggaagaaacaccaaaaacaccaaagaaccaugcagcaaaccgguccauguggcagaccugccgguuauagucaaaaguggcaacagcucauuuauuuagccaaaaaauagauacuuucuuguacaauuugguucacacguauguacauuuucccguauauacaaaaagagucagacaggcuuguucucuccguaaccccacuccccccccccccgaaaucaacacaacgaaggaaccucacaaucuaaauguggggugacuugggggagggccaagguggggggacuggcuuucuuucuuucuuuuguccuuuccuguuguuguuguuguuguuguuguuguuuaguguuucuuuuaagguaaucauacacagacaugcuugcaacucgucacuauacagagcgauuuuguuuuguuuuguuuuuuacaauuaguacaacgauuuaaaaaugguugaaaaguuaagacgaggagagagcugauaagaccagagcagcguccagaugguucuguggccuggaagagaacggaagcagagacagugagcuuuagaguuggggagacugcuuagauaggggauccccuauaaagccgguguuuagcugugggaguauuaacuaaaagcugagcuaaagagaucagaagucaagaccgggcuuggaaggaaguggacauuacgcagaggccuucugcgccacaggccucuuguaagggccagacuuccccuagcucuguaccacaggccugaggugcuccagccgagaauggaaccgugucuauggguccacaagaagugacagaagaguggauuuuuuggguccuuuagcaauaguuugccagcuacuuugcuaccuucccagggggcaaagggcucccgccacuggcucuguguuuuucuuauuccucccgaagggucucccacuaugcuucccaaauucggagucucuuaccgccuuggcaccggcuggaaagcugucuugaguaacuuuuucuccacuuccaaggcacuacagcgaucuguaggaaacagagggaagaaaaaggaggccuuuaaaacacaggcuccaggccuccagggcagcugcacccgccugcgagcaaagaggaaaacaccggcgucccacacacccccaaagccccguucuuucccuuuagucuaggcgagagccccaccaacacccucccacugugccccuacauuuuucuugucaccuguuccacucuccggcucggcaggccgagcauaggcggcugcggccgcagcgggaugaccugcggcuccgggaagucccagcaggugcuguggggccgagcccagcauggacagcgggugcggccgcggaccggccggcggcccugggaaaggccuguugguccaagcggggaauuugccaagcggcgccgacacgagucugugugccgcugcagccgcugcagcggccgcgggcgagagcugcagcgucgggggcgcaacggcugcgccgggaggcgaaccuccggcuccgggaggcgagcggcguggguuguccgggcugguggccgucucggccagugaccagaucuugggcuucuggagggcggaggagggcgccggggccggagcgcagggauccaggcuggaggguggagaagguggagaugcaggagcccuggccacgggcgguggcgguggggccaggcucaggaccgacaguggucgguccuccaagccuucggagcugucguccgagucgcuaguuuugcaguccgaaaugggucccaggccgaagucgccguuccugugcgccgccccagccagggucagcuccgacccggcugccgcgcugucuaaguuuuccaaaucgaucuccucauccucgucgucgucggccagccccucgccccccguguccuccuccucuccugcgagcuccuccuccuccaucuccagcucgcguuugcucucuuccucgucuuccucuucguccuccuccucccgcucgcucccauaagcauugcccuccucguccgugcgacuacggggagcccacgucaucuuguucuccuucuugaggcgccggcgcgcguuggcgaaccagguggacaccugggugagggucaucuuggugaugauggccaacaugaucuucucgcccuuggugggguacggguucuugcggugcucguugagccaggccuugagcgugcucgugcuuucccggguggcguucuugggacgggacggguccccgaacugguacuggccauagggguagaaggcggggugcgggugcgggaacgcggcggccguggccggaugcuggacgccagggcuguccuucagcucauacugagcgcccuguacgcacauggaaaaggaaggggacacgcgcgcagggagcgcgagugagcuccugccguccccaccuuuauccucccgccgggaccccagcuuucuucugcacgcucaccuugccccacaccccaacuccaaccccucucucccggguuucucuggcucu

SEQ ID NO: 11292 - RNA, 2954 nt, Mus musculus
agagccagagaaacccgggagagagggguuggaguugggguguggggcaaggugagcgugcagaagaaagcuggggucccggcgggaggauaaagguggggacggcaggagcucacucgcgcucccugcgcgcguguccccuuccuuuuccaugugcguacagggcgcucaguaugagcugaaggacagcccuggcguccagcauccggccacggccgccgcguucccgcacccgcaccccgccuucuaccccuauggccaguaccaguucggggacccgucccgucccaagaacgccacccgggaaagcacgagcacgcucaaggccuggcucaacgagcaccgcaagaacccguaccccaccaagggcgagaagaucauguuggccaucaucaccaagaugacccucacccagguguccaccugguucgccaacgcgcgccggcgccucaagaaggagaacaagaugacgugggcuccccguagucgcacggacgaggagggcaaugcuuaugggagcgagcgggaggaggaggacgaagaggaagacgaggaagagagcaaacgcgagcuggagauggaggaggaggagcucgcaggagaggaggaggacacggggggcgaggggcuggccgacgacgacgaggaugaggagaucgauuuggaaaacuuagacagcgcggcagccgggucggagcugacccuggcuggggcggcgcacaggaacggcgacuucggccugggacccauuucggacugcaaaacuagcgacucggacgacagcuccgaaggcuuggaggaccgaccacugucgguccugagccuggccccaccgccaccgcccguggccagggcuccugcaucuccaccuucuccacccuccagccuggaucccugcgcuccggccccggcgcccuccuccgcccuccagaagcccaagaucuggucacuggccgagacggccaccagcccggacaacccacgccgcucgccucccggagccggagguucgccucccggcgcagccguugcgcccccgacgcugcagcucucgcccgcggccgcugcagcggcugcagcggcacacagacucgugucggcgccgcuuggcaaauuccccgcuuggaccaacaggccuuucccagggccgccggccgguccgcggccgcacccgcuguccaugcugggcucggccccacagcaccugcugggacuucccggagccgcaggucaucccgcugcggccgcagccgccuaugcucggccugccgagccggagaguggaacaggugacaagaaaaauguaggggcacagugggaggguguugguggggcucucgccuagacuaaagggaaagaacggggcuuugggggugugugggacgccgguguuuuccucuuugcucgcaggcgggugcagcugcccuggaggccuggagccuguguuuuaaaggccuccuuuuucuucccucuguuuccuacagaucgcuguagugccuuggaaguggagaaaaaguuacucaagacagcuuuccagccggugccaaggcgguaagagacuccgaauuugggaagcauagugggagacccuucgggaggaauaagaaaaacacagagccaguggcgggagcccuuugcccccugggaagguagcaaaguagcuggcaaacuauugcuaaaggacccaaaaaauccacucuucugucacuucuuguggacccauagacacgguuccauucucggcuggagcaccucaggccugugguacagagcuaggggaagucuggcccuuacaagaggccuguggcgcagaaggccucugcguaauguccacuuccuuccaagcccggucuugacuucugaucucuuuagcucagcuuuuaguuaauacucccacagcuaaacaccggcuuuauaggggauccccuaucuaagcagucuccccaacucuaaagcucacugucucugcuuccguucucuuccaggccacagaaccaucuggacgcugcucuggucuuaucagcucucuccucgucuuaacuuuucaaccauuuuuaaaucguuguacuaauuguaaaaaacaaaacaaaacaaaaucgcucuguauagugacgaguugcaagcaugucuguguaugauuaccuuaaaagaaacacuaaacaacaacaacaacaacaacaacaacaggaaaggacaaaagaaagaaagaaagccaguccccccaccuuggcccucccccaagucaccccacauuuagauugugagguuccuucguuguguugauuucggggggggggggagugggguuacggagagaacaagccugucugacucuuuuuguauauacgggaaaauguacauacgugugaaccaaauuguacaagaaaguaucuauuuuuuggcuaaauaaaugagcuguugccacuuuugacuauaaccggcaggucugccacauggaccgguuugcugcaugguucuuugguguuuuugguguuucuucccccccacccccggccguuguuuaaagaaucuacaggaaaagaugagcugggucugaggacagcaauggcagaagucguucgggcuuagguagccaggcuuagaagccucuccaagaaggggugaugagagucgcugggcgaccgagaaaaaagggcaaagaccaaggagaaaaugauguugguuccuuacuaggagcuggaaaacuaggcucugcccacggguccacaggaguaaccauggagccuuggggccuccucugaugacuuagcagaaagacuuagggaagcuuccaggaguucagggcgugggcugggagacucgcccucccugcucccuucugacugcgcucaacugaaguuucucagccuggaguauaggggcugucuuuaaacgcucaaugccuaggccuuucucgccgugguucccucuccaacggcuccuuauaggugcaa

SEQ ID NO: 11293 - RNA, 5043 nt, Mus musculus
ccgagaaguuucuauguuggugugauuuuuuuuuuuuuaauugcgaccauucauuucacuaucccccuccccuuuccgcucucugguccccagacccagcguuuuucuuuuggcgagaauucccccagagccguagagagugugcauugugggggcggggagcaagacuuugguuuuaugguaggauauuuccuaaaucuaacuugaaaugugaguguccaagugcccaccgucacggauuagugugugcaguggaaagucauacugaaauucccgggauagcuggagcucccagauaaggcuguagcggcgacccacgcgcgggccaggccugcugugggccugcggacugaacaacuccccggcugcgauucuucaguagagugaagagcccuagcuuagaggcagaaaaaccaccccaagggccuccgacugaacuaagaaucaaaccggaacucgccagcuuggaggaaucuaagggucccgggcuggccgggcucuagugugaauacaguuagggaauggauuucuuucucccuggcccuggccuccaguuuugacccccaugucccaccucuggcugcauuccacugaccuuaggcuccaggagguacuaacucagaaaauuagugggagaaacacaaacagaaguuuggggagcuaccaagucuaggguucgaugucagcauguggggucuuccuaaauugaaucugugcagcuucucuguggucuccuggucuccuugccuggugcuggagguuggcuuuaaggugagccuggacagaggaggcauaguaggaucagcucaggccuucgaauggcuuccccgcagccugauuccguuucugguuaaaccugucacaggaagccagggcucaccugcucaagcaaaggucuuaggguuguagaauagaggugacauuauuuuccaggaucuuuccuguguauaggauggugagucuuuuaagacagccgggacgaccuaccuacacagaacuggaccagaccaaugggcgacagagccagauugcaaggugggcgaagggguuucgcuguacaugucugggcaaaaccacgaguauuucauuccuuuuuguuuguuuguuuguuuuguuuuguuuuucagaagggaaagaaaaacaaaacgcaacaccacacaacaacaccacacaagagccucugagaugcuccuuccuuccuuacugcauuaaccagcuaucgaccugguuguguccgauugcgaugaugggcugagagaaagaacaccggaagagccaggcuguucucaggaaggacucacgccggccacggggccgccccuggcccagagggugaaccucuagacccaggcaugaaccuaagaaccucgcuuaauuagauuccuccaggcaucccaggccuggaguagaaacagcuaccaguuaccccgugaccaacugggaagagcuuuggucuggcccugaaaucagcaacccacgccgggacccaguaucccaagcgacuggagucacugcauggcucugauuccucaacaagaccaggccaguggaacucagcucuuagacuaaacucgcgaguccgcggagagcugaagcuuuucaugggauuuuuaauccaggagauuaggucagacagacagauucgcacagagagugaggagaagcaggugcaucgggaguugauuggggaaagaccugagcgcaacagcaggagaccagcaggagcuucucccucacccccucuuucucccaacaggcacagugcacaaagcgcucgccgcggacgcucuguggucugggaucagggcgccaggagcauacagaaaagguguacgccgaggacacguggcgcacgaagcugugcgcgcuggaggacaacuacaaggggugcccuauguguagccagaggcccaccagcuucggggucggacacuccgaaccaccagcccccaucucuucccuccccugguccagcuccccgaugugcccgugccccccgucguugggagcuucugcagcugugucucccagcucggacagaguucacuccuuuccucccaaggcucagagucccccagaggcggugcgggcuggcuauccuucagcuucuugcagaggcugcugcguacgcuccccccccccccagcugggguuacagguuaaugaaacgcucguuuuccucagucauuuguuuuguuuuccugcaaaguucugauaaguagcuaaccaacgaagcuuguaauuacaaucuuacagaaaccgggccgaucuguauauaaaucucaccauccaauuacaagauguaauaauuuugcacucaagcugguaaugaggucuaauacucgcgcaugcgauaauccccucuggaugcuggcuugaucagauguuggcuuuguaauuagacgggcagaaaaucauuauuucauguucaaauagaaaaugagguuggugggaaguuaauuucucuccgcucugugaagcguagacaagaauuuaaugauuuaauuacaguuguaagcccuuuccaugagacuuaaauugagcugagaauauuuuuuuccuuuucucucucucccccucucuggcuuucucauucucucucuccgcuauuagcagccacacggacuugcagaugcauggccuggcguagcaccgggaggaauucacauuugacugugaauccggccucggagcaucccaggaggcgcgggccgggcgccggcacgucugccgugcaacgcuggcugagcccuguaagccgucagggcccgggaggcugucccugguccagaggcgcuacgggaaacuuugaggcaaacuuugcaaacuucuuucucggaguuaagagaggccgccggucagaaaggcugcggcggcagcagcgugggccccaggccggauuuguacaccgccgaacuggcccugcggccccagaaggagcgcgaggcucuccagcgugcccaucucugccugcaccucccggaccagggccccugccacuggccuucgaguggccagcucuacgcagcucccggaaucucagcauggaaggaaaaccguggcccugugcaccagugguuuuguuucucuuucucucugcaaaaacauccacuuuccaccugcgcugagcuuuuucgcugaucuuuuuuuuuuucuuucuuuuccguccugucuauuucucacacuuucuguauguuugauuuccggggauguauuuuucucuuucuuugaguccaaguguguuguucgauccuuuuauuuuuauuuuccuggaccguuuucuuaaagcucauucuuuuuugccucucccuuccgugucucugcccccccccuccucaguuucaucuucuuccuuuucucccucccucucuuaccccaucugcccuauuucaaucuugaucuaccccaggcucuccuuugcugguuucuucucuuuuccuuuccucuacagucuguccccucccccgcccguggaucugcuucucgggcauccccucccuccucauccaucuugggagaugaauaugucgccuuauuggaugcggaggccaaagcagggcaauggggcucggccaacgccgcacauuuucuucaugcauauugagaauaugguaaugagcgcguuugcauuguugcauggaaaugaugcgacucccucugcggugcggagugggcaagguugguguggacccaagagagcucgguaguggggacugggccugguggccauagugacccacggggggacaaggacgugaccucuaggagcgcccugcucucccuccgccugcucuggcuuccagaaaggcgucacuacccggguuaaaccuuggagaagggaagccagccucgcuugcccgcccgguuguagcgucccuggucccggccugaaaacccuuccccgcuauuuuagaguucugggaaggagagucuguucucuaauggcuacacauuguuugcaacuugagugauccuuuaggaugaaacacggcccuacgccauccggcgggcggguggacaucguuugccccgccagguugaacucuggccaguuggcccucagcggggauaagguugaacaccccuccccccaguuauccaacagaggcagcucuuccccgaggccagccaaguucaggugaagggacccagggccugcagaagggugaaauucuguugaagcaggccaggcucugccugggacugggaaggaagccauguuacacuugcugggagcucagagccccggaaccccuauuuagcagucaaaccucaccacagcucaccucaggacauuuuccugccuccuucucccccauuuccuauucgggaagucccuagcaggggcuccagggccgaaaugcauuguggaaaggcagcucugaauagggucagguuucccaaccuucuagcauucugcccguggcuaaggacugaagaguuucgcuucaaccgagugcuuuucaaaacucaagugucucuuucugggaaagcguuugauccguccccuacuucggcaaacuggaaaguagcgguuagcagaaaggaaaccuagcuaggagcaaaccaugcuccuaagccuugcaccuucccacuugggguucaagugcuuccuguguuauuaacaaggcagcuuugggugugugaguagugacucuuggaagacaagagcauaaaaacgaauguuucuuccuugguccucuuaugucuuaaaaugaugucaggggucucaagggcuguccugguuuguggcuugguggugguguuuucugcuaaaaccagugugaaaaugugaaggcaaaaccaacgugcugaauuauuacugcaaauaagcucauuuaaacguuuuucaggcagcauuguguuuaagucucaucccccaccccccaaggagggugagaggccacacaugauuguguaugaugcuuacuaaagccauguccaagagaagaggggacugagguuauucuucuggguucaccgagcugugugucuugguuuaggcuaagccagggaaacgauuucucuaaucuguagaaguag

SEQ ID NO: 11294 - RNA, 5043 nt, Mus musculus
cuacuucuacagauuagagaaaucguuucccuggcuuagccuaaaccaagacacacagcucggugaacccagaagaauaaccucaguccccucuucucuuggacauggcuuuaguaagcaucauacacaaucauguguggccucucacccuccuuggggggugggggaugagacuuaaacacaaugcugccugaaaaacguuuaaaugagcuuauuugcaguaauaauucagcacguugguuuugccuucacauuuucacacugguuuuagcagaaaacaccaccaccaagccacaaaccaggacagcccuugagaccccugacaucauuuuaagacauaagaggaccaaggaagaaacauucguuuuuaugcucuugucuuccaagagucacuacucacacacccaaagcugccuuguuaauaacacaggaagcacuugaaccccaagugggaaggugcaaggcuuaggagcaugguuugcuccuagcuagguuuccuuucugcuaaccgcuacuuuccaguuugccgaaguaggggacggaucaaacgcuuucccagaaagagacacuugaguuuugaaaagcacucgguugaagcgaaacucuucaguccuuagccacgggcagaaugcuagaagguugggaaaccugacccuauucagagcugccuuuccacaaugcauuucggcccuggagccccugcuagggacuucccgaauaggaaaugggggagaaggaggcaggaaaauguccugaggugagcuguggugagguuugacugcuaaauagggguuccggggcucugagcucccagcaaguguaacauggcuuccuucccagucccaggcagagccuggccugcuucaacagaauuucacccuucugcaggcccugggucccuucaccugaacuuggcuggccucggggaagagcugccucuguuggauaacuggggggagggguguucaaccuuauccccgcugagggccaacuggccagaguucaaccuggcggggcaaacgauguccacccgcccgccggauggcguagggccguguuucauccuaaaggaucacucaaguugcaaacaauguguagccauuagagaacagacucuccuucccagaacucuaaaauagcggggaaggguuuucaggccgggaccagggacgcuacaaccgggcgggcaagcgaggcuggcuucccuucuccaagguuuaacccggguagugacgccuuucuggaagccagagcaggcggagggagagcagggcgcuccuagaggucacguccuuguccccccgugggucacuauggccaccaggcccaguccccacuaccgagcucucuuggguccacaccaaccuugcccacuccgcaccgcagagggagucgcaucauuuccaugcaacaaugcaaacgcgcucauuaccauauucucaauaugcaugaagaaaaugugcggcguuggccgagccccauugcccugcuuuggccuccgcauccaauaaggcgacauauucaucucccaagauggaugaggagggaggggaugcccgagaagcagauccacgggcgggggaggggacagacuguagaggaaaggaaaagagaagaaaccagcaaaggagagccugggguagaucaagauugaaauagggcagaugggguaagagagggagggagaaaaggaagaagaugaaacugaggagggggggggcagagacacggaagggagaggcaaaaaagaaugagcuuuaagaaaacgguccaggaaaauaaaaauaaaaggaucgaacaacacacuuggacucaaagaaagagaaaaauacauccccggaaaucaaacauacagaaagugugagaaauagacaggacggaaaagaaagaaaaaaaaaaagaucagcgaaaaagcucagcgcagguggaaaguggauguuuuugcagagagaaagagaaacaaaaccacuggugcacagggccacgguuuuccuuccaugcugagauuccgggagcugcguagagcuggccacucgaaggccaguggcaggggcccugguccgggaggugcaggcagagaugggcacgcuggagagccucgcgcuccuucuggggccgcagggccaguucggcgguguacaaauccggccuggggcccacgcugcugccgccgcagccuuucugaccggcggccucucuuaacuccgagaaagaaguuugcaaaguuugccucaaaguuucccguagcgccucuggaccagggacagccucccgggcccugacggcuuacagggcucagccagcguugcacggcagacgugccggcgcccggcccgcgccuccugggaugcuccgaggccggauucacagucaaaugugaauuccucccggugcuacgccaggccaugcaucugcaaguccguguggcugcuaauagcggagagagagaaugagaaagccagagagggggagagagagaaaaggaaaaaaauauucucagcucaauuuaagucucauggaaagggcuuacaacuguaauuaaaucauuaaauucuugucuacgcuucacagagcggagagaaauuaacuucccaccaaccucauuuucuauuugaacaugaaauaaugauuuucugcccgucuaauuacaaagccaacaucugaucaagccagcauccagaggggauuaucgcaugcgcgaguauuagaccucauuaccagcuugagugcaaaauuauuacaucuuguaauuggauggugagauuuauauacagaucggcccgguuucuguaagauuguaauuacaagcuucguugguuagcuacuuaucagaacuuugcaggaaaacaaaacaaaugacugaggaaaacgagcguuucauuaaccuguaaccccagcuggggggggggggagcguacgcagcagccucugcaagaagcugaaggauagccagcccgcaccgccucugggggacucugagccuugggaggaaaggagugaacucuguccgagcugggagacacagcugcagaagcucccaacgacggggggcacgggcacaucggggagcuggaccaggggagggaagagaugggggcuggugguucggaguguccgaccccgaagcuggugggccucuggcuacacauagggcaccccuuguaguuguccuccagcgcgcacagcuucgugcgccacguguccucggcguacaccuuuucuguaugcuccuggcgcccugaucccagaccacagagcguccgcggcgagcgcuuugugcacugugccuguugggagaaagagggggugagggagaagcuccugcuggucuccugcuguugcgcucaggucuuuccccaaucaacucccgaugcaccugcuucuccucacucucugugcgaaucugucugucugaccuaaucuccuggauuaaaaaucccaugaaaagcuucagcucuccgcggacucgcgaguuuagucuaagagcugaguuccacuggccuggucuuguugaggaaucagagccaugcagugacuccagucgcuugggauacugggucccggcguggguugcugauuucagggccagaccaaagcucuucccaguuggucacgggguaacugguagcuguuucuacuccaggccugggaugccuggaggaaucuaauuaagcgagguucuuagguucaugccugggucuagagguucacccucugggccaggggcggccccguggccggcgugaguccuuccugagaacagccuggcucuuccgguguucuuucucucagcccaucaucgcaaucggacacaaccaggucgauagcugguuaaugcaguaaggaaggaaggagcaucucagaggcucuugugugguguuguugugugguguugcguuuuguuuuucuuucccuucugaaaaacaaaacaaaacaaacaaacaaacaaaaaggaaugaaauacucgugguuuugcccagacauguacagcgaaaccccuucgcccaccuugcaaucuggcucugucgcccauuggucugguccaguucuguguagguaggucgucccggcugucuuaaaagacucaccauccuauacacaggaaagauccuggaaaauaaugucaccucuauucuacaacccuaagaccuuugcuugagcaggugagcccuggcuuccugugacagguuuaaccagaaacggaaucaggcugcggggaagccauucgaaggccugagcugauccuacuaugccuccucuguccaggcucaccuuaaagccaaccuccagcaccaggcaaggagaccaggagaccacagagaagcugcacagauucaauuuaggaagaccccacaugcugacaucgaacccuagacuugguagcuccccaaacuucuguuuguguuucucccacuaauuuucugaguuaguaccuccuggagccuaaggucaguggaaugcagccagaggugggacaugggggucaaaacuggaggccagggccagggagaaagaaauccauucccuaacuguauucacacuagagcccggccagcccgggacccuuagauuccuccaagcuggcgaguuccgguuugauucuuaguucagucggaggcccuuggggugguuuuucugccucuaagcuagggcucuucacucuacugaagaaucgcagccggggaguuguucaguccgcaggcccacagcaggccuggcccgcgcgugggucgccgcuacagccuuaucugggagcuccagcuaucccgggaauuucaguaugacuuuccacugcacacacuaauccgugacggugggcacuuggacacucacauuucaaguuagauuuaggaaauauccuaccauaaaaccaaagucuugcuccccgcccccacaaugcacacucucuacggcucugggggaauucucgccaaaagaaaaacgcugggucuggggaccagagagcggaaaggggagggggauagugaaaugaauggucgcaauuaaaaaaaaaaaaaucacaccaacauagaaacuucucgg

SEQ ID NO: 11295 - RNA, 1112 nt, Mus musculus
cgcggcccuugcaaacuugagcaauugucuaauucagcuucacucgagccgcgggcuccggaguggcucuggcgaaagccgcgucuugcugggaucgccgagcugaagggaaggcuuuggggcgcggggagggggggggauugauuggucuuuacuauaaagaacggcauuuggcucaaagcucugggacaacccgcaaauuucuucuucuucuuccuccucuuucuuuugguuuugccauguuggaaaaaguaguucaaaagaagccgaccggaauuccaaacaguaguagugugcuaaaucuauguaaauguguuuggccucgccuuuaauuaauccccaaaauguugcaaauccguaauccuaucuucgcaauccgauuuggaaguauuaaauuucugaaacggccagcgagaugcgguguauccggguuuuuacggcggggugugauuucuggaaaagcgcaacggcuucgguuagggauagcauuuuuagaccgucggugugcaagcuaaggcucagcuugucuaucgcauuucuuugaagauuaaagaaagagccuuuccuucccuuguuguaccccuugcgcccaacaugcggccgcucuggagcagagcucugaguuguugcugaggcugcucaggccucuaagagaaccgugggcccuuccgcagaggccagaucugagaccugggcaccgaggucccccagcagaugguggccuccaagguggugugcuaaacccugaacagccucaggggucccgaagggccagaaucagaauuggggggcccugcugccuucugaggagggggaagguggucacucuugcguuuaaaccagccagcucugccucaggggaagcuggagugcgggcccgcgcuggcacucaaaaccaaggacagagggaaaguggguuucagucuuuuggguggcuauguagcccacacccucacucacuuaaccucugccugucccucacagggcucucccuacgaccacacucccgguauggcagguuccuugggauaucacccuuaugcagcaccucugggcuccuauccuuauggggaccccgcguaccggaagaaugccacucgggacgcuacagc

SEQ ID NO: 11296 - RNA, 1112 nt, Mus musculus
gcuguagcgucccgaguggcauucuuccgguacgcgggguccccauaaggauaggagcccagaggugcugcauaagggugauaucccaaggaaccugccauaccgggaguguggucguagggagagcccugugagggacaggcagagguuaagugagugagggugugggcuacauagccacccaaaagacugaaacccacuuucccucuguccuugguuuugagugccagcgcgggcccgcacuccagcuuccccugaggcagagcuggcugguuuaaacgcaagagugaccaccuucccccuccucagaaggcagcagggccccccaauucugauucuggcccuucgggaccccugaggcuguucaggguuuagcacaccaccuuggaggccaccaucugcugggggaccucggugcccaggucucagaucuggccucugcggaagggcccacgguucucuuagaggccugagcagccucagcaacaacucagagcucugcuccagagcggccgcauguugggcgcaagggguacaacaagggaaggaaaggcucuuucuuuaaucuucaaagaaaugcgauagacaagcugagccuuagcuugcacaccgacggucuaaaaaugcuaucccuaaccgaagccguugcgcuuuuccagaaaucacaccccgccguaaaaacccggauacaccgcaucucgcuggccguuucagaaauuuaauacuuccaaaucggauugcgaagauaggauuacggauuugcaacauuuuggggauuaauuaaaggcgaggccaaacacauuuacauagauuuagcacacuacuacuguuuggaauuccggucggcuucuuuugaacuacuuuuuccaacauggcaaaaccaaaagaaagaggaggaagaagaagaagaaauuugcggguugucccagagcuuugagccaaaugccguucuuuauaguaaagaccaaucaaucccccccccuccccgcgccccaaagccuucccuucagcucggcgaucccagcaagacgcggcuuucgccagagccacuccggagcccgcggcucgagugaagcugaauuagacaauugcucaaguuugcaagggccgcg

SEQ ID NO: 11297 - RNA, 979 nt, Mus musculus
uacaacucagucauggggugagugagcaaugcaaacagggaaaacucacucccacuuggccagggugcgggguggguaugggagggggcaugcgccuaggccuuugcgcucauugggcagguagccccuagauaauguucggacagcacccacucacccacgccuggccagucagcugggacaggcaggccuaaaccagccggccucaccuagaggcgucugcccccgaggcagacaccgcccgacgcccucgcuucagcgguucccaggagagcaggcggcagagaccaagugaucuaccgcuaaaccugagcccaccucgacccuauuucugacguguccucugcuagcggggggagugggagggagaggaaggggccucggggggauggaucccuuagccgcuauugucaacuuccucggcaggaguggaugucuguaaagguuggaagguaagguggcucugggaauggccuagcacgcuuccacgcgguagucgcucaaaaguuucaaacaagaccuuguccuacuggccgugccacugggucgcgucgcuccaggucuccccuccuccccucccccucgaaguagugucccugccacuccgcaguuccaccacccacgcgggcccccacgcucaccuguugcagcacuuuguccagggacuccgcccgcgcuaggcugucugcgcugaguccacucgccucgcggcauuguggacucagggcagccgccucggcgcgaacuagcgacuugugcagcguccccaccuaaaagcaccgaggguaaccccaugagccgcugugccucaacaggcucugaagcgucccgagguccccucuuucccacccuaccugucggcugcgcggcuccaccacuugccaaacuaggaggauuaagucggucucguccgagccuagguccggccccagcgcaccggcaguggccccgaacaaaaccaccagcgacugagguucgg

SEQ ID NO: 11298 - RNA, 979 nt, Mus musculus
ccgaaccucagucgcuggugguuuuguucggggccacugccggugcgcuggggccggaccuaggcucggacgagaccgacuuaauccuccuaguuuggcaagugguggagccgcgcagccgacagguagggugggaaagaggggaccucgggacgcuucagagccuguugaggcacagcggcucaugggguuacccucggugcuuuuagguggggacgcugcacaagucgcuaguucgcgccgaggcggcugcccugaguccacaaugccgcgaggcgaguggacucagcgcagacagccuagcgcgggcggagucccuggacaaagugcugcaacaggugagcgugggggcccgcgugggugguggaacugcggaguggcagggacacuacuucgagggggaggggaggaggggagaccuggagcgacgcgacccaguggcacggccaguaggacaaggucuuguuugaaacuuuugagcgacuaccgcguggaagcgugcuaggccauucccagagccaccuuaccuuccaaccuuuacagacauccacuccugccgaggaaguugacaauagcggcuaagggauccauccccccgaggccccuuccucucccucccacuccccccgcuagcagaggacacgucagaaauagggucgaggugggcucagguuuagcgguagaucacuuggucucugccgccugcucuccugggaaccgcugaagcgagggcgucgggcggugucugccucgggggcagacgccucuaggugaggccggcugguuuaggccugccugucccagcugacuggccaggcgugggugagugggugcuguccgaacauuaucuaggggcuaccugcccaaugagcgcaaaggccuaggcgcaugcccccucccauacccaccccgcacccuggccaagugggagugaguuuucccuguuugcauugcucacucaccccaugacugaguugua

SEQ ID NO: 11299 - RNA, 775 nt, Mus musculus
uuuacccaguccccagagccugguuccacaucugugcaacuggauggcgcgcugagucucuaggaggggguaugacgaccgguccccugcuaguccuuuccacccucauucacaaaaccuucaaagacacaggggaauuucgggaccuacagaccaaguucgucuauucaugagggugggguuuaaacaaaccuacggucugaaacaagcugcugagaaagaccucacugacuuuguuacacaucaccggagaaugaacguuuaggugggcuuaguuucguguuuaaaacggcggcuucugcuagcagucugcugcgcauacauagccuugucaggaagagcgaguccaacuauuaacucuucguugggcuaacuuuauucagccccccccccaaccuggaagcuggacuuugaaagguauagagggaaggcuagggaacaagacuuaagagucuguggcccuccggcuagccccaccuaccuagccuucuaaaccguuccaguuucaguccugaaacucuccuccuuccucugguucucgggcuuucccacuuuuucuuuuaugucaucucuccuccacccucggcggucccuggucccuagcaggugcaccccucaccucuccaacccgcggcgcccgaggccaugcuucugcgacagcucugggggcccccagggugcgggucccggagucggggcugcgucccaacuggguccccagggcucgggccgcgcacggcuuugacgggacuucuccaaggcucuuuguucggau

SEQ ID NO: 11300 - RNA, 775 nt, Mus musculus
auccgaacaaagagccuuggagaagucccgucaaagccgugcgcggcccgagcccuggggacccaguugggacgcagccccgacuccgggacccgcacccugggggcccccagagcugucgcagaagcauggccucgggcgccgcggguuggagaggugaggggugcaccugcuagggaccagggaccgccgaggguggaggagagaugacauaaaagaaaaagugggaaagcccgagaaccagaggaaggaggagaguuucaggacugaaacuggaacgguuuagaaggcuagguagguggggcuagccggagggccacagacucuuaagucuuguucccuagccuucccucuauaccuuucaaaguccagcuuccagguuggggggggggcugaauaaaguuagcccaacgaagaguuaauaguuggacucgcucuuccugacaaggcuauguaugcgcagcagacugcuagcagaagccgccguuuuaaacacgaaacuaagcccaccuaaacguucauucuccggugauguguaacaaagucagugaggucuuucucagcagcuuguuucagaccguagguuuguuuaaaccccacccucaugaauagacgaacuuggucuguaggucccgaaauuccccugugucuuugaagguuuugugaaugaggguggaaaggacuagcaggggaccggucgucauacccccuccuagagacucagcgcgccauccaguugcacagauguggaaccaggcucuggggacuggguaaa

SEQ ID NO: 11301 - RNA, 1934 nt, Mus musculus
ggcggccggagaagccgcccuacucguacaucgcgcucaucgucauggcuauccagagcucgcccagcaagcgccugacccucagcgagaucuaccaguuucuucaggcgcgcuuccccuucuuccgcggcgccuaccagggcuggaagaacuccgugcgccacaaccugucgcucaacgagugcuucaucaaacugcccaagggccucgggcgacccggcaagggccacuacuggaccaucgauccggcuagcgaguuuauguucgaggagggcucguuccgccggcggccgcgcggcuuccgaaggaaaugccaggcgcucaagccuguguacagcauggugaacgggcugggcuucaaccaccuccccgacaccuacggcuuccagggcuccggaggccucucgugcgcgcccaacagccuggcgcuggagggcggcuugggcaugaugaauggccauuuggcuggcaacguggacggcauggcuuugcccagccacucggugccacaccugcccuccaacggcggccacucguacauggguggcugcgguggcucugcggccggggaguacccgcaccacgacagcucggugcccgcuucaccgcugcugccggccggcgccggcggagucauggagccgcacgccguuuacuccagcucugcagcagccuggccgcccgcggccuccgcggcucucaacagcggggccuccuacaucaagcaacagccucuguccccuugcaacccagccgccaacccccugucuggcagcaucuccacgcacucccuggagcagccauaccuucaccaaaacagucacaacgggccggcagaacugcaaggugagugcagggggcuccaaccccagacccaagccaugacagccacugugaaccgaucuugcuucuagagcauuagccccaauucuuuggguaccaacugcucucucucucuaaggagaguuuugauguccccaguuuagacuggucgaguuucguuucuuguuucucuuuucuggcugccccuagccugaccagguaggccccauucacaccaaaaagacucagaccccaggcucucuuaaguccagggaacaucuggguuccuucgccucuagcaaaggcccuguguaucuagccagcggccuagcccuggccaacaaacccaccuuucugauacuucccaugcaaagaaucugugucaggcaagaacggaaaaguuaggcccaaagcaagaguuaggcccaaagaggccuggaccaaacacugagaggcccagcccaggcccuucaggaaaccugguuuggugaguccaggggcauuuugugcagacuuaagcuggguccugugugguggccaggccuggaguugggggucagagucauaagccccaaugcucuuugucuuucaggauccagguuucaaggccccucagagcccaccccagacucccccacugaaaaagaagauagcuuucagccuccaagccuaguucuggaaggaaaagucgguagagggauagccauaaauaagcugucagggccaccccagggaggcagaccagaggagagaggugguuagcuguugguccaccucuccacagggucaccccacacacacacauauacacacaccuuaugccuguccuuaaggggacucuucagcugccugaaccuugaugugggcuuugaauucuguugacccugcauugggcuucuggcuccaccaggguggaaauggcaacugcagaaaucucagcguuccaggcucuggggcaugaggccaugacggacggacgggccgccuccuaggccuuccccuuccgcaucaaagaagcccucugccaggcaaggaguccagacuggagaggcccaagcggcaggaagcaaccucgagcaggacuuggaguuagugauuuaguccaaauccag

SEQ ID NO: 11302 - RNA, 1934 nt, Mus musculus
cuggauuuggacuaaaucacuaacuccaaguccugcucgagguugcuuccugccgcuugggccucuccagucuggacuccuugccuggcagagggcuucuuugaugcggaaggggaaggccuaggaggcggcccguccguccgucauggccucaugccccagagccuggaacgcugagauuucugcaguugccauuuccacccugguggagccagaagcccaaugcagggucaacagaauucaaagcccacaucaagguucaggcagcugaagaguccccuuaaggacaggcauaagguguguguauauguguguguguggggugacccuguggagagguggaccaacagcuaaccaccucucuccucuggucugccucccugggguggcccugacagcuuauuuauggcuaucccucuaccgacuuuuccuuccagaacuaggcuuggaggcugaaagcuaucuucuuuuucagugggggagucuggggugggcucugaggggccuugaaaccuggauccugaaagacaaagagcauuggggcuuaugacucugacccccaacuccaggccuggccaccacacaggacccagcuuaagucugcacaaaaugccccuggacucaccaaaccagguuuccugaagggccugggcugggccucucaguguuugguccaggccucuuugggccuaacucuugcuuugggccuaacuuuuccguucuugccugacacagauucuuugcaugggaaguaucagaaagguggguuuguuggccagggcuaggccgcuggcuagauacacagggccuuugcuagaggcgaaggaacccagauguucccuggacuuaagagagccuggggucugagucuuuuuggugugaauggggccuaccuggucaggcuaggggcagccagaaaagagaaacaagaaacgaaacucgaccagucuaaacuggggacaucaaaacucuccuuagagagagagagcaguugguacccaaagaauuggggcuaaugcucuagaagcaagaucgguucacaguggcugucauggcuugggucugggguuggagcccccugcacucaccuugcaguucugccggcccguugugacuguuuuggugaagguauggcugcuccagggagugcguggagaugcugccagacaggggguuggcggcuggguugcaaggggacagaggcuguugcuugauguaggaggccccgcuguugagagccgcggaggccgcgggcggccaggcugcugcagagcuggaguaaacggcgugcggcuccaugacuccgccggcgccggccggcagcagcggugaagcgggcaccgagcugucguggugcggguacuccccggccgcagagccaccgcagccacccauguacgaguggccgccguuggagggcagguguggcaccgaguggcugggcaaagccaugccguccacguugccagccaaauggccauucaucaugcccaagccgcccuccagcgccaggcuguugggcgcgcacgagaggccuccggagcccuggaagccguaggugucggggaggugguugaagcccagcccguucaccaugcuguacacaggcuugagcgccuggcauuuccuucggaagccgcgcggccgccggcggaacgagcccuccucgaacauaaacucgcuagccggaucgaugguccaguaguggcccuugccgggucgcccgaggcccuugggcaguuugaugaagcacucguugagcgacagguuguggcgcacggaguucuuccagcccugguaggcgccgcggaagaaggggaagcgcgccugaagaaacugguagaucucgcugagggucaggcgcuugcugggcgagcucuggauagccaugacgaugagcgcgauguacgaguagggcggcuucuccggccgcc

SEQ ID NO: 11303 - RNA, 1339 nt, Mus musculus
cucccccgcauccgagauggugcggcgauagggcggccccgaucugggcucagauaaaguuuaaaauauuccauucugcaagucccauccugauaagaucgcucugucgggacgggcugaaauugugaucuuaucuggcgugcuugacucucccaggcuuuguaucuagaggcagaaggagaaagaccugggaguaagggggacuugggacugcggggaccggccggcgcccaccgcagcgcuuuggcugcagagcgacaaggcagcggaauagguaguggaggcugcuccaaccuaggcauuuggcacuggcugaccaaacccccuuuauccgcuccggcucuggaguuuucgauccgaccucugccugcugggggacauguggagauccgacccaccaacugccccuaacaacgcuacacgaauggaugcccaugggcaccgcucucuccaccuccauccgagggguuauccugaaccauccagggaccucaggcacucaaacguuguucccgagugaaguuucucgcagguucucccgugggcacuuucccgagcaaggcagacccuauaauccuacaucauccgugccccccuacaguaagacccuccugggcucuuggggcuaccagguugcggggccucuuggcugcucuaggagcgaguaagcacacaggaagagcuccuccccacgccacaccaauaauaacuucgcgccucucccggcagggcgcggggcuuccuccccggagcuucccuuuggcgagagcgacaggucaucugggcugcccaggaggugacgggaggggggcugggcauccggcuuuccagcuccagacgccugagcuaccuccucuguccacaucacacugccaccaggaccaagugugcauuuuagcuugugagaguacccccuacugaaguggggggggacggggaggaaucuggguucugguaacccgacuccccaaaugcgugcuggaccuguuuuccgaaagucuccuucuaucaugucagcugaagaauuaaagccacccacaggucccgaucugugcugguucucugguuucuuuuuccccuccucgccugugcgccucugcuggguucuguucucgcguguaugugugugugcgugagcgugagcgugugcguguguguguguguguguguguguguguguguguguguguguguguuucaguuugaugagaaaugcagauagcuagggcagggagaucucagguugggaacggaucgccagcgcugauaagcccgcaggagcccagcagagcccaacccacuugggucagcgaaaccccauacucugagaucuaggacc

SEQ ID NO: 11304 - RNA, 1339 nt, Mus musculus
gguccuagaucucagaguaugggguuucgcugacccaaguggguugggcucugcugggcuccugcgggcuuaucagcgcuggcgauccguucccaaccugagaucucccugcccuagcuaucugcauuucucaucaaacugaaacacacacacacacacacacacacacacacacacacacacacacacgcacacgcucacgcucacgcacacacacauacacgcgagaacagaacccagcagaggcgcacaggcgaggaggggaaaaagaaaccagagaaccagcacagaucgggaccuguggguggcuuuaauucuucagcugacaugauagaaggagacuuucggaaaacagguccagcacgcauuuggggagucggguuaccagaacccagauuccuccccguccccccccacuucaguaggggguacucucacaagcuaaaaugcacacuugguccugguggcagugugauguggacagaggagguagcucaggcgucuggagcuggaaagccggaugcccagccccccucccgucaccuccugggcagcccagaugaccugucgcucucgccaaagggaagcuccggggaggaagccccgcgcccugccgggagaggcgcgaaguuauuauugguguggcguggggaggagcucuuccugugugcuuacucgcuccuagagcagccaagaggccccgcaaccugguagccccaagagcccaggagggucuuacuguaggggggcacggaugauguaggauuauagggucugccuugcucgggaaagugcccacgggagaaccugcgagaaacuucacucgggaacaacguuugagugccugaggucccuggaugguucaggauaaccccucggauggagguggagagagcggugcccaugggcauccauucguguagcguuguuaggggcaguuggugggucggaucuccacaugucccccagcaggcagaggucggaucgaaaacuccagagccggagcggauaaaggggguuuggucagccagugccaaaugccuagguuggagcagccuccacuaccuauuccgcugccuugucgcucugcagccaaagcgcugcggugggcgccggccgguccccgcagucccaagucccccuuacucccaggucuuucuccuucugccucuagauacaaagccugggagagucaagcacgccagauaagaucacaauuucagcccgucccgacagagcgaucuuaucaggaugggacuugcagaauggaauauuuuaaacuuuaucugagcccagaucggggccgcccuaucgccgcaccaucucggaugcgggggag

SEQ ID NO: 11305 - RNA, 541 nt, Mus musculus
gguuggugcugucuaggcuguuguauucucuccugagggguuugugguguuuuacuagcuaacgagcuucgaaauauaguuaucuuuuccaaagauuuguagcccuccuuacuugauuuugaguaacaguacacgaccagaaaagaauggagguagaucgcggcuuagggagauaggggguagaaucuugaguaggauggacugcccaugagcagccgccgacuuuaccccuacucagacacugaaugucaaaggcacauggcugauucccuuuuucucuggcaucuucaaguuauuccuagcugcagguacggagggaggaaggaagggagggaggaagguggaagugucuuuuugacucugggagggguucaugauucguuuuuuauuuucaguaacgaacauggaaacaguguuucccugugccuggcuugugugggguggacacugacucucauuagcccugcuuucugaaugguuguugugcugggagccccugcuugcuaggguuuaagucuagcaagcguggcugguggcagca

SEQ ID NO: 11306 - RNA, 541 nt, Mus musculus
ugcugccaccagccacgcuugcuagacuuaaacccuagcaagcaggggcucccagcacaacaaccauucagaaagcagggcuaaugagagucaguguccaccccacacaagccaggcacagggaaacacuguuuccauguucguuacugaaaauaaaaaacgaaucaugaaccccucccagagucaaaaagacacuuccaccuuccucccucccuuccuuccucccuccguaccugcagcuaggaauaacuugaagaugccagagaaaaagggaaucagccaugugccuuugacauucagugucugaguagggguaaagucggcggcugcucaugggcaguccauccuacucaagauucuacccccuaucucccuaagccgcgaucuaccuccauucuuuucuggucguguacuguuacucaaaaucaaguaaggagggcuacaaaucuuuggaaaagauaacuauauuucgaagcucguuagcuaguaaaacaccacaaaccccucaggagagaauacaacagccuagacagcaccaacc

SEQ ID NO: 11307 - RNA, 1354 nt, Mus musculus
uuuuauaggguggggcuggcaugcuucuuaauucaguacaaauucugauauguuuagauuucuucucaaagcaucugauauuccagguggaaucagacuagugaguagcuggaauuccaacgccagagauuuagaucuagccagugauuggcuagggaggggcuuugggcgggccuuccuagagcgccaacgcuugcuagaaagcuauggagccagucuagacugucacuaucagucuuuguaguauuuacgggugcgaggauucugacauucugcuaacuucucuuagcuuuacuagagcaaccugcaaccagaacucgcugggauuguagagaaccuagggagccauagagacugucgcugcaggagaacgaguaagaaugggcuacgucuuagccccagguuuuuggugaggacuguaaagcaaacuuccuaggaugucuagguuucaacaaacauaagaaguccggagauagcgggaguccuuuuuuucagcaccggccacaccaguuccgggucucccauucaagaagaaacacgaaaaaaagucucucgaauaacucccaguucucagaccagaccagcuugcuccagcuacuucuuccuguccucaccccaccgcgaccgggacagcgcgacuaccacccuuccucugcgucuggguggaggguaaggacaggagcugaccaagaccgccccucccaaccaggagguggagaucccacggguccugcgacucuacacccacuuccuccucccucugccccuauaucaccggcacccccuccuccuucccuuuucccuccucccaggagacaggggaggagaaaaggggagcuugggucgucaugacugagcugcaggcaaaggauccgcagguucuccacacgucuggcgcuucgcccucccccccacacaucgggucccccuugcuugcacgcuuggacucaggucccuuccaagggagccagcacucggacgugucgucuguagucucgccuauaccgaucucccuggacgggcugcuuuuuccucgguccugccggggucccgagcucccagacggaaagacaggggaccagcagucgcuguccgacguggagggagcuuucucugggguagaagccacucauagggaaggaggcagaaauuccagagccccggagaaggacagcagacucuuagacagugucuuagacucguuguugacucccuccgggaccgaacagagucacgccagcccuccagccugcgaggccaucacuuccuggugucucuuugggccagagcuuccagaagacccccgcagugucccugcuaccaaaggguuguuguccccgcucaugagucggcc

SEQ ID NO: 11308 - RNA, 1354 nt, Mus musculus
ggccgacucaugagcggggacaacaacccuuugguagcagggacacugcgggggucuucuggaagcucuggcccaaagagacaccaggaagugauggccucgcaggcuggagggcuggcgugacucuguucggucccggagggagucaacaacgagucuaagacacugucuaagagucugcuguccuucuccggggcucuggaauuucugccuccuucccuaugaguggcuucuaccccagagaaagcucccuccacgucggacagcgacugcugguccccugucuuuccgucugggagcucgggaccccggcaggaccgaggaaaaagcagcccguccagggagaucgguauaggcgagacuacagacgacacguccgagugcuggcucccuuggaagggaccugaguccaagcgugcaagcaagggggacccgaugugugggggggagggcgaagcgccagacguguggagaaccugcggauccuuugccugcagcucagucaugacgacccaagcuccccuuuucuccuccccugucuccugggaggagggaaaagggaaggaggagggggugccggugauauaggggcagagggaggaggaaguggguguagagucgcaggacccgugggaucuccaccuccugguugggaggggcggucuuggucagcuccuguccuuacccuccacccagacgcagaggaagggugguagucgcgcugucccggucgcgguggggugaggacaggaagaaguagcuggagcaagcuggucuggucugagaacugggaguuauucgagagacuuuuuuucguguuucuucuugaaugggagacccggaacugguguggccggugcugaaaaaaaggacucccgcuaucuccggacuucuuauguuuguugaaaccuagacauccuaggaaguuugcuuuacaguccucaccaaaaaccuggggcuaagacguagcccauucuuacucguucuccugcagcgacagucucuauggcucccuagguucucuacaaucccagcgaguucugguugcagguugcucuaguaaagcuaagagaaguuagcagaaugucagaauccucgcacccguaaauacuacaaagacugauagugacagucuagacuggcuccauagcuuucuagcaagcguuggcgcucuaggaaggcccgcccaaagccccucccuagccaaucacuggcuagaucuaaaucucuggcguuggaauuccagcuacucacuagucugauuccaccuggaauaucagaugcuuugagaagaaaucuaaacauaucagaauuuguacugaauuaagaagcaugccagccccacccuauaaaa

SEQ ID NO: 11309 - RNA, 974 nt, Mus musculus
cuggaggucuugaaaccgcuuccuugccaaagaacagcggaguaagggaaacuaacuucacaccaacacaacagggagagcccaagguccucuugccaccuguggauuuccccuuuagucacagaggcaguggcaagaaaggaggccuuguuaacaagaacuuuugucggagugucagcuuggagugcugaggagggagcgggcuuugaagccggucagugcgugagaagggccuugguuacucagagccaagcaacaaaaaagcuagagggguucacgaaagagaauaaagaccgggaucugggugccagagagugggcagcgaguuagagaggugaccuugggcaugucacguuccccuuucggcacugcguuucucuucugcgggcuugaggguuccugggacgcccgacagcuugcccgcccuccguggugggugggacaggacucuugaugguaccucaccuucuugaaauccgcgaugaaggagaugagagugccgucggguuugcgcagaucaaggcugaugcuguccgcgucgcuguccgccuguagacucuccucgaucaccuggcugucgggcagucucacucggacccgcagcucggccggagcgccgcugcccgcgcccacgccgugcagcgccccaagcagcagcggcgacagcagcagcagcagcagcggcagcgcggggcgcgccgaggggacgucgcggcagccagggggccgcauccccggggcccccggcgcgccgcgugggggaggggagacgcgccuacaaaguuugcucgaaguuggggguccgguucggggauucccggcaguccccuacuucuagaggggagacucaacccggagguuccccacgacgugcagcgaauucacgugggccgcguacagccacgcaccccgagucccggacggcgccccccgugcguguccccuagccgccccgauuccugagcuccggacuc

SEQ ID NO: 11310 - RNA, 974 nt, Mus musculus
gaguccggagcucaggaaucggggcggcuaggggacacgcacggggggcgccguccgggacucggggugcguggcuguacgcggcccacgugaauucgcugcacgucguggggaaccuccggguugagucuccccucuagaaguaggggacugccgggaauccccgaaccggacccccaacuucgagcaaacuuuguaggcgcgucuccccucccccacgcggcgcgccgggggccccggggaugcggcccccuggcugccgcgacguccccucggcgcgccccgcgcugccgcugcugcugcugcugcugucgccgcugcugcuuggggcgcugcacggcgugggcgcgggcagcggcgcuccggccgagcugcggguccgagugagacugcccgacagccaggugaucgaggagagucuacaggcggacagcgacgcggacagcaucagccuugaucugcgcaaacccgacggcacucucaucuccuucaucgcggauuucaagaaggugagguaccaucaagaguccugucccacccaccacggagggcgggcaagcugucgggcgucccaggaacccucaagcccgcagaagagaaacgcagugccgaaaggggaacgugacaugcccaaggucaccucucuaacucgcugcccacucucuggcacccagaucccggucuuuauucucuuucgugaaccccucuagcuuuuuuguugcuuggcucugaguaaccaaggcccuucucacgcacugaccggcuucaaagcccgcucccuccucagcacuccaagcugacacuccgacaaaaguucuuguuaacaaggccuccuuucuugccacugccucugugacuaaaggggaaauccacagguggcaagaggaccuugggcucucccuguuguguuggugugaaguuaguuucccuuacuccgcuguucuuuggcaaggaagcgguuucaagaccuccag

SEQ ID NO: 11311 - RNA, 4410 nt, Mus musculus
gcccugcuuccucucaaaggggacauuuuaggaggagaagcaaggcuggaccacguguaucacuuaugccccucucaugccagcacuggacuccuggggugacugggaccccggagacccaugcucagggaccuggaaaaugguuuuacagcggcagagaaauggaggugagugccccuccccuauccuuagcaaauucucaagaacucaguuucugguuaggaggggcuuucucuagguaggagaggguuaaagguugagccuaggacuccugcggagauagacugccauuaccuaggagguuugcaggaucuagagguaaugggagccaggucuagcccaagauagccuugggguggagggugaggugacaaguaucccccaguaccuggagcaggcacagugcagagcccacucacuggcuucaacaauaaauccaaguccacaccuagggcaggcaaagcaagcacauucacaaauaaauaaaucauugcccaacaggcaagagaugugcuuaguccucacuuccagcaaggccccacacagauaccuuuccagaaaaggcacacucccaaguguauagggucccaacagagagaaccacuaugguuacuguagauaccagacacugagcacgaugagguaggauucuaaggcuuucccugcgauuaguuuaauuuuuuuuaacaaagcaaagacagcuguucuaaguacaacccauuucacagaugaggaaaagugagggaggaagaagaaaugaaacacccaaagucacagagaccagcgcugaugcaggacccuuuacuucaugguuugugguuuaccagcagagauacagucaugcaaacuuaaccagccccagagccagagcggcuggggcgcuaguaggaaagauggggaagggucggccuguugucaagcggguuguaggcuguggcaaaacucuggguccagagaacacuagcgcucuaaagguggaggcggggucaaaagcuacaggaauccggcuguggagcgaggugccagacuguuuccagcgcuggggcaucuccgagcagccuuucuaaccccgacuuucugcagaaccugugccgacgcucuugacugcaaccauuucccagcccagcagcuucggcucuuagcaguuggaccgccgcgccugaauuagauagaucucgggcagcgaggccugcgggauccaaguccggacauagcuuuuggucgagauacuuuaucccagaagcccacccgcgccccacuuagagagguaucaaguuuuugguguccuuucagaaugggagugagggaccaacagaccaccguuggauaaacacuguuuguaccucaucgauuugucuuucaacccuuugaaacaaaauucacaacgauuuuuguuuaaaaaaaucccgagucuuagaaaucgcagauuuuucuaggauuaaaaagccaccgggaagacgguaaauuaccccgugucccacauuuguuucugauuaguuguguuguaauugguuuguguaacccaaaaucagagaguucguaaaaaucuuuuacuguaugagugacacaucacagcacuguuuuuaggcucuaugcagcugagaggagaaaggagagggugggagucagcaucaauuuaaccaaaagagcaaaaaguaggagggaggaaaagugccuaggccagggugggugggaggacuguggcucuaagucucuggauuccuuuuggcuuacccaccugcaacaucgaguuuucuacaggcggcgcgggugggaaaguccgcauagaguuuauccaaacccaggugcucauuuccuacccguucucccuaacuuggaccccgccgaacaaaggcucaggcccaccagggagaaagguggccggcuggaccagugauggucccgaaacagcgaauccucuuuucucccucaaggucugucguccccaggaggaauuuuuaauuuaaaaauuauaaaagaaaaacacuuuuaagggggagacgacucucaucuauucccagaagacuauugccuugcuaggcaaacgcccuacaaguccgaagaaagcgcggcgcugcggcagagcccgcgggguggagaugcggcuuccaagggauugcgggacccggggcugcagagaggaucuaggaagguuucgggggagggggcugcgcuccauuguucacuccgaaccaaucagagcuuucccacuuccucccagccaaucucccugcgccuccgugucuaccccagcccacccuccggguccccaucaucucccgagcaagccccagggcggugggagagcugggugacgcuacaggucccgccuccagcucgggccccgggcgagugcgugcugacgucaugcugcgugcgggccggugcggaaucgcuccuucaacuccgcggggcaggaguuaguuagcaaagagcagaggcugggcgcucgacccugguccuucuguccccggccgcaagcuuugcucacaucucucucugcaugguggauauuauuuuucauuauccuuuucugggugcuaugggggaucauuccaagaguaagucuuucucuguguguggguguguaugugugcuugauaugcaacauuuccaaugcagaagaauguuuagcggauucuacaaguggcuuuuauuugacaaaauacuugggagaauaaaaaaaaacaaacaaacaagcagugcauuucgcccauaacacuguuuauucguuggaauccuacuauuuuauuuugcaauuagacauuauuucccaaguuggcuggaaugaccucaggcugugaaauucuuuuucuuuucugcuaggacaauuagguuugauuuagagaaauggguuucuucucugccuuaggaagguagagagguuucaguagcuugaucugagguguuuaaacuaagaacugucgaagaagcuaagaggggacagggcugaaugcugcggugucugcguugaaauagggagucgcugugagcgggagcgggcggaaauccgggcuuggcugacaguguggacacggaggcguccguagcuccccagugucaccgugcugucgucugccucccguuagcucugucucuagcugaaccgauacuacguccgcguucaaagacggugauaauggaaauaucaggagauuguguuguuuucguuuccuacuuucuggaucauucgaaaguggucucacuuuuagagcgggagaucaagcaagggagggcggguuggguuggggcugcugcagcggccaaggccggccggguccuguaccgggccugacgcgggcccugcgcccuucccugcuagagaagcccgggacggccaugugcgugggcugcgggagucagauccacgaccaguuuauccuucgcgugucgcccgaccucgaguggcacgccgccugccucaagugcgcggagugcagccaguaccuggacgagacgugcacgugcuucgugagagacgggaaaaccuacugcaagcgggacuacgucaggugagccggcgggacccgggguucggcccccuugggcugggggggacacggcugcgcguccugggcucgggucccugcgcugacgcccgccgcacccgggcccgcaggcuguucggcaucaagugugcccagugccaggugggcuucagcagcagugaccuggugaugcgggcgcgggacagcguguaccacaucgagugcuuccgcugcuccgugugcagccgccagcugcucccuggagacgaguucucgcugcgggagcaugagcugcucugccgagcugaccacggccuccugcuggagcgcgcugcggcuggcagcccgcgcagccccggcccgcuccccggcgcccgcggccugcaucugccagguaagccucucucccggcccgcagcgcugcgccgcgucaguaggauguacgacuguguagccgacagcugagcuuccgacgggaagccggugugaaaggcugcgugcgcugggaacccugcuaugugucugcgagugcgggggucggggggaauuguauguaugugagcgugagagccucgggaguuguguucuccguggcccggaccauguaggaucgggagaguggaggacccggaauccuaggugcugccugucuggguuguguuuagaauuccuuugaugaacagggagaaaagguauccaucccacccggagccaagggaagaaggccagcggcgcagaagaggggccuguguucuuguuuugauguccggcuagcauaaagaaagguucagggaguuuauugguuaaaacccuccuaggaugauaggugcucuggccaggaguugcucagacugggaaauaaguguugacaagaagcagguggagagggugcgacaggagaccccaguuccaggaagccagg

SEQ ID NO: 11312 - RNA, 4410 nt, Mus musculus
ccuggcuuccuggaacuggggucuccugucgcacccucuccaccugcuucuugucaacacuuauuucccagucugagcaacuccuggccagagcaccuaucauccuaggaggguuuuaaccaauaaacucccugaaccuuucuuuaugcuagccggacaucaaaacaagaacacaggccccucuucugcgccgcuggccuucuucccuuggcuccgggugggauggauaccuuuucucccuguucaucaaaggaauucuaaacacaacccagacaggcagcaccuaggauuccggguccuccacucucccgauccuacaugguccgggccacggagaacacaacucccgaggcucucacgcucacauacauacaauuccccccgacccccgcacucgcagacacauagcaggguucccagcgcacgcagccuuucacaccggcuucccgucggaagcucagcugucggcuacacagucguacauccuacugacgcggcgcagcgcugcgggccgggagagaggcuuaccuggcagaugcaggccgcgggcgccggggagcgggccggggcugcgcgggcugccagccgcagcgcgcuccagcaggaggccguggucagcucggcagagcagcucaugcucccgcagcgagaacucgucuccagggagcagcuggcggcugcacacggagcagcggaagcacucgaugugguacacgcugucccgcgcccgcaucaccaggucacugcugcugaagcccaccuggcacugggcacacuugaugccgaacagccugcgggcccgggugcggcgggcgucagcgcagggacccgagcccaggacgcgcagccgugucccccccagcccaagggggccgaaccccgggucccgccggcucaccugacguagucccgcuugcaguagguuuucccgucucucacgaagcacgugcacgucucguccagguacuggcugcacuccgcgcacuugaggcaggcggcgugccacucgaggucgggcgacacgcgaaggauaaacuggucguggaucugacucccgcagcccacgcacauggccgucccgggcuucucuagcagggaagggcgcagggcccgcgucaggcccgguacaggacccggccggccuuggccgcugcagcagccccaacccaacccgcccucccuugcuugaucucccgcucuaaaagugagaccacuuucgaaugauccagaaaguaggaaacgaaaacaacacaaucuccugauauuuccauuaucaccgucuuugaacgcggacguaguaucgguucagcuagagacagagcuaacgggaggcagacgacagcacggugacacuggggagcuacggacgccuccguguccacacugucagccaagcccggauuuccgcccgcucccgcucacagcgacucccuauuucaacgcagacaccgcagcauucagcccuguccccucuuagcuucuucgacaguucuuaguuuaaacaccucagaucaagcuacugaaaccucucuaccuuccuaaggcagagaagaaacccauuucucuaaaucaaaccuaauuguccuagcagaaaagaaaaagaauuucacagccugaggucauuccagccaacuugggaaauaaugucuaauugcaaaauaaaauaguaggauuccaacgaauaaacaguguuaugggcgaaaugcacugcuuguuuguuuguuuuuuuuuauucucccaaguauuuugucaaauaaaagccacuuguagaauccgcuaaacauucuucugcauuggaaauguugcauaucaagcacacauacacacccacacacagagaaagacuuacucuuggaaugaucccccauagcacccagaaaaggauaaugaaaaauaauauccaccaugcagagagagaugugagcaaagcuugcggccggggacagaaggaccagggucgagcgcccagccucugcucuuugcuaacuaacuccugccccgcggaguugaaggagcgauuccgcaccggcccgcacgcagcaugacgucagcacgcacucgcccggggcccgagcuggaggcgggaccuguagcgucacccagcucucccaccgcccuggggcuugcucgggagaugauggggacccggagggugggcugggguagacacggaggcgcagggagauuggcugggaggaagugggaaagcucugauugguucggagugaacaauggagcgcagcccccucccccgaaaccuuccuagauccucucugcagccccgggucccgcaaucccuuggaagccgcaucuccaccccgcgggcucugccgcagcgccgcgcuuucuucggacuuguagggcguuugccuagcaaggcaauagucuucugggaauagaugagagucgucucccccuuaaaaguguuuuucuuuuauaauuuuuaaauuaaaaauuccuccuggggacgacagaccuugagggagaaaagaggauucgcuguuucgggaccaucacugguccagccggccaccuuucucccuggugggccugagccuuuguucggcgggguccaaguuagggagaacggguaggaaaugagcaccuggguuuggauaaacucuaugcggacuuucccacccgcgccgccuguagaaaacucgauguugcagguggguaagccaaaaggaauccagagacuuagagccacaguccucccacccacccuggccuaggcacuuuuccucccuccuacuuuuugcucuuuugguuaaauugaugcugacucccacccucuccuuucuccucucagcugcauagagccuaaaaacagugcugugaugugucacucauacaguaaaagauuuuuacgaacucucugauuuuggguuacacaaaccaauuacaacacaacuaaucagaaacaaaugugggacacgggguaauuuaccgucuucccgguggcuuuuuaauccuagaaaaaucugcgauuucuaagacucgggauuuuuuuaaacaaaaaucguugugaauuuuguuucaaaggguugaaagacaaaucgaugagguacaaacaguguuuauccaacgguggucuguuggucccucacucccauucugaaaggacaccaaaaacuugauaccucucuaaguggggcgcgggugggcuucugggauaaaguaucucgaccaaaagcuauguccggacuuggaucccgcaggccucgcugcccgagaucuaucuaauucaggcgcggcgguccaacugcuaagagccgaagcugcugggcugggaaaugguugcagucaagagcgucggcacagguucugcagaaagucgggguuagaaaggcugcucggagaugccccagcgcuggaaacagucuggcaccucgcuccacagccggauuccuguagcuuuugaccccgccuccaccuuuagagcgcuaguguucucuggacccagaguuuugccacagccuacaacccgcuugacaacaggccgacccuuccccaucuuuccuacuagcgccccagccgcucuggcucuggggcugguuaaguuugcaugacuguaucucugcugguaaaccacaaaccaugaaguaaaggguccugcaucagcgcuggucucugugacuuuggguguuucauuucuucuuccucccucacuuuuccucaucugugaaauggguuguacuuagaacagcugucuuugcuuuguuaaaaaaaauuaaacuaaucgcagggaaagccuuagaauccuaccucaucgugcucagugucugguaucuacaguaaccauagugguucucucuguugggacccuauacacuugggagugugccuuuucuggaaagguaucuguguggggccuugcuggaagugaggacuaagcacaucucuugccuguugggcaaugauuuauuuauuugugaaugugcuugcuuugccugcccuagguguggacuuggauuuauuguugaagccagugagugggcucugcacugugccugcuccagguacugggggauacuugucaccucacccuccaccccaaggcuaucuugggcuagaccuggcucccauuaccucuagauccugcaaaccuccuagguaauggcagucuaucuccgcaggaguccuaggcucaaccuuuaacccucuccuaccuagagaaagccccuccuaaccagaaacugaguucuugagaauuugcuaaggauaggggaggggcacucaccuccauuucucugccgcuguaaaaccauuuuccaggucccugagcaugggucuccggggucccagucaccccaggaguccagugcuggcaugagaggggcauaagugauacacgugguccagccuugcuucuccuccuaaaauguccccuuugagaggaagcagggc

SEQ ID NO: 11313 - RNA, 4861 nt, Mus musculus
ggcugcuggccagaacaugggaaacgucggguauacaguggcggcggcagcugcggcagcuaccgccgcugcguccuuggcugcgccggaagguugauguccccagaacauugugccgccaccagggccgggcccugcuccugggggcaaguggccagcucccgggccacccgcacccgcggcggugccagcgcccccacugcucccggugccagggccucccuuggguucuccggcgaccaacacugggucguccuuuuugggacauaggccgaaugcuguggggaaaccguaaggaugcgggaaaagaggcgggggcagcuuuugcaagaggccaaaaccuuugcugggcacuggaaucaccggguagcugcgaaccccugcgcugcccccagguccuccagguccugcagggccacuagcugccgccgccaggccaagugcgcgcugcggaugcgguggagguggcccgggaggcccagccgccucgucuucaccgcagcgcagacuuuuguggggcggugggccuggggccaucucugagccgcacccuggaccgccaccgccaccagcgccgcccuucccugcaccaccagacccgcuauuagcgccgccuccgccgcccccuugcagggagaagguccgcuugcgcguaccgccauuaaacauagccuugacguccucccaagcguggcucaguucgucgguggccgacuugucacugaguuugaggugccgacgccacgaguuaaaguuggcggcgucgggcugaguguacuuggcgucgggugugcggugcgaauggaagaugaacuuguugggagagaaauacauacugcaguagccgcacuugaugcacuuagcacgagagcuguuguaacgggcagggaugaagcugccccgagagccccaugcgcacucgugcaccacgucaaaggcgaaguucucaggcaguuuggggggcuugugcucgcccaggaacgacuugcacaggcguucggccucucguuuugugaucauaccacagcggcgagaggagaugggcauggccccggcccgacgcaguaucuccagcugcaccggcgugcauugcacgcaugugaugcccagggccacgcggcgguuguggaucucauuguagcuguaguuuuugagcaggguguuggagaucugggcuaggcacaggcgcuccugcccaucaaugaccagcgacacgauggguaccccguacagcgacgucucgcccaccugguuggguuuaagggcgcuggaucccgaguagggcugcagcucuugcuuggaguugggagaggagcugcccucgcgucccggccccagcugaguggugagagccuccaugccgccgcuccugcgaaacagagagagcagagagcagaugagccauuuuuuuagcgccgcuaccuagguucaggcccgcccagcggggcgcaacguguggggugcgaggggguuacuuggcaguggggagcucaagcucauucgucccacggacuggccccuuuuguuauucagaccagcuucugagcugaaacaaaagcacccggggggcuaagggaggaaaagggaaaaucgaaaccucaggaaagccccggcugccaggaaaccaauccuguuuucagauuggaaaggaagugggacccagagacggagagugacuugcccaaggccacacagcaaugccauagccaaauccaggcuuuccagccggcacucagguuugcgugccuucagcuaccucacagcucgcccugcccgccaggguccugaagcccggacuucagggaccagcggccccucugcucagucgcgcaugcacgcgugcgggcgggggcagugaagggagagguggggaggcgaaggaggggcacucacugcccaucacaaacugcaggauguaggggugggggcagggagaagggggagggauggagguugaaggaggaggauagaaggaagaggaggaggccacugcuguucgcggugcugaacccuacccuuuccaaagcuugucgcgugcaccacgaccucggguggcccccaaugcaccuaucuucguggugaccggcuuccagggacaacaguaccgguuugcacaaaccuguacuucucuucugacuccuugagcccgguguuccuugagcagaaagaguccagcuggguuuacaaaacgcuuucuugccagccaucaguuaggccgggaucacgcagucucuaaccacauuuucugcauuuuuuagcugcauuccagacuaaagccggcuccccucuugucagcgcuugggacagagagguucucacaggcguuucucuggagucacuuuuuagcuuuggaaacaugccccugagcuuucuguccucuuccacacagcuuuucuuacucagacccaacacaggcuccccaggcucugggcugcuccuuuugugggggugacuccucuuugaguauccuucaugccccgacaucagcucagaugggcuagaaggaaucuuggccacucuuggaagccacuguaaaacuccaagcacuaaaaaguugcugcuggucccucgcuuugaucucuggagaaggcagagaggaagcuguauccacagucuagccugguggaggacccaggaauugauguuuagggccuucuaggucgcccagucaccucacgugucuucagacacucagggcuccauggacccaaugcugggcggcaggcgcucuugccgccaaucuagucccuaggacucccuccuccgaacuuggcuggaaaagcaaauccauuucagagggguagcuucacucuaacagggauccgaauuccaaagcuaagaaccuggcaucuuuggucugcagguaucuuucccucccucuguuugcuuagauacuuauuugucgaucuuaucugucccugagcugucugucgcugccagcucaccgcucuuucucccaucuaucuuguaucuuguucaaguaucaaccuauuuauuaucuguuucaucucuuccagucaaacugaggcaaguugauccucccuugucacugaaauccccaguaacauuuuaggaggcaagcaaacuacugugcuaacucccuggcugaggggucaacaaggcgagcuaggugucccagggacggcucucacacaggcugaggagguggcuaagggggcccgcagcugugggaaaugacgauggcuucugggauuucugggcaaauguaccgggcccgcauagagugaagaggacacccugagccuggagcguccaccugaagcuggggcuccugaguccccaagggguuuucccaaagggcuuuuggccuuggagcccggagaagugagggacccuaggaaggaaacagcauuucgagggccaaagaagaaagcaccaacgaagggccgcacucagggacaaggagcagugcucagggcggcauggggacccccuggcccgcuccuguggcucgaggggcgagccuagcgagguuaagcaggcgggaggugggcagcgguggcagcgaggcuguggagucguuuguuaggauaggaaacaaccgccacagagucuaaaggagaagucaacgaaagaagcgcugcggcggccggcgcgggggcugugggcucgcgaucgcagguacucaccgugcgggcggcuggagccgggcaagcggcgagcggaggugcgcggcgggcggagcggcgggcgggagucggggauccgccgggcucuccgggugacggcgcggccccuccccgcgcgcgcgcacagccgcgcaaccccgcuccccgcgcugccacccgcggccccucccgcucucaacaggcacggggcgccaggguccccggaacggagcccggugcccggaaccgccgcccccgaggccggggacuggcccgaagaagaagccgaagccuagagcucauggcgcagcggcgggcacggccucggucacaggcgggaguggcgaggccggcgcugggcgggagcgccugacagcugcgagccggggcgccacacccaccaccccucgcugucccucgcgcccuccccgggugcgcccgcccgcgggccacgcgccgcgcccgccgccucuccgcagccccagggccugugcgccccagguaagcggccgcccaccugcggcccgcggcucgcaccugcggcccugcgcgagccagagaggccgagugggcggaagggauggaggggaucagaaagucccccccgccccccauaaccaagcgcuaggguccaaagcuagccauugccaccgagggcccgaagccgggcugggugguggaguugaggguuacucaaaagaaaggggaguagggagggucacaucgcgcucccgcugcaaggacaguggaacuaagaguuugcccuggagacccagacgggccguccagacugggauggaguacugagcgcuggggagcgcaaccgggaaggggcaggcgcagcgccccaaggcuccugacucugggagcaggcuagaaugcauuauugugaaagucacccuucugcuuucuucacugggcaagggacggcuggggacuuggguuugugccccaaccccaguaucucuuaucucuaacagguuuaaggcaaacgccaagucauaauuagagagugcgaggggucaacuacuuggucgacgucgcuguucucuagcggugagggguccaaauauuuuggacgucaccaccccuugguacuuucuuuauacucuaaauacucuaaagcauauuucccucucucucucucucucucucucucucucucucucucucucucauccuucugucaggucucuuuucgucuuaauccaugaguuacuaguagcacaccc

SEQ ID NO: 11314 - RNA, 4861 nt, Mus musculus
gggugugcuacuaguaacucauggauuaagacgaaaagagaccugacagaaggaugagagagagagagagagagagagagagagagagagagagagagggaaauaugcuuuagaguauuuagaguauaaagaaaguaccaagggguggugacguccaaaauauuuggaccccucaccgcuagagaacagcgacgucgaccaaguaguugaccccucgcacucucuaauuaugacuuggcguuugccuuaaaccuguuagagauaagagauacugggguuggggcacaaacccaaguccccagccgucccuugcccagugaagaaagcagaagggugacuuucacaauaaugcauucuagccugcucccagagucaggagccuuggggcgcugcgccugccccuucccgguugcgcuccccagcgcucaguacuccaucccagucuggacggcccgucugggucuccagggcaaacucuuaguuccacuguccuugcagcgggagcgcgaugugacccucccuacuccccuuucuuuugaguaacccucaacuccaccacccagcccggcuucgggcccucgguggcaauggcuagcuuuggacccuagcgcuugguuauggggggcgggggggacuuucugauccccuccaucccuuccgcccacucggccucucuggcucgcgcagggccgcaggugcgagccgcgggccgcaggugggcggccgcuuaccuggggcgcacaggcccuggggcugcggagaggcggcgggcgcggcgcguggcccgcgggcgggcgcacccggggagggcgcgagggacagcgaggggugguggguguggcgccccggcucgcagcugucaggcgcucccgcccagcgccggccucgccacucccgccugugaccgaggccgugcccgccgcugcgccaugagcucuaggcuucggcuucuucuucgggccaguccccggccucgggggcggcgguuccgggcaccgggcuccguuccggggacccuggcgccccgugccuguugagagcgggaggggccgcggguggcagcgcggggagcgggguugcgcggcugugcgcgcgcgcggggaggggccgcgccgucacccggagagcccggcggauccccgacucccgcccgccgcuccgcccgccgcgcaccuccgcucgccgcuugcccggcuccagccgcccgcacggugaguaccugcgaucgcgagcccacagcccccgcgccggccgccgcagcgcuucuuucguugacuucuccuuuagacucuguggcgguuguuuccuauccuaacaaacgacuccacagccucgcugccaccgcugcccaccucccgccugcuuaaccucgcuaggcucgccccucgagccacaggagcgggccaggggguccccaugccgcccugagcacugcuccuugucccugagugcggcccuucguuggugcuuucuucuuuggcccucgaaaugcuguuuccuuccuagggucccucacuucuccgggcuccaaggccaaaagcccuuugggaaaaccccuuggggacucaggagccccagcuucagguggacgcuccaggcucaggguguccucuucacucuaugcgggcccgguacauuugcccagaaaucccagaagccaucgucauuucccacagcugcgggcccccuuagccaccuccucagccugugugagagccgucccugggacaccuagcucgccuuguugaccccucagccagggaguuagcacaguaguuugcuugccuccuaaaauguuacuggggauuucagugacaagggaggaucaacuugccucaguuugacuggaagagaugaaacagauaauaaauagguugauacuugaacaagauacaagauagaugggagaaagagcggugagcuggcagcgacagacagcucagggacagauaagaucgacaaauaaguaucuaagcaaacagagggagggaaagauaccugcagaccaaagaugccagguucuuagcuuuggaauucggaucccuguuagagugaagcuaccccucugaaauggauuugcuuuuccagccaaguucggaggagggaguccuagggacuagauuggcggcaagagcgccugccgcccagcauuggguccauggagcccugagugucugaagacacgugaggugacugggcgaccuagaaggcccuaaacaucaauuccuggguccuccaccaggcuagacuguggauacagcuuccucucugccuucuccagagaucaaagcgagggaccagcagcaacuuuuuagugcuuggaguuuuacaguggcuuccaagaguggccaagauuccuucuagcccaucugagcugaugucggggcaugaaggauacucaaagaggagucacccccacaaaaggagcagcccagagccuggggagccuguguugggucugaguaagaaaagcuguguggaagaggacagaaagcucaggggcauguuuccaaagcuaaaaagugacuccagagaaacgccugugagaaccucucugucccaagcgcugacaagaggggagccggcuuuagucuggaaugcagcuaaaaaaugcagaaaaugugguuagagacugcgugaucccggccuaacugauggcuggcaagaaagcguuuuguaaacccagcuggacucuuucugcucaaggaacaccgggcucaaggagucagaagagaaguacagguuugugcaaaccgguacuguugucccuggaagccggucaccacgaagauaggugcauugggggccacccgaggucguggugcacgcgacaagcuuuggaaaggguaggguucagcaccgcgaacagcaguggccuccuccucuuccuucuauccuccuccuucaaccuccaucccucccccuucucccugcccccaccccuacauccugcaguuugugaugggcagugagugccccuccuucgccuccccaccucucccuucacugcccccgcccgcacgcgugcaugcgcgacugagcagaggggccgcuggucccugaaguccgggcuucaggacccuggcgggcagggcgagcugugagguagcugaaggcacgcaaaccugagugccggcuggaaagccuggauuuggcuauggcauugcuguguggccuugggcaagucacucuccgucucugggucccacuuccuuuccaaucugaaaacaggauugguuuccuggcagccggggcuuuccugagguuucgauuuucccuuuuccucccuuagccccccgggugcuuuuguuucagcucagaagcuggucugaauaacaaaaggggccaguccgugggacgaaugagcuugagcuccccacugccaaguaacccccucgcaccccacacguugcgccccgcugggcgggccugaaccuagguagcggcgcuaaaaaaauggcucaucugcucucugcucucucuguuucgcaggagcggcggcauggaggcucucaccacucagcuggggccgggacgcgagggcagcuccucucccaacuccaagcaagagcugcagcccuacucgggauccagcgcccuuaaacccaaccaggugggcgagacgucgcuguacgggguacccaucgugucgcuggucauugaugggcaggagcgccugugccuagcccagaucuccaacacccugcucaaaaacuacagcuacaaugagauccacaaccgccgcguggcccugggcaucacaugcgugcaaugcacgccggugcagcuggagauacugcgucgggccggggccaugcccaucuccucucgccgcugugguaugaucacaaaacgagaggccgaacgccugugcaagucguuccugggcgagcacaagccccccaaacugccugagaacuucgccuuugacguggugcacgagugcgcauggggcucucggggcagcuucaucccugcccguuacaacagcucucgugcuaagugcaucaagugcggcuacugcaguauguauuucucucccaacaaguucaucuuccauucgcaccgcacacccgacgccaaguacacucagcccgacgccgccaacuuuaacucguggcgucggcaccucaaacucagugacaagucggccaccgacgaacugagccacgcuugggaggacgucaaggcuauguuuaauggcgguacgcgcaagcggaccuucucccugcaagggggcggcggaggcggcgcuaauagcgggucugguggugcagggaagggcggcgcugguggcgguggcgguccagggugcggcucagagauggccccaggcccaccgccccacaaaagucugcgcugcggugaagacgaggcggcugggccucccgggccaccuccaccgcauccgcagcgcgcacuuggccuggcggcggcagcuaguggcccugcaggaccuggaggaccugggggcagcgcagggguucgcagcuacccggugauuccagugcccagcaaagguuuuggccucuugcaaaagcugcccccgccucuuuucccgcauccuuacgguuuccccacagcauucggccuaugucccaaaaaggacgacccaguguuggucgccggagaacccaagggaggcccuggcaccgggagcagugggggcgcuggcaccgccgcgggugcggguggcccgggagcuggccacuugcccccaggagcagggcccggcccugguggcggcacaauguucuggggacaucaaccuuccggcgcagccaaggacgcagcggcgguagcugccgcagcugccgccgccacuguauacccgacguuucccauguucuggccagcagcc

SEQ ID NO: 11315 - RNA, 501 nt, Mus musculus
aucugucuuuuugaguugaguccacagagaagcaagaccgacccuuccugggcgaaccaacuugcagaguuuucuuaaacucucagguggagcagacguacugcuuagucagaggauugucagggcugugcucccucccccugcaaauuggaguucacuguugcuucaaguuuccugaugcuucggguuugagacagcgguauuucauucccaggcuuuccuaggacagguugcaugauuauuuuguuccuaugagaaagugcuuuaccauagguaagcuaauuugccgcccaagugucuggagagagguuagcuuaaaagcauugaauuggaaacaacccccagaacuuccaggggugcuucggaugguugucagcagccuaauuugauacuuuagaaaauauccuaguguuuucuguaguguauugucuguguucaucccuuugucucauugacuuaaacugcaggacccagccuauuuuugucuggcauucugcuuac

SEQ ID NO: 11316 - RNA, 501 nt, Mus musculus
guaagcagaaugccagacaaaaauaggcuggguccugcaguuuaagucaaugagacaaagggaugaacacagacaauacacuacagaaaacacuaggauauuuucuaaaguaucaaauuaggcugcugacaaccauccgaagcaccccuggaaguucuggggguuguuuccaauucaaugcuuuuaagcuaaccucucuccagacacuugggcggcaaauuagcuuaccuaugguaaagcacuuucucauaggaacaaaauaaucaugcaaccuguccuaggaaagccugggaaugaaauaccgcugucucaaacccgaagcaucaggaaacuugaagcaacagugaacuccaauuugcagggggagggagcacagcccugacaauccucugacuaagcaguacgucugcuccaccugagaguuuaagaaaacucugcaaguugguucgcccaggaagggucggucuugcuucucuguggacucaacucaaaaagacagau

SEQ ID NO: 11317 - RNA, 3028 nt, Mus musculus
cuuagccaaaacauuuaucggagugcuuagcaacacuucauugagcauucucagacauagaugucugaaagcgguagcccuuacguggcaguaggauuucccucacuuccccucaugaaugaaaaugaaucaacugcccggagugggggcacuaugggaacuggucucuuucggacaacuugccccucccccaccccuugcuggaaggagccaacuucuuaacucucucaauuuaacuuuuuuuuucaaacgcacacacaggcacacaaauguuucgugggcccaucuagaguccaggcgucaccuacgucuucuauaaaggcuaccuagccaaggacgagcuuagacuuguuucuucgccccccucccccaauccuaccccaguauucuuuagaagacccuaaccuuggagcugagaggagguguaugccaaagaucugaauuggucaggggaugguggcugaggaagccagaugcaggucccauuugucaacugcucucaaaugcacugacuccacgcacucugaucugugcacucaaagacuggaggagaacccuccucaaaggucccauugacugacccuggguaaaacuuaaucccagugcauucaggaggaacccaaaaaggaagucucagaagcugcgagagcuggccuaacccagcagcacuuugaaagcaguggaggauggagccagggcagcucccccgagcaucuggagaugccacuagcgccuagucuccccaagcuggagcgcuuuccacuggcccuccauggaauucuucgcggagcguacaguacuucacuucguuuucuggcaaugccuugagucccugcugcaagccuggagucccuggcaaagccaccagauuauaaagagcgaccuaugcagcccgugcacuucacugaaagcgacagagacuauagaggacauugcccuacagauggauacacugagucccacuuggcacacaagcaagccaccuuuccuucucccuccaaaacuccaaagaaaccgccaaacuccugugccacagaucuaucucgggcacacuaaucaaucgcuuccaaagccaagcagccccugcugggcauucugccagccccggguuaaggugcaagcaagaagccacuuuccccaguuaucuuugggaaagggcgcgagggguggggguugggguggggaacagaagccagacugaccugagccggaggugacagagggagcgggcguccagcagccugcgcgugggaccccccgggccugggagggcgcugcgcuccgggagcaccuggcggccgccgguguggaaaaggcgaugggagcacccagcagcagcgccuagugcgcagagugagcggaggcagggggacugaaugcagcugcgggcggacgcgucugcagcggccgccuuugccgacugggaagagacuccgcgccgcgggcuacuuaauagagggcuguucccggcucucaguuuacucgguuacgaaacgccugagaagguggaaggcugccacgggugauguaugcuccucggcggugaaggaggucuacuuuugggaacgugugcauacuucgagcauuccuucggcgugagguggcgaucgccguaguagcaaugccccuccgggggcggggaggagggagggagagagggggacagccgcagccggguucccugccaagggaggccgcggacuccuccgcuuggggcgggcuagggggcucggguuucccuaacccaacgaguuucuuuaauacguuuauuuuucuaaaauaagaacaauggagaaguggggaacggaucuucguuucagagcagcgggaugggcauccccuuugucccucaccauugcaucuccggccgccaccguccccacguccaccuuccucccccucuguccugggugcacuuaaaaccgauuuacaggcuuuccauuaacuaacugucugugcacgcggcgggccucugucuuucccagucuccaaggcgcgacuuugaaaacuccgacagccgccugccugcucccggcucagggcuaggauggcuuucccaggccugucugucuaaccuaguuuuucaggauagagaugggaggcuucgauucagucuggagggagggagaggaaaguuauugguaccugggggcgggggcggcgggggcaucccaacgggacacuuaagaacaaguuuuauucuccuuagaaauuucuugucaguuuaagaguaaaaucuggcccacguuggggcuucaggcagcucuucccuaaaaaauuccuagaggugaaaaggacggagaggagcucgcucggggacgcucgcacgcaggcgcgagcuacugagaaggccaacuaggagccggauacuccgccagcacacgggcucuuuucugcagcuccccgguucccggcacuccaccccuuggacgcagugggagucuggcacuugaaguugccaaauuguacaagacgcaugggaugaaguguccaguagucacacguuguuauccggaaagggcucgaagacggauuccuacacgcguuugugagcucagaacucgcuccgcgaauuucccgccccuugaagcccagagacgucgccucagcaggguugggcuaguggguacuggaaacaggacagggcucuagacccuggaguagaccgccccuugguagcagaaguugcgagcacaccugacuuaagccuuucuuccaugcuugaucuuaccucugcagauuugacuucccugcucuaggcacauuaguguuggaauugaccaaaacucugcacgcuuuuucccaguucccuugcgccuugccccacgcacgggcggccucuggccagagcuaaccagagcaagagaggagccuggaagaaaagaaacgagaaaaaugagaauggccaccaccucugcacauucuuggagcacgcagggcccacucaaaggccgcugagcaacuugcacaaagcgcccacacaaugcgcaggcuuuucccucaugucuccacaguucuggugucugcc

SEQ ID NO: 11318 - RNA, 3028 nt, Mus musculus
ggcagacaccagaacuguggagacaugagggaaaagccugcgcauugugugggcgcuuugugcaaguugcucagcggccuuugagugggcccugcgugcuccaagaaugugcagaggugguggccauucucauuuuucucguuucuuuucuuccaggcuccucucuugcucugguuagcucuggccagaggccgcccgugcguggggcaaggcgcaagggaacugggaaaaagcgugcagaguuuuggucaauuccaacacuaaugugccuagagcagggaagucaaaucugcagagguaagaucaagcauggaagaaaggcuuaagucaggugugcucgcaacuucugcuaccaaggggcggucuacuccagggucuagagcccuguccuguuuccaguacccacuagcccaacccugcugaggcgacgucucugggcuucaaggggcgggaaauucgcggagcgaguucugagcucacaaacgcguguaggaauccgucuucgagcccuuuccggauaacaacgugugacuacuggacacuucaucccaugcgucuuguacaauuuggcaacuucaagugccagacucccacugcguccaagggguggagugccgggaaccggggagcugcagaaaagagcccgugugcuggcggaguauccggcuccuaguuggccuucucaguagcucgcgccugcgugcgagcguccccgagcgagcuccucuccguccuuuucaccucuaggaauuuuuuagggaagagcugccugaagccccaacgugggccagauuuuacucuuaaacugacaagaaauuucuaaggagaauaaaacuuguucuuaagugucccguugggaugcccccgccgcccccgcccccagguaccaauaacuuuccucucccucccuccagacugaaucgaagccucccaucucuauccugaaaaacuagguuagacagacaggccugggaaagccauccuagcccugagccgggagcaggcaggcggcugucggaguuuucaaagucgcgccuuggagacugggaaagacagaggcccgccgcgugcacagacaguuaguuaauggaaagccuguaaaucgguuuuaagugcacccaggacagagggggaggaagguggacguggggacgguggcggccggagaugcaauggugagggacaaaggggaugcccaucccgcugcucugaaacgaagauccguuccccacuucuccauuguucuuauuuuagaaaaauaaacguauuaaagaaacucguuggguuagggaaacccgagcccccuagcccgccccaagcggaggaguccgcggccucccuuggcagggaacccggcugcggcugucccccucucucccucccuccuccccgcccccggaggggcauugcuacuacggcgaucgccaccucacgccgaaggaaugcucgaaguaugcacacguucccaaaaguagaccuccuucaccgccgaggagcauacaucacccguggcagccuuccaccuucucaggcguuucguaaccgaguaaacugagagccgggaacagcccucuauuaaguagcccgcggcgcggagucucuucccagucggcaaaggcggccgcugcagacgcguccgcccgcagcugcauucagucccccugccuccgcucacucugcgcacuaggcgcugcugcugggugcucccaucgccuuuuccacaccggcggccgccaggugcucccggagcgcagcgcccucccaggcccggggggucccacgcgcaggcugcuggacgcccgcucccucugucaccuccggcucaggucagucuggcuucuguuccccaccccaacccccaccccucgcgcccuuucccaaagauaacuggggaaaguggcuucuugcuugcaccuuaacccggggcuggcagaaugcccagcaggggcugcuuggcuuuggaagcgauugauuagugugcccgagauagaucuguggcacaggaguuuggcgguuucuuuggaguuuuggagggagaaggaaagguggcuugcuugugugccaagugggacucaguguauccaucuguagggcaauguccucuauagucucugucgcuuucagugaagugcacgggcugcauaggucgcucuuuauaaucugguggcuuugccagggacuccaggcuugcagcagggacucaaggcauugccagaaaacgaagugaaguacuguacgcuccgcgaagaauuccauggagggccaguggaaagcgcuccagcuuggggagacuaggcgcuaguggcaucuccagaugcucgggggagcugcccuggcuccauccuccacugcuuucaaagugcugcuggguuaggccagcucucgcagcuucugagacuuccuuuuuggguuccuccugaaugcacugggauuaaguuuuacccagggucagucaaugggaccuuugaggaggguucuccuccagucuuugagugcacagaucagagugcguggagucagugcauuugagagcaguugacaaaugggaccugcaucuggcuuccucagccaccauccccugaccaauucagaucuuuggcauacaccuccucucagcuccaagguuagggucuucuaaagaauacugggguaggauugggggaggggggcgaagaaacaagucuaagcucguccuuggcuagguagccuuuauagaagacguaggugacgccuggacucuagaugggcccacgaaacauuugugugccugugugugcguuugaaaaaaaaaguuaaauugagagaguuaagaaguuggcuccuuccagcaaggggugggggaggggcaaguuguccgaaagagaccaguucccauagugcccccacuccgggcaguugauucauuuucauucaugaggggaagugagggaaauccuacugccacguaagggcuaccgcuuucagacaucuaugucugagaaugcucaaugaaguguugcuaagcacuccgauaaauguuuuggcuaag

SEQ ID NO: 11319 - RNA, 2223 nt, Mus musculus
agcuguaacacagaguucuccccagagcauagaguauuaauugucaaguucaaguacugccaggcuguauguagaggugucucaggccucagacaacaucuacaagugcuacuggcuuagagggcaacaacauccaugauacaaaacggggcagggauacccauccaucaccaauguuaaaaaguugcaaccuuuugugugaauggcugcuggaggaucugugcugagcccggacuuugaguggaggaagcuaaguuccucggguauggaagcuuuacaguaguuugcguuguucacauuccagagugcucucucagagaagcuaggcuucugccggggccucugaggauccauugcccuugcccagaagagagagccuugcuuccacccaguaacagggaaagaagauuugaccuaccugugaaaagacccaacuugguccccaaaggucgcuuaggcgaccccacugccauugacaagucaaccugcgcacuuaaagcguaucaguuuguggaacgcuuguuugaaguccucauuggacaugguguagaugaugggguugaugagggaguuaagauagccuaaccaauugaagaagucaaaaauggccaugugaaaccagcaggcauccuuacagauaggcaucaccagggagaugaugaagaagggcagccaacacacaauaaaugcuccuaaaaugaucccuagggucuugguggcuuugcgcucccuagcggccaugaguuucuucuuuuccagcagggcgucugagacucgcacuuugacuugguucacguacacaggagacccggacucacugggcacguccggagcccgggaguuaauggaggugaccgaggauguggaucccggggagucuguuaucaacugggcucgggucaagcgcuugccggucuuguugggugucuguuucaaaauccgagagcgggcuuccacauagaugcggccauagagggcgaugaggagcaggguggguaaauagaaagcgcccaccguggaguagaccguguagaggacguggucgguguucacaaagcaguccagcaucuccuccucugcuuuggcuugacgccagaagaaggguggcaacgaaauagagauggagaagacccacaccagcacgaucaugauggccgcccuuuugggaguccuuuuagcagaauacuccaccgcaucggugauggcccaguagcgguccagggcgaugacacagagaugcaugauggaagcagugcaacaggugauauccgacgacagccagaagucgcagaccaccuggccuaguguccagcguccagugaccguguacauggugcugaugggcaucaccaggauggacacgagcaggucagugacugccagagaggcgaucagguaguuagccgggguguguagcuuccggguccgauacaccguagcgauuacaaaggcguuggagagcgugguggccaaggugaugagcgccaacaaagcaaccagcaggacuuuccagggcagggcgauggaguccugguaaauguagccgucggcgcugcaguugugggagagguuggugagagguaccccugucugggaggcggcgggaggcggcggggcgcacugaauacccugcuccuccauagcucuccucguccuggcugcggagcgcagcucuugaacauggagcggaccagggaaagaacagaggacgggaggaucauggagacuauaggcuugucuccuuuggcuagccaguuccgugggcuccucaguaacuccuccgccuguguucucagcccaaaggagaggucacaggcgcggccaccaagccugcgggcgcguccccugcacuuccagugcgccaggcgcugcugccgcgucugcuagcuccucuccacuccccgucuucgcccgggugaauaaagcacuggcccacccaguccagcuucucucagguucccuggaggcaaacaguggagaaggacuaaguaucgcuuguagaggggucucggggucuagugggaccucuuaccccaauugcucaggucucagcuucuccuaacccgggcgcuccggaaucugcagacuccgcccgaaggaguuugcuggcugugcagaccgaagcuugcaggccagugcagaguccugggcuugcauccccaccccaugcccccuacaagcccggagcuccgccacuuucuuuggccgccgccugacuugggg

SEQ ID NO: 11320 - RNA, 2223 nt, Mus musculus
ccccaagucaggcggcggccaaagaaaguggcggagcuccgggcuuguagggggcaugggguggggaugcaagcccaggacucugcacuggccugcaagcuucggucugcacagccagcaaacuccuucgggcggagucugcagauuccggagcgcccggguuaggagaagcugagaccugagcaauugggguaagaggucccacuagaccccgagaccccucuacaagcgauacuuaguccuucuccacuguuugccuccagggaaccugagagaagcuggacugggugggccagugcuuuauucacccgggcgaagacggggaguggagaggagcuagcagacgcggcagcagcgccuggcgcacuggaagugcaggggacgcgcccgcaggcuugguggccgcgccugugaccucuccuuugggcugagaacacaggcggaggaguuacugaggagcccacggaacuggcuagccaaaggagacaagccuauagucuccaugauccucccguccucuguucuuucccugguccgcuccauguucaagagcugcgcuccgcagccaggacgaggagagcuauggaggagcaggguauucagugcgccccgccgccucccgccgccucccagacagggguaccucucaccaaccucucccacaacugcagcgccgacggcuacauuuaccaggacuccaucgcccugcccuggaaaguccugcugguugcuuuguuggcgcucaucaccuuggccaccacgcucuccaacgccuuuguaaucgcuacgguguaucggacccggaagcuacacaccccggcuaacuaccugaucgccucucuggcagucacugaccugcucguguccauccuggugaugcccaucagcaccauguacacggucacuggacgcuggacacuaggccagguggucugcgacuucuggcugucgucggauaucaccuguugcacugcuuccaucaugcaucucugugucaucgcccuggaccgcuacugggccaucaccgaugcgguggaguauucugcuaaaaggacucccaaaagggcggccaucaugaucgugcuggugugggucuucuccaucucuauuucguugccacccuucuucuggcgucaagccaaagcagaggaggagaugcuggacugcuuugugaacaccgaccacguccucuacacggucuacuccacggugggcgcuuucuauuuacccacccugcuccucaucgcccucuauggccgcaucuauguggaagcccgcucucggauuuugaaacagacacccaacaagaccggcaagcgcuugacccgagcccaguugauaacagacuccccgggauccacauccucggucaccuccauuaacucccgggcuccggacgugcccagugaguccgggucuccuguguacgugaaccaagucaaagugcgagucucagacgcccugcuggaaaagaagaaacucauggccgcuagggagcgcaaagccaccaagacccuagggaucauuuuaggagcauuuauuguguguuggcugcccuucuucaucaucucccuggugaugccuaucuguaaggaugccugcugguuucacauggccauuuuugacuucuucaauugguuaggcuaucuuaacucccucaucaaccccaucaucuacaccauguccaaugaggacuucaaacaagcguuccacaaacugauacgcuuuaagugcgcagguugacuugucaauggcaguggggucgccuaagcgaccuuuggggaccaaguugggucuuuucacagguaggucaaaucuucuuucccuguuacuggguggaagcaaggcucucucuucugggcaagggcaauggauccucagaggccccggcagaagccuagcuucucugagagagcacucuggaaugugaacaacgcaaacuacuguaaagcuuccauacccgaggaacuuagcuuccuccacucaaaguccgggcucagcacagauccuccagcagccauucacacaaaagguugcaacuuuuuaacauuggugauggauggguaucccugccccguuuuguaucauggauguuguugcccucuaagccaguagcacuuguagauguugucugaggccugagacaccucuacauacagccuggcaguacuugaacuugacaauuaauacucuaugcucuggggagaacucuguguuacagcu

SEQ ID NO: 11321 - RNA, 1356 nt, Mus musculus
gcccacucacccccaaacacagguggauggaucucuuaaacuuuuccugguuccugagguuugucggauuggguuuuguuuucuguuuuuaauggcaguuuggaaaccuuguugccgaucucccucuccccucauuuuuuuuuccuuuuuuuuccccuccggucugguccguuguguggcuugcucccacccccaacucgcucacucugcccucccauucccaucccagucccuuucauucagguaaaacuguaaauuucccaacgcgccauuguuccucuggaucucccaaagcucccuagagaucccggaauacuuuuuugguauuuaaauccccgguagauaggaccaauguaaauuuugugacauucaaaccuuuuccaguucacaaaucagucacccuugucacaguuauugaaauuccgcaacuugccacaacaagacgguggaaaaagcgggcgcggucuuuguugccaaccaggcuuuugaucgccagagaaaauuuacuuaccuucagaugagugagcagaaaaagaaauaacacucccuuugauuuaguuaggaaaaugcagacauuuggauuccgugcaaacauacaacacucgcuuguuuucgcgaugcggcccucgauuaaccugucuuugcccagcgcaaagucuauucaacaacugcgcguaguugcuuuuugucccauccacaaagaaccauugacuauauauuaaaaugauuguugaaagguagagggguauggcacguaaaagcagggggaaaaucccuguaacucaaucaauuaaaccgggcgacauuuauacauuucaaaaacugcacgcggauguggagccgggggcgauggagguugcgguucuacuuagcucaguuuuaagcccaucagcuuggcccaggauuuagccuuagcgccugcauauucauuaggucuaauuauuuucuaguaaggaaaacacaaaaagccaagagucggaauucuucaauuugcccuuuguuucuaacuucauuuggcuucuuugcaacugaaucaaggcucuaaacucuuugccagacaaagagaccuucaacucauccuuucacaugauguccgcuuagaaaacuuaacaguucuccaagcaaaagaaaaagaaaaccucucucucucucucucucucucucucucucucucucucucucucucucucccucucucccucucucucccucucucucccucucucucccucucucucccucccucucucucucucucucucucucucucucucucucucucucucucucucucucucucccagcuagcuugcuagggcuagaggaaggaugaacaucaguggcuacuccuacccu

SEQ ID NO: 11322 - RNA, 1356 nt, Mus musculus
aggguaggaguagccacugauguucauccuuccucuagcccuagcaagcuagcugggagagagagagagagagagagagagagagagagagagagagagagagagagagagagggagggagagagagggagagagagggagagagagggagagagagggagagagggagagagagagagagagagagagagagagagagagagagagagagagagagguuuucuuuuucuuuugcuuggagaacuguuaaguuuucuaagcggacaucaugugaaaggaugaguugaaggucucuuugucuggcaaagaguuuagagccuugauucaguugcaaagaagccaaaugaaguuagaaacaaagggcaaauugaagaauuccgacucuuggcuuuuuguguuuuccuuacuagaaaauaauuagaccuaaugaauaugcaggcgcuaaggcuaaauccugggccaagcugaugggcuuaaaacugagcuaaguagaaccgcaaccuccaucgcccccggcuccacauccgcgugcaguuuuugaaauguauaaaugucgcccgguuuaauugauugaguuacagggauuuucccccugcuuuuacgugccauaccccucuaccuuucaacaaucauuuuaauauauagucaaugguucuuuguggaugggacaaaaagcaacuacgcgcaguuguugaauagacuuugcgcugggcaaagacagguuaaucgagggccgcaucgcgaaaacaagcgaguguuguauguuugcacggaauccaaaugucugcauuuuccuaacuaaaucaaagggaguguuauuucuuuuucugcucacucaucugaagguaaguaaauuuucucuggcgaucaaaagccugguuggcaacaaagaccgcgcccgcuuuuuccaccgucuuguuguggcaaguugcggaauuucaauaacugugacaagggugacugauuugugaacuggaaaagguuugaaugucacaaaauuuacauugguccuaucuaccggggauuuaaauaccaaaaaaguauuccgggaucucuagggagcuuugggagauccagaggaacaauggcgcguugggaaauuuacaguuuuaccugaaugaaagggacugggaugggaaugggagggcagagugagcgaguugggggugggagcaagccacacaacggaccagaccggaggggaaaaaaaaggaaaaaaaaaugaggggagagggagaucggcaacaagguuuccaaacugccauuaaaaacagaaaacaaaacccaauccgacaaaccucaggaaccaggaaaaguuuaagagauccauccaccuguguuugggggugagugggc

SEQ ID NO: 11323 - RNA, 783 nt, Mus musculus
aacuccuccaccuguuugaucugcuggaaggugagcgcgguccgccaggcauuggcggccugaguggcauugcgagcugacaccacgaaaggcuuggaggaggagcccgaaccacuggucauguucagggcaaacugcuccauuucgggacucaccagcagccccacaaagucauauacccuccguagggucuuaacggggucucccaccagauccucguaccucaccaccaaguagugucccugcagccagucaggaggcugcagggcuguuugcagcgucuuggccauacuguugcagaugaccuccauugcacccagagcgugguagucugcugggccacccauacccuccuucuuggcaccaagcuuguggccagcagccuccaggaagggcaugcggugggcucuuggaucccggcuucgcaccaccuguaggcuuucccggaugaggccgugacgcgagcggaugcgggagcuggcaacagcacgaggaucacguacuagguggaugaccuugagguccaaggcuggaucuuuaagcagcggcgccaacacagccacaucgaagacccgcacgcccuugauaaccagcgugcgguacuugcgacacuccuccucgaagcgugccaggcguugaggugggcacuuuuugcacacgcggucguccaccaguccgacgaccuccuugcgguaggcaggacagaguggcgaggagcauaccaccuuguuaguggcugccccaaagaugcccagaguggugagguugcgccccccacugccu

SEQ ID NO: 11324 - RNA, 783 nt, Mus musculus
aggcaguggggggcgcaaccucaccacucugggcaucuuuggggcagccacuaacaaggugguaugcuccucgccacucuguccugccuaccgcaaggaggucgucggacugguggacgaccgcgugugcaaaaagugcccaccucaacgccuggcacgcuucgaggaggagugucgcaaguaccgcacgcugguuaucaagggcgugcgggucuucgauguggcuguguuggcgccgcugcuuaaagauccagccuuggaccucaaggucauccaccuaguacgugauccucgugcuguugccagcucccgcauccgcucgcgucacggccucauccgggaaagccuacagguggugcgaagccgggauccaagagcccaccgcaugcccuuccuggaggcugcuggccacaagcuuggugccaagaaggaggguauggguggcccagcagacuaccacgcucugggugcaauggaggucaucugcaacaguauggccaagacgcugcaaacagcccugcagccuccugacuggcugcagggacacuacuugguggugagguacgaggaucuggugggagaccccguuaagacccuacggaggguauaugacuuuguggggcugcuggugagucccgaaauggagcaguuugcccugaacaugaccagugguucgggcuccuccuccaagccuuucguggugucagcucgcaaugccacucaggccgccaaugccuggcggaccgcgcucaccuuccagcagaucaaacagguggaggaguu

SEQ ID NO: 11325 - RNA, 842 nt, Mus musculus
gcgccgccgucugucgccccggcuccuccccuucgccgugcuccccuccuccucugccugucccacacccgcccuccucgcagcuccagacucccgccgccaccuccuuaggggcuggagaugcgacccgguucaaggaggcgcugcuagggccuccagccguuaguagcagaacagagcucuaggugcgcccggggcgcggcgccggcgccugauucccagcucgcccgcacagccggagacuuggguucucuguagcugcacgacucggcucccaggauucgcucuggagaagaguuggugauaaaaguuugagcagaaauaccccggacguacgcuccuuucauccccagcggucagcacugguguccccuccuaggacgcgagcagcaccgcccaacagcgcugugugcagcgggaacccaguucugaagccuuggcccuggugcuagcccauuccagcggguuugugguuucucccucaaggaggaaguaauaaaucuuucugggcccggggucacugaagaggcuucagaguaugccucuccgcaaccuuuccgaguguccuggauuuggacaaggccacaagguuucgaugaucccacccccaccuccugcccggcagauguucuaggcuuguggaguuuccaccucugcugacacccucugagacagggcugcuggggggaggggagggcgcuuuguuuaaauuuguggugugauagugaguccauugacuuuaaagaggaagagaugagaucaaagaacuugaucgcaaaggaaaacguuuuuggacguugaaaguuacuuuuuaguuuggucugcguugguuuguauacuuu

SEQ ID NO: 11326 - RNA, 842 nt, Mus musculus
aaaguauacaaaccaacgcagaccaaacuaaaaaguaacuuucaacguccaaaaacguuuuccuuugcgaucaaguucuuugaucucaucucuuccucuuuaaagucaauggacucacuaucacaccacaaauuuaaacaaagcgcccuccccuccccccagcagcccugucucagagggugucagcagagguggaaacuccacaagccuagaacaucugccgggcaggaggugggggugggaucaucgaaaccuuguggccuuguccaaauccaggacacucggaaagguugcggagaggcauacucugaagccucuucagugaccccgggcccagaaagauuuauuacuuccuccuugagggagaaaccacaaacccgcuggaaugggcuagcaccagggccaaggcuucagaacuggguucccgcugcacacagcgcuguugggcggugcugcucgcguccuaggaggggacaccagugcugaccgcuggggaugaaaggagcguacguccgggguauuucugcucaaacuuuuaucaccaacucuucuccagagcgaauccugggagccgagucgugcagcuacagagaacccaagucuccggcugugcgggcgagcugggaaucaggcgccggcgccgcgccccgggcgcaccuagagcucuguucugcuacuaacggcuggaggcccuagcagcgccuccuugaaccgggucgcaucuccagccccuaaggagguggcggcgggagucuggagcugcgaggagggcgggugugggacaggcagaggaggaggggagcacggcgaaggggaggagccggggcgacagacggcggcgc

SEQ ID NO: 11327 - RNA, 858 nt, Mus musculus
caugagcugcacggcgcacguguucagcugccugucgcugcgccugcgcgccgccuucuucuaccuggacuacgcuuccaucagcuacuauggcuucggcagcaccguggccuacuacuacuaccugcugcccagccugagccugcuggacgccagggucaugacgccguaugugcagcagcgccugggcuggcacguggacugcacccgccucaucgcggucuaccgcgcgcucgugcugcccguggccuucgugcuggcuguggccugcaccguggcuugcuguaagagccgcaccgacuggugcuccuacccguucgcccugcgcaccuucgucuucgucaugccgcucagcauggccugccccauuaugcuagagagcuggcucuucgaccugcgaggcgagaaccccacacucuucgugcacuucuaccgccgcuacuucuggcuggugguggccgccuucuucaacgugagcaagaucccugagcgcauccagccgggucucuucgacaucauuggccacagccaucagcucuuccacaucuucacuuuccucagcaucuaugaccagguguacuacguggaagagggccugcgccaguuccuccaggcacccccugccgcgcccaccuucucgggcacagugggcuacaugcugcugcuggugguuugccugggacuagucaucaggaaguuccugaacagcaccgaauucugcaguaaaaagugagccuccacccccggaggaggcuaugguuugcccaccgguuugcguggaguuucuguuguuguuguuguuauuguugguuuguuuucaaguuuuguuguuuccuucuuugcuggaagagggugcug

SEQ ID NO: 11328 - RNA, 858 nt, Mus musculus
cagcacccucuuccagcaaagaaggaaacaacaaaacuugaaaacaaaccaacaauaacaacaacaacaacagaaacuccacgcaaaccggugggcaaaccauagccuccuccggggguggaggcucacuuuuuacugcagaauucggugcuguucaggaacuuccugaugacuagucccaggcaaaccaccagcagcagcauguagcccacugugcccgagaaggugggcgcggcagggggugccuggaggaacuggcgcaggcccucuuccacguaguacaccuggucauagaugcugaggaaagugaagauguggaagagcugauggcuguggccaaugaugucgaagagacccggcuggaugcgcucagggaucuugcucacguugaagaaggcggccaccaccagccagaaguagcggcgguagaagugcacgaagagugugggguucucgccucgcaggucgaagagccagcucucuagcauaauggggcaggccaugcugagcggcaugacgaagacgaaggugcgcagggcgaacggguaggagcaccagucggugcggcucuuacagcaagccacggugcaggccacagccagcacgaaggccacgggcagcacgagcgcgcgguagaccgcgaugaggcgggugcaguccacgugccagcccaggcgcugcugcacauacggcgucaugacccuggcguccagcaggcucaggcugggcagcagguaguaguaguaggccacggugcugccgaagccauaguagcugauggaagcguaguccagguagaagaaggcggcgcgcaggcgcagcgacaggcagcugaacacgugcgccgugcagcucaug

SEQ ID NO: 11329 - RNA, 832 nt, Mus musculus
aagaggacucugguuccuagacagguccuuggguuuuccaguuuuguuuuguuuguuuguuuguuuguuuguuuguuugcuuguuucugaaacaggguuucucuguguagccuuugcuguccuggaacucacucuguagaccagccuggcuuuuaacucaaagaccugccugccuuugccuuccaaguacugggauuaaaggcgugcaccaccaccgacugguagguuuuccgacuuuuagguuauugccuguagucauuguuauuugcuugccggaguguuaaguucuuaagauuacaaguucauuauuagaaauuaaaucuuuaaaauauuugugugugugcccaaaaaagccagaugaggguaauaagucccagggaguugacugauauggggugcuggaaaugaacuuggguccucugaaagaaccacaggcaaguccucuuauucucugcgcuaucgggcccuggaguuaggguauugacaagucuugccuugccuuguuuuuguuucuuuguuuguuuucuuuuaucuuuuucuucuucuuauaaaggugaauguaaugcaaaaggcgcgucguuaaugaaacccucaaguuaaguuguagcucccaugagucucgaguacauucugcucuugguggucuuuuaggacucucuggugacguuaaaaaaaaaaguaugaaauuuuucugaaguuaaauaaagccucgaugcuagaaccguucucggggauauaguuuauaaaucuuaacucaucaauaacguuuccuuuuccggcguucggaaaacuucaaaaaaaacagaggugccugcagagaaacaccguuuuc

SEQ ID NO: 11330 - RNA, 832 nt, Mus musculus
gaaaacgguguuucucugcaggcaccucuguuuuuuuugaaguuuuccgaacgccggaaaaggaaacguuauugaugaguuaagauuuauaaacuauauccccgagaacgguucuagcaucgaggcuuuauuuaacuucagaaaaauuucauacuuuuuuuuuuaacgucaccagagaguccuaaaagaccaccaagagcagaauguacucgagacucaugggagcuacaacuuaacuugaggguuucauuaacgacgcgccuuuugcauuacauucaccuuuauaagaagaagaaaaagauaaaagaaaacaaacaaagaaacaaaaacaaggcaaggcaagacuugucaauacccuaacuccagggcccgauagcgcagagaauaagaggacuugccugugguucuuucagaggacccaaguucauuuccagcaccccauaucagucaacucccugggacuuauuacccucaucuggcuuuuuugggcacacacacaaauauuuuaaagauuuaauuucuaauaaugaacuuguaaucuuaagaacuuaacacuccggcaagcaaauaacaaugacuacaggcaauaaccuaaaagucggaaaaccuaccagucggugguggugcacgccuuuaaucccaguacuuggaaggcaaaggcaggcaggucuuugaguuaaaagccaggcuggucuacagagugaguuccaggacagcaaaggcuacacagagaaacccuguuucagaaacaagcaaacaaacaaacaaacaaacaaacaaacaaaacaaaacuggaaaacccaaggaccugucuaggaaccagaguccucuu

SEQ ID NO: 11331 - RNA, 2821 nt, Mus musculus
uuaguugaaagacagaggugccaaagugaggaaacagacaggaagccucagggguuagucgcuuuccacagggcacagugggaagugaacuuuccccuuaucucuucuaaaucuagauaggcucaacaacuguuaggggcagaugaauggaaggauaagagauguucacaccaauuccuggaguagggagggagaggaaccaggagaaggggaagaaagggggaggggaggagggcgaggggaagcacagagcagcggaccuuagaagaaucgcucaaggucacaccgcgggauggagcugaaagccgaauucaaauccaagcccgggacugcaggacugaaaguucuagauagagccacacaaacgugcucucuucucucuucuugacucagcagcucucgcuuggccacggggcggugggaaucacacuuccugggccuuucuagccgggaguuuggggucccuuguuuuuccuggacuuauuugccgcacuccgggcuuuggcuuccuccucccugcuucccagagcagaauccggagccaccuauucucuccaaguuugucucgcagccaggcugggaaccgugcgcgagcgacucccggacccggcaaucagucuucccugccccagcgucggagacgaacaaucaccaccagcggcugcugagugcuagacgcuuuacucccacagcuccaaaagccacagacgagcagacccccagaaauuaguccucgccacucagaugaggcagcucugcgaaauuggaugaugugcuuggacucacaaggcuaauaacgcuaguuaguaucuaagugcuuucugaaugccagacgcgggucuccgcaccaccccagcaguuccuccaacacucuaguaaaaaagggcacacuaucacccccaucuuauggaugaggaaaccgugguuguggcaccuggcccaaggucaccccagagagugacggauauacgaccggaacauagucgguugagucuggguucaauuuguguguguugucuccacuacagggagagcagcgguuucaaaccuacaguaccagaggcugaccucaacgcaacgcccgaggcugggcgcaaaccaaccaguucggaaugccauaauucacagagacauucccacggaccggaaccagagagucccccaagagcaccgagugugaccgguacuggcggacgaucaccccuuagcaggagcuggagaacacuuaccauaaaagagagggcgagcgccugccugggaggaauccccagcgcuggcagguccgggacucccgggagagaggucugcugccacugccgcccacgcaggggcgcccgagcgaccccgcggaugcuggcugcugcuucucaaccagcggcgcguccucucgacuuguauccggcggcagcgcccucucgcuccgcagggugcccuggaguuagggacguucuuggagaaguugacgcucgggagaggccgccgagguccggucccgaguagugaagugccccacugcgcugaucucagcgagaugcggaagcccuugcccugauggcccuaaagcuuggcgccugaccuggagagcgacgagucccgcgcucagggcacacgggccgcaccucggccgcccguccccggagcaccggguuucuucccuagagcacugagcacacgccgcgagggcugcagugguggccagggcccgggcagcugugcgcucauugccuuccccaggggcugagcgccuuugugcgccgggcgcgccgaccgccagggccagcucuggaugcugcagccgccgccucccccuccuccuccacggccgcucgcuccccgccuucccggccggcccggaggcugcagcugaaagccgauccggcugagcucaucccugaaggccacuaauccaauagccgcggaaggcgcggccgccgggaacgccccuucccccaccaucccgcgccccggccgucccagcucgggccgcugccggcucugccaccuucuggaggccaccagcuggcgggaaagggaaguggaacccucgcccgcgccccugggccgaaguggcgcggacgccauucacucaucugcggacuggcuagccuagacacucgcucacacacgcgcucauucaugcgcauggguccucccccauucauucaagcgugccuagagagccacggugggugucccuaggggcggggaugaagagaggagacaucacggucgccagauagcuuuggagccuguauugaaggccugcgggaaacaacgacugggaaagagaaugcuuuaauauacccccuugccuuaggcacacacauguccacacuuuauuucugaggccagacuccaacucaucuuucagaauccaauuucacgcagcaccugcuccauggugcuuuuccccugaccaccugaggcccgagagaaggaucaucgaucagagggcuaccgagagcgcugaaggauggcggcucccucgguaaccagagcgcagagauaagagggcguggccagagcgagggaugcucuguaccuccaaguuggcuuccuuccaggccagggcauccugcuuuccaugccagaguugacauuagguccauuccauagucuuaacugaccucaccccucagaaaguguccuuuuuuuuccccccauguacacagaagauaagcaccuguaauucagcccugugagggaaauguguugaccaaggcuccaggguaccucucccagacuggggagggcaauuugagaauguuuccuuguggaagugucugcaugaaugagcugcuagaugcagagacaucauagu

SEQ ID NO: 11332 - RNA, 2821 nt, Mus musculus
acuaugaugucucugcaucuagcagcucauucaugcagacacuuccacaaggaaacauucucaaauugcccuccccagucugggagagguacccuggagccuuggucaacacauuucccucacagggcugaauuacaggugcuuaucuucuguguacauggggggaaaaaaaaggacacuuucugaggggugaggucaguuaagacuauggaauggaccuaaugucaacucuggcauggaaagcaggaugcccuggccuggaaggaagccaacuuggagguacagagcaucccucgcucuggccacgcccucuuaucucugcgcucugguuaccgagggagccgccauccuucagcgcucucgguagcccucugaucgaugauccuucucucgggccucagguggucaggggaaaagcaccauggagcaggugcugcgugaaauuggauucugaaagaugaguuggagucuggccucagaaauaaaguguggacaugugugugccuaaggcaaggggguauauuaaagcauucucuuucccagucguuguuucccgcaggccuucaauacaggcuccaaagcuaucuggcgaccgugaugucuccucucuucauccccgccccuagggacacccaccguggcucucuaggcacgcuugaaugaaugggggaggacccaugcgcaugaaugagcgcgugugugagcgagugucuaggcuagccaguccgcagaugagugaauggcguccgcgccacuucggcccaggggcgcgggcgaggguuccacuucccuuucccgccagcugguggccuccagaagguggcagagccggcagcggcccgagcugggacggccggggcgcgggauggugggggaaggggcguucccggcggccgcgccuuccgcggcuauuggauuaguggccuucagggaugagcucagccggaucggcuuucagcugcagccuccgggccggccgggaaggcggggagcgagcggccguggaggaggagggggaggcggcggcugcagcauccagagcuggcccuggcggucggcgcgcccggcgcacaaaggcgcucagccccuggggaaggcaaugagcgcacagcugcccgggcccuggccaccacugcagcccucgcggcgugugcucagugcucuagggaagaaacccggugcuccggggacgggcggccgaggugcggcccgugugcccugagcgcgggacucgucgcucuccaggucaggcgccaagcuuuagggccaucagggcaagggcuuccgcaucucgcugagaucagcgcaguggggcacuucacuacucgggaccggaccucggcggccucucccgagcgucaacuucuccaagaacgucccuaacuccagggcacccugcggagcgagagggcgcugccgccggauacaagucgagaggacgcgccgcugguugagaagcagcagccagcauccgcggggucgcucgggcgccccugcgugggcggcaguggcagcagaccucucucccgggagucccggaccugccagcgcuggggauuccucccaggcaggcgcucgcccucucuuuuaugguaaguguucuccagcuccugcuaaggggugaucguccgccaguaccggucacacucggugcucuugggggacucucugguuccgguccgugggaaugucucugugaauuauggcauuccgaacugguugguuugcgcccagccucgggcguugcguugaggucagccucugguacuguagguuugaaaccgcugcucucccuguaguggagacaacacacacaaauugaacccagacucaaccgacuauguuccggucguauauccgucacucucuggggugaccuugggccaggugccacaaccacgguuuccucauccauaagaugggggugauagugugcccuuuuuuacuagaguguuggaggaacugcugggguggugcggagacccgcgucuggcauucagaaagcacuuagauacuaacuagcguuauuagccuugugaguccaagcacaucauccaauuucgcagagcugccucaucugaguggcgaggacuaauuucugggggucugcucgucuguggcuuuuggagcugugggaguaaagcgucuagcacucagcagccgcugguggugauuguucgucuccgacgcuggggcagggaagacugauugccggguccgggagucgcucgcgcacgguucccagccuggcugcgagacaaacuuggagagaauagguggcuccggauucugcucugggaagcagggaggaggaagccaaagcccggagugcggcaaauaaguccaggaaaaacaagggaccccaaacucccggcuagaaaggcccaggaagugugauucccaccgccccguggccaagcgagagcugcugagucaagaagagagaagagagcacguuuguguggcucuaucuagaacuuucaguccugcagucccgggcuuggauuugaauucggcuuucagcuccaucccgcggugugaccuugagcgauucuucuaagguccgcugcucugugcuuccccucgcccuccuccccucccccuuucuuccccuucuccugguuccucucccucccuacuccaggaauuggugugaacaucucuuauccuuccauucaucugccccuaacaguuguugagccuaucuagauuuagaagagauaaggggaaaguucacuucccacugugcccuguggaaagcgacuaaccccugaggcuuccugucuguuuccucacuuuggcaccucugucuuucaacuaa

SEQ ID NO: 11333 - RNA, 4586 nt, Mus musculus
agguauccagagucuaguggcccuggccugaucugcaaauguccugagaacacuauugggucucugaucccacagcuuggcagacuuucacaaaauggaauuccccucacuuaaagcaaugacuugggaagccaugaagugggagggcacgcuggcgugaagagacuuggagucuaaaagccgauuuaacacacuucuacuaaaaugcucagagucugaacaaauauuugcaacagguaaacugagggaguaaaggggcggagagaauucaagguuggcgggaagagagauggaugggggucacuguguguuagagagauguuguguggaugcuuaaguuguaggugugaagcuggagguccaguagggacauaaguccccuuugaagcgcuccucuuuccaaugugcugcugaagcagcuugcguagaagagggcuucagccuccugguucuuuucuucuggcgcgggaacucaggccggauaagaagaggaucugaaggacuagcagcuagcagccagccggguggcugagcgucagagcugagcgguacuggggaaacacuagccugccucgcguggcgguccgcgguguuucugcggcagcugcaggaagcucggcccgggagaaaagcaucuucaccggggauccgcgacuugcucacguaggcggcggucgagacuucggagcguuagaccagcuugcugagaggcuucugcucugucccuggcuccccggcaaggcaugggcaggcauuucucuagaggcacaaggagcuggaggcgcugaggaauccugaaaaccccggccagagaaacacggaguuccuccgccuggcucaggaccgaggccucugccacuaaguggauggugcuuaaccuugccagaaugaaacgggugaaaguugugggggccgcacaacggggccgcacaggccuagaggaacagaauccuacuauagucgagaccugggucccuacccagccugccuaaggggacuggguaggagugagaagugaaucaaaguccacccggccacuuccuagagugccugcucuauccaccuacugcuguaccaccgaacaggcaagcacauucgucccagucuucuuagcucuggcugcucacccagggucuggaaggugaucccucggggcgcccugcaguuguguuucccagccuugugcgcacaagaggcacucuuucuccaccugggauuagggugcugauccugcaaaggacagcaagaagucaguucccaggaaugugugacuccuauuuccacucagaaaaaaaaaaaaaaaaagccuaaaagagauucugaucuacaaucccaacacacacacacacacacacacacacacacacacacaccucgggcuccuuaaagacugaaaagggagccgacagaggaauucagggaagcgaugacacaugcaacaauucugucacaccuggcugcugaggaggagcugagcggccggaaauggagccguggagggggugggggaugagacccagggucagcuuggguggucaaagaaagaaaaaaaaaaggaagaaaaaaagaaaaaaaugaagaagagggagaccgaccuccacccucuuuggucccgaccaaagccagauauuuuuccccugcccagaaccaagcagacucagauccagacccauaaccugggcaugccugauggugaggaagaagacaaacaccugcaggcaugcucagaaaacagacaaguauugaagaagugcuguuugucucuugagugugcucagggcggugagggauagcuuagaaaaacauggaggcuacuuggggauacugucaauaagggcuagauguggguauuucucagagaaauuuagagaagccuaccucccuuguauccuggugguuaggccggguuugccuggcugaccucucuguagucaucuuugagauguuggacuacacacacacacacacacacacacacacacacacacacacacacacagaguccuccuuucccuucaucucaaagugggaagcacaagcacacacuguagauaaauggucuucggaccgcuggagccacuggccagugugggcucguggcauucuggagaacucuuaaaguccaagcaaccugaaagaaagagguagaaacaggcacugggauagccaccuagaugugugacuggcacacaucauucauucagaccauuauccuucacaacgugucugaucacucuuccucagccucucucacacuuccaagacugcaaaccuguguuaaggcugagugacagggcacaccugauguugugcuggcacggaaggaauuccucuaaguccguuuucuauuuucggagauguaacuggauccccaccagacuucggcuauuaucuuaaaaacaaggggaaagacuacuguccauucgugacugggacgcgagaaagcgccuccccagccugugguuuuccuuccuuaccuaugcuggaaggagaagaugcagguaacggcuguaaggguaggaaggacaaaggaagacaggaaaaaaaaaaaaaaaagagguuguauccacgaaccauguucauggauacaaccauguacucuggugcuugauucauacaccucacuaagcaaaaauaagcaaauacaagucucacacauuguacauauauaagcauaccuggguuucugaacagcacacuugcgcaguaucacgugugucuuuaagaacagauuuuugccccgugccuuccacgcgugacacuugugcacgcaacaguccccaaagccccucagcaacauccucgucuguguccaagccagaguacaagggauaccacuugaucuuuaaaacacacacccaaauugugggauugcaaggcgaguuccaaggagaaagcuggucccuacauccaccucagcacagagaagcgaaacguccgaugccagugagcgguacuccugggugucucuucccagcgauccucuccccagccucaauugggcucagagagcucgagggacagagcaggccgaagcuucugccuuccgugacacgagcucugagcugguuuaccuccagcugccgcaaaguucggccacuccaccccgguccggcccccuugccaucucgccccucccuaagccucaaagcuagaagucuagccccagcacagcccgaagcacagagcaaaggguuuuguuuucuuucaccugaaagcugcccagaggcuuggaucaccucuccucgcuggggucagcauucccggggcacuggcagggcgcagcgagccccaaccagggcuuuucggcgaagcaaacacccgcagauuuucaagacucguaagagcgugaggcaggcuguuggcugggcccgggaggcuccggaggcucgggaaggccgguccaaguucugccggccguuuaaaaaaaaaaggagacuuagagaugaacucgcccgugcgcugcuggcugccccgcuauaggggcgaaggccccugacgcaagcggaacucugcggagcccauacgaaucagaacggagcgaggcuccuggcgcacuagggacuccaggaggcggcugcgccagagacgcgggucgcgccucggggaaaccgggcgguggggggaggggagagcucagccaagaaaacccaccgaggcggggacuggccugggcggggaggggcggcggggccggagccccucgcuguugggcagacucccgauggccagaggcugacuuccacucccgcagaccgcuccccggggggaaaagagaagagagugagagccgcgcgaggccuccgguccccgcagccugcagaaguuagaggcucugcgccgagcgcacacuccugcgcccgccugcaaggcgagccugcaccaggagagcacagccuccgggcugcccggccgcggagagccggcuuuugucaugauggccagcuaccccgagcccgaagacacggcggggacccugcuggcuccggagagcggacgcgcagucaaagaggccgaggcgucgccgccgagucccggcaagggaggcgggacaacaccggagaaaccagaccccgcgcagaagcccccguacucguacguggcgcucaucgccauggcgauccgcgagagcgccgagaagaggcucacucuguccggcaucuaccaguacaucauagccaaguucccguucuacgagaagaacaagaagggcuggcagaauagcauccgccacaaccucagccucaacgagugcuucaucaaggugccgcgcgagggcggcggcgagcgcaagggcaacuacuggacgcucgacccggccugcgaggacauguucgagaagggcaacuaccggcgccgccgccgcaugaagcggcccuuccggccgccgcccgcucacuuccagcccggcaaggggcucuucgggagcggaggagcggcggguggcugcggcgugcccggagcuggggccgauggcuauggcuaccuggcgccacccaaguaccugcaaucgggguuccucaacaacuccuggccccugccgcagccucccucgcccaugcccuacgccuccugccagauggcgg

SEQ ID NO: 11334 - RNA, 4586 nt, Mus musculus
ccgccaucuggcaggaggcguagggcaugggcgagggaggcugcggcaggggccaggaguuguugaggaaccccgauugcagguacuuggguggcgccagguagccauagccaucggccccagcuccgggcacgccgcagccacccgccgcuccuccgcucccgaagagccccuugccgggcuggaagugagcgggcggcggccggaagggccgcuucaugcggcggcggcgccgguaguugcccuucucgaacauguccucgcaggccgggucgagcguccaguaguugcccuugcgcucgccgccgcccucgcgcggcaccuugaugaagcacucguugaggcugagguuguggcggaugcuauucugccagcccuucuuguucuucucguagaacgggaacuuggcuaugauguacugguagaugccggacagagugagccucuucucggcgcucucgcggaucgccauggcgaugagcgccacguacgaguacgggggcuucugcgcggggucugguuucuccgguguugucccgccucccuugccgggacucggcggcgacgccucggccucuuugacugcgcguccgcucuccggagccagcaggguccccgccgugucuucgggcucgggguagcuggccaucaugacaaaagccggcucuccgcggccgggcagcccggaggcugugcucuccuggugcaggcucgccuugcaggcgggcgcaggagugugcgcucggcgcagagccucuaacuucugcaggcugcggggaccggaggccucgcgcggcucucacucucuucucuuuuccccccggggagcggucugcgggaguggaagucagccucuggccaucgggagucugcccaacagcgaggggcuccggccccgccgccccuccccgcccaggccaguccccgccucgguggguuuucuuggcugagcucuccccuccccccaccgcccgguuuccccgaggcgcgacccgcgucucuggcgcagccgccuccuggagucccuagugcgccaggagccucgcuccguucugauucguaugggcuccgcagaguuccgcuugcgucaggggccuucgccccuauagcggggcagccagcagcgcacgggcgaguucaucucuaagucuccuuuuuuuuuuaaacggccggcagaacuuggaccggccuucccgagccuccggagccucccgggcccagccaacagccugccucacgcucuuacgagucuugaaaaucugcggguguuugcuucgccgaaaagcccugguuggggcucgcugcgcccugccagugccccgggaaugcugaccccagcgaggagaggugauccaagccucugggcagcuuucaggugaaagaaaacaaaacccuuugcucugugcuucgggcugugcuggggcuagacuucuagcuuugaggcuuagggaggggcgagauggcaagggggccggaccgggguggaguggccgaacuuugcggcagcuggagguaaaccagcucagagcucgugucacggaaggcagaagcuucggccugcucugucccucgagcucucugagcccaauugaggcuggggagaggaucgcugggaagagacacccaggaguaccgcucacuggcaucggacguuucgcuucucugugcugagguggauguagggaccagcuuucuccuuggaacucgccuugcaaucccacaauuuggguguguguuuuaaagaucaagugguaucccuuguacucuggcuuggacacagacgaggauguugcugaggggcuuuggggacuguugcgugcacaagugucacgcguggaaggcacggggcaaaaaucuguucuuaaagacacacgugauacugcgcaagugugcuguucagaaacccagguaugcuuauauauguacaaugugugagacuuguauuugcuuauuuuugcuuagugagguguaugaaucaagcaccagaguacaugguuguauccaugaacaugguucguggauacaaccucuuuuuuuuuuuuuuuuccugucuuccuuuguccuuccuacccuuacagccguuaccugcaucuucuccuuccagcauagguaaggaaggaaaaccacaggcuggggaggcgcuuucucgcgucccagucacgaauggacaguagucuuuccccuuguuuuuaagauaauagccgaagucugguggggauccaguuacaucuccgaaaauagaaaacggacuuagaggaauuccuuccgugccagcacaacaucaggugugcccugucacucagccuuaacacagguuugcagucuuggaagugugagagaggcugaggaagagugaucagacacguugugaaggauaauggucugaaugaaugaugugugccagucacacaucuagguggcuaucccagugccuguuucuaccucuuucuuucagguugcuuggacuuuaagaguucuccagaaugccacgagcccacacuggccaguggcuccagcgguccgaagaccauuuaucuacagugugugcuugugcuucccacuuugagaugaagggaaaggaggacucuguguguguguguguguguguguguguguguguguguguguguguguaguccaacaucucaaagaugacuacagagaggucagccaggcaaacccggccuaaccaccaggauacaagggagguaggcuucucuaaauuucucugagaaauacccacaucuagcccuuauugacaguauccccaaguagccuccauguuuuucuaagcuaucccucaccgcccugagcacacucaagagacaaacagcacuucuucaauacuugucuguuuucugagcaugccugcagguguuugucuucuuccucaccaucaggcaugcccagguuaugggucuggaucugagucugcuugguucugggcaggggaaaaauaucuggcuuuggucgggaccaaagaggguggaggucggucucccucuucuucauuuuuuucuuuuuuucuuccuuuuuuuuuucuuucuuugaccacccaagcugacccugggucucaucccccacccccuccacggcuccauuuccggccgcucagcuccuccucagcagccaggugugacagaauuguugcaugugucaucgcuucccugaauuccucugucggcucccuuuucagucuuuaaggagcccgagguguguguguguguguguguguguguguguguguguguugggauuguagaucagaaucucuuuuaggcuuuuuuuuuuuuuuuuucugaguggaaauaggagucacacauuccugggaacugacuucuugcuguccuuugcaggaucagcacccuaaucccagguggagaaagagugccucuugugcgcacaaggcugggaaacacaacugcagggcgccccgagggaucaccuuccagacccugggugagcagccagagcuaagaagacugggacgaaugugcuugccuguucggugguacagcaguagguggauagagcaggcacucuaggaaguggccggguggacuuugauucacuucucacuccuacccaguccccuuaggcaggcuggguagggacccaggucucgacuauaguaggauucuguuccucuaggccugugcggccccguugugcggcccccacaacuuucacccguuucauucuggcaagguuaagcaccauccacuuaguggcagaggccucgguccugagccaggcggaggaacuccguguuucucuggccgggguuuucaggauuccucagcgccuccagcuccuugugccucuagagaaaugccugcccaugccuugccggggagccagggacagagcagaagccucucagcaagcuggucuaacgcuccgaagucucgaccgccgccuacgugagcaagucgcggauccccggugaagaugcuuuucucccgggccgagcuuccugcagcugccgcagaaacaccgcggaccgccacgcgaggcaggcuaguguuuccccaguaccgcucagcucugacgcucagccacccggcuggcugcuagcugcuaguccuucagauccucuucuuauccggccugaguucccgcgccagaagaaaagaaccaggaggcugaagcccucuucuacgcaagcugcuucagcagcacauuggaaagaggagcgcuucaaaggggacuuaugucccuacuggaccuccagcuucacaccuacaacuuaagcauccacacaacaucucucuaacacacagugacccccauccaucucucuucccgccaaccuugaauucucuccgccccuuuacucccucaguuuaccuguugcaaauauuuguucagacucugagcauuuuaguagaaguguguuaaaucggcuuuuagacuccaagucucuucacgccagcgugcccucccacuucauggcuucccaagucauugcuuuaagugaggggaauuccauuuugugaaagucugccaagcugugggaucagagacccaauaguguucucaggacauuugcagaucaggccagggccacuagacucuggauaccu

SEQ ID NO: 11335 - RNA, 1084 nt, Mus musculus
auggagaauacuguugccuuguguaauaugaaugcuaaagaaaauauauauucacgaugggccauaaaauaugugaagauaaaauagccuacauggacugguaaagccagugaguucaucuuucuccuccccucccaauaauuacaagaacacaaaucuaguuuuaacuuggaaaccacauucuuaauuauuaaucuccuccacacuuacauccuccuaaauuguucuccacuaaccgaaauagaacacuucauugagaacccuuguuucuuaagacucucgggaaaccauuuggcuuugguuauuuuucucccuccaucauguguauguguguagacccgccugugcauaacuucagucccugaauuguggggaaccgugugcuguuggugcggggguggggggagcuugggcacccagagcaggcaaaucugaggaguacugcuugugccaccagccuaggcacucuuggggacuuucccugggcgccccuucggugggaguaacagagcuugagaaggaaacgaagcuacaagaaagcccuacaugagccucuugaggaagaauccugaggacucgcguccaagguggcugaaaaagagggagcauuggucccacgcuuaugauggacaauuuaaggagcuaagggagaguuugagauccccagaacgucucuacuccaggagcaucuaccuagcucucuauuuuccccagccuauauuagggcgcaggcaaagggagccacccagguguaguuagagcuggguguaguuagagcugugcagacaagcuccaagaacacggaggaaagcaucgaccuucucgggacccaacccucuucccaugccaucaagggagccuauagcuccccuggcucuaggcagcugaacccaggcagcggguaucccaaacgcugcgcccuggcgccagagggcaccccgggagagagaucacgcaacgacacacucccggggcucgguucccaggggcagugcaccccugggagccagagccacggaaaauucccgggugggcacagaggggcagaagagauccggacaccgcucuuuccgcccccagccag

SEQ ID NO: 11336 - RNA, 1084 nt, Mus musculus
cuggcugggggcggaaagagcgguguccggaucucuucugccccucugugcccacccgggaauuuuccguggcucuggcucccaggggugcacugccccugggaaccgagccccgggagugugucguugcgugaucucucucccggggugcccucuggcgccagggcgcagcguuugggauacccgcugccuggguucagcugccuagagccaggggagcuauaggcucccuugauggcaugggaagaggguugggucccgagaaggucgaugcuuuccuccguguucuuggagcuugucugcacagcucuaacuacacccagcucuaacuacaccuggguggcucccuuugccugcgcccuaauauaggcuggggaaaauagagagcuagguagaugcuccuggaguagagacguucuggggaucucaaacucucccuuagcuccuuaaauuguccaucauaagcgugggaccaaugcucccucuuuuucagccaccuuggacgcgaguccucaggauucuuccucaagaggcucauguagggcuuucuuguagcuucguuuccuucucaagcucuguuacucccaccgaaggggcgcccagggaaaguccccaagagugccuaggcugguggcacaagcaguacuccucagauuugccugcucugggugcccaagcuccccccacccccgcaccaacagcacacgguuccccacaauucagggacugaaguuaugcacaggcgggucuacacacauacacaugauggagggagaaaaauaaccaaagccaaaugguuucccgagagucuuaagaaacaaggguucucaaugaaguguucuauuucgguuaguggagaacaauuuaggaggauguaaguguggaggagauuaauaauuaagaaugugguuuccaaguuaaaacuagauuuguguucuuguaauuauugggaggggaggagaaagaugaacucacuggcuuuaccaguccauguaggcuauuuuaucuucacauauuuuauggcccaucgugaauauauauuuucuuuagcauucauauuacacaaggcaacaguauucuccau

SEQ ID NO: 11337 - RNA, 2990 nt, Mus musculus
ccaucccaacacacaguggaacuugaggcgaagaaggcaguuagcuaccccauuugggaagcuggaaccccaaagaucuguaccgagcucuugagauucguuucaaucccuaacucucccauuuuucuucacccuuuucucuccccaaauuuucuuccuaaauugauuuucauauaacauuggggguuuugucucuccucccucaguucuauagcuaagaaguuaaagaaauguacaaaaccaaaauuauuucaauucgcuauuuuuaacgcaaaagaagacuucuccacaguagcaucaaaggcaaaaacgcauugccaaaugggcacauguuuuuuuuuuuuuuuuaauuuaccggaaagggcaaauaaacaaaauuaacugaauuuagagaaaauguaccagugaauaacaacuucagucagcaaagucuccaagucucccugguugaaccugccccguuuuggcuccgguauccggcuuucuauugagaccuuguuuugcccacauuucuguaaacuagauagagaacaacccauaucuucuaaguccaaaguaacgucguaggcugaucuuccaggcaacuucuguuccuucccuucauuuuaaguguaagauuugguuaaaagaaauagaaugaggggaguggcacagaagaaaguuuuuaaagaacaaaacaacaacaaaaacaagaaguccagugcauccgcggugagugugucaaucaaaggguuuugugccugggggcuccuugugguuccaagcagaggugucccagggcggccccacaaugaauaugaauaggaauccuugcuaacugggacagcaaagcgcaccgcccugaaugaugauggcacgucaucuuaaccagcccaggauagauaggagggcuccuuuugucucuuuucuccacugcagcgcuauaaaagccccucuuuuacugcaagagguuaguucaggcacacaccaaugugcagugcaggaaacagcuaaaccagagauagcgaagcaagccaggagagagagagaggcggggcaaggcagggccuugacuuuucuucucugguuuuacaacuggggaaguggguuccuggaccuugcuuuuuuuuuuuuuuuuuuuuuaauucaagauucucuuuaauuuccugccuaaaggcuccucaaccauaaggccgcaucucuuguaauaaaaugaauucugauucgagcucugucuccagcagagcgucaucuccggacauggaugagauguaccuaagagaccaccaccaccgccaccaccaccaccaucaggagagucgucugaacucggucuccuccacacagggcgauaugguccagaagaugccaggggaaagccucucgagggcaggcgccaaggcugcaggagaaagcagcaaguacaaaaucaagaagcagcugucggagcaggaucuucagcaguugcggcugaagaucaacggacgcgaacgcaagaggaugcacgaccugaaccucgccauggauggucugcgcgaggucaugcccuacgcucacgggcccucggugcgcaagcucuccaagaucgccacucugcuucuggccagaaacuacauccucaugcucaccagcucccuggaggagaugaagagguugguuggagagaucuacgggggacaccacucggccuuccacugugggacuguggggcauucggccggccacccggcacacgcagccaacgcugugcacccggugcacccuauccugggcggcgcgcucuccucuggcaaugccucguccccucuguccgcgaccucccugccgaccauuggcaccauccguccuccccacucacugcucaaggcgcccuccacgccgcccgcgcuacaauugggcagcggcuuccagcacugggcggggcugcccugucccugcaccaucugccagaugccaccaccgccgcaccuguccgcucucuccaccgccaacauggcccggcuuucggcugaauccaaggacuugcucaagugagccacgggcuggcccggccgggaggaggaagggagagcugaggcaggggucgcagugccgggccaggagggaaagggagacugcucggccugcgggagggugggcgcgcggccccaggccucgccagcgcccuacagauccagauuccaguugacccaccccagcggggcgugccaaaaccaaacuggaauaccuagguguuagcgaaggggacuggaacccgaaguccuguuuugcaugcaugcuucuuucccucaugccacgccaguauuucucacugugguaugcucuugucaaaacugcauuuguuguuuaacgaugggaucaguggaguuuaaaacuugcaaaggaacuuuggaguuggcucuuucuggcuguguucuuaucuuggaggaaagauggcuaucccuuuugugcaaagcaaauguaaauauuucaucgagcuagauacacuuaugauugucucugcccuuauagauuuuucagagacaauggagagagagagagagagagagagagagagagagagagagagcuuguuucagaauccaaguuuugauucucagcccagggcaugaaccucuuauguggguuuuccuuuccacgcaaacauaggucaagaaaaugcaugcacgcuucuaaaugaaucuugucuaaacauguugugcgggcuauagcgccauuuuccuuguaacaaggauuuauuagugagcucuccaaaguacuccauauaucugucugugguuguauaaaaugaaaagggggccagagcacagagauucacacucaaugaacaugugauucuucccccaagcccaugucugucucugucccucaaaucucauuccaacguuagggcuguuccaaggggcccacuacaaaaccgggccuccucuagaaguucauccuacccccuugccaaauuauacugcaugcgggguugggucgguuaccccucagcuuugaaaacacacugg

SEQ ID NO: 11338 - RNA, 2990 nt, Mus musculus
ccaguguguuuucaaagcugagggguaaccgacccaaccccgcaugcaguauaauuuggcaaggggguaggaugaacuucuagaggaggcccgguuuuguagugggccccuuggaacagcccuaacguuggaaugagauuugagggacagagacagacaugggcuugggggaagaaucacauguucauugagugugaaucucugugcucuggcccccuuuucauuuuauacaaccacagacagauauauggaguacuuuggagagcucacuaauaaauccuuguuacaaggaaaauggcgcuauagcccgcacaacauguuuagacaagauucauuuagaagcgugcaugcauuuucuugaccuauguuugcguggaaaggaaaacccacauaagagguucaugcccugggcugagaaucaaaacuuggauucugaaacaagcucucucucucucucucucucucucucucucucucucucuccauugucucugaaaaaucuauaagggcagagacaaucauaaguguaucuagcucgaugaaauauuuacauuugcuuugcacaaaagggauagccaucuuuccuccaagauaagaacacagccagaaagagccaacuccaaaguuccuuugcaaguuuuaaacuccacugaucccaucguuaaacaacaaaugcaguuuugacaagagcauaccacagugagaaauacuggcguggcaugagggaaagaagcaugcaugcaaaacaggacuucggguuccaguccccuucgcuaacaccuagguauuccaguuugguuuuggcacgccccgcuggggugggucaacuggaaucuggaucuguagggcgcuggcgaggccuggggccgcgcgcccacccucccgcaggccgagcagucucccuuucccuccuggcccggcacugcgaccccugccucagcucucccuuccuccucccggccgggccagcccguggcucacuugagcaaguccuuggauucagccgaaagccgggccauguuggcgguggagagagcggacaggugcggcggugguggcaucuggcagauggugcagggacagggcagccccgcccagugcuggaagccgcugcccaauuguagcgcgggcggcguggagggcgccuugagcagugaguggggaggacggauggugccaauggucggcagggaggucgcggacagaggggacgaggcauugccagaggagagcgcgccgcccaggauagggugcaccgggugcacagcguuggcugcgugugccggguggccggccgaaugccccacagucccacaguggaaggccgaguggugucccccguagaucucuccaaccaaccucuucaucuccuccagggagcuggugagcaugaggauguaguuucuggccagaagcagaguggcgaucuuggagagcuugcgcaccgagggcccgugagcguagggcaugaccucgcgcagaccauccauggcgagguucaggucgugcauccucuugcguucgcguccguugaucuucagccgcaacugcugaagauccugcuccgacagcugcuucuugauuuuguacuugcugcuuucuccugcagccuuggcgccugcccucgagaggcuuuccccuggcaucuucuggaccauaucgcccuguguggaggagaccgaguucagacgacucuccugauggugguggugguggcgguggugguggucucuuagguacaucucauccauguccggagaugacgcucugcuggagacagagcucgaaucagaauucauuuuauuacaagagaugcggccuuaugguugaggagccuuuaggcaggaaauuaaagagaaucuugaauuaaaaaaaaaaaaaaaaaaaaagcaagguccaggaacccacuuccccaguuguaaaaccagagaagaaaagucaaggcccugccuugccccgccucucucucucuccuggcuugcuucgcuaucucugguuuagcuguuuccugcacugcacauuggugugugccugaacuaaccucuugcaguaaaagaggggcuuuuauagcgcugcaguggagaaaagagacaaaaggagcccuccuaucuauccugggcugguuaagaugacgugccaucaucauucagggcggugcgcuuugcugucccaguuagcaaggauuccuauucauauucauuguggggccgcccugggacaccucugcuuggaaccacaaggagcccccaggcacaaaacccuuugauugacacacucaccgcggaugcacuggacuucuuguuuuuguuguuguuuuguucuuuaaaaacuuucuucugugccacuccccucauucuauuucuuuuaaccaaaucuuacacuuaaaaugaagggaaggaacagaaguugccuggaagaucagccuacgacguuacuuuggacuuagaagauauggguuguucucuaucuaguuuacagaaaugugggcaaaacaaggucucaauagaaagccggauaccggagccaaaacggggcagguucaaccagggagacuuggagacuuugcugacugaaguuguuauucacugguacauuuucucuaaauucaguuaauuuuguuuauuugcccuuuccgguaaauuaaaaaaaaaaaaaaaacaugugcccauuuggcaaugcguuuuugccuuugaugcuacuguggagaagucuucuuuugcguuaaaaauagcgaauugaaauaauuuugguuuuguacauuucuuuaacuucuuagcuauagaacugagggaggagagacaaaacccccaauguuauaugaaaaucaauuuaggaagaaaauuuggggagagaaaagggugaagaaaaaugggagaguuagggauugaaacgaaucucaagagcucgguacagaucuuugggguuccagcuucccaaaugggguagcuaacugccuucuucgccucaaguuccacuguguguugggaugg

SEQ ID NO: 11339 - RNA, 954 nt, Mus musculus
cuccgggguugcagcgcccgggagcggagggaaacacagaccggacccaccgcucaggcaccaguguccugcuccgaagacuacggcaggcuguguggaggcugaaugucgcuuagaggggucuccagcacagcgcgccgucagacuguuugccaggaagcuuuugccuuccugagaaggacuucgaaguaggacaacucagccuccagcucccugauuuucuuucucuuucugucucccuucccccucugccccaaacgcaagcuuaugcucuguuacaaaguagcaucuuuacccggugacccggcuugcacccucaccgugcccugugcuuaaugggaaggguugggcuuaguggguacuguugugcgcucaggaucccuccccccagaagccccacgcccucgccacgcacgacaggacccucuccucuccaucagguuccacacucuuccaccagacucgcaucugcugguuccaaagcccagcucauccuccaugcgcucacguguuuccucuugggccgccucuguccacgcccuggaccaaggucggcugcgccugucccugucuuuuggguugagguaucagcgugaaccguuugaugaggcuccagagacaacacacagcucugaaaaucuccuacacacacugcaaaggaacgacaccuagacguucccaguucagcuuucccgcgccgcuccacuuuguaauuaccugacacaaugugauauggggguguccauuguuccccggcuuguuauuacggaguguucauuaugacagugguggaauuuaaaauuacacauuuuuaaguccuuaagagauagaaugaauucgguguggggguaugaguaagcuuuucauuaaaaucucaguucggccuaucaagugggguucauucugaguguugccuugccuaauuugcauuuuagcaugguuuugucucuuuaa

SEQ ID NO: 11340 - RNA, 954 nt, Mus musculus
uuaaagagacaaaaccaugcuaaaaugcaaauuaggcaaggcaacacucagaaugaaccccacuugauaggccgaacugagauuuuaaugaaaagcuuacucauacccccacaccgaauucauucuaucucuuaaggacuuaaaaauguguaauuuuaaauuccaccacugucauaaugaacacuccguaauaacaagccggggaacaauggacacccccauaucacauugugucagguaauuacaaaguggagcggcgcgggaaagcugaacugggaacgucuaggugucguuccuuugcaguguguguaggagauuuucagagcuguguguugucucuggagccucaucaaacgguucacgcugauaccucaacccaaaagacagggacaggcgcagccgaccuugguccagggcguggacagaggcggcccaagaggaaacacgugagcgcauggaggaugagcugggcuuuggaaccagcagaugcgagucugguggaagaguguggaaccugauggagaggagaggguccugucgugcguggcgagggcguggggcuucuggggggagggauccugagcgcacaacaguacccacuaagcccaacccuucccauuaagcacagggcacggugagggugcaagccgggucaccggguaaagaugcuacuuuguaacagagcauaagcuugcguuuggggcagagggggaagggagacagaaagagaaagaaaaucagggagcuggaggcugaguuguccuacuucgaaguccuucucaggaaggcaaaagcuuccuggcaaacagucugacggcgcgcugugcuggagaccccucuaagcgacauucagccuccacacagccugccguagucuucggagcaggacacuggugccugagcgguggguccggucuguguuucccuccgcucccgggcgcugcaaccccggag

SEQ ID NO: 11341 - RNA, 536 nt, Mus musculus
ugaauucccagaagucacugaaguggcacaguuuacuguaacuaaaguuauacagaagacuuggggauccuccucuuaucugcccucggaaaaaguccuuuccaaagaggaaaagcaagaaagauaaaacagccucugcaacguauucccacauagacgccgcagauaaaaauuaggaauaaggauaaccauguuagaacgcgcgcuugugaaaauguaaacacaguacagcgggagucccucuccggagcuggucuuuacaauucgucccuagauaggacgcuccgagaaggggaaagaugcuuacuuguccuugucccggguacaacuuaaacuaucucauucuuauuuaguuccaacauguaaggucauguggaacaaacgauguuaaauacaagugaaaaccuaagucaacccgggauaguuacaguaauguaaaggcagcgaguggcgaagcggacaagaaccacuacugaaauuucagugaauugacaauuaugucuagaacugaaaggguuaaugauucauacggagga

SEQ ID NO: 11342 - RNA, 536 nt, Mus musculus
uccuccguaugaaucauuaacccuuucaguucuagacauaauugucaauucacugaaauuucaguagugguucuuguccgcuucgccacucgcugccuuuacauuacuguaacuaucccggguugacuuagguuuucacuuguauuuaacaucguuuguuccacaugaccuuacauguuggaacuaaauaagaaugagauaguuuaaguuguacccgggacaaggacaaguaagcaucuuuccccuucucggagcguccuaucuagggacgaauuguaaagaccagcuccggagagggacucccgcuguacuguguuuacauuuucacaagcgcgcguucuaacaugguuauccuuauuccuaauuuuuaucugcggcgucuaugugggaauacguugcagaggcuguuuuaucuuucuugcuuuuccucuuuggaaaggacuuuuuccgagggcagauaagaggaggauccccaagucuucuguauaacuuuaguuacaguaaacugugccacuucagugacuucugggaauuca

SEQ ID NO: 11343 - RNA, 2512 nt, Mus musculus
ucccagggccugcacacggaggcauugaaaagacaaaaaaggcuagcagagaacaagucccuccuugaccuuucccuaucaccugccucucgggucaggccuucccgauagcauccauaguggggcggggcgugaugagaugcccccucugcacucucucuacaaccacccucgccuccggaauagaacccaaugucucggaugaggacuaugguggggguuuucaaggucuggucugggggcuggaggguuggaucccaaggugauauugaaccuggccaagcaauaguuucugaguagaaaggacuugagcagggaccgucucuggucacucuguccucuuucccaggauggagucagucugugaaacaugguugcacacacauuuccugacccaacccauaguggcggagagcuggauagcacuuugaacuaaugggcgcuccucccagcugccagccaagaagacacuugacuccuugaucgcugguucauuuagacaagccguuucccucucugagccaaaagaccccauguguaauacucaaagaagaggccuuccuuauauauauauaggcacccccaaaccuccuucaugcuaccaagaaagggucuggacacaugccaaaaagaaagaggaaaaggcaaagcucuccccagcggccggacgggacucuucuggcugggcgaggcucuuugaggaaccgagaguugcugggacugagcccgcgacgggggaggcguggagugggggaacaaacagagugcugcuccccucccccgaccccugcccuuuguccggaauccagcugugcucugcggguggggguuguggggggaggagcgggcucgcguggcgcagccccugggcccccuccgcugauuggcccguggugcaggcagcagcccggcaggcacgcuccuggccgggggcagagcagauaaagcgugccaggggacacacgacuugcaugcagcucagaaaucccucugggucucaucacugcagcaguggucgaguaccuccucggagcuuuucuacgacuuccagacgcaauuuacuccaggcgagggcgccugcaguuuagcagaacuucagagggagcagagaggcucagcuauccacugcugcuugacacugacccuauccacugcugcuugucacugacugaccugcugcucucuauucuuuugagucgggagaacuagguaacaauucggaaacuccaaaggguggaugaggggcgcgcggggugugugugggggauacucuggucccccgugcagugaccucuaagucagaggcuggcacacacacaccuuccauuuuuucccaaccgcaggauggcgccucaucccuuggaugcgcucaccauccaaguguccccagagacacaacaaccuuuucccggagccucggaccacgaagugcucaguuccaauuccaccccaccuagccccacucucauaccuagggacugcuccgaagcagaagugggugacugccgagggaccucgaggaagcuccgcgcccgacgcggagggcgcaacaggcccaagagcgaguuggcacucagcaaacagcgaagaagccggcgcaagaaggccaaugaucgggagcgcaaucgcaugcacaaccucaacucggcgcuggaugcgcugcgcgguguccugcccaccuucccggaugacgccaaacuuacaaagaucgagacccugcgcuucgcccacaacuacaucugggcacugacucagacgcugcgcauagcggaccacagcuucuauggcccggagcccccugugcccuguggagagcuggggagccccggagguggcuccaacggggacuggggcucuaucuacuccccagucucccaagcggguaaccugagccccacggccucauuggaggaauucccuggccugcaggugcccagcuccccauccuaucugcucccgggagcacugguguucucagacuucuugugaagagaccugucuggcucuggguggugggugcuaguggaaagggaggggaccagagccgucuggagugggagguaguggaggcucucaagcaucucgccucuucuggcuuucacuacuuggaucccuagcccucucacagggcuuaacuaggcuucucaucgguacccuugcugcugcgcacagcagacauugggggcugcucuucucuuaacucuccucggugcagccacaucaaacucucgcuccaagcauuugagaaugguagcacuaccuaguuggagacucccauacuuccuggugagucugcccucauucaaaucugccggccuccgaccauccaucacuuuuuccagggugaccuaauccaguguugcgucuuaccucacuggcuccuccauccagcucuuggcccauagaugauguucgucgucuuuacugcccgcuacaugcaggguuucugagcuucuccauucugccuuaguccacgaaggugaucugccuucuucugcacuuuucaagucgu

SEQ ID NO: 11344 - RNA, 2512 nt, Mus musculus
acgacuugaaaagugcagaagaaggcagaucaccuucguggacuaaggcagaauggagaagcucagaaacccugcauguagcgggcaguaaagacgacgaacaucaucuaugggccaagagcuggauggaggagccagugagguaagacgcaacacuggauuaggucacccuggaaaaagugauggauggucggaggccggcagauuugaaugagggcagacucaccaggaaguaugggagucuccaacuagguagugcuaccauucucaaaugcuuggagcgagaguuugauguggcugcaccgaggagaguuaagagaagagcagcccccaaugucugcugugcgcagcagcaaggguaccgaugagaagccuaguuaagcccugugagagggcuagggauccaaguagugaaagccagaagaggcgagaugcuugagagccuccacuaccucccacuccagacggcucugguccccucccuuuccacuagcacccaccacccagagccagacaggucucuucacaagaagucugagaacaccagugcucccgggagcagauaggauggggagcugggcaccugcaggccagggaauuccuccaaugaggccguggggcucagguuacccgcuugggagacuggggaguagauagagccccaguccccguuggagccaccuccggggcuccccagcucuccacagggcacagggggcuccgggccauagaagcugugguccgcuaugcgcagcgucugagucagugcccagauguaguugugggcgaagcgcagggucucgaucuuuguaaguuuggcgucauccgggaaggugggcaggacaccgcgcagcgcauccagcgccgaguugagguugugcaugcgauugcgcucccgaucauuggccuucuugcgccggcuucuucgcuguuugcugagugccaacucgcucuugggccuguugcgcccuccgcgucgggcgcggagcuuccucgaggucccucggcagucacccacuucugcuucggagcagucccuagguaugagaguggggcuaggugggguggaauuggaacugagcacuucgugguccgaggcuccgggaaaagguuguugugucucuggggacacuuggauggugagcgcauccaagggaugaggcgccauccugcgguugggaaaaaauggaaggugugugugugccagccucugacuuagaggucacugcacgggggaccagaguaucccccacacacaccccgcgcgccccucauccacccuuuggaguuuccgaauuguuaccuaguucucccgacucaaaagaauagagagcagcaggucagucagugacaagcagcaguggauagggucagugucaagcagcaguggauagcugagccucucugcucccucugaaguucugcuaaacugcaggcgcccucgccuggaguaaauugcgucuggaagucguagaaaagcuccgaggagguacucgaccacugcugcagugaugagacccagagggauuucugagcugcaugcaagucguguguccccuggcacgcuuuaucugcucugcccccggccaggagcgugccugccgggcugcugccugcaccacgggccaaucagcggagggggcccaggggcugcgccacgcgagcccgcuccuccccccacaacccccacccgcagagcacagcuggauuccggacaaagggcaggggucgggggaggggagcagcacucuguuuguucccccacuccacgccucccccgucgcgggcucagucccagcaacucucgguuccucaaagagccucgcccagccagaagagucccguccggccgcuggggagagcuuugccuuuuccucuuucuuuuuggcauguguccagacccuuucuugguagcaugaaggagguuugggggugccuauauauauauaaggaaggccucuucuuugaguauuacacauggggucuuuuggcucagagagggaaacggcuugucuaaaugaaccagcgaucaaggagucaagugucuucuuggcuggcagcugggaggagcgcccauuaguucaaagugcuauccagcucuccgccacuauggguugggucaggaaaugugugugcaaccauguuucacagacugacuccauccugggaaagaggacagagugaccagagacggucccugcucaaguccuuucuacucagaaacuauugcuuggccagguucaauaucaccuugggauccaacccuccagcccccagaccagaccuugaaaacccccaccauaguccucauccgagacauuggguucuauuccggaggcgagggugguuguagagagagugcagagggggcaucucaucacgccccgccccacuauggaugcuaucgggaaggccugacccgagaggcaggugauagggaaaggucaaggagggacuuguucucugcuagccuuuuuugucuuuucaaugccuccgugugcaggcccuggga

SEQ ID NO: 11345 - RNA, 550 nt, Mus musculus
caucuggucgcccccacgcagcggaccgcccagacacgccgggaagggcgcccgcucugagcagcagcuggaggggagggggcggggagagcgcgggcagagggagggggcgccuccggccgaggaucuuucuccccgaagcucccgcagcccuucugcuccauucucuacccuaaccccuacccucaaguuaccuaaaaauacuuaaacaaacaaacagcccagaccuguuccguuuucacuccuguauaaauagcacagacuuuccaaaaaagcaagaccgcauuuacucuuaucaccagacacuacuuuccaccguguaauucagaaaaaggcagucagcuuccgugagugcggguaauuuuuuucucucucucuuuuuuucucugucucucucucucuuuuuuucuuuugcuugcgguuuugagcugccaagaaagugaaggagggguuugacuguagugucucggcagcgcucgguuuucuuuccgaaguuuaauuuuccggaauggcucccaaacaagggccggggaggcggagccgccacuac

SEQ ID NO: 11346 - RNA, 550 nt, Mus musculus
guaguggcggcuccgccuccccggcccuuguuugggagccauuccggaaaauuaaacuucggaaagaaaaccgagcgcugccgagacacuacagucaaaccccuccuucacuuucuuggcagcucaaaaccgcaagcaaaagaaaaaaagagagagagagacagagaaaaaaagagagagagaaaaaaauuacccgcacucacggaagcugacugccuuuuucugaauuacacgguggaaaguagugucuggugauaagaguaaaugcggucuugcuuuuuuggaaagucugugcuauuuauacaggagugaaaacggaacaggucugggcuguuuguuuguuuaaguauuuuuagguaacuugaggguagggguuaggguagagaauggagcagaagggcugcgggagcuucggggagaaagauccucggccggaggcgcccccucccucugcccgcgcucuccccgcccccuccccuccagcugcugcucagagcgggcgcccuucccggcgugucugggcgguccgcugcgugggggcgaccagaug

SEQ ID NO: 11347 - RNA, 1894 nt, Mus musculus
gcaggagagagucagugacggauagacuuuuuuuuuucuuuaagaagccaacaacuugguugcuaguuuuauuucuguuaauuuuuuucuuuuuuuugguguguguggauguguugugguggucuuuucuaaguguggagggcaaaaggagauaccauccuaggcucaguucaaccccucuccaaaaaaaacggcuucucuggcgcuccagguagcgagggaguugggucuccagguugugcgaggagcaaaugaugaccgccaaggccguagacaaaaucccaguaacucucagugguuuuaugcaccagcugccugacagccucuacccgguggaagaccucgccgccucgucggugaccaucuuccccaauggugaacugggaggccccuuugaccagaugaacggaguggcgggagguaagccgcgugucuucuucggagcuuguggguggggagcggugggugugggggggcuuggaggggagaauggggacuugagguggacggcgcugaccacacuggcucugaagacuggaaguaggcgcagggggagcggaaaaagauagacuagggcugccuggccgugcgcgccagcagaugcaccuggucaccaaaagccacccgcaugccuguagcuccgggcgcgcccagcuuuggcuaggcgcaggguugaagcaucaucuccugguccuugaagcagguccaucagccggacucugcgcuacugggcuagggucaaagagaugggaaaguucaucagucggguuagagcugcgcgucuggagagcucagugucaggggagcgcuuagggagcgcgcgggcagcgcucucugggcagagcccacucccggaggaucucccgagcgcguuguccuucugggguggcugggaggcaccacccaacuugcgcaucgccccaaagugaacaggguuaacaagccgaggcggcggagcagggcaaguaacagcgagaagcggcaaggagaaugccuagggaggcccgcgcuggcaccggugugcgccgguuccuuggcgaugcuguguaaagucgucuuccucagcccccgcgccuuccuagaagcgcagccucuuagucuuaggcuaagacagggaugcgcggguguccggcuuggccgaggauguugggagggaagggaacccuagacuccuuccuccgcugcccggguucacacuggcagucuucagcugaagcgcagcgggagagggagggggagguggcaccaggaauuagcuucaagaacaucacccacccacuuauccauucugggguuccccucucucgcggcuggcaccuucucuguaccgccugggauugauuggucggcucuuuuuauuggugucuguaugguugccucggcgguaagaccacaaggcaaaggagugggagagaagucagaggcagaugggaaauuguuugauauuguugcugcuauuggguguuuuuauugggaacuagagucacagauggccgggagauggaagcaggaaggggcaugcccugcuucuuggagauacaguuuuugaguuccagacucugccuaacuucuuacugucucuccaggccucaguuuccccaccuguugcucuguaguguuggaaucaugaaauggggauugccguguguguguguguguguguguguguguguguguguguguguguguguccgcgcgucagcaugcguguaugugaauuaguucuugccuguauucucauugucccaccucuucccugacuuuucccuccccagauggcaugaucaacauugacaugacuggagagaagagaccccuggaucucccguauccgaguagcuucgcucccaucucugcaccuagaaaccagaccuucacuuacaugggcaaauuc

SEQ ID NO: 11348 - RNA, 1894 nt, Mus musculus
gaauuugcccauguaagugaaggucugguuucuaggugcagagaugggagcgaagcuacucggauacgggagauccaggggucucuucucuccagucaugucaauguugaucaugccaucuggggagggaaaagucagggaagaggugggacaaugagaauacaggcaagaacuaauucacauacacgcaugcugacgcgcggacacacacacacacacacacacacacacacacacacacacacacacacggcaauccccauuucaugauuccaacacuacagagcaacagguggggaaacugaggccuggagagacaguaagaaguuaggcagagucuggaacucaaaaacuguaucuccaagaagcagggcaugccccuuccugcuuccaucucccggccaucugugacucuaguucccaauaaaaacacccaauagcagcaacaauaucaaacaauuucccaucugccucugacuucucucccacuccuuugccuuguggucuuaccgccgaggcaaccauacagacaccaauaaaaagagccgaccaaucaaucccaggcgguacagagaaggugccagccgcgagagaggggaaccccagaauggauaagugggugggugauguucuugaagcuaauuccuggugccaccucccccucccucucccgcugcgcuucagcugaagacugccagugugaacccgggcagcggaggaaggagucuaggguucccuucccucccaacauccucggccaagccggacacccgcgcaucccugucuuagccuaagacuaagaggcugcgcuucuaggaaggcgcgggggcugaggaagacgacuuuacacagcaucgccaaggaaccggcgcacaccggugccagcgcgggccucccuaggcauucuccuugccgcuucucgcuguuacuugcccugcuccgccgccucggcuuguuaacccuguucacuuuggggcgaugcgcaaguuggguggugccucccagccaccccagaaggacaacgcgcucgggagauccuccgggagugggcucugcccagagagcgcugcccgcgcgcucccuaagcgcuccccugacacugagcucuccagacgcgcagcucuaacccgacugaugaacuuucccaucucuuugacccuagcccaguagcgcagaguccggcugauggaccugcuucaaggaccaggagaugaugcuucaacccugcgccuagccaaagcugggcgcgcccggagcuacaggcaugcggguggcuuuuggugaccaggugcaucugcuggcgcgcacggccaggcagcccuagucuaucuuuuuccgcucccccugcgccuacuuccagucuucagagccaguguggucagcgccguccaccucaaguccccauucuccccuccaagcccccccacacccaccgcuccccacccacaagcuccgaagaagacacgcggcuuaccucccgccacuccguucaucuggucaaaggggccucccaguucaccauuggggaagauggucaccgacgaggcggcgaggucuuccaccggguagaggcugucaggcagcuggugcauaaaaccacugagaguuacugggauuuugucuacggccuuggcggucaucauuugcuccucgcacaaccuggagacccaacucccucgcuaccuggagcgccagagaagccguuuuuuuuggagagggguugaacugagccuaggaugguaucuccuuuugcccuccacacuuagaaaagaccaccacaacacauccacacacaccaaaaaaaagaaaaaaauuaacagaaauaaaacuagcaaccaaguuguuggcuucuuaaagaaaaaaaaaagucuauccgucacugacucucuccugc

SEQ ID NO: 11349 - RNA, 600 nt, Mus musculus
ugcgccuuucacccucuagaccagagucggggccucggagagccucggugaagcuagcgggagccagcuccggagcccagccagcucuguucugagccuccccggugcugguacccccgcggcgggguccccgcuucugcgcucgggacgcgccucccggacagccggguccccgcggccaggacaaagccaugaagccggcgcugcuggaagugaugaggaugaacagaauuugccggauggugcuggccacuugcuucggauccuuuaucuuggucaucuucuauuuccaaaguauguugcacccagguagggggcgcguuagcgugguuuuguuggauauuuucuccucucucgcucugcuuucugcuucuuccaaccucaccucuucccuucggccucuucggggcucuuuacugccgggauccgcgggucacggaguugggaugggaagagaaggugcgcuuccucuuccucccaucuccaggcuagagguugagacugcaaggagagacagcggcgcguguuguugccuccuuuuucuuuucuuuucuuuucuuuuuuucuuugugucuugucuauuggcuagguggcauagaa

SEQ ID NO: 11350 - RNA, 600 nt, Mus musculus
uucuaugccaccuagccaauagacaagacacaaagaaaaaaagaaaagaaaagaaaagaaaaaggaggcaacaacacgcgccgcugucucuccuugcagucucaaccucuagccuggagaugggaggaagaggaagcgcaccuucucuucccaucccaacuccgugacccgcggaucccggcaguaaagagccccgaagaggccgaagggaagaggugagguuggaagaagcagaaagcagagcgagagaggagaaaauauccaacaaaaccacgcuaacgcgcccccuaccugggugcaacauacuuuggaaauagaagaugaccaagauaaaggauccgaagcaaguggccagcaccauccggcaaauucuguucauccucaucacuuccagcagcgccggcuucauggcuuuguccuggccgcggggacccggcuguccgggaggcgcgucccgagcgcagaagcggggaccccgccgcggggguaccagcaccggggaggcucagaacagagcuggcugggcuccggagcuggcucccgcuagcuucaccgaggcucuccgaggccccgacucuggucuagagggugaaaggcgca

SEQ ID NO: 11351 - RNA, 2057 nt, Mus musculus
cagagguaaucucauuacauguuaaaguaucaagauauacacauuuuuaaaccauuuguacaaaacuucuauaaauuuuuucucucucuuuuucuuauguacaaaaauaucuuaauauauccccaaacugguuaggauagauacaaauagauuuuuuucuuauaauaaaaaaauucacaaagauuggaagcauucuaugaagaaaacagaagcaaagaccgugggagggcgaugugggguuuggggaggaggccaccaggagagggaaaggcuguccgagaacugacguugcuucaauggaggcaaauguccauagaucgcuggaaugggggugacugaggaaagacaucaacccaguuucagggggcuaagacagcucugacagagagugggaggugaaggcacuugcacaugcgcgcuuccagcccugccuguuagugguugggaguuaauauagugucugucugugugugugugugugugugugacgcucuugcuccaggaaaggaacccaucugugauucgggcuuagguucagacaccagucacucuucucgugucuggaaaugauguuggaaugcagagacacuguuggagcccaccccuguuugcugagaacauugcaucuuagugaaggugccccuguagguuggcugucugguuuguuuguuucauuucuucuucuuuuuuccccuuguuuuucugccuccccauuugacgucguuggcgagaaacacuaaagaugcaggaucugcugccauccuguaacagaaacaagagagguuagugugaacuugaaggggugugguagaagcuauucaggcuuggagaaucugucagguaaaacaucucuuuggacaaagucccaggacucaauacgcagggucucuaugccucaccucgaccuucugcucuuggaaacuugggcaaagccacucucaggggccaagacugaaguuaacacacuagcacuugagauggacaaacuaacaacauaguaaccuccucucaccccuggguuccuggagacagccccuaccuuccgugaacuccccccuccacaccgaaaaagaaaaagggaccuagucaagaaaggcucugcccauccccacaugaagcguaccugcuuccaaaguccauucccaggagagccuggcagguccucagaaccaguugguaaaguccagcagcucuuguuccucugggcuaagagggucguaggaucccucgucggaggaguaggacgagaccggagaacccgccauagaguucaagucguuggaguaguugggggagauggugggcgacaggacgcccgccugaaaggcagcgcucaccgcgucgugcucguccagcagcugcugcagcgcgcggauguacucgaccgccgagcgcagcgucuccaccuugcucaucuucuuguuggccgcgccguuggggacaugcucccggaggguggcaaaacccagguugaccaacuugacccgguugcgcucgcgcucguugcggcgcgccacggcggccggcugcugcuguggcaggcuguagccgaagccgcugaaguugagccggcguuugcagcgcaucaguuccggagaggacgagcgcuggcgcuugaccugcuuggccgcugacuugugaccgcccccugagggcuggcugucggccaccgggcucagcugcggcgccugcugcggcggcgccugcggcuguugcugcugcgcgcucugagcugccgcggccgccgccgcugccgccgccgccgcggucgcaaagaagcaggcugcgggaggcaggaagggcugcgggggcugcggcugcuggccggcuccacucuccaucuugccagagcucuccaugccgggccaaacugucgcgggggagaacgaguuggggacgcagggugcgcagagcccuugaaggaagcggggcugcgaagcacgaucaaagggggacgaagaaaaaggagaggggagaaacgagccccggaggaaaguuaaaggggaagaaacgcgcagaaggaggcagaguugucaggcugcagcggaggaaggugc

SEQ ID NO: 11352 - RNA, 2057 nt, Mus musculus
gcaccuuccuccgcugcagccugacaacucugccuccuucugcgcguuucuuccccuuuaacuuuccuccggggcucguuucuccccucuccuuuuucuucgucccccuuugaucgugcuucgcagccccgcuuccuucaagggcucugcgcacccugcguccccaacucguucucccccgcgacaguuuggcccggcauggagagcucuggcaagauggagaguggagccggccagcagccgcagcccccgcagcccuuccugccucccgcagccugcuucuuugcgaccgcggcggcggcggcagcggcggcggccgcggcagcucagagcgcgcagcagcaacagccgcaggcgccgccgcagcaggcgccgcagcugagcccgguggccgacagccagcccucagggggcggucacaagucagcggccaagcaggucaagcgccagcgcucguccucuccggaacugaugcgcugcaaacgccggcucaacuucagcggcuucggcuacagccugccacagcagcagccggccgccguggcgcgccgcaacgagcgcgagcgcaaccgggucaaguuggucaaccuggguuuugccacccuccgggagcauguccccaacggcgcggccaacaagaagaugagcaagguggagacgcugcgcucggcggucgaguacauccgcgcgcugcagcagcugcuggacgagcacgacgcggugagcgcugccuuucaggcgggcguccugucgcccaccaucucccccaacuacuccaacgacuugaacucuauggcggguucuccggucucguccuacuccuccgacgagggauccuacgacccucuuagcccagaggaacaagagcugcuggacuuuaccaacugguucugaggaccugccaggcucuccugggaauggacuuuggaagcagguacgcuucauguggggaugggcagagccuuucuugacuaggucccuuuuucuuuuucgguguggaggggggaguucacggaagguaggggcugucuccaggaacccaggggugagaggagguuacuauguuguuaguuuguccaucucaagugcuaguguguuaacuucagucuuggccccugagaguggcuuugcccaaguuuccaagagcagaaggucgaggugaggcauagagacccugcguauugaguccugggacuuuguccaaagagauguuuuaccugacagauucuccaagccugaauagcuucuaccacaccccuucaaguucacacuaaccucucuuguuucuguuacaggauggcagcagauccugcaucuuuaguguuucucgccaacgacgucaaauggggaggcagaaaaacaaggggaaaaaagaagaagaaaugaaacaaacaaaccagacagccaaccuacaggggcaccuucacuaagaugcaauguucucagcaaacaggggugggcuccaacagugucucugcauuccaacaucauuuccagacacgagaagagugacuggugucugaaccuaagcccgaaucacagauggguuccuuuccuggagcaagagcgucacacacacacacacacacacagacagacacuauauuaacucccaaccacuaacaggcagggcuggaagcgcgcaugugcaagugccuucaccucccacucucugucagagcugucuuagcccccugaaacuggguugaugucuuuccucagucacccccauuccagcgaucuauggacauuugccuccauugaagcaacgucaguucucggacagccuuucccucuccugguggccuccuccccaaaccccacaucgcccucccacggucuuugcuucuguuuucuucauagaaugcuuccaaucuuugugaauuuuuuuauuauaagaaaaaaaucuauuuguaucuauccuaaccaguuuggggauauauuaagauauuuuuguacauaagaaaaagagagagaaaaaauuuauagaaguuuuguacaaaugguuuaaaaauguguauaucuugauacuuuaacauguaaugagauuaccucug

SEQ ID NO: 11353 - RNA, 654 nt, Mus musculus
auggggcgggggugucuucggagguggguggugugcauguguguguguguguguguguguguguguguguguguguguguguguguuucugcuuaccuucccagaaaagaagcaccuccuuuaagugaaaggauacacccuagaauagaaguaggcugggcacccagagaagaccuguccugcuucuagcauccccaggggacucacuuccuuuuaaccaucaaacucccaacauuuaccauaaacuucacaggggcuccgggugggguauuggguggagaaugucccuuccauauagguacuucccacacuucaccccaaaguuccuguuuggagggacacgucuucacccucucuggguggcccgggaugccaaggggagaaguuaugcuacguuaaguuucugaaagucagauccagucccggauuaccaucucuccgccccggggcuccugcugcacgcgaaaguggcggcggcggcggcggcugccgcugcuugggcggcaaagggaccgcggcugcuuuaagaaccgccucccccucucuucccuuugacaauggucugaaccgagcccugcuucccaaagcaaaauuuguaauaugccauuuuuccgauggaccuuucuccuuuuggcugcugacggagccacggga

SEQ ID NO: 11354 - RNA, 654 nt, Mus musculus
ucccguggcuccgucagcagccaaaaggagaaagguccaucggaaaaauggcauauuacaaauuuugcuuugggaagcagggcucgguucagaccauugucaaagggaagagagggggaggcgguucuuaaagcagccgcggucccuuugccgcccaagcagcggcagccgccgccgccgccgccacuuucgcgugcagcaggagccccggggcggagagaugguaauccgggacuggaucugacuuucagaaacuuaacguagcauaacuucuccccuuggcaucccgggccacccagagagggugaagacgugucccuccaaacaggaacuuuggggugaagugugggaaguaccuauauggaagggacauucuccacccaauaccccacccggagccccugugaaguuuaugguaaauguugggaguuugaugguuaaaaggaagugaguccccuggggaugcuagaagcaggacaggucuucucugggugcccagccuacuucuauucuaggguguauccuuucacuuaaaggaggugcuucuuuucugggaagguaagcagaaacacacacacacacacacacacacacacacacacacacacacacacacaugcacaccacccaccuccgaagacacccccgccccau

SEQ ID NO: 11355 - RNA, 1364 nt, Mus musculus
cagggagagccggcuuuaauggcagaaaggaccacggugaagaacacaggaaggagggucagugaggguggggaccuguggauuaugaagaacucacgcugggaccauagaagguuccacugccccggagucaauaccuaacucccggcaaagggauguacugucgcuucauacacaguaaacccugcagauccaggacaagcgugcugaaggagggagagcgcugugcuauccugcagaugaagcuuaaagcuacgcgcuccucuucuuucacuagaggcuccucuugagguacaguuaggagaagagcccugaaggaacugcucccccuaggcuagagccagauaacuaaaaagaagugcuaaaugucuacuguuuugccauucucucucaaacuuucaugggaugggagaaaaaguuugccauuugggggcccuacgcuagcccggcacugaaaaagcucccuuuucccaagccuagccaacacccuuggcccuggcacaagccaaacgaaauucacccgcccagguauucaaaugcgccgauucucucaggugcauggcgcugcgcgguacgggccaauauggucuggcagcuuugggacacuucgcacaguuuacguugccgacccuacacuuguggagcagcuccugcgacaagaaagucacuguccagagcgcuguaguuucucaucaugggcagagcaccgucgccgccaccagcgugcuugcggauugcuaacggcgugagucgaccccugagcaccuuauuccugccccgacucccacagccaaguugggcuuggagggaggucggaaguuuccaccaaucuucuggcauuuccccgguucuccagucuguacuccaguccgaacgcagguagagccgauuccucaccccucccugcauguuuggggccaaaauccuacgauuccacgagauaggcgagggcaccagcauuuggcuggaacgugagcaucugugauucaguuuaccauggaacccacucccaucccugagcaggaagugaguaaagaggaacggagaugagagauuggugaggucagggugauuucuacacccggagagagcagacauaauacuccuggucacccuagccuucuccacacacgcucacgucccuaaagucccucucugcacccgggcagggauggugaagaauggcagaggcuccgaagucuucuggccccgcuccuccuccggccacaagcagccgcgggcuaugcuggaacucuggacaacgugguccgugaccuugugcgacgacuaaggcgccagcggggacguggcucugggcuacccggccuaguucuggacguggcaggagaguuuuacaaauuugg

SEQ ID NO: 11356 - RNA, 1364 nt, Mus musculus
ccaaauuuguaaaacucuccugccacguccagaacuaggccggguagcccagagccacguccccgcuggcgccuuagucgucgcacaaggucacggaccacguuguccagaguuccagcauagcccgcggcugcuuguggccggaggaggagcggggccagaagacuucggagccucugccauucuucaccaucccugcccgggugcagagagggacuuuagggacgugagcguguguggagaaggcuagggugaccaggaguauuaugucugcucucuccggguguagaaaucacccugaccucaccaaucucucaucuccguuccucuuuacucacuuccugcucagggaugggaguggguuccaugguaaacugaaucacagaugcucacguuccagccaaaugcuggugcccucgccuaucucguggaaucguaggauuuuggccccaaacaugcagggaggggugaggaaucggcucuaccugcguucggacuggaguacagacuggagaaccggggaaaugccagaagauugguggaaacuuccgaccucccuccaagcccaacuuggcugugggagucggggcaggaauaaggugcucaggggucgacucacgccguuagcaauccgcaagcacgcugguggcggcgacggugcucugcccaugaugagaaacuacagcgcucuggacagugacuuucuugucgcaggagcugcuccacaaguguagggucggcaacguaaacugugcgaagugucccaaagcugccagaccauauuggcccguaccgcgcagcgccaugcaccugagagaaucggcgcauuugaauaccugggcgggugaauuucguuuggcuugugccagggccaaggguguuggcuaggcuugggaaaagggagcuuuuucagugccgggcuagcguagggcccccaaauggcaaacuuuuucucccaucccaugaaaguuugagagagaauggcaaaacaguagacauuuagcacuucuuuuuaguuaucuggcucuagccuagggggagcaguuccuucagggcucuucuccuaacuguaccucaagaggagccucuagugaaagaagaggagcgcguagcuuuaagcuucaucugcaggauagcacagcgcucucccuccuucagcacgcuuguccuggaucugcaggguuuacuguguaugaagcgacaguacaucccuuugccgggaguuagguauugacuccggggcaguggaaccuucuauggucccagcgugaguucuucauaauccacagguccccacccucacugacccuccuuccuguguucuucaccgugguccuuucugccauuaaagccggcucucccug

SEQ ID NO: 11357 - RNA, 827 nt, Mus musculus
cgggcccucuaugcgcuagucuugcugcucgccugcgccucgcugggucuccuguacuccagcacccgaaacgcgccaagucucccgaacccucuggcauuguggucgcccccacaaggucccccgagacucgaucugcuagaccuugccccugagccucgcuacgcacacaucccggucaggaucaaggagcaagugguggggugagugcggaccgcggcguggcggcggcgacagcgcagaacaugcuggaggggguggccggggagcuuuuguuuccuccagugcuagacucggacgcugcuuacugcugacugguugggugcaguuaucagggagguggagagggcuaccgaagcuugaacugggggggagacaggggcgcggcaaaucuauccuccucaaccuugucgccgccacuggagugugggaggauguacaggcaaaagagcacccggagacugccugcugucuugauuuagacuugagauuccagaaggguuccuggauggcggcuacguagacauccuaguaauuggcccuaguucgcaccucuguaacgcacagauuuaagggauaagcugucucucaccugugggcagaguugagggaucaaagugugcagcgcugugcguuuugugagauaaauggagcuuagguaccuaccuggacucugaagccgcuucuccucccuuuaggcugcuggcucagaacaacugcaguugugaauccaagggaggaagccuucccuugcccuuucugagacagguucgggcgguugaccucacuaaagccuuugacgcugaggagcugagggcuguuucugu

SEQ ID NO: 11358 - RNA, 827 nt, Mus musculus
acagaaacagcccucagcuccucagcgucaaaggcuuuagugaggucaaccgcccgaaccugucucagaaagggcaagggaaggcuuccucccuuggauucacaacugcaguuguucugagccagcagccuaaagggaggagaagcggcuucagaguccagguagguaccuaagcuccauuuaucucacaaaacgcacagcgcugcacacuuugaucccucaacucugcccacaggugagagacagcuuaucccuuaaaucugugcguuacagaggugcgaacuagggccaauuacuaggaugucuacguagccgccauccaggaacccuucuggaaucucaagucuaaaucaagacagcaggcagucuccgggugcucuuuugccuguacauccucccacacuccaguggcggcgacaagguugaggaggauagauuugccgcgccccugucucccccccaguucaagcuucgguagcccucuccaccucccugauaacugcacccaaccagucagcaguaagcagcguccgagucuagcacuggaggaaacaaaagcuccccggccacccccuccagcauguucugcgcugucgccgccgccacgccgcgguccgcacucaccccaccacuugcuccuugauccugaccgggaugugugcguagcgaggcucaggggcaaggucuagcagaucgagucucgggggaccuugugggggcgaccacaaugccagaggguucgggagacuuggcgcguuucgggugcuggaguacaggagacccagcgaggcgcaggcgagcagcaagacuagcgcauagagggcccg

SEQ ID NO: 11359 - RNA, 1481 nt, Mus musculus
gauagacggguaaaggauucugaaguacaggugaccccuccguuugcacacacccaagucuauauauacacuguguccacagaggacaggaauggccgagcugggcuagaaucucuacuggcuggucuccguccccgcgaugcugcuaucccggguuauuaaugcugccgccauccgcucgucauacauauuuauugccccccucauuucuucuccuauccagcccuccucccaccccaggugagggcgguggagguggcagagagugauugacucacgcagacaagcuugagcuggcaucuuacgcccagaggguguaccugaguagggccagggacagaggcuuaggauggagaugggggcagggaagaagcuggggagguggaacugaacccccugggggguguuagagguaggauugggugaggcuucagggaaagccaaagggugggucucucccccucccacucuggaccaaaccccaguaaaguccuauuuccagcugguccaccccccacccccugcccccaagcgcucaaugcuaggacaucaaaugucuccaagcuacuacuuccuaggacauccuaguacuuucugcccugcacccaaucccgggagggaccugcucagggcugguaggcucagucucuucagaggaagagauugggggugggguggggguagggagugagguuugacagggcagagagaggugccaggauguccccccaccucugaucccagacaaauugcugucucugcuucugugauccuggcaaaucccugggcuuugguacccacagcccccacccacugcuggagugagcuaagauaaaagggaagaguuggggagagaggcagcugaagcgaccuugggggugggaagcucggaccgggaggggugagagucuggaaggaaacgagccgagaaaugggaacacggaauaaaauaaaauaaaauccucccucuggcuuccuugaucgcucacgcucacucucccucucuagcucucccucucucccucuuucucucucucucucucucucucucucucucucucauucucucucuuucucucucauucucucucucucacucucucuuuuccccaaucuuuucucaaucucucugucucaguuucuucccccacucugucucugauuuccaguucuggggagcacccccuuucucucuuucugucugucuuucugguugucaguuuccaguaauggauaugggggagggcacaggaaacucaagguggugugggagcuccuuuuugccagagcccaccccgcaaugacugagggccugagcuggguguugaccaagggggacccccccccacuugaaagcuaguuuaauuaaacuaauugggcgcagugacauuugcagaggggagaggcuagcaugcuggcugucagcugggguaggagguggaggugugugguggugguuaggggggcuuccagcagacucc

SEQ ID NO: 11360 - RNA, 1481 nt, Mus musculus
ggagucugcuggaagccccccuaaccaccaccacacaccuccaccuccuaccccagcugacagccagcaugcuagccucuccccucugcaaaugucacugcgcccaauuaguuuaauuaaacuagcuuucaagugggggggggucccccuuggucaacacccagcucaggcccucagucauugcggggugggcucuggcaaaaaggagcucccacaccaccuugaguuuccugugcccucccccauauccauuacuggaaacugacaaccagaaagacagacagaaagagagaaagggggugcuccccagaacuggaaaucagagacagagugggggaagaaacugagacagagagauugagaaaagauuggggaaaagagagagugagagagagagaaugagagagaaagagagagaaugagagagagagagagagagagagagagagagagaaagagggagagagggagagcuagagagggagagugagcgugagcgaucaaggaagccagagggaggauuuuauuuuauuuuauuccguguucccauuucucggcucguuuccuuccagacucucaccccucccgguccgagcuucccacccccaaggucgcuucagcugccucucuccccaacucuucccuuuuaucuuagcucacuccagcagugggugggggcuguggguaccaaagcccagggauuugccaggaucacagaagcagagacagcaauuugucugggaucagagguggggggacauccuggcaccucucucugcccugucaaaccucacucccuacccccaccccacccccaaucucuuccucugaagagacugagccuaccagcccugagcaggucccucccgggauugggugcagggcagaaaguacuaggauguccuaggaaguaguagcuuggagacauuugauguccuagcauugagcgcuugggggcagggggugggggguggaccagcuggaaauaggacuuuacugggguuugguccagagugggagggggagagacccacccuuuggcuuucccugaagccucacccaauccuaccucuaacaccccccaggggguucaguuccaccuccccagcuucuucccugcccccaucuccauccuaagccucugucccuggcccuacucagguacacccucugggcguaagaugccagcucaagcuugucugcgugagucaaucacucucugccaccuccaccgcccucaccuggggugggaggagggcuggauaggagaagaaaugaggggggcaauaaauauguaugacgagcggauggcggcagcauuaauaacccgggauagcagcaucgcggggacggagaccagccaguagagauucuagcccagcucggccauuccuguccucuguggacacaguguauauauagacuugggugugugcaaacggaggggucaccuguacuucagaauccuuuacccgucuauc

SEQ ID NO: 11361 - RNA, 561 nt, Mus musculus
cacccugugaauggucauuucacggacaagggaggccugaagcacacccccuucaggcccgcagaugcuuaacucaaaggaaccaccuucucccggaugccugcuaaugacacacugagacagcuaagagccgccaccccucacacuguugacagaucaagcucuggagcuuccccuggcuggggggacauucuuugcagggggcucaugugccagguuaugcccacugaguaaaccuggaguggaaaacgaggcaguacucuaucguauccagguucaucgggucuuuguuugcuuccaggauccccuauuucgaauacucacccccuuuuccaucagucuccaccucccaccuccgucccgcuuccccacguccucuuuucgaccuccacccuuuagaccccauuccggaguccaacuccacccaucuccacucccugccaccuccuuuugcccacuaacuugaaucuggguugcgggguccggcguguguuauccccucugccagguggcuguuccgcugugggagagggagcucugugcauggacggccagagauca

SEQ ID NO: 11362 - RNA, 561 nt, Mus musculus
ugaucucuggccguccaugcacagagcucccucucccacagcggaacagccaccuggcagaggggauaacacacgccggaccccgcaacccagauucaaguuagugggcaaaaggagguggcagggaguggagauggguggaguuggacuccggaauggggucuaaaggguggaggucgaaaagaggacguggggaagcgggacggaggugggagguggagacugauggaaaagggggugaguauucgaaauaggggauccuggaagcaaacaaagacccgaugaaccuggauacgauagaguacugccucguuuuccacuccagguuuacucagugggcauaaccuggcacaugagcccccugcaaagaauguccccccagccaggggaagcuccagagcuugaucugucaacagugugagggguggcggcucuuagcugucucagugugucauuagcaggcauccgggagaaggugguuccuuugaguuaagcaucugcgggccugaagggggugugcuucaggccucccuuguccgugaaaugaccauucacagggug

SEQ ID NO: 11363 - RNA, 861 nt, Mus musculus
gggcugagagccccucugcgacuuuuccugcuucugaguucauggggggugugggaagugggugucugguggacuguggugcagugagcauggcaguugcacccuuucucucucucuccacugucuacucgcccaaaauuugccccagaccaggccugggcugaggacagacuucccgaauggcuuccccugggcucccacuaguauccuuuccuauguuggucacuccaacucacuccuaugagcccaagugggaccccaaagcugagaccccuugacuacagagaccggagacaggcccaucaucuggguaaucucaaccccucccccagcagccgacaaacacccuaagggaccaagacucccaucagcucagagucuccgacuccacuccauauggggccucaagaggccuggggggaggggaaucuugagcacacccccgcccccaaucucagcagagaaaaagcuaggaaggccccaggggucucacugcgccccaggacacucaauccaggaaccccagccucggccugcugcucugaucuucaauagccaacugccugcgugcggucccuauucccgaaaggcacggggacuagggucggggggagguuuagguuccggccucugccuuuccuuccaggcuuuugcuaucgcgaccgagccucccaauccggccacuuguugucgccaacgccucccagcugccucggcagcgcacggguggggggucccucgcagggccgcagaaggggauggggguagcccugcacccagcaagagcggggcagucgcccucucuccccuucucccacugccggagcagauuggauucucaacgcgacacgagcggaaugu

SEQ ID NO: 11364 - RNA, 861 nt, Mus musculus
acauuccgcucgugucgcguugagaauccaaucugcuccggcagugggagaaggggagagagggcgacugccccgcucuugcugggugcagggcuacccccauccccuucugcggcccugcgagggaccccccacccgugcgcugccgaggcagcugggaggcguuggcgacaacaaguggccggauugggaggcucggucgcgauagcaaaagccuggaaggaaaggcagaggccggaaccuaaaccuccccccgacccuaguccccgugccuuucgggaauagggaccgcacgcaggcaguuggcuauugaagaucagagcagcaggccgaggcugggguuccuggauugaguguccuggggcgcagugagaccccuggggccuuccuagcuuuuucucugcugagauugggggcgggggugugcucaagauuccccuccccccaggccucuugaggccccauauggaguggagucggagacucugagcugaugggagucuuggucccuuaggguguuugucggcugcugggggagggguugagauuacccagaugaugggccugucuccggucucuguagucaaggggucucagcuuuggggucccacuugggcucauaggagugaguuggagugaccaacauaggaaaggauacuagugggagcccaggggaagccauucgggaagucuguccucagcccaggccuggucuggggcaaauuuugggcgaguagacaguggagagagagagaaagggugcaacugccaugcucacugcaccacaguccaccagacacccacuucccacaccccccaugaacucagaagcaggaaaagucgcagaggggcucucagccc

SEQ ID NO: 11365 - RNA, 1610 nt, Mus musculus
cauagcugaagcuguuguaaacaauuuguuguuuuaaccgcuucuggucagaggaaggagagaaauagcuauuacuccacauugggaccugagcccugagcucugaaguggggcuccuaucuccauaaggacagcagcuugcugagaacagcuuuucacagccuuccucgcaaaaauuggcuccaaagaccugggauguuggugauaacuggacaaaggugacaccugugcaagcacacagcaggugacacuuugaagagcuaaccuccagaaaguggaaaggaggugaucgccaguacccucgagggcccuacucccucccuccccuagcaaucucccugggcucagagcaaagggcacagcggguuagagcacaggucuccuuagacuccgcacacucccuuccccauaacuguugcauucuuuucucccaggccuuccuccccgcuaggcgcccugcacccagacccucuaaacugggcgcugacgcugcuauuagucugggcuccgugcugcuccgccucccucccccgcagcccccgguccaaggccggcuccuccuccucccccuccggaaacccgaagcccccgccccggccaggccgucgcaagcgcucuggagggcgguccgcgugagagccagccacgcggggcaggagcgcccaguugcugccggagcugggcccgccagaaccucuccuggagccccuugcucuccuugaaucucccuuucccaccgcuuucuggauacccuugacgcccacguuccucgcgcccuuucccgccccuacgcggggcgcugccccugccacccaagucccugcucaagcccgcccggcucccgcgcgugcccagagccauggcuccagugcgcaccgcaucccugcucugcggccuccuggcacugcugacgcugugcccugaggggaacccacagacggugcugacggacgacgagaucgaggaguuccucgaaggcuuccuuucggaguuggagacccaguccccgccccgggaagacgacguggaaguccagccgcuucccgaacccacccagcguccccgcaaauccaaggcagggggcaagcagcgggcagauguagaaggugagaaccuggugacauggguggccauggcaucaagugagcauacaggggcucuggagggucuagccacuucccaugcugccccgugaggaaugucucuccaaggcaacgcaaggcaacacacugccaggcagcaguucuguccuggaguuuggaaaccuggagguguguguucagcauaggguggcgcugggcuuuugaggucgcccaaguuguucaucccaggucucaagagaguguagguuuggacgagugggaaauugugauucgccucuccgaacuggcccuagucucuuaguggcaagcuucaagccuaggcaucugcuugccuccucuucucccacaggaacacagacaggggagcggggugaggaagacuuccaggugaaagugggcagucugagauggucagaacuaagcgaggugauagcaucccggaggcaugcaaccccgagccucuuaugcaaucguugucaguaaaucuuagcuguuuuucauggcccu

SEQ ID NO: 11366 - RNA, 1610 nt, Mus musculus
agggccaugaaaaacagcuaagauuuacugacaacgauugcauaagaggcucgggguugcaugccuccgggaugcuaucaccucgcuuaguucugaccaucucagacugcccacuuucaccuggaagucuuccucaccccgcuccccugucuguguuccugugggagaagaggaggcaagcagaugccuaggcuugaagcuugccacuaagagacuagggccaguucggagaggcgaaucacaauuucccacucguccaaaccuacacucucuugagaccugggaugaacaacuugggcgaccucaaaagcccagcgccacccuaugcugaacacacaccuccagguuuccaaacuccaggacagaacugcugccuggcaguguguugccuugcguugccuuggagagacauuccucacggggcagcaugggaaguggcuagacccuccagagccccuguaugcucacuugaugccauggccacccaugucaccagguucucaccuucuacaucugcccgcugcuugcccccugccuuggauuugcggggacgcuggguggguucgggaagcggcuggacuuccacgucgucuucccggggcggggacugggucuccaacuccgaaaggaagccuucgaggaacuccucgaucucgucguccgucagcaccgucuguggguuccccucagggcacagcgucagcagugccaggaggccgcagagcagggaugcggugcgcacuggagccauggcucugggcacgcgcgggagccgggcgggcuugagcagggacuuggguggcaggggcagcgccccgcguaggggcgggaaagggcgcgaggaacgugggcgucaaggguauccagaaagcggugggaaagggagauucaaggagagcaaggggcuccaggagagguucuggcgggcccagcuccggcagcaacugggcgcuccugccccgcguggcuggcucucacgcggaccgcccuccagagcgcuugcgacggccuggccggggcgggggcuucggguuuccggagggggaggaggaggagccggccuuggaccgggggcugcgggggagggaggcggagcagcacggagcccagacuaauagcagcgucagcgcccaguuuagagggucugggugcagggcgccuagcggggaggaaggccugggagaaaagaaugcaacaguuauggggaagggagugugcggagucuaaggagaccugugcucuaacccgcugugcccuuugcucugagcccagggagauugcuaggggagggagggaguagggcccucgaggguacuggcgaucaccuccuuuccacuuucuggagguuagcucuucaaagugucaccugcugugugcuugcacaggugucaccuuuguccaguuaucaccaacaucccaggucuuuggagccaauuuuugcgaggaaggcugugaaaagcuguucucagcaagcugcuguccuuauggagauaggagccccacuucagagcucagggcucaggucccaauguggaguaauagcuauuucucuccuuccucugaccagaagcgguuaaaacaacaaauuguuuacaacagcuucagcuaug

SEQ ID NO: 11367 - RNA, 1668 nt, Mus musculus
gucaacaggaaggaaaaguuaaagcgugaucaggcugaggaggugagagccgggaccgcggagggugcaaaaucccaagugaagucaauuuuuuuuuuaguguggcggaagcaauuugcucaagcaaauguucauuuggcgccgggagggcaggccgcacagagauaccggguuauuucguuuaguuugaaauauuuuugaaagagggacaaaauggcaaguaauacagaggcccaaggugaauacaccuugggucgccaaggcucacuggccacaucauuucuucaaagaucuccagcgcugccuccuaccccagagccugcaaucaccuuucuaguugaccucucugggccccuagcacuaagagauagcugaacaggaaucccaccgcaccuccaggguagaugcggcccaggccaggcuaaggcggcaagaagacgccaaaggcaccacaguagaaguggcaguuucaggaugccgcccaaggucagggguaccuccgaggcggucaccccucuuccuuugcucgcacaggcgggccuucuuucuaccaagucugcuaagcacaccgagucccaccagaauuugauggccaacccagcgccccaaacauucuagggauuuuggaaggccuagcgugccaggucgcgucgcaucggccguccuauaugaacccgauggagagcaaggaacuaggccucagguuguaaagcucacgcacagccgaccgggagggcgaggcucggcgcagacacucugagcccacgcagcucugcuccagcaaaagaagggguucugggaguaugacugggaccggcggggggcuugaagcuacaucccaggacccaaggguaggagauuccggggagaaagggagguaaaacuaaagcagcucccccaucccaacuccuuuccccgccucagcccugggggacccucagccuagacuaaggggguggggggaggucagcgagcacauaaggcggaaaggaaggauucaaagagcuugggccgaagggccacaggccugcagccuccgcggcuaagcccggcugcggugugaguuuucgaguacuuucgucuaacuuagcagcccaguuccgcagcuucggaggaggcgggggagggggcggccggcucccgagcggccugggguccccagggcagccaaggggcgcccggccucucacuccaaccccgcccaccugccccggacagagguagcgggggucgauuagaggacggggagacgagaggggccaccaucgucccgggguggcgcgcggcccggcgacucccuccuuaccugcccuccgcagucgcggcuuuucaccaucuaccucucgccuucaccgagacucgccggcagccaaccugcaaaacggaggcgcacagguauuaccccggagacggcgggacccuaggcuuuccucuucccucaacuucccucuucccgucuccugcauuuuuucuaggagcucugugcguguaccuccagguuucacuuuauugcucaaacacuuuguugcaaagucccacaugcuuuuccucucaagaccuggccucgcccgggacccgggggguggggugggugaguaggggguguucgagggacagaguuaggagguggcuugcgcuggcagcugcacucucucggagcaagccgga

SEQ ID NO: 11368 - RNA, 1668 nt, Mus musculus
uccggcuugcuccgagagagugcagcugccagcgcaagccaccuccuaacucugucccucgaacacccccuacucacccaccccaccccccgggucccgggcgaggccaggucuugagaggaaaagcaugugggacuuugcaacaaaguguuugagcaauaaagugaaaccuggagguacacgcacagagcuccuagaaaaaaugcaggagacgggaagagggaaguugagggaagaggaaagccuagggucccgccgucuccgggguaauaccugugcgccuccguuuugcagguuggcugccggcgagucucggugaaggcgagagguagauggugaaaagccgcgacugcggagggcagguaaggagggagucgccgggccgcgcgccaccccgggacgaugguggccccucucgucuccccguccucuaaucgacccccgcuaccucuguccggggcaggugggcgggguuggagugagaggccgggcgccccuuggcugcccuggggaccccaggccgcucgggagccggccgcccccucccccgccuccuccgaagcugcggaacugggcugcuaaguuagacgaaaguacucgaaaacucacaccgcagccgggcuuagccgcggaggcugcaggccuguggcccuucggcccaagcucuuugaauccuuccuuuccgccuuaugugcucgcugaccuccccccacccccuuagucuaggcugagggucccccagggcugaggcggggaaaggaguugggaugggggagcugcuuuaguuuuaccucccuuucuccccggaaucuccuacccuuggguccugggauguagcuucaagccccccgccggucccagucauacucccagaaccccuucuuuugcuggagcagagcugcgugggcucagagugucugcgccgagccucgcccucccggucggcugugcgugagcuuuacaaccugaggccuaguuccuugcucuccaucggguucauauaggacggccgaugcgacgcgaccuggcacgcuaggccuuccaaaaucccuagaauguuuggggcgcuggguuggccaucaaauucuggugggacucggugugcuuagcagacuugguagaaagaaggcccgccugugcgagcaaaggaagaggggugaccgccucggagguaccccugaccuugggcggcauccugaaacugccacuucuacuguggugccuuuggcgucuucuugccgccuuagccuggccugggccgcaucuacccuggaggugcggugggauuccuguucagcuaucucuuagugcuaggggcccagagaggucaacuagaaaggugauugcaggcucugggguaggaggcagcgcuggagaucuuugaagaaaugauguggccagugagccuuggcgacccaagguguauucaccuugggccucuguauuacuugccauuuugucccucuuucaaaaauauuucaaacuaaacgaaauaacccgguaucucugugcggccugcccucccggcgccaaaugaacauuugcuugagcaaauugcuuccgccacacuaaaaaaaaaauugacuucacuugggauuuugcacccuccgcggucccggcucucaccuccucagccugaucacgcuuuaacuuuuccuuccuguugac

SEQ ID NO: 11369 - RNA, 3303 nt, Mus musculus
gugcagcucucggcgcgcagggcgcccugcggcgacccgggacucuugcgcccagaaagagcaccggcaggggaggcgccgccaauucccagcugcacagcguuuccaggggcucccaggcagucucaccaaagguguucgcaaguccuaaaagcuucuucggaaccguuggaacucaaaucuccuuacauucucucucucucucucucucucucucucucucucucucucucucucucucucucucucauggauuugauagaaaacuuucuuuuucacaaucugucagucuuuccagaucuccaccuacaacgaacagucugguggaaaauguggcuacacaccccgaucccucucacuucauuuucuacaccuuacuggaggagccuccucgaaacaauuuccccggauuguucuuacuggcagaccccaguuuccagccgaauaaacuugcugagaucgucuucuuguguguacuuuucaaagcgagagggaagaguauuuucggcccaaccccgaacaaggcaauauuuuuacauggcaucuccuacugaauacuagggaccacacuuacacucuuuccuaguucuuuuuccucaucuucugccguucucaccccaacaggcgggcgaaaaguuugaaccacaguaugugcgugggugaguucggcagccgccgagagcaagguagagcggagcaccgcgaugcccaggccgcgcgguccgcuguggucgcugaccgggugcggggcgaccagaaggaaggggggagcccgcugagugaaaagggccgcgacugccgcucaucaaagugcuucuccccucccccacgcgacacuuuucuuuggaguccgaauaaaauacgguaacagaauaugacggagggcacacuguuuccuuaacugcuucucaaaggaccgagagaucuucuuaggaccuuuaauaaggcuuuggucgguucuuuuguuggucucucaaaaucaacuccuucuaauugaaguuggagcugaaagcgagcuaauguucaaagaaaguggccgccagacuaacgaaauuacauuuuuuuuuuugaacgaugagggaacaucuaaucaaaggggcagggaaggaggggugugagaggggacuacggaggagaaaaggagguuuuacaagauccuucucugguucacaaaagucagcgacacgggcgcuucucuccagaacaaagacaccgcggcccauucacaaaagcgagagaaagagaaagcagaauaaaagaacgcggggaaaggggggaaaugagagugagagagauaaaccugcaggcagaaaagaaacagcgcagagcacagcgcuggccggagugagcacacaccuuaggcucucaggucccuaccagaaguagaccccaaggcagacagacgaucagucucagccaccgggacuuuccugaguuuaaagaaagaaacgaaauauacuccugcccccuuuuccagggaaaggcgcaggcuagggugcacuaguuuggcgggcacgaaaauguugacguccuggggagugaacugaaggcaucccugucugggucuccaggcugugagccuggguuggcccucugaggcccggggcgcccguccuggcuagaaaacucugcuacucuggccucuuuggggcggguucguuggcagucuuagaacuucgccugggucaggcuugaagaaguggggcggcuguacgcauaggaaugugccggcgaggucccuaaggcccacugcgagggagucggucgcuguggcuucuugaugcugucucccuucauuuucagggaaaugggaggaaucgaguggcaaggacccuaccgccaccaccccccgccccgccccgcugcgccacgagaguauuuaucuaaucccaaauuggaggcgaauuuucuuaaugcucauccuguaaaaccuugggauuaaggagaaagaagcagcagaggggguggggggaggggaggagagagagagagagagagagagagagagagagagagagagagagagagagagagagagagagagagagaaguuucuugaauucagcucagaagacugaggcagccuuugcuaggcaaagguacgggucggggguacugguccagaagcuucgacaguucucucaaaggauacuugugcauccagggcacaguagggccaguguuggagaaguggguggugguggcucaguuuaaggcccaucggccagcugggugcagcaucuaaguaaucucacacacacuguagaggcaugacucuagaaacacuugggacuggaaggggcuuggaccccuggccaggagaaaguucugcacccgcccuccacaaacuccuccauccuccccccacccccacacccggcggcccugauccuuugucucuccacacugagugggcuuucuagguuucuguccgcuggccggcuggguucuugcuugcccuaaggagcgggacuccaggcacugugcugagcugcaguaacgcgacuccuaggcugcggcccaaacccgggccacgcuccaccgccgcugaggggcguucgggcgcugcagagggaaaccccacgaggcugggaaccaagcaggaggggcccccaaucacuagcaaagcuaggggaguuuggccaccuggaaggucuggggcgggccugggagaaagggaaagcgccuuucugagaggccccuggaaaagggaagguuucuccaauccacccuaaaccgauccccagggugcuccggggccaggcggugaauuuccuaccugggauggguuggauucuuaauuuuccccagagaguagcaacuugcugaucugcucucauaaagaggacaaagacucgauuucauuuaguuccaauagcuuuucaucagaaagaaaaagaaaauucuuugcuauuagggaauuguaguaaguuuuuacuauuuugaaauacgaguaaguggaaauggcaguauacuuuucgaguaaagugugugugugugugugugugugugugugugugugugugugugugugugagagagagagagagagagagagagagagagagagagagagagagagagagagagagugaauaaacagagagauguggcuaaagaagaugccaguguuucccguaaguaaguuuccggacuuguugaaggagcuuucuuuguucggacucccaauauagaagagcccauuuuuaccgguggcauagaaauugcuacaauucucuuucuuccaucucaaaugcacauauccgcacaaccccucccccaaccguagcccacucccuuucu

SEQ ID NO: 11370 - RNA, 3303 nt, Mus musculus
agaaagggagugggcuacgguugggggagggguugugcggauaugugcauuugagauggaagaaagagaauuguagcaauuucuaugccaccgguaaaaaugggcucuucuauauugggaguccgaacaaagaaagcuccuucaacaaguccggaaacuuacuuacgggaaacacuggcaucuucuuuagccacaucucucuguuuauucacucucucucucucucucucucucucucucucucucucucucucucucucucucucucacacacacacacacacacacacacacacacacacacacacacacacacuuuacucgaaaaguauacugccauuuccacuuacucguauuucaaaauaguaaaaacuuacuacaauucccuaauagcaaagaauuuucuuuuucuuucugaugaaaagcuauuggaacuaaaugaaaucgagucuuuguccucuuuaugagagcagaucagcaaguugcuacucucuggggaaaauuaagaauccaacccaucccagguaggaaauucaccgccuggccccggagcacccuggggaucgguuuaggguggauuggagaaaccuucccuuuuccaggggccucucagaaaggcgcuuucccuuucucccaggcccgccccagaccuuccagguggccaaacuccccuagcuuugcuagugauugggggccccuccugcuugguucccagccucgugggguuucccucugcagcgcccgaacgccccucagcggcgguggagcguggcccggguuugggccgcagccuaggagucgcguuacugcagcucagcacagugccuggagucccgcuccuuagggcaagcaagaacccagccggccagcggacagaaaccuagaaagcccacucaguguggagagacaaaggaucagggccgccggguguggggguggggggaggauggaggaguuuguggagggcgggugcagaacuuucuccuggccagggguccaagccccuuccagucccaaguguuucuagagucaugccucuacagugugugugagauuacuuagaugcugcacccagcuggccgaugggccuuaaacugagccaccaccacccacuucuccaacacuggcccuacugugcccuggaugcacaaguauccuuugagagaacugucgaagcuucuggaccaguacccccgacccguaccuuugccuagcaaaggcugccucagucuucugagcugaauucaagaaacuucucucucucucucucucucucucucucucucucucucucucucucucucucucucucucucucucucuccuccccuccccccacccccucugcugcuucuuucuccuuaaucccaagguuuuacaggaugagcauuaagaaaauucgccuccaauuugggauuagauaaauacucucguggcgcagcggggcggggcggggggugguggcgguaggguccuugccacucgauuccucccauuucccugaaaaugaagggagacagcaucaagaagccacagcgaccgacucccucgcagugggccuuagggaccucgccggcacauuccuaugcguacagccgccccacuucuucaagccugacccaggcgaaguucuaagacugccaacgaacccgccccaaagaggccagaguagcagaguuuucuagccaggacgggcgccccgggccucagagggccaacccaggcucacagccuggagacccagacagggaugccuucaguucacuccccaggacgucaacauuuucgugcccgccaaacuagugcacccuagccugcgccuuucccuggaaaagggggcaggaguauauuucguuucuuucuuuaaacucaggaaagucccgguggcugagacugaucgucugucugccuuggggucuacuucugguagggaccugagagccuaaggugugugcucacuccggccagcgcugugcucugcgcuguuucuuuucugccugcagguuuaucucucucacucucauuuccccccuuuccccgcguucuuuuauucugcuuucucuuucucucgcuuuugugaaugggccgcggugucuuuguucuggagagaagcgcccgugucgcugacuuuugugaaccagagaaggaucuuguaaaaccuccuuuucuccuccguaguccccucucacaccccuccuucccugccccuuugauuagauguucccucaucguucaaaaaaaaaaauguaauuucguuagucuggcggccacuuucuuugaacauuagcucgcuuucagcuccaacuucaauuagaaggaguugauuuugagagaccaacaaaagaaccgaccaaagccuuauuaaagguccuaagaagaucucucgguccuuugagaagcaguuaaggaaacagugugcccuccgucauauucuguuaccguauuuuauucggacuccaaagaaaagugucgcgugggggaggggagaagcacuuugaugagcggcagucgcggcccuuuucacucagcgggcuccccccuuccuucuggucgccccgcacccggucagcgaccacagcggaccgcgcggccugggcaucgcggugcuccgcucuaccuugcucucggcggcugccgaacucacccacgcacauacugugguucaaacuuuucgcccgccuguuggggugagaacggcagaagaugaggaaaaagaacuaggaaagaguguaaguguggucccuaguauucaguaggagaugccauguaaaaauauugccuuguucgggguugggccgaaaauacucuucccucucgcuuugaaaaguacacacaagaagacgaucucagcaaguuuauucggcuggaaacuggggucugccaguaagaacaauccggggaaauuguuucgaggaggcuccuccaguaagguguagaaaaugaagugagagggaucgggguguguagccacauuuuccaccagacuguucguuguagguggagaucuggaaagacugacagauugugaaaaagaaaguuuucuaucaaauccaugagagagagagagagagagagagagagagagagagagagagagagagagagagagagaauguaaggagauuugaguuccaacgguuccgaagaagcuuuuaggacuugcgaacaccuuuggugagacugccugggagccccuggaaacgcugugcagcugggaauuggcggcgccuccccugccggugcucuuucugggcgcaagagucccgggucgccgcagggcgcccugcgcgccgagagcugcac

SEQ ID NO: 11371 - RNA, 3436 nt, Mus musculus
gggcaguguauaacugacuugguccugcggccaauggggucacuugugcccacggguggacuggcgggcugugcaccaccagcugggcgacacuugacggggugucuaccaggcacuaucuugaagcccucucuagaacauagagcuucuucgucguuuacggguuggauggaagcaaagauaguauuaaaaagaaaaaaaggaaaagaaaaaagcagaguuggagagaggacccuaaaacagcccuggccaucaauccgaaauccgagugggugggcuagaaugagagagggaggagagugugggaggcccggggugugugugguggggggcaggugggaggaacccaaacgagcaaaggaggcgaaacaaaacacuggcgagaugggccugaaaauggagacgccgaggcgugggagagauggcgagagggauacaggucggugggaagaaaggacaacaaaucuguaaaagaagggcgaugcaugguccagggggcgcggguaggagcuagcacaggagagggcgugaugcuggacugccgcgcagggcggggcaggugcagggcaggugcguggugggccgggccgggccucucucaccgccacuugguccuccgauuuuggaaccaggucuugaccugcgcguccgucauuuugagggacuuugcgagcgccgcccucucggccgaggccagguacuuuuggcgauggaagcgcuuuuccagcucacagaucugcacccgggaaaaggacgugcgcggcuucuuacgcuuggguggcguccgguucugguagggguggccaaugcgccgggucacggugaagggcgugagcgcggccgccgcugcagagacacaugaggccccuugaagcccagcccuaccaccguucgggccacacguggagccccgugggacacagugcuccgcuauuucgcucgucccgcgaguccccuccgcagcuucaagccaggcagggacgccccccccccuuucccugggacguugguuucuuuccccccucccccgacccauaacucuccgauuuaccuucaaccuccccccacccauagccgccccgagcucugggugccgaggccuccgccacgccugggccucuggaaucgauccugggaguggggugcacagggcgcggcgccccuggccccgggagagccgaggccuggcuccuggugguucgcucugcucaccugugaagcgguccuuuacaaagcggcgacugcucuccauccaggggaaauugaggccgccuaggcuggagaccgugggcaccgagggcauagcgggcagcgcgcuaggcagaggcggcggcacggccccagggagcggccugugcgcuggcacccggaucacgccggcgggggccaagcuuagguugacacuguaagaucccgcguccucgaagggcgcgccgaggcccgcaaaggaggcgggcagagacggguacgcggcgcccggacggcccccggggggcccucccagguagcuggcgccgucggggccccgcggggcgggcgcgcuguccugguccgggcuguugaggauuuggucgaugccgaagcugaugggcucgugcggguguggggucugcgcgcuggcgggcgccuccauccugggcgggcggaagggcugggcugggcugggcggggaggcugcuggguccccguuacggcgcggccauggagcgcccggcgccuccagucgcacugaaacuuugccaagagugcgcgggcccgacaggcucugugucaucuuucuugaaccgaaccuggaguuuccgcugcuaauuccucucccgccgcagccauuggcugcgaucaacaagccucucuucucucauuggcucccggcuuucaauaaaggccuaauucauggaaauaggagcuuagggacuguuccaaggugacaucauuuuaacaaacgaacaauaggucaaauuuauuagccgggauaaugggcggcggauauuagcgcccgaaccgcagcuucucaaacccgaaaucuaacgaagcugcaauuagcagacgcuccccgcuccgggcucggccguuucccgccgccgcacccgcccguaggcgcugcuggggaaauggccuuuugccgcggggguuuucguugucuucuaaauauuuucaucugcguaaaccccaaacaaaaugaaucuucagccacagcagagaugcaacccaagaacgguccuacgaaaucugcggaagccuaucgggccguucgcccuccuucggagcaacgaaagcguagcauuguggggugcaagcucggcgcuguccacccguggaacaaggggagcaccggagcguucuccacgccaccuaggacaccgacccgcguggggagaauuuguccucgcccgggcuuccaacgaggcgucgcgggcacuuuggagaugcuuccuggucccagccaggaggacugagcggugacuagcaggugcccacgcguacgggcccgguuggacuagggacccgaggucaacugguggggaacugggauucagccccuugaaauucguugcgggauaguuagggccauggucgcugguuugggaccccuccgaggugcagcagguuuggggaccucagucguuaguggcacauaagggggcgguucccaucuagagcagauggagaaauuuccuuuggaaauuugagcagcgagcuccuaccggcugcaguucaguccagacgcugaccacccuaggaucugcugucgccuucgggacuguccacacuagcccgguaacaccguggccagcaccacauggggaguggucaccuuucucucggucugggugagacccagagucauuucuuagcggccgauuguaaagucguuggcuguaaacucugagcgcuacacucgcggcaaggccucuuccucugguuuccugacuaugaaagccccaagccaugucugugauguuggucagaaguuguguguagguuugggcgggccacuuuauagcucaguaaguuugaaauucauuugagacuuuagguuuuuauuuguaaaauggggcaaagcgugcacuguguauucgagcacugugagagagauauugagagugcuaagagcauagagcccuacacuuaguagguacagcacaucgcucggcucccuucccacccccacacccagcauauguuuaugguaggugguaaguguucauuuuguugguaguuuuuuauuugcagagguaucuuggacagguggauuucuuccccaguggggucagagcacaggcaggaggcagcaggggcuugauucccuagucagucuccuugcucucaacaaucaggaugacucaggcucuagugggcaguuaggucaccugccaguugugugacauugggcagcuugcuggcucuggcagaaccacugugcuggguugggaca

SEQ ID NO: 11372 - RNA, 3436 nt, Mus musculus
ugucccaacccagcacagugguucugccagagccagcaagcugcccaaugucacacaacuggcaggugaccuaacugcccacuagagccugagucauccugauuguugagagcaaggagacugacuagggaaucaagccccugcugccuccugccugugcucugaccccacuggggaagaaauccaccuguccaagauaccucugcaaauaaaaaacuaccaacaaaaugaacacuuaccaccuaccauaaacauaugcugggugugggggugggaagggagccgagcgaugugcuguaccuacuaaguguagggcucuaugcucuuagcacucucaauaucucucucacagugcucgaauacacagugcacgcuuugccccauuuuacaaauaaaaaccuaaagucucaaaugaauuucaaacuuacugagcuauaaaguggcccgcccaaaccuacacacaacuucugaccaacaucacagacauggcuuggggcuuucauagucaggaaaccagaggaagaggccuugccgcgaguguagcgcucagaguuuacagccaacgacuuuacaaucggccgcuaagaaaugacucugggucucacccagaccgagagaaaggugaccacuccccauguggugcuggccacgguguuaccgggcuaguguggacagucccgaaggcgacagcagauccuaggguggucagcgucuggacugaacugcagccgguaggagcucgcugcucaaauuuccaaaggaaauuucuccaucugcucuagaugggaaccgcccccuuaugugccacuaacgacugagguccccaaaccugcugcaccucggaggggucccaaaccagcgaccauggcccuaacuaucccgcaacgaauuucaaggggcugaaucccaguuccccaccaguugaccucgggucccuaguccaaccgggcccguacgcgugggcaccugcuagucaccgcucaguccuccuggcugggaccaggaagcaucuccaaagugcccgcgacgccucguuggaagcccgggcgaggacaaauucuccccacgcgggucgguguccuagguggcguggagaacgcuccggugcuccccuuguuccacggguggacagcgccgagcuugcaccccacaaugcuacgcuuucguugcuccgaaggagggcgaacggcccgauaggcuuccgcagauuucguaggaccguucuuggguugcaucucugcuguggcugaagauucauuuuguuugggguuuacgcagaugaaaauauuuagaagacaacgaaaacccccgcggcaaaaggccauuuccccagcagcgccuacgggcgggugcggcggcgggaaacggccgagcccggagcggggagcgucugcuaauugcagcuucguuagauuucggguuugagaagcugcgguucgggcgcuaauauccgccgcccauuaucccggcuaauaaauuugaccuauuguucguuuguuaaaaugaugucaccuuggaacagucccuaagcuccuauuuccaugaauuaggccuuuauugaaagccgggagccaaugagagaagagaggcuuguugaucgcagccaauggcugcggcgggagaggaauuagcagcggaaacuccagguucgguucaagaaagaugacacagagccugucgggcccgcgcacucuuggcaaaguuucagugcgacuggaggcgccgggcgcuccauggccgcgccguaacggggacccagcagccuccccgcccagcccagcccagcccuuccgcccgcccaggauggaggcgcccgccagcgcgcagaccccacacccgcacgagcccaucagcuucggcaucgaccaaauccucaacagcccggaccaggacagcgcgcccgccccgcggggccccgacggcgccagcuaccugggagggccccccgggggccguccgggcgccgcguacccgucucugcccgccuccuuugcgggccucggcgcgcccuucgaggacgcgggaucuuacagugucaaccuaagcuuggcccccgccggcgugauccgggugccagcgcacaggccgcucccuggggccgugccgccgccucugccuagcgcgcugcccgcuaugcccucggugcccacggucuccagccuaggcggccucaauuuccccuggauggagagcagucgccgcuuuguaaaggaccgcuucacaggugagcagagcgaaccaccaggagccaggccucggcucucccggggccaggggcgccgcgcccugugcaccccacucccaggaucgauuccagaggcccaggcguggcggaggccucggcacccagagcucggggcggcuauggguggggggagguugaagguaaaucggagaguuaugggucgggggaggggggaaagaaaccaacgucccagggaaaggggggggggcgucccugccuggcuugaagcugcggaggggacucgcgggacgagcgaaauagcggagcacugugucccacggggcuccacguguggcccgaacggugguagggcugggcuucaaggggccucaugugucucugcagcggcggccgcgcucacgcccuucaccgugacccggcgcauuggccaccccuaccagaaccggacgccacccaagcguaagaagccgcgcacguccuuuucccgggugcagaucugugagcuggaaaagcgcuuccaucgccaaaaguaccuggccucggccgagagggcggcgcucgcaaagucccucaaaaugacggacgcgcaggucaagaccugguuccaaaaucggaggaccaaguggcggugagagaggcccggcccggcccaccacgcaccugcccugcaccugccccgcccugcgcggcaguccagcaucacgcccucuccugugcuagcuccuacccgcgcccccuggaccaugcaucgcccuucuuuuacagauuuguuguccuuucuucccaccgaccuguaucccucucgccaucucucccacgccucggcgucuccauuuucaggcccaucucgccaguguuuuguuucgccuccuuugcucguuuggguuccucccaccugccccccaccacacacaccccgggccucccacacucuccucccucucucauucuagcccacccacucggauuucggauugauggccagggcuguuuuaggguccucucuccaacucugcuuuuuucuuuuccuuuuuuucuuuuuaauacuaucuuugcuuccauccaacccguaaacgacgaagaagcucuauguucuagagagggcuucaagauagugccugguagacaccccgucaagugucgcccagcugguggugcacagcccgccaguccacccgugggcacaagugaccccauuggccgcaggaccaagucaguuauacacugccc

SEQ ID NO: 11373 - RNA, 1398 nt, Mus musculus
gagccgagcccaagcuuugccggcacuuuccgcagccccaucugcgaguguuuucguuuuguuuuaacccagaagaggcgucucugcagcucgguguuggauagcugcgcuuuucugaccgcuuguuuucuuuucugugugguuauauuuuucccuuuuccucuccuucucuucgcuuccuuuccccuuuauuucgcuucaguucuuuccuuuuucuucuucccucuuuucuuuuuuccuacuuaauuuucuucucucccccuuucuuccuuucuauuuucuaccuucuuuaauucuuuccuuucccccuaucuuuccuuucccuuuucuaccuucuuuaauuuuuucuuguccuucuccacucuuuuccccccuucuuucucaguuucacucuucguuuuucucuucucuuuccucaccuggcucucucccccguuucucucucucucucucucucucucucuccauuuuucuucuuggagucuccucuuauuucuccuaucugguucuuuacucucuccucucuccacuucuuagccuucaguuuuucucagucugccuguagaauagugauuuccaacuuuaauuuucacaucuccuaaaagccacccucauccacugucaccuuggccuuccccagucccucucccacucuccagauccuacacugagugauuuggaggccaugcucuuggagaccaacuugaggaacuucccuggacacacccagugcccuguccaggggcuccuagucccaagugagaaaugguaccuugcccuuuucauugcuggccaccaccugggcuucggggaaaacuuugugggcccaggcuccauuagacauaaagggugcagaaggggaauggggaguaguuccaucuuuccauuuuuggggggaagggcuagggacaacuguccuauacuguuuccauccccaugagcacaggguugggagugguugguagugagagugaauuggguaacuaggcuagaagcgaaaguguguguguguguguguguguguguguguguguguguguguguguguguuguccgauaguguccggcaguuugggcugucauuguggugcccccgggcauccuauucuccagucccccgcggaucuucucagccaagaagccuuggcccuuuggguuucuggaaugugugaggaggauuucucagaauggcaaaacuuuggcaagacaggucuuuuauuuaaaaaaaaaauuaaccaaacaacaacagucacuuacaacaguaaaacaagacgccccaguucucuuucccauggcgaucgaucauuucuaauagccgcgagucccaaucagggacccuucuccgcuugcuugccguuuguguagaaaauuagcgugcugaggucggguaccaucagc

SEQ ID NO: 11374 - RNA, 1398 nt, Mus musculus
gcugaugguacccgaccucagcacgcuaauuuucuacacaaacggcaagcaagcggagaagggucccugauugggacucgcggcuauuagaaaugaucgaucgccaugggaaagagaacuggggcgucuuguuuuacuguuguaagugacuguuguuguuugguuaauuuuuuuuuuaaauaaaagaccugucuugccaaaguuuugccauucugagaaauccuccucacacauuccagaaacccaaagggccaaggcuucuuggcugagaagauccgcgggggacuggagaauaggaugcccgggggcaccacaaugacagcccaaacugccggacacuaucggacaacacacacacacacacacacacacacacacacacacacacacacacacacuuucgcuucuagccuaguuacccaauucacucucacuaccaaccacucccaacccugugcucauggggauggaaacaguauaggacaguugucccuagcccuuccccccaaaaauggaaagauggaacuacuccccauuccccuucugcacccuuuaugucuaauggagccugggcccacaaaguuuuccccgaagcccaggugguggccagcaaugaaaagggcaagguaccauuucucacuugggacuaggagccccuggacagggcacuggguguguccagggaaguuccucaaguuggucuccaagagcauggccuccaaaucacucaguguaggaucuggagagugggagagggacuggggaaggccaaggugacaguggaugaggguggcuuuuaggagaugugaaaauuaaaguuggaaaucacuauucuacaggcagacugagaaaaacugaaggcuaagaaguggagagaggagagaguaaagaaccagauaggagaaauaagaggagacuccaagaagaaaaauggagagagagagagagagagagagagagaaacgggggagagagccaggugaggaaagagaagagaaaaacgaagagugaaacugagaaagaaggggggaaaagaguggagaaggacaagaaaaaauuaaagaagguagaaaagggaaaggaaagauagggggaaaggaaagaauuaaagaagguagaaaauagaaaggaagaaagggggagagaagaaaauuaaguaggaaaaaagaaaagagggaagaagaaaaaggaaagaacugaagcgaaauaaaggggaaaggaagcgaagagaaggagaggaaaagggaaaaauauaaccacacagaaaagaaaacaagcggucagaaaagcgcagcuauccaacaccgagcugcagagacgccucuucuggguuaaaacaaaacgaaaacacucgcagauggggcugcggaaagugccggcaaagcuugggcucggcuc

SEQ ID NO: 11375 - RNA, 761 nt, Mus musculus
ccggcgacccagaguguggcgaggaacagcggaaaguacucgcugcaguuuacccugcgagggguaggcugggugagcgcgugguucaccuuggcugacacccgaacccgcccggacccgccgcgcucacugggcucggaagacgcgcucgaacucgggagggccagaggugagcggcggcgacacguggaaagcccuucgugcagagaucaccuguagggagaaguaggcugcggccgugggggugugggagucagguguggugcuccgcagaucuggagcgggauccgucccuuaguuccccucuccuugccucucacugagcgacucucuucuaaugcccuucucccaccugccccaucagugguguucaauggagaggcccuguaggccugaggguugauugacuagggugaugcgcggcugaaacaccugccggugggaggaaccuuagaagacuuuacuccugaacgauuugacuugcaaagcacaggcaaaugccuaccucccguucugcaggucuggacccccugcguaggcaauggaccagggcaaaauuggcuguauucuuuaaggaacaaggaagcacacguucuguggcuaagggacccugguuuccccucuacagaaucagccagaagggacucugccacaagccagagucagucuagcuugggucucaguaccaccacacaauagcauaaauucuugucucaguuucuguuuagacaucauggacccagccuuaaaucuggcagaua

SEQ ID NO: 11376 - RNA, 761 nt, Mus musculus
uaucugccagauuuaaggcuggguccaugaugucuaaacagaaacugagacaagaauuuaugcuauuguguggugguacugagacccaagcuagacugacucuggcuuguggcagagucccuucuggcugauucuguagaggggaaaccagggucccuuagccacagaacgugugcuuccuuguuccuuaaagaauacagccaauuuugcccugguccauugccuacgcaggggguccagaccugcagaacgggagguaggcauuugccugugcuuugcaagucaaaucguucaggaguaaagucuucuaagguuccucccaccggcagguguuucagccgcgcaucacccuagucaaucaacccucaggccuacagggccucuccauugaacaccacugauggggcaggugggagaagggcauuagaagagagucgcucagugagaggcaaggagaggggaacuaagggacggaucccgcuccagaucugcggagcaccacaccugacucccacacccccacggccgcagccuacuucucccuacaggugaucucugcacgaagggcuuuccacgugucgccgccgcucaccucuggcccucccgaguucgagcgcgucuuccgagcccagugagcgcggcggguccgggcggguucgggugucagccaaggugaaccacgcgcucacccagccuaccccucgcaggguaaacugcagcgaguacuuuccgcuguuccucgccacacucugggucgccgg

SEQ ID NO: 11377 - RNA, 1037 nt, Mus musculus
cgcugcccuccuaccgagccgcaacuaacaguuccagaguccacaccacucagagagaauauaagaggcaggguguaaagucaaucccccaauggaccaaucagagugcagcaucccauaaugccaccuggugggcagccaauaggaauguagcugggucuauaaaagcagugcuacucgccccccacauugugcaccugaggagcaagggaggcggacgauucaggaagauggcacgcaccaagcagacggcacggaagucgacgggaggcaaggcuccgcgcaagcagcuagccacgaagguggcccgcaagagcgccccggccaccgggggcgugaagaagccgcaccgcuaccacccuggcacgguggcgcugcgcgagauccggcgcuaccagaaguccaccgagcugcugauucgcaaguugccauuccagcgcuuggugcgugagaucgcccaggacuucaagaccgaccugcgcuuccagagcuccgcggugauggcgcugcaggaggccugcgagucguaccucguggggcuguucgaagacacgaaccugugcgcuauccacgccaagcgggugaccaucaugcccaaagacauccaguuggcucggcgcauccgcggagaacgggcuuaggcucccacaggcaccgcucaugaacccaacggcucuuuucagagccacccacagagucagaaaaagugucuguaacguagacuuagguguccugucuccucaggaggugaagacaagguggccggcaaucgaagugucuccccagaucagucuagagggcuuagcagcuaauccuugcccauugagcuauuugacuugcagcuccguccuauucuaaccugccuucccuugauagguauaguggccugagcccuuguacuacaagaugaugguuguguugcugacugguuuuaccaagugaagguagcuccuaccggcaguaaacgugcuauguuugcauaguugauaguauccaaacgcaucugcucaguaaccaaguuacuuauguuuuguguu

SEQ ID NO: 11378 - RNA, 1037 nt, Mus musculus
aacacaaaacauaaguaacuugguuacugagcagaugcguuuggauacuaucaacuaugcaaacauagcacguuuacugccgguaggagcuaccuucacuugguaaaaccagucagcaacacaaccaucaucuuguaguacaagggcucaggccacuauaccuaucaagggaaggcagguuagaauaggacggagcugcaagucaaauagcucaaugggcaaggauuagcugcuaagcccucuagacugaucuggggagacacuucgauugccggccaccuugucuucaccuccugaggagacaggacaccuaagucuacguuacagacacuuuuucugacucuguggguggcucugaaaagagccguuggguucaugagcggugccugugggagccuaagcccguucuccgcggaugcgccgagccaacuggaugucuuugggcaugauggucacccgcuuggcguggauagcgcacagguucgugucuucgaacagccccacgagguacgacucgcaggccuccugcagcgccaucaccgcggagcucuggaagcgcaggucggucuugaaguccugggcgaucucacgcaccaagcgcuggaauggcaacuugcgaaucagcagcucgguggacuucugguagcgccggaucucgcgcagcgccaccgugccagggugguagcggugcggcuucuucacgcccccgguggccggggcgcucuugcgggccaccuucguggcuagcugcuugcgcggagccuugccucccgucgacuuccgugccgucugcuuggugcgugccaucuuccugaaucguccgccucccuugcuccucaggugcacaauguggggggcgaguagcacugcuuuuauagacccagcuacauuccuauuggcugcccaccagguggcauuaugggaugcugcacucugauugguccauugggggauugacuuuacacccugccucuuauauucucucugagugguguggacucuggaacuguuaguugcggcucgguaggagggcagcg

SEQ ID NO: 11379 - RNA, 1093 nt, Mus musculus
ugaugacacagcgcuccuuguccuuagccuggcugccgacacugguuuuuucacgaauguacaugaggucgcugugcacgcugggucugcgagcaaagggcgccaagaugccaaaggcaucgccguggucgcccccgccuccgcugcccgcacgcagaagcuucuuguuccucagagccuucuugugcaguacgucgcaguacugcacagauaccuugcggugcaagucggggcucaucucgcuaggcagcuuggccauggcaaagagcgcacggaacaucugguccaagcugcuguucuucuuggcugagaucucgaaguaggcacaacgcugagggucgucacccaccagcugcucaaucucccgcugcucuacuucccgguagaagucccgguccccuuuguuaccgcaaaugaccagcggcacguccacauucucuuugguuuuguucuugagacaggacuuggugucuaggaucugcuguuugagccuuugcaccucuucgaaugagucgcgguugucuaagcugaacaccagaaugaaaacgucuccuauaagggaacgagugggaaaggugaggacagcugccaggcacagagcugcagacaccccaggugaaggggcaagccccaagcacaacacaccagccccauccacuccccucaagacuccggucccccuauccccgucgacuccccacucaccugugaggauagagaggcgccgcauggcgggaaacggaugauugccggauguguccaguauguccaacugguagacuucgccgcggaucgaguaaaacuuucgguggaaguccucgaugguagggguguaagcauccucgaaacggcccgugaggaagcgcgacacaauggccgucuugcccacuuuggaugagccgaggaugaccauccuguagcaguucuuggccgggauacucaguucagagucgcuugggcacaucuucuugaucaucgcggccaguuucauuggguagaggggccccaggggcggaugcguggccgagagaagguagagagagggcugcagagaacuccggagugacggaagagcuuggcuucgggacugcgc

SEQ ID NO: 11380 - RNA, 1093 nt, Mus musculus
gcgcagucccgaagccaagcucuuccgucacuccggaguucucugcagcccucucucuaccuucucucggccacgcauccgccccuggggccccucuacccaaugaaacuggccgcgaugaucaagaagaugugcccaagcgacucugaacugaguaucccggccaagaacugcuacaggauggucauccucggcucauccaaagugggcaagacggccauugugucgcgcuuccucacgggccguuucgaggaugcuuacaccccuaccaucgaggacuuccaccgaaaguuuuacucgauccgcggcgaagucuaccaguuggacauacuggacacauccggcaaucauccguuucccgccaugcggcgccucucuauccucacaggugaguggggagucgacggggauagggggaccggagucuugaggggaguggauggggcugguguguugugcuuggggcuugccccuucaccuggggugucugcagcucugugccuggcagcuguccucaccuuucccacucguucccuuauaggagacguuuucauucugguguucagcuuagacaaccgcgacucauucgaagaggugcaaaggcucaaacagcagauccuagacaccaaguccugucucaagaacaaaaccaaagagaauguggacgugccgcuggucauuugcgguaacaaaggggaccgggacuucuaccgggaaguagagcagcgggagauugagcagcuggugggugacgacccucagcguugugccuacuucgagaucucagccaagaagaacagcagcuuggaccagauguuccgugcgcucuuugccauggccaagcugccuagcgagaugagccccgacuugcaccgcaagguaucugugcaguacugcgacguacugcacaagaaggcucugaggaacaagaagcuucugcgugcgggcagcggaggcgggggcgaccacggcgaugccuuuggcaucuuggcgcccuuugcucgcagacccagcgugcacagcgaccucauguacauucgugaaaaaaccagugucggcagccaggcuaaggacaaggagcgcugugucauca

SEQ ID NO: 11381 - RNA, 1217 nt, Mus musculus
aaaaauagaggaaaggcuauggacgcugucuguaagcgccugggaacccacaucugacucaaagagaagaccuuugagucguugguuccggaggugcgaggccaggugagagauauuaggagaacgagugaaggguuugagugagaagaggagguguggucgcacugugugucugccuuucaccuuaggucucuaucgcgcggcucacuagccugggggcaaagaguggcccuaaaguucuucagugauacacugagagggagacgacacaagauagagauauaaagagaaaagaagagugccauagaggggagaagagaggagaaagcugaacacagaaagggcagggagaagugggcgagccacggaaagcgacccaagggacugggaaguagcagggagugagagggaaacgaauggaccagacccaagcagccugggauuaggggaaaggggcgcaugggggguuuucccagcggcaggaucggacgcuugcgcggcggcgcugagucucgguccggucggcccgcucuuccuuucccgcuggucacagaugcugaagccguugguggagaagcggcgccgggaccgcaucaaccgcagccuagaagagcugaggcugcugcuccuggagaggaccagggaccaggucaguuccaccgcuggccccaggccccuaagcauucuguaccugugucccagagcuuucuacugggguggggacauaagcuggaguggugacucuggacccaagccugcuccuugaaaucccaucccagacccccucucgcucucagaacuugcucuucuccaccuugcuggucuguaaguuuccagucuggcucgguaaacugagcuuccagccugcgucaguuucccacuugggguuuucuaaaauuccuuaucuaccucccacgccugaucaaugggcuucaguucugcggugguuuucaccauccggguugcuguuucguacaccucucauauugggaacugguuccacucccucagguuggacaggcucaucucggggugggacgggaacuuuucuuggccaucuccacauucggucgcgagucaugggggcacccgcagcucccguauccgccccucccuucuuccccuagccacuuucccccucucuccccaccccuuucugucucugcgccccuccccccgucuguagaaccuccggaacccgaagcuggagaaagcgg

SEQ ID NO: 11382 - RNA, 1217 nt, Mus musculus
ccgcuuucuccagcuucggguuccggagguucuacagacggggggaggggcgcagagacagaaagggguggggagagagggggaaaguggcuaggggaagaagggaggggcggauacgggagcugcgggugcccccaugacucgcgaccgaauguggagauggccaagaaaaguucccgucccaccccgagaugagccuguccaaccugagggaguggaaccaguucccaauaugagagguguacgaaacagcaacccggauggugaaaaccaccgcagaacugaagcccauugaucaggcgugggagguagauaaggaauuuuagaaaaccccaagugggaaacugacgcaggcuggaagcucaguuuaccgagccagacuggaaacuuacagaccagcaagguggagaagagcaaguucugagagcgagagggggucugggaugggauuucaaggagcaggcuuggguccagagucaccacuccagcuuauguccccaccccaguagaaagcucugggacacagguacagaaugcuuaggggccuggggccagcgguggaacugaccuggucccugguccucuccaggagcagcagccucagcucuucuaggcugcgguugaugcggucccggcgccgcuucuccaccaacggcuucagcaucugugaccagcgggaaaggaagagcgggccgaccggaccgagacucagcgccgccgcgcaagcguccgauccugccgcugggaaaaccccccaugcgccccuuuccccuaaucccaggcugcuugggucugguccauucguuucccucucacucccugcuacuucccagucccuugggucgcuuuccguggcucgcccacuucucccugcccuuucuguguucagcuuucuccucucuucuccccucuauggcacucuucuuuucucuuuauaucucuaucuugugucgucucccucucaguguaucacugaagaacuuuagggccacucuuugcccccaggcuagugagccgcgcgauagagaccuaaggugaaaggcagacacacagugcgaccacaccuccucuucucacucaaacccuucacucguucuccuaauaucucucaccuggccucgcaccuccggaaccaacgacucaaaggucuucucuuugagucagauguggguucccaggcgcuuacagacagcguccauagccuuuccucuauuuuu

SEQ ID NO: 11383 - RNA, 561 nt, Mus musculus
cugggucaaguugcauccuccuguugccacuaacccuucuucuuuccuccagugcucuacuguccagaggucaaggacauugcccacaugacccguuguacgcuguaaccaaggaaccccagagcuauggcagaaagcaggugggagcagcauccucaggcgugcucugacacaaaagguugaugucaagacuaccuggaaaucaaggcugaugcuggaauugguacaugcgugauggagauggagcucaacagaaaggacccuagaugguguggauucugagcggcgaaggcuccuagacugugccagcauuauauuuucaggauggaguggccaagggauaauagaaacaaagccuaccauaauguaggaagaaaaaaaaaauaacaaagcuuuggcguuuguucagagucugugguguaagcaaaggauccaauuuuagcaguggucugugguugacaauguguacuguggaaaaaaggacaggacaggggauaagcuaauuuauaugucaugucaaucucacuuaucugguuguguuugcuggcaugccaucuuccc

SEQ ID NO: 11384 - RNA, 561 nt, Mus musculus
gggaagauggcaugccagcaaacacaaccagauaagugagauugacaugacauauaaauuagcuuauccccuguccuguccuuuuuuccacaguacacauugucaaccacagaccacugcuaaaauuggauccuuugcuuacaccacagacucugaacaaacgccaaagcuuuguuauuuuuuuuuucuuccuacauuaugguaggcuuuguuucuauuaucccuuggccacuccauccugaaaauauaaugcuggcacagucuaggagccuucgccgcucagaauccacaccaucuaggguccuuucuguugagcuccaucuccaucacgcauguaccaauuccagcaucagccuugauuuccagguagucuugacaucaaccuuuugugucagagcacgccugaggaugcugcucccaccugcuuucugccauagcucugggguuccuugguuacagcguacaacgggucaugugggcaauguccuugaccucuggacaguagagcacuggaggaaagaagaaggguuaguggcaacaggaggaugcaacuugacccag

SEQ ID NO: 11385 - RNA, 531 nt, Mus musculus
cucugaaaggucacuagaugauuuuugcaaagacauguguggcucagguucagggacauaaucaugugacggaucuacagaguuuucccggucggugggacucucuuugcuauggguuuggugagucauaucacuuucuucugggacaggagguccuaagcaauccugccaggccucccggaccaaaauuccacgcaucaguucuggaaggcggagccaugcagaacaggauuccagauccaguagcagcucgggcccagugccauccagagaaaacacaggcacaaggaguguaaagccggcaucauaaugagguccccgggaguagggaccuaagggggcgugcccuaaaucuagggaaccuucgcgaaucccaccacgaagcagcaagaguucugccugggguggaaaacgagggucuuggcggugaaccagaccuaaagaagagaaagggucgugaagguauccugguucaaagucggggcaggaaauggcgaggcugggguuugcaaauucccacacuuaccgagu

SEQ ID NO: 11386 - RNA, 531 nt, Mus musculus
acucgguaagugugggaauuugcaaaccccagccucgccauuuccugccccgacuuugaaccaggauaccuucacgacccuuucucuucuuuaggucugguucaccgccaagacccucguuuuccaccccaggcagaacucuugcugcuucguggugggauucgcgaagguucccuagauuuagggcacgcccccuuaggucccuacucccggggaccucauuaugaugccggcuuuacacuccuugugccuguguuuucucuggauggcacugggcccgagcugcuacuggaucuggaauccuguucugcauggcuccgccuuccagaacugaugcguggaauuuugguccgggaggccuggcaggauugcuuaggaccuccugucccagaagaaagugauaugacucaccaaacccauagcaaagagagucccaccgaccgggaaaacucuguagauccgucacaugauuaugucccugaaccugagccacacaugucuuugcaaaaaucaucuagugaccuuucagag

SEQ ID NO: 11387 - RNA, 838 nt, Mus musculus
ggucccaaccuuuccauaaccaccuuucauuuaggacucgggaacugucuagcucuccgcugacaaucagccuuucuauguccucugggggcgcccaggagauaggccuugccuuucuuaacaaaagcaucaacaacuguuagguccuugggacaacagcaccuaguccaggcacauaauuaccuccaccccuucucccgggugcaagccucugauucacuagggcucuuuaggcugucgcuuauuccuagcacuucuggcaagacucgucccugcguauacgagggauaauuccauuauuaggcuguauaggguacccacgugguauggcuucuccccgguguggaugcgaacguggcuuuugagggucuguagauggcggaagcggguuccgcaggugggacacggauagggcuucucuccgguguggaugagcacgugugcgcguaggugugccaccuaaagggcagagccuugagaucaccuuggggaggggcggaacccucuucgcuccucccauuugccuuccagccuucuccuuaccugaacaaaacgcgagccgcaggucucacacuuguacgguuucucuccggaauggaugcggcuguguguuuuuagguuagcaggucgguuaaaacgugcuccgcagauggagcagcgguagggcuuuuccccugcaaguuggaagacagucagaucgcccuacgggagcgguggucaggaagaccaagacccccuccuaccugugugcaccgugcggugacuagccaaguugcccuuauaacggaaggcagaucggcacagcuggcauuuauagggcuuguccucguccccugga

SEQ ID NO: 11388 - RNA, 838 nt, Mus musculus
uccaggggacgaggacaagcccuauaaaugccagcugugccgaucugccuuccguuauaagggcaacuuggcuagucaccgcacggugcacacagguaggagggggucuuggucuuccugaccaccgcucccguagggcgaucugacugucuuccaacuugcaggggaaaagcccuaccgcugcuccaucugcggagcacguuuuaaccgaccugcuaaccuaaaaacacacagccgcauccauuccggagagaaaccguacaagugugagaccugcggcucgcguuuuguucagguaaggagaaggcuggaaggcaaaugggaggagcgaagaggguuccgccccuccccaaggugaucucaaggcucugcccuuuagguggcacaccuacgcgcacacgugcucauccacaccggagagaagcccuauccgugucccaccugcggaacccgcuuccgccaucuacagacccucaaaagccacguucgcauccacaccggggagaagccauaccacguggguacccuauacagccuaauaauggaauuaucccucguauacgcagggacgagucuugccagaagugcuaggaauaagcgacagccuaaagagcccuagugaaucagaggcuugcacccgggagaagggguggagguaauuaugugccuggacuaggugcuguugucccaaggaccuaacaguuguugaugcuuuuguuaagaaaggcaaggccuaucuccugggcgcccccagaggacauagaaaggcugauugucagcggagagcuagacaguucccgaguccuaaaugaaaggugguuauggaaagguugggacc

SEQ ID NO: 11389 - RNA, 856 nt, Mus musculus
uuuccaucucuucuuagcacaguuccugggguucaggucuuauuacuaucaacuaaccccaagcccucuuuggagacucagaaaucugauacccucaggguuugguucuuaccccugucccgcaggggcugcggcuucucuucucgaggggggcggggucucucuccucuuucggucucugcuccuuuauucagccgggauggcgggggcggggguggagguggggugaacccgugagucuguauccuuccuuccucugaggcucuccagauggugagcccggggcggggucuccguuucaaacuguaucucagaaucucgggguggucguaucguggauggcuuugguucauuaaauaagcacccgaggaugaggauauuagaauuggggagguuaguggugcggagggugguaauaugggaggcuuaugucgucgaaggagcugggacagcgaguauuggaguguuggguuuuggaggcgugugccaacagccaguugagggagaaaggaaauauccuaaaacuccucuuucuaauguauuggacucaggaagaaaauagacaguccaagugguaucggguuuggggaggcauuaguggacuccaguggaucucagauagugggagaaggaggagugauugacaggcaagguccagaaaagggggagguggagcucugaccaggcgggguaaggagagggcggauaugauuucuaguucguuuccuuccauuguccugagaccggacggcuccugcagcugcuuccccucgaggagguggggaaaaccccggguggggaccgagagacgcucgggagaccuaggcguccggccuccuacucucgacucucuucu

SEQ ID NO: 11390 - RNA, 856 nt, Mus musculus
agaagagagucgagaguaggaggccggacgccuaggucucccgagcgucucucgguccccacccgggguuuuccccaccuccucgaggggaagcagcugcaggagccguccggucucaggacaauggaaggaaacgaacuagaaaucauauccgcccucuccuuaccccgccuggucagagcuccaccucccccuuuucuggaccuugccugucaaucacuccuccuucucccacuaucugagauccacuggaguccacuaaugccuccccaaacccgauaccacuuggacugucuauuuucuuccugaguccaauacauuagaaagaggaguuuuaggauauuuccuuucucccucaacuggcuguuggcacacgccuccaaaacccaacacuccaauacucgcugucccagcuccuucgacgacauaagccucccauauuaccacccuccgcaccacuaaccuccccaauucuaauauccucauccucgggugcuuauuuaaugaaccaaagccauccacgauacgaccaccccgagauucugagauacaguuugaaacggagaccccgccccgggcucaccaucuggagagccucagaggaaggaaggauacagacucacggguucaccccaccuccacccccgcccccgccaucccggcugaauaaaggagcagagaccgaaagaggagagagaccccgccccccucgagaagagaagccgcagccccugcgggacagggguaagaaccaaacccugaggguaucagauuucugagucuccaaagagggcuugggguuaguugauaguaauaagaccugaaccccaggaacugugcuaagaagagauggaaa

SEQ ID NO: 11391 - RNA, 536 nt, Mus musculus
ccacaggcuacuugacacauggcugaguccagauuccuguacagucagcucucaccacugaucaagaugcuaucuaguugcugacaugguuagcguguuuacgacuaggauggcugcuucuguucuaaacauggaaaccaucggcguacucugaacuauauacaacagagaccgacuauuagcacggcacuuacacuguguguuagguguugcaagcaauccagagaugaaguaaagaauagguuauaugcaauugcuacgaauuauaugagacuaaccucuccucccucuucuccaccccuagcccugccaccaccaccaccaggaaagaacuacugaauuccccaccuucucagccugugaaugucgaaggcccuaaaacagaacacacauuuguaucaagauuuuugacucuguuccugugaccugccugucaccuugcccucaagucugcaacugccuucuucaggcccucucuauuuucgguuuguuugcuuguuugcaucuauguggcccugggcccaucccuuccccca

SEQ ID NO: 11392 - RNA, 536 nt, Mus musculus
ugggggaagggaugggcccagggccacauagaugcaaacaagcaaacaaaccgaaaauagagagggccugaagaaggcaguugcagacuugagggcaaggugacaggcaggucacaggaacagagucaaaaaucuugauacaaauguguguucuguuuuagggccuucgacauucacaggcugagaagguggggaauucaguaguucuuuccuggugguggugguggcagggcuagggguggagaagagggaggagagguuagucucauauaauucguagcaauugcauauaaccuauucuuuacuucaucucuggauugcuugcaacaccuaacacacaguguaagugccgugcuaauagucggucucuguuguauauaguucagaguacgccgaugguuuccauguuuagaacagaagcagccauccuagucguaaacacgcuaaccaugucagcaacuagauagcaucuugaucaguggugagagcugacuguacaggaaucuggacucagccaugugucaaguagccugugg

SEQ ID NO: 11393 - RNA, 494 nt, Mus musculus
caguguguaggagccgcggccgcaugaaugagccgccgcacgaguacuacgcgcgccuauaaaagcggcggcgccggccgggcugcgggaggcaagccggcacuggugcgacgcggcccgacagguaaggaccaccaacagucggagaugggcagaugcgcggacgccaugggaaggcgaggaggggaccggaggggcggcggguuggagggggacuccggagugaggauggggggcagagugggagggacgaagguuccuuucagcuugguggaccaggggccggcggcugacccaacccuaugcagcaccugccggcacccaaaugcagacgcagacacuauggagaaacaucaagcggagagccgagcccccgaccccauuucccgaggcugagcagcuccugcgccauccuuucaagaaaguggggagaaggugcuggcgucucaggagacgcgcccccucauuucuccccuguccgcagagcggugacu

SEQ ID NO: 11394 - RNA, 494 nt, Mus musculus
agucaccgcucugcggacaggggagaaaugagggggcgcgucuccugagacgccagcaccuucuccccacuuucuugaaaggauggcgcaggagcugcucagccucgggaaauggggucgggggcucggcucuccgcuugauguuucuccauagugucugcgucugcauuugggugccggcaggugcugcauaggguugggucagccgccggccccugguccaccaagcugaaaggaaccuucgucccucccacucugccccccauccucacuccggagucccccuccaacccgccgccccuccgguccccuccucgccuucccauggcguccgcgcaucugcccaucuccgacuguuggugguccuuaccugucgggccgcgucgcaccagugccggcuugccucccgcagcccggccggcgccgccgcuuuuauaggcgcgcguaguacucgugcggcggcucauucaugcggccgcggcuccuacacacug

SEQ ID NO: 11395 - RNA, 447 nt, Mus musculus
ucggcggcacgcggccucgcgccuccccucccacacccccgcacacaaagacgccucucggcggagggagcagggacccgcagcuggagcgggggcgcucggggcgccggccccggggucgccgccgccgccgccgccgcagggacgcgcgcccgcacccuccggcuccccuaagccgcauagcccggcccucagcccgagcggacggugagggacaagcgaaugcggggaagagaggaggggacccgggugcgccgugcuggguuaguuacagcuuggccccgcagcaucauggggcuuguaguccgccugguagaaccgugcguuucggaugaccagagauggucuggaacugauuuccuggaaggguggacagagagucaaacccggccgaagcggaggccuuacuuggaugccaaguggguugggggcgccuccacccuuugg

SEQ ID NO: 11396 - RNA, 447 nt, Mus musculus
ccaaaggguggaggcgcccccaacccacuuggcauccaaguaaggccuccgcuucggccggguuugacucucuguccacccuuccaggaaaucaguuccagaccaucucuggucauccgaaacgcacgguucuaccaggcggacuacaagccccaugaugcugcggggccaagcuguaacuaacccagcacggcgcacccggguccccuccucucuuccccgcauucgcuugucccucaccguccgcucgggcugagggccgggcuaugcggcuuaggggagccggagggugcgggcgcgcgucccugcggcggcggcggcggcggcgaccccggggccggcgccccgagcgcccccgcuccagcugcgggucccugcucccuccgccgagaggcgucuuugugugcgggggugugggaggggaggcgcgaggccgcgugccgccga

SEQ ID NO: 11397 - RNA, 1470 nt, Mus musculus
cggccgcucuagcgcugcuacuggcggcgcucgccuugcuccuccugcgacccuggaagcgcgcugucggagcgcgaaccucaguccgggaccacgaggagcaggagguggcgagcggaggccccgcggaucaguucagcgaccggcgcgaagcgcuccccggaggcugcagccucauuugcaagccgucggcgcuggcccagugccugcugcgcgcucugcgacgcucggcggcgcuggaacccagcccccgcuccuggcugucgggaccccaccugcaaaccuucugccacuucauccugccagucgggcccgggccugagcuagcccgugaguaccugcagcuggcagaugaugggcugguggcucuggauugggucauaggaccuugugccaggggccgccgggucaccaacccugggagccucccuccagugcuguugguaauccccaaugcauggggacgccucacucgcaauguacuggggcucugccugcucgcccuggagcgcggcuacuacccggucaucuuccaucgccgcggccaccacgguugcccgcuagucagccccagacuacagccuuucggggacccguccgaccucaaggaggcggugacuuacauucgcuuccgacacccggcggccccccuguucgcggugagcgaggguucaggguccgcgcugcugcuguccuacuugggggaguguggcuccuccagcuaugugacuggcgccgccugcaucucgccagugcuacgcugucgcgagugguucgaggcuggcuugccuuggcccuaugaacguggguucuugcugcaccagaaaaucucucucagcagguggguaacgggaacagaagucuacagcucugccugguaugggaacagagcuuuguggguagguuggggcaaaguucucacgagguuuccaaagcuguucaaacccuauaauugacauagagccaggaaaguggguuucaaagccauauuagccccagggccuccguuagggccccaucaguucaucucagucgcagguguccuagcaaccgguggucagcagaggccugcaccuggcauuuaccacuuaguccauagcuagauaggucaacaaacagggcucuggaagcaauugcggccgauuaucuguccagaauauuuaccuucaggcucugagccaggagguggcaggaaugagagauguacagucuuugguuuuuuuaaauccuucaaucugacagauguuuuacauauuucuaggugaguacacaacacuuauuccuguguuuguucuuucugagucaaggucucauacaacucuggcugcacagcugagggugugugucccugaacuccagacccucagccuuugccuccuaagugccaaaauuacaggcaucagacaccgcacacauaaaaaacaaaaacaaaaacaaaacccagaucuccagagggagaacaguuuuaac

SEQ ID NO: 11398 - RNA, 1470 nt, Mus musculus
guuaaaacuguucucccucuggagaucuggguuuuguuuuuguuuuuguuuuuuaugugugcggugucugaugccuguaauuuuggcacuuaggaggcaaaggcugagggucuggaguucagggacacacacccucagcugugcagccagaguuguaugagaccuugacucagaaagaacaaacacaggaauaaguguuguguacucaccuagaaauauguaaaacaucugucagauugaaggauuuaaaaaaaccaaagacuguacaucucucauuccugccaccuccuggcucagagccugaagguaaauauucuggacagauaaucggccgcaauugcuuccagagcccuguuuguugaccuaucuagcuauggacuaagugguaaaugccaggugcaggccucugcugaccaccgguugcuaggacaccugcgacugagaugaacugauggggcccuaacggaggcccuggggcuaauauggcuuugaaacccacuuuccuggcucuaugucaauuauaggguuugaacagcuuuggaaaccucgugagaacuuugccccaaccuacccacaaagcucuguucccauaccaggcagagcuguagacuucuguucccguuacccaccugcugagagagauuuucuggugcagcaagaacccacguucauagggccaaggcaagccagccucgaaccacucgcgacagcguagcacuggcgagaugcaggcggcgccagucacauagcuggaggagccacacucccccaaguaggacagcagcagcgcggacccugaacccucgcucaccgcgaacaggggggccgccgggugucggaagcgaauguaagucaccgccuccuugaggucggacggguccccgaaaggcuguagucuggggcugacuagcgggcaaccgugguggccgcggcgauggaagaugaccggguaguagccgcgcuccagggcgagcaggcagagccccaguacauugcgagugaggcguccccaugcauuggggauuaccaacagcacuggagggaggcucccaggguuggugacccggcggccccuggcacaagguccuaugacccaauccagagccaccagcccaucaucugccagcugcagguacucacgggcuagcucaggcccgggcccgacuggcaggaugaaguggcagaagguuugcagguggggucccgacagccaggagcgggggcuggguuccagcgccgccgagcgucgcagagcgcgcagcaggcacugggccagcgccgacggcuugcaaaugaggcugcagccuccggggagcgcuucgcgccggucgcugaacugauccgcggggccuccgcucgccaccuccugcuccucguggucccggacugagguucgcgcuccgacagcgcgcuuccagggucgcaggaggagcaaggcgagcgccgccaguagcagcgcuagagcggccg

SEQ ID NO: 11399 - RNA, 1098 nt, Mus musculus
acugguccccgaggcugaaggaaguggagcaggaggcuugcuuuuuuguuuuggggguuuuuuuuuuuuugucuuuuuaaucuauuuuucugaaauaaaagcucgucucuguacaaccacgagcucccguggcccaugcgagaccccgcuaccacacggcugccucguucauuucaggagggugagacaaaugguucccguagcuggcuccaccauugaccgacagagaugagaaagguggacugggcccgaagaccuccgcugacauggaguggagaggcccgggcaagcugggcucaggacuaggcgaguccccugggggaugugccaggaugucaguaaaucgcugcgccucacuggaaggguggugaccaggcagcgggugguccagaccuccaaggggcguccccgaagggccagaugauggcacaaaggguagguccacuggcgucugagccugagaggauggcgguccuugcgggaagaagucguaguugccuccgggaccguaguacucacucugguaaucugcgggccaguaaggagagugaagagaaagauaucaggcacaaccccgagucuagaagcacccacaaguuacaaaagcaggcuugccagcaagcaucgcuagguggcucgggaaacuggcuguuugugggguaacggagcaggcuggacacuuggcacaaaacucuuggaacugcucccuauccgggacccucuuaacgguguugggacuucggucacaucccuugacuugcucuccagccuucgcccuuacaccucgacggaaagcaagagguaccucccgcacugcccacccggauccugcgaagcccgcacagccggggcaccgccuugccauucagccacacucacucaccuccguaaaaggagaaggggccguuggggaugaguucgcccggcuccaggcgguccaccagcggccgcauccgacgaggacugcggaaaaaggcguggcgccgcgcgccuagcgcgcuuagcuguuucauccuucgcuccuuggagcgucgauucuggaaccagaccugaagcgcacaggcacaaugucagaccgcgggaaacuccacugggcag

SEQ ID NO: 11400 - RNA, 1098 nt, Mus musculus
cugcccaguggaguuucccgcggucugacauugugccugugcgcuucaggucugguuccagaaucgacgcuccaaggagcgaaggaugaaacagcuaagcgcgcuaggcgcgcggcgccacgccuuuuuccgcaguccucgucggaugcggccgcugguggaccgccuggagccgggcgaacucauccccaacggccccuucuccuuuuacggaggugagugaguguggcugaauggcaaggcggugccccggcugugcgggcuucgcaggauccgggugggcagugcgggagguaccucuugcuuuccgucgagguguaagggcgaaggcuggagagcaagucaagggaugugaccgaagucccaacaccguuaagagggucccggauagggagcaguuccaagaguuuugugccaaguguccagccugcuccguuaccccacaaacagccaguuucccgagccaccuagcgaugcuugcuggcaagccugcuuuuguaacuugugggugcuucuagacucgggguugugccugauaucuuucucuucacucuccuuacuggcccgcagauuaccagagugaguacuacggucccggaggcaacuacgacuucuucccgcaaggaccgccauccucucaggcucagacgccaguggaccuacccuuugugccaucaucuggcccuucggggacgccccuuggaggucuggaccacccgcugccuggucaccacccuuccagugaggcgcagcgauuuacugacauccuggcacaucccccaggggacucgccuaguccugagcccagcuugcccgggccucuccacuccaugucagcggaggucuucgggcccaguccaccuuucucaucucugucggucaaugguggagccagcuacgggaaccauuugucucacccuccugaaaugaacgaggcagccgugugguagcggggucucgcaugggccacgggagcucgugguuguacagagacgagcuuuuauuucagaaaaauagauuaaaaagacaaaaaaaaaaaaacccccaaaacaaaaaagcaagccuccugcuccacuuccuucagccucggggaccagu

SEQ ID NO: 11401 - RNA, 1651 nt, Mus musculus
ggaccaguuccacaagcugggcaccgagauggucaucaccaaguccgggagguaggacgggccgggcgggcgggcucggggaccgcacagcacccaccaccacugggucgaugcucucucggauugcccccgcuccggcccuggcgccacacuccuuuccacagacaagcaagcugacuuuuuuuuuuuuccguuuggcuccggagcgaauuaaaaaagaaaaagaaaagcaaacaucucucgauugaaauaaaacgaaaacacguuccuaaagaauagucccaacuguucugagucucaaagccccggagacucuggcgggucuccacagccccuugcggucucacuguuuuuuuuuuguuuuguuuuguuuuguuuuguuuuguuuuuguuuuuguuuuuuccgucuccuggacggucuggaaguuccuaagaaaagggaucuuucccggauucuccgcucugaucacuggaguccauagugggacuagcaucccgccuccugcuagcuccaggcugaccacuugguuccggcagagaguuguccagcccacagcuaggccuuggagagagucuugcuuguccuuggagcuuggagcacuggaccagccaccucuugaggccuuaaagccagaagaaaaauaaaauccccaaucuucccagcacuccagucucugaaaguccaggccucagguucacccuguucccccgaaauucuaggcuaggguucccugauuaagccucuaaaucguuucucccagacaaagaccuugauaguuuauuucuucaagcccugucccaagaguuuauuuccucucuacgaauuucaaggcaauucagaaaagccuaguguaucucuaaagggccuaguuuccuuuccugggcaucaacccucaucuuagaucagaguggaggaaaggucuccagacugagugcaaaacgcauccaaagcuuuacaaaacaggcucuggccggcagaaauaggaugucuugggaguaagaagcacaggcugggucuuuccagguagcaacacagcacaaguggaggacauugugacaaauuauguagauagggaagcuucaaguaggaugucaugucauugucgggaagguaaagggacaaaaaagagccgggucccaauggcaugucccccuucccucccuccgaggcggauguucccccccuucaaggugcgagucagcggccuggacaagaaagccaaauacauccugcuaauggacaucguggcugccgaugacugccgcuauaaguuucacaacucccgcuggaugguggcaggcaaagccgaccccgagaugccuaaacgcauguacauccacccggacaguccggccacaggggaacaguggauggccaagccuguggccuuccacaaacugaagcugaccaacaacauuucugacaagcauggcuuugugagugugggcagguugggaagguguugagagcccaggggcccccacagucgaguggguagaaggaagcuagaggauuucuagaggggagcauuaguugaacaccccccacccacagugccccugucuguggcccaggcaaacugggccuaggcuuccagagcccuguucugcaagccugaggaaaaguaugucgacuguuuguggaaagcuc

SEQ ID NO: 11402 - RNA, 1651 nt, Mus musculus
gagcuuuccacaaacagucgacauacuuuuccucaggcuugcagaacagggcucuggaagccuaggcccaguuugccugggccacagacaggggcacugugggugggggguguucaacuaaugcuccccucuagaaauccucuagcuuccuucuacccacucgacugugggggccccugggcucucaacaccuucccaaccugcccacacucacaaagccaugcuugucagaaauguuguuggucagcuucaguuuguggaaggccacaggcuuggccauccacuguuccccuguggccggacuguccggguggauguacaugcguuuaggcaucucggggucggcuuugccugccaccauccagcgggaguugugaaacuuauagcggcagucaucggcagccacgauguccauuagcaggauguauuuggcuuucuuguccaggccgcugacucgcaccuugaagggggggaacauccgccucggagggagggaagggggacaugccauugggacccggcucuuuuuugucccuuuaccuucccgacaaugacaugacauccuacuugaagcuucccuaucuacauaauuugucacaauguccuccacuugugcuguguugcuaccuggaaagacccagccugugcuucuuacucccaagacauccuauuucugccggccagagccuguuuuguaaagcuuuggaugcguuuugcacucagucuggagaccuuuccuccacucugaucuaagaugaggguugaugcccaggaaaggaaacuaggcccuuuagagauacacuaggcuuuucugaauugccuugaaauucguagagaggaaauaaacucuugggacagggcuugaagaaauaaacuaucaaggucuuugucugggagaaacgauuuagaggcuuaaucagggaacccuagccuagaauuucgggggaacagggugaaccugaggccuggacuuucagagacuggagugcugggaagauuggggauuuuauuuuucuucuggcuuuaaggccucaagagguggcugguccagugcuccaagcuccaaggacaagcaagacucucuccaaggccuagcugugggcuggacaacucucugccggaaccaaguggucagccuggagcuagcaggaggcgggaugcuagucccacuauggacuccagugaucagagcggagaauccgggaaagaucccuuuucuuaggaacuuccagaccguccaggagacggaaaaaacaaaaacaaaaacaaaacaaaacaaaacaaaacaaaacaaaaaaaaaacagugagaccgcaaggggcuguggagacccgccagagucuccggggcuuugagacucagaacaguugggacuauucuuuaggaacguguuuucguuuuauuucaaucgagagauguuugcuuuucuuuuucuuuuuuaauucgcuccggagccaaacggaaaaaaaaaaaagucagcuugcuugucuguggaaaggaguguggcgccagggccggagcgggggcaauccgagagagcaucgacccagugguggugggugcugugcgguccccgagcccgcccgcccggcccguccuaccucccggacuuggugaugaccaucucggugcccagcuuguggaacuggucc

SEQ ID NO: 11403 - RNA, 841 nt, Mus musculus
uuugaucaguugucuaugaggucugaugaagacaaaauagcuuucuuuucuagcccccuccaggcuuuggagaaauccaggaaguggguuugaacuuagccgcagugaaucuugcgauaguaaacuuuugggguggucagaguaacaccuuucauuacaacuauuagcugaauggcaaaagacucucggguuucccaguguuugcagaggcauuauuucagaacaauuccauuuggaaagaaacgcgauuguaaaccguuucuauuucaagcccauaaaaagcagaacucggaugaaaggcaaagccuugaccuuucuauuuuagacuugcaucuggguagcuaagccaucugcuuuucucccaccucccaccccaucuacuuaauggacugaaaauacugcacuuaauugcaauuuuauccaaccaggcugacuuuucugacuuacgaccucgucuuuucaccuaacggcuugcucgguaggguuuuacuuacccuuccuucccaauuccucccuaccgcucucaauuauaugcugucaaaugucugcaaaguaugauacuaggcucucacguaagaaagccaucuauagagccuuuucauuucaacagugagcgccugacggaaaaucuaggggucugggcuccucugggcaccgacgguauuagcuuuguugcgguuauguagaaaggcaccucuuacugccuguaaaggagucgcgcguccccaccgcccaacaaggaacgcagcccgggaaaggacagacagacgaaggugggaggaaaccccgggaagaaaggcgcagggaagaauggggagcccaagacgggagggaagaccuu

SEQ ID NO: 11404 - RNA, 841 nt, Mus musculus
aaggucuucccucccgucuugggcuccccauucuucccugcgccuuucuucccgggguuuccucccaccuucgucugucuguccuuucccgggcugcguuccuuguugggcgguggggacgcgcgacuccuuuacaggcaguaagaggugccuuucuacauaaccgcaacaaagcuaauaccgucggugcccagaggagcccagaccccuagauuuuccgucaggcgcucacuguugaaaugaaaaggcucuauagauggcuuucuuacgugagagccuaguaucauacuuugcagacauuugacagcauauaauugagagcgguagggaggaauugggaaggaaggguaaguaaaacccuaccgagcaagccguuaggugaaaagacgaggucguaagucagaaaagucagccugguuggauaaaauugcaauuaagugcaguauuuucaguccauuaaguagauggggugggaggugggagaaaagcagauggcuuagcuacccagaugcaagucuaaaauagaaaggucaaggcuuugccuuucauccgaguucugcuuuuuaugggcuugaaauagaaacgguuuacaaucgcguuucuuuccaaauggaauuguucugaaauaaugccucugcaaacacugggaaacccgagagucuuuugccauucagcuaauaguuguaaugaaagguguuacucugaccaccccaaaaguuuacuaucgcaagauucacugcggcuaaguucaaacccacuuccuggauuucuccaaagccuggagggggcuagaaaagaaagcuauuuugucuucaucagaccucauagacaacugaucaaa

SEQ ID NO: 11405 - RNA, 1281 nt, Mus musculus
gcguuggccaccuggaguccuuggcugucgucucagaggggggaaaaaauucccucggccacaccuccuucuuaaagaguaggcaagacugccagcgguucuuuuuuaggauccccggaggcugcagaaccgcacacucugguuucugcagucagcuagcugcuuuccuuccucucucagcgccagcccccacacccccacugcuccccuccgggucucaugacgcccgacuucccaguacagagaaucucuagacuuccuagacuccauucaagaauccggggagcccucugguguaacuacuuuggcucuuaugccgcacccuuagaugccacacagucuggauguucgcuguguuugcugcaucuacugugcagaucaaaaaacaugguucuuucccaccuucuuccuuuccacuucuccacucuuucuaugcuuauuagaucgaggcucacagugaaacagcuucuaagcaucagcaauuuaaaaguacaaaaauauucccuguggguugugcguguguuuguuguguguguccauccgcgcuuaugcaaagccucccaacgucacacuuggguauccggacaagcuucuccacaaaccccagaucuuuccagggauucccucugcccugcccucuucuucuucagcacccuuaaaagagguaggucuggggcuuuccgccagccacuccugccuugauagacgcacacaaaucugcugcaguuuuuccuucccuguucaccccuagcccuuuuaggcgagcaguccggagcgcaggauuuccuagcauuuacccugcauccgcacugcauucccaggccgcccuuccagggcuagaccuucugcagacccggcggcuccggcuccgccugggugguggguggugcucucgccgcccccuccuuccccuggggcccgagagagccgcgcgcugggcaagagugcgcgcgcgccggcuugcugggggaaaaucuccuucccuggaagcugcugagugucgcugaccgagaguaucccgggguccaucaaaagccaccaaagcguuugagagcuuuucuaaagaaaaacggugaaagaaaaacaagaagggaaacccguuucccgggaggccuggguuuccgaugguaucggauucucccguagcugcucugauagggaugcgguuggcggccgcugguacccggacuuagaguguccguugcgagaggagggaggugagggacuugcgggcaagaguugcaccugaucagggaaucugcgaagagaacugugggguaa

SEQ ID NO: 11406 - RNA, 1281 nt, Mus musculus
uuaccccacaguucucuucgcagauucccugaucaggugcaacucuugcccgcaagucccucaccucccuccucucgcaacggacacucuaaguccggguaccagcggccgccaaccgcaucccuaucagagcagcuacgggagaauccgauaccaucggaaacccaggccucccgggaaacggguuucccuucuuguuuuucuuucaccguuuuucuuuagaaaagcucucaaacgcuuugguggcuuuugauggaccccgggauacucucggucagcgacacucagcagcuuccagggaaggagauuuucccccagcaagccggcgcgcgcgcacucuugcccagcgcgcggcucucucgggccccaggggaaggagggggcggcgagagcaccacccaccacccaggcggagccggagccgccgggucugcagaaggucuagcccuggaagggcggccugggaaugcagugcggaugcaggguaaaugcuaggaaauccugcgcuccggacugcucgccuaaaagggcuaggggugaacagggaaggaaaaacugcagcagauuugugugcgucuaucaaggcaggaguggcuggcggaaagccccagaccuaccucuuuuaagggugcugaagaagaagagggcagggcagagggaaucccuggaaagaucugggguuuguggagaagcuuguccggauacccaagugugacguugggaggcuuugcauaagcgcggauggacacacacaacaaacacacgcacaacccacagggaauauuuuuguacuuuuaaauugcugaugcuuagaagcuguuucacugugagccucgaucuaauaagcauagaaagaguggagaaguggaaaggaagaaggugggaaagaaccauguuuuuugaucugcacaguagaugcagcaaacacagcgaacauccagacuguguggcaucuaagggugcggcauaagagccaaaguaguuacaccagagggcuccccggauucuugaauggagucuaggaagucuagagauucucuguacugggaagucgggcgucaugagacccggaggggagcagugggggugugggggcuggcgcugagagaggaaggaaagcagcuagcugacugcagaaaccagagugugcgguucugcagccuccggggauccuaaaaaagaaccgcuggcagucuugccuacucuuuaagaaggagguguggccgagggaauuuuuuccccccucugagacgacagccaaggacuccagguggccaacgc

SEQ ID NO: 11407 - RNA, 686 nt, Mus musculus
caacccucccaccucaauuuucucuacugguccauccacccugcaaugcccaggaguaagucucccauagcuuggccagcaggaguagccacacuucucuaggaaucuucccuguguccuucuccagugccucgggugcacgcccccuccagaacuuaaagagucuuucccgcuccugggcccacaguucucaggcuugggaagucccauuuggcugaaucaagacuacaccggaccacgucuguucuguucaacggcgguccccuucugcuucagcgccccaggcuggccgcucgcccggcaaaugcuuguugaauaagagaaucagaagcccucacagacccugcagaggagauggaaagccccgugcguccuaaggcgggaccgccucccuggucgcuucccugccauucgcgcgcagacucccuagcgcugagacucccgcgguccgagaaguagcggcaauugggaucccggggccggccgcgggcacccgccgccuccuccccucgguccuagcugcuuccgccccgcccgcccuccucuucccuccuucccuaccguucuuugucucccgggcgcucggccuccccauaagcguaucgccccccccgccccccccgucgccuuaucccgggcgaccccccacggaccuagccacugcgacgcuacacaaaucggccggu

SEQ ID NO: 11408 - RNA, 686 nt, Mus musculus
accggccgauuuguguagcgucgcaguggcuagguccguggggggucgcccgggauaaggcgacggggggggcggggggggcgauacgcuuauggggaggccgagcgcccgggagacaaagaacgguagggaaggagggaagaggagggcgggcggggcggaagcagcuaggaccgaggggaggaggcggcgggugcccgcggccggccccgggaucccaauugccgcuacuucucggaccgcgggagucucagcgcuagggagucugcgcgcgaauggcagggaagcgaccagggaggcggucccgccuuaggacgcacggggcuuuccaucuccucugcagggucugugagggcuucugauucucuuauucaacaagcauuugccgggcgagcggccagccuggggcgcugaagcagaaggggaccgccguugaacagaacagacgugguccgguguagucuugauucagccaaaugggacuucccaagccugagaacugugggcccaggagcgggaaagacucuuuaaguucuggagggggcgugcacccgaggcacuggagaaggacacagggaagauuccuagagaaguguggcuacuccugcuggccaagcuaugggagacuuacuccugggcauugcaggguggauggaccaguagagaaaauugaggugggaggguug

SEQ ID NO: 11409 - RNA, 1835 nt, Mus musculus
uuugccucgaaggcaagacuugcagccaaucagcgcgcaggagccucccucggcgacuccaacauugagucuauaaccggcuggccgggcggagcuggcagcauuugacuguggcuugggacgcggagagaggcacgcagcgacugaccgacagccggcgauggucuaagcgccccucggccacccccucccccagacgcgaccgcguccugcccucgcccucuggacacacacccccaccugggcuccuccgcccguucggcgcuccucggaggaggcccgggguguugcggcgcucgccagcaugagcggcuccuucgaucgcaagcucagcagcauccucaccgacaucuccagcucgcucagcugccaugcgggcuccaaggacucgcccacccugcccgaaucuacagucacugaccugggcuauuacagcgcuccucagcaugacuacuacucgggccagcccuacggccagacggugaaccccuacaccuaccaccaccaguucaaucucaaugggcucgcaggcaccggcgcuuacucgcccaagucggaauauaccuacgggggauccuauaggcaguacggagcguaccgggagcagccuuugccugcccaggacccaggugaggaugcccggguuguggagagggugcgagggacucuaagguucccaagcaagaggaagucugggaauaggagcugaaaucuagggaaacucgagguuaagaaauggaagcguuggagauuagaggagaccggguuagaugaccuccagaggggugaacgacacuccgaagaggcgcgcacugugcgccgcggucucuuggagauuccagggcagcuggagccaccgggagcuccuucugagugaucaugggggccuucaaugcugccaucccgcuggcacuugagccggagacgaaagacggucgccgagagcuggaggggagucagcgaggacuggagguuccagggcccuucuuuuggaugccgucaggggaaacccggaguagugaaaggcuuguggagaaagacccaaagaagucccagaaauggaggagagacugggaaguagagaugcggagagagaaguggggacggcgagaaagaaauguggggggggcgguaagauaaagcgcacagcagaaagcaacagaggaaaugaagaaagggcggggaggaaagaaagaaaaaggaggaaagaagagggaaggaagaaaaagaaaacagagagaaagggaaaagagacagagaaaacgcuuguacuguccuugcaaauuuuuuccugaaacaaaugauccugaacuagaaagcguauuaaaaggagauggggaggaggggggacaagaagugggagacgccaccgcggcuaggugggucaccagagaagaguggcugagccgggaaggcgucgugagcgagccgcgcgguccucgcccagucgguugcuggcgccggagucggcgcuccgaggccccgggugccgagcugggagcgccgcgucgugggcggccgccgguccggcugggucgcugcgguuccuccccgggcgcgggcggcacuacgcuccuccaagaagucccggggagaucagugggccggagggugcggcguccgacggugggaaaucuuggagaacgcgguggucgcaggcugagacuaaacugguguuuuuccccuacagugucggugaaagaggagccggaagccgagguucgcauggugaacggcaagcccaaaaagguccgaaagccgcgaacgaucuacuccagcuaucagcuggcugcccugcagcgccguuuccagaaagcccaguaucuggccuugcc

SEQ ID NO: 11410 - RNA, 1835 nt, Mus musculus
ggcaaggccagauacugggcuuucuggaaacggcgcugcagggcagccagcugauagcuggaguagaucguucgcggcuuucggaccuuuuugggcuugccguucaccaugcgaaccucggcuuccggcuccucuuucaccgacacuguaggggaaaaacaccaguuuagucucagccugcgaccaccgcguucuccaagauuucccaccgucggacgccgcacccuccggcccacugaucuccccgggacuucuuggaggagcguagugccgcccgcgcccggggaggaaccgcagcgacccagccggaccggcggccgcccacgacgcggcgcucccagcucggcacccggggccucggagcgccgacuccggcgccagcaaccgacugggcgaggaccgcgcggcucgcucacgacgccuucccggcucagccacucuucucuggugacccaccuagccgcgguggcgucucccacuucuuguccccccuccuccccaucuccuuuuaauacgcuuucuaguucaggaucauuuguuucaggaaaaaauuugcaaggacaguacaagcguuuucucugucucuuuucccuuucucucuguuuucuuuuucuuccuucccucuucuuuccuccuuuuucuuucuuuccuccccgcccuuucuucauuuccucuguugcuuucugcugugcgcuuuaucuuaccgccccccccacauuucuuucucgccguccccacuucucucuccgcaucucuacuucccagucucuccuccauuucugggacuucuuugggucuuucuccacaagccuuucacuacuccggguuuccccugacggcauccaaaagaagggcccuggaaccuccaguccucgcugacuccccuccagcucucggcgaccgucuuucgucuccggcucaagugccagcgggauggcagcauugaaggcccccaugaucacucagaaggagcucccgguggcuccagcugcccuggaaucuccaagagaccgcggcgcacagugcgcgccucuucggagugucguucaccccucuggaggucaucuaacccggucuccucuaaucuccaacgcuuccauuucuuaaccucgaguuucccuagauuucagcuccuauucccagacuuccucuugcuugggaaccuuagagucccucgcacccucuccacaacccgggcauccucaccuggguccugggcaggcaaaggcugcucccgguacgcuccguacugccuauaggaucccccguagguauauuccgacuugggcgaguaagcgccggugccugcgagcccauugagauugaacugguggugguagguguagggguucaccgucuggccguagggcuggcccgaguaguagucaugcugaggagcgcuguaauagcccaggucagugacuguagauucgggcagggugggcgaguccuuggagcccgcauggcagcugagcgagcuggagaugucggugaggaugcugcugagcuugcgaucgaaggagccgcucaugcuggcgagcgccgcaacaccccgggccuccuccgaggagcgccgaacgggcggaggagcccagguggggguguguguccagagggcgagggcaggacgcggucgcgucugggggaggggguggccgaggggcgcuuagaccaucgccggcugucggucagucgcugcgugccucucuccgcgucccaagccacagucaaaugcugccagcuccgcccggccagccgguuauagacucaauguuggagucgccgagggaggcuccugcgcgcugauuggcugcaagucuugccuucgaggcaaa

SEQ ID NO: 11411 - RNA, 3844 nt, Mus musculus
uuauuuguaaaauugacucugccuuuguucuaggacguuucuuucuccuucucucugucuuuccagucaguucccucaggagaccauugguucugccugccacccuaagguuugaccccccccaccagccaugugccagguacacagaggagggccugggcuuggaguggggcagccagucauuucuggauuugaggccucagaucuucaggugcuggagguccaacuaaaggcaccccaacaagagaagaggggaaauggagaccuugguggccuuguuuuuuuccacuccaagguuagugcagguggucaaauggcuauggggacauauaccaauaacaggugccuuuuaaacccacaccuuuguguugggcacgggagagcauaagacagcaguaaccaaggccuugguacccagccuuagucuccacuacccuuaccucuuuugcuguguggaugaagaggucacuaucuauaccuggaaggcuuguguguagaaggaaugggugguuggccccagaaagcugggugucaguggggcuugguuucugaaugccaaggcccggggcacagguuuacagccacacgagauaucauccuuugauaucacuggaccuuucccucuaaaguggccaaagcaccuccagaagaccccccccuuucucuugcagcuccccccaaccaccagcagguaaagcuccuguaaauggcagaauuggcagccgccugcagaacuuuguuccaccuuagcacugcccauuaaccagaaaguuucuucuuccucucucaggcccucucagacucccuuuccacagaaaaucucgcguguuugcuuaaugagggaaaguuaugugcgugaccuaggugaggacagaucucggggugguuuggggucucauaagagccaguggggucaggugugucugcaagggagaaaaucucggggaaagucaccguuugugccgaaagggaaaaaaaaauccacagcaacccauaaucggucucauuucagcuaagucacccccaccgugcuucagucgggcggcgggggcgaucgaagcugcaguuuuauagcuguagaggaaagaacucguaaaaugcuaacagcuuuuaugcgcugcagcauaaacaacaacagacuccggcuuuauugcguuuuauaguuuguuaaagaguuuacagccguuuuuuugggggcugguuacccagccaauucccuccacacgauaguuaaaccuuuaucaauaauaaggaaauugaucauuaaagcuuuaaauaugacuaccucguuuguuugaaaauauguuuaggagaggaagcuguaugauuugauaacuuguauuaaaauaccaauuacauuuauaggaccuuuuaaaacucggugcaauuaaaccguguucuuuuacauuuuuccgaagcgacccugacauuuagaaagacuccaauugccucguuaaaaucgcgaaauuaacagcgugccuacgccaggcucagcguuguggauguguguguaugguguuuuuccgugacucccccacaucagucuuuggggguggucugcgaagguauuugauuuguugugaggcaagagauaucucauuaauguagguaguuaaacagauuuaauccguauucguucucucucucuccccccucccucucccccccucucccccucuuucucccuggguguuuuuuucucuuccccuccuuuuuuucugcccucuccucacucccuggcgcucucucgcucuagcucucucucgcacucgcucucucucgcucucacccucgcucugcguucuguccgggaggaguacccagaagccaauaggaugcggggucucuaauggaugcaaaugauggugaaaagacggggcaaaauaugaaacaacucauuuggagggaaguaaaucaccgaaaacuguuuaugaacuggcaucccuucuucgaaauguaaagcgaggaccucuuuaaguggcgguauauuuuuguuuggggggugggggguggggggagggcgagcgagccgcggcugccaugcaggcuuagacuuuugcaggcuucgcucuucuauuccuggaaaucacaaaaaguguggcggcuuugagaucuucuucgucuuuucuuucuuuuccuuccuuccuucuuuuuuuuccccuccucccuuuuccucuccuuuccuggcgagggugacuaggagccggcgaauccgcguuuuuuuuucucucucucucccucccuuuucccccuccccacccccuccccaacagcccccaacuacagccugcgccgccgccgccgccgccucaaaauucaauaaaaugagcucuuauuucgucaacucacuguucuccaaauacaaaaccggggagucccugcgccccaauuauuaugacugcggcuucgcccaggaccugggcggccgacccaccgugguguacggucccagcagcggcggcagcuuccagcacccuucgcaaauccaggaguucuaccacgggccaucgucgcuguccacagcucccuaccagcagaacccgugcgccguggcgugccacggcgaccccggcaacuucuacggcuacgacccucugcagcgccagagccuguucggugcgcaggauccagaccuggugcaguacgcagacugcaagcucgcggcagccagcggccugggcgaggaggccgaggggucugagcagagcccgucgcccacacagcucuuucccuggaugcgcccucaaggugagcucccguccgaccuggaccugacagggugggaaggggccaggggggcccccaugccggugggggggggagggcuggugggcaguccgggaguaucuucugcuccuagaggacuugugggcuccguuccaaacaccuaccuccucucccuucugucccacuuucuuuucuucuuuuuccccuuuucuuuuugcuuccuuugaaggaggggggggugucucuaagcgaauuuccugaauccauaaaccccucacccuccuuaacuuuucuucuucuccuccuuuccccuuuuacuguuuuaugggggcuguggagaaagacuggugggugugggggcgcucaacguuugcacuucucaauugcuuuauaguuuaauuacccugaagaaacuuuucuucuggggcagaggcucugggggcuuuucaagguggguucgagguccccacucuggcuuuuuagucuuacuccccccuccacauccacccucuuaaacuuuauggcacuuuuaauguaucugaacccccuauucugguucuaguuaccagagaaggggcuccuccuuuauggccccugcagauucagggcugucuaguccccccucgcccccccccccgcugaccgcgucuuccgcgcucccccucccgcccccgcauaaggguccccugcccuuauuauccuggucuccuaggcugguucacgaaucuuccaaccuucucugucucuucccccucccccacccuccccucugucucgcccuuuucccccauucccagcagccgccggacgcaggcgaggccgccagaccuacagucgcuaccagacccuggagcuggagaaggaguuccuauuuaaucccuaucugacucgcaagcggaggaucgagguaucgcacgcgcugggacugacagagagacaggucaaaaucugguuccagaaucggagaaugaaguggaaaaaggagaacaacaaagacaaguuucccagcaguaaaugcgagcaggaggagcuggagaaagagaagcuggagcgggcaccagagaccgccgagcagggcgaugcgcagaagggugacaagaaguaggcuccagcuggg

SEQ ID NO: 11412 - RNA, 3844 nt, Mus musculus
cccagcuggagccuacuucuugucacccuucugcgcaucgcccugcucggcggucucuggugcccgcuccagcuucucuuucuccagcuccuccugcucgcauuuacugcugggaaacuugucuuuguuguucuccuuuuuccacuucauucuccgauucuggaaccagauuuugaccugucucucugucagucccagcgcgugcgauaccucgauccuccgcuugcgagucagauagggauuaaauaggaacuccuucuccagcuccagggucugguagcgacuguaggucuggcggccucgccugcguccggcggcugcugggaaugggggaaaagggcgagacagaggggagggugggggagggggaagagacagagaagguuggaagauucgugaaccagccuaggagaccaggauaauaagggcaggggacccuuaugcgggggcgggagggggagcgcggaagacgcggucagcgggggggggggcgaggggggacuagacagcccugaaucugcaggggccauaaaggaggagccccuucucugguaacuagaaccagaauaggggguucagauacauuaaaagugccauaaaguuuaagaggguggauguggaggggggaguaagacuaaaaagccagaguggggaccucgaacccaccuugaaaagcccccagagccucugccccagaagaaaaguuucuucaggguaauuaaacuauaaagcaauugagaagugcaaacguugagcgcccccacacccaccagucuuucuccacagcccccauaaaacaguaaaaggggaaaggaggagaagaagaaaaguuaaggagggugagggguuuauggauucaggaaauucgcuuagagacaccccccccuccuucaaaggaagcaaaaagaaaaggggaaaaagaagaaaagaaagugggacagaagggagaggagguagguguuuggaacggagcccacaaguccucuaggagcagaagauacucccggacugcccaccagcccucccccccccaccggcaugggggccccccuggccccuucccacccugucagguccaggucggacgggagcucaccuugagggcgcauccagggaaagagcugugugggcgacgggcucugcucagaccccucggccuccucgcccaggccgcuggcugccgcgagcuugcagucugcguacugcaccaggucuggauccugcgcaccgaacaggcucuggcgcugcagagggucguagccguagaaguugccggggucgccguggcacgccacggcgcacggguucugcugguagggagcuguggacagcgacgauggcccgugguagaacuccuggauuugcgaagggugcuggaagcugccgccgcugcugggaccguacaccacggugggucggccgcccagguccugggcgaagccgcagucauaauaauuggggcgcagggacuccccgguuuuguauuuggagaacagugaguugacgaaauaagagcucauuuuauugaauuuugaggcggcggcggcggcggcgcaggcuguaguugggggcuguuggggaggggguggggagggggaaaagggagggagagagagagaaaaaaaaacgcggauucgccggcuccuagucacccucgccaggaaaggagaggaaaagggaggaggggaaaaaaaagaaggaaggaaggaaaagaaagaaaagacgaagaagaucucaaagccgccacacuuuuugugauuuccaggaauagaagagcgaagccugcaaaagucuaagccugcauggcagccgcggcucgcucgcccuccccccaccccccaccccccaaacaaaaauauaccgccacuuaaagagguccucgcuuuacauuucgaagaagggaugccaguucauaaacaguuuucggugauuuacuucccuccaaaugaguuguuucauauuuugccccgucuuuucaccaucauuugcauccauuagagaccccgcauccuauuggcuucuggguacuccucccggacagaacgcagagcgagggugagagcgagagagagcgagugcgagagagagcuagagcgagagagcgccagggagugaggagagggcagaaaaaaaggaggggaagagaaaaaaacacccagggagaaagagggggagagggggggagagggaggggggagagagagagaacgaauacggauuaaaucuguuuaacuaccuacauuaaugagauaucucuugccucacaacaaaucaaauaccuucgcagaccacccccaaagacugaugugggggagucacggaaaaacaccauacacacacauccacaacgcugagccuggcguaggcacgcuguuaauuucgcgauuuuaacgaggcaauuggagucuuucuaaaugucagggucgcuucggaaaaauguaaaagaacacgguuuaauugcaccgaguuuuaaaagguccuauaaauguaauugguauuuuaauacaaguuaucaaaucauacagcuuccucuccuaaacauauuuucaaacaaacgagguagucauauuuaaagcuuuaaugaucaauuuccuuauuauugauaaagguuuaacuaucguguggagggaauuggcuggguaaccagcccccaaaaaaacggcuguaaacucuuuaacaaacuauaaaacgcaauaaagccggagucuguuguuguuuaugcugcagcgcauaaaagcuguuagcauuuuacgaguucuuuccucuacagcuauaaaacugcagcuucgaucgcccccgccgcccgacugaagcacggugggggugacuuagcugaaaugagaccgauuauggguugcuguggauuuuuuuuucccuuucggcacaaacggugacuuuccccgagauuuucucccuugcagacacaccugaccccacuggcucuuaugagaccccaaaccaccccgagaucuguccucaccuaggucacgcacauaacuuucccucauuaagcaaacacgcgagauuuucuguggaaagggagucugagagggccugagagaggaagaagaaacuuucugguuaaugggcagugcuaagguggaacaaaguucugcaggcggcugccaauucugccauuuacaggagcuuuaccugcuggugguuggggggagcugcaagagaaaggggggggucuucuggaggugcuuuggccacuuuagagggaaagguccagugauaucaaaggaugauaucucguguggcuguaaaccugugccccgggccuuggcauucagaaaccaagccccacugacacccagcuuucuggggccaaccacccauuccuucuacacacaagccuuccagguauagauagugaccucuucauccacacagcaaaagagguaaggguaguggagacuaaggcuggguaccaaggccuugguuacugcugucuuaugcucucccgugcccaacacaaagguguggguuuaaaaggcaccuguuauugguauauguccccauagccauuugaccaccugcacuaaccuuggaguggaaaaaaacaaggccaccaaggucuccauuuccccucuucucuuguuggggugccuuuaguuggaccuccagcaccugaagaucugaggccucaaauccagaaaugacuggcugccccacuccaagcccaggcccuccucuguguaccuggcacauggcugguggggggggucaaaccuuaggguggcaggcagaaccaauggucuccugagggaacugacuggaaagacagagagaaggagaaagaaacguccuagaacaaaggcagagucaauuuuacaaauaa

SEQ ID NO: 11413 - RNA, 752 nt, Mus musculus
ugaguuucuauuuccauuuuuuccuuggacucagguuggggaaacaggagcagagggaagcgguuccucccuaccuccccucucugggacgucgucacuuucucccaguuucuaggccucggcuugccgcagccuuccuuccuucguugcuucugccuuccuggcagccacgcuccagugagugaggcauccgccuuccggaaccgggaaagcagcgagccggacccaagccuccuuccucccuuccuuuuucucccagcccccauuccauucuuuuuaaauuuuguauaucuuuuuauugucaucagaaaucucagcguccaacgccuuauuggguuggaucucugccuuagggacgccuuggucacaucuaguuacuacaacuggggcacuaagacaaccgggaggccaggcucgccuccucuugggagaagagcagcagcucggaugaauuaacccaaauuaauaaauauucggccagcacccacccaccaaguugcgaacauucaaucccugcgucucucucgcucuguaaccggcugggggaaaugggugggggaugacaacacgguucccucagagguuauuuauuuucucuuccacucaauuccuucuuccccaaaucucgccugcaagcugccuccagcccgcgggggucgacagcggcccuuaagcccccagccccaauccgcagagcucggccuucccauucauuauugaucauauuuuauaaauccaacgccacacaauuu

SEQ ID NO: 11414 - RNA, 752 nt, Mus musculus
aaauuguguggcguuggauuuauaaaauaugaucaauaaugaaugggaaggccgagcucugcggauuggggcugggggcuuaagggccgcugucgacccccgcgggcuggaggcagcuugcaggcgagauuuggggaagaaggaauugaguggaagagaaaauaaauaaccucugagggaaccguguugucaucccccacccauuucccccagccgguuacagagcgagagagacgcagggauugaauguucgcaacuuggugggugggugcuggccgaauauuuauuaauuuggguuaauucauccgagcugcugcucuucucccaagaggaggcgagccuggccucccgguugucuuagugccccaguuguaguaacuagaugugaccaaggcgucccuaaggcagagauccaacccaauaaggcguuggacgcugagauuucugaugacaauaaaaagauauacaaaauuuaaaaagaauggaaugggggcugggagaaaaaggaagggaggaaggaggcuuggguccggcucgcugcuuucccgguuccggaaggcggaugccucacucacuggagcguggcugccaggaaggcagaagcaacgaaggaaggaaggcugcggcaagccgaggccuagaaacugggagaaagugacgacgucccagagaggggagguagggaggaaccgcuucccucugcuccuguuuccccaaccugaguccaaggaaaaaauggaaauagaaacuca

SEQ ID NO: 11415 - RNA, 519 nt, Mus musculus
cugcuccugaguacggccaaccuggaaccuucugaggggcacacacacacacaggagggggagggagagaaaaauauguuuuuuuuaaaggggauuauuucguuuucugcguuugguuaccagaaacucaaccuaaaauguaguuuuuguuuuuuuaaagaaagccuaggaaaacggagugaguuauuguuaaaauaaaaucaaggauuucguaaauccuucaucgcugaaaaaccuaaacgacagugucuuuucaccuagacaugggguacugguuuuuaauauuuauucguuuacaaacccucaguugucuaaagaagguuaucuuaaacuaaaagggcuugaaaaaggugauugguuuccggaaaaaaucugcuuaauuugaauuucuaagagacagcccuuaaaacccgcagcuucaauuuguaagaaaaagcccuuaaaaccugcggcuuccccagaacugaccgcugcaaccccuggcgagcacaggggaaccuggucccgaaagcaggcguu

SEQ ID NO: 11416 - RNA, 519 nt, Mus musculus
aacgccugcuuucgggaccagguuccccugugcucgccagggguugcagcggucaguucuggggaagccgcagguuuuaagggcuuuuucuuacaaauugaagcugcggguuuuaagggcugucucuuagaaauucaaauuaagcagauuuuuuccggaaaccaaucaccuuuuucaagcccuuuuaguuuaagauaaccuucuuuagacaacugaggguuuguaaacgaauaaauauuaaaaaccaguaccccaugucuaggugaaaagacacugucguuuagguuuuucagcgaugaaggauuuacgaaauccuugauuuuauuuuaacaauaacucacuccguuuuccuaggcuuucuuuaaaaaaacaaaaacuacauuuuagguugaguuucugguaaccaaacgcagaaaacgaaauaauccccuuuaaaaaaaacauauuuuucucucccucccccuccugugugugugugugccccucagaagguuccagguuggccguacucaggagcag

SEQ ID NO: 11417 - RNA, 8817 nt, Mus musculus
aggucggagcacuaccguccuucagggcuccagccucuugauauuuuuauacuucaauaucagcucgauagagcgagagagagagagagagagagagagagagagagagagagagagagagagagagagagaaggagaggggggagaggagagaaggcugagagagggaaggaggggugggaauuacacaaaagagagaaccuaaaauaauuuugauucuuaauuuacuugcugaucugggauuuuuagucaucaugaaggcuaaauggacaaucugcccaggacugcagccugauaucauuuuucaaagccagaacuuacuccauuuucuaugcaaauaucagaaaagcgaaacaaccucucucucaagucugagaaggggaaacgacggcucucagguugggacaauauuaucuggaagcugaagaagauaccgaacgcuccuuuaucccucccuccacauccuuuugaauccggaggagggcaaaaucccccaaguucugcaaagguaaggaagauucuacaauucuuauucuuuugcauccuuuucuugcaggggguggggcuuagauuuuucucccuccuccuccccccauuucaagacaggguugaaccccaccucugggcgcugcugggagaggcuucccaggaaauucuguaguagagacagggguggcugcuuccuggagggggaccggcugcagggaagauggggaggagggauggaaaggggccuaugaggccgguuuuauguugcuuuuuuagcugggagagaucuccagcgaggggucugcaaaagcgaggguggggggugucugggcuacagccacgcuggccagucgcucuggcccuuguggguuugugcucaccucccuccaucucucccuuuuccuggccucuccgauugcccccgugcgguuucucuugcccaguguggguaauggcgauuucccggcugcauuggcacgaggggcgguggcgcugagggaaguccuggucucuguggggccuggaaucuccgcagaggccagccuagggcgaagaggcgucuagagugauauaaaaagaacaauucacagagaaauguucgcuaucuuccuucggagacauuucugaaaauaaaggguugugggugaaggaacccaaagcaagggaagcuagccgaagaccucccagcucuuuugccaccggucucuugccacucccgccagccggagggagccugcagggagagaguuuugugguuuuaaugcgguagguuaaagucuguuggucucugugugauuugaucuuguuacuuguguuuuauugguauaagauguauggauuuugguggagaaaauuguauaucugcuaugggcacauuucaaacuuuuccuggauuuuaaugcgguugggaagagacuuuuagcauguuguuucaggcuuguacacacaaauccauuugguguguaugucugggaggaugggaguggguggguugggauacaaaauguaaugguauguaugaucugggaaaaccuccuggagucugaguucaaaguuaaguccugucuuucgccgcccaauuuuuguucccuggcuuccugggggugggggaggggauggggggggggaaagaucucuuggguaugagacagauuccuaaagugguugauaggcuucaggcugacuggugaggacuauaaaaugggacgaaagguccccagagaagcuaucagugacagagagauaagugacuguggguaugaaugaaggacaggaggcguugugguuucguuugguuugcaugaauaaggauugucuucuuguuucuuaaggagccugugcagauagaugguucaggcucaggucucagguuauccgauuuuagugucuugggagaguguguagguacauuggucuccugggcuauuaggagagggaaacguagccacuuguggcacaagacugggguucccugggggcccagauaaaaagcucuagacacaggccugaaagggccucacugagagaccuugguuucuuagcaagcgaaauuaaucgccaacaucuaggacgcucggauccuauuugcggcgggaaauacccuccaaacccacucaaacuaaaggucuuuuccccuuguagucuugguggguuauaaaucgucccuuagacaguuuccucugacccaaauuaugcaguuugcugccaucuaccguccguucggggacaggcggcuuugguacagcaaaucgcucgacacuccccgagcccugcggguuugcuuugagccccugucgcgcaguucggugggauaccggcccacgcugauguccucuuaguccccgagugcagauuagaaagcggaaugagucucuugucacauuauccucaaccuucucccgucuccugcauacccuuccacacucaucccagccacaaaccugaaggcugguagugggaaagggagucuagaggaguaacacuguaacccacggacaggggguacugagccaaagggcugaggguucagaccuacgaccuuccucaccaccuaagacacgagacacgacuggggaccgcuggagagaugugaggccaaaucuguucaagguuuauuuaguuuucuucucugccaagggagggagggggucccguuaagggaggcgccggccaggcaguuccacucgguugucaaaagacaaacccagucuguauucuuccaguugguuuguggguuuugccaauuccuaagcuggcgaguccguggugaaggaguugaacugaauuuucuggaaacuguuggugucugcaagugaguguugguccccucccccauucucgaccguuucaagcgaaaucgcgcaaaaaaaaaaaaaaaagcuuugguagaacaucaugagugaggagaaaucguaaaaaaaaaaaaaaaaaaaaaaaaacaaaacacuguaauuuccuguccugccggaccccucacacccgguuaacggaaccgcuuucccaaaaggggguggcgagggcggggugcgcgccuccgcagaggcguuggagucuuggccccugucucaccgguuacugauuagcucggucuuucaagcugcuggaggaagcucuggccgccccuuucaaggugcugugcccccccccguucuugggcggggggagggcugcuccaggaaauugcuugcggugccaggcugggcaagguguuacuaaggucuggcugggagcugagggccuaggggcuguguagugcugggggcacacaccauugcugcuuccaggagccuuagaggucucuagagcaaaucuuuaagcuuuuuuuuuccuuccgugcguuaagagugacuuucuggcggcuagaaggccagacccagcuuagugaguugcucgcucugcaggaggccccaagggaucuagcaggaaggucugggggcccuccuaauuuuuuuucuuuuggcaaccagaaggaaacauagggagggggaagucagguuaguacagggcuugaaccaccucggagcucuuaggguaagggugaagcagaggagggagagaaggauugcccacuccuccuagaagaucagagaggaugccgaucauuugcauaauggaaaugaggucuuuguaccucgcgauuuggacuagucgauuuuagggccgaguguccacguaaagagucuaucuccaaucuauaggcgccaucacauugcacuacuggggaacauuucagacgaucagaaggggggggggauuggguuugagagauuuuuucauuccccccauccuaaguaaaguugaggauggaacaggagaagguacccacuacccaaggaucuggcggggggggggucaucucagagaaauaggaagcuuagauauugucucaccaccuccucauacaggcaaaaggcauuccuaagauuaccuuccagagauuuucucuccugagcugaaaaugacuuaagcaacauuucucugggagcuggaauguacaugcuuacccacgggacugcagacucaaagcacagaaaaucacaauuauaaauccugccugugggguaucaggacagucccaaugcuguguacucaagacuugguauauauuuacaucccuccuucugugagugagggggcggcaacccuaauggagaacuggcuggugccugcugugugucuacuuauuucccagugaagacagacaaacugagguggacagaaccacaggcagauccuuagagaucuggcuccagaaaccaggcagucucuggcucagcucugccugccugcuccuuuucccaaacaaacggaucagaugaauaaacgcucauaaauaccucugggcuuagauaagagcgaugaggcgcuauuuccuuucaugcccgacuccaggcgcccuggcccuggccguuguggcuccaucuucagacaagcaaccugcggaggugagguuaauucagggguugcugcucuaaaggauaaagcaauuauuuucccgccucuauuacaggagaaagccuccucuuacuugggccauacuuuacauggacagcuauacaguauuuccuaugaugaggacauugugaccagggagaaaggcugaggcccaaggcccagccucaguggcaagaaagggggaggguccucccgugccuuguugccuugaugaaauagcuccuauuccucucucagcaugggcccagcauuucuagacuggagagcaaugcuuucuucaccacuaggagguuugagcuucuuuuuaugccccaccaccuccaccacuggauugaggcuaagagagauacccgggaauggucauuuugccacaaagggacagccuagcaguugcuaugaguucaaagaacuucagaggccacauugcagccaaauaaauccucccucuugaucagccauccucagcccuuuccuauuaaccgugggcagagcuggcucacaaaaaggaacccaaagaacaaggcagaggugggucagccuggccugaccccaggcaccgucuuacaaccaauccucccugucuucagguuggauacacuguuugucuugggugugcauuuuagaaugucagaaauaccuugugucccccagguugggaucuguccuuauuuucuuuggaugagagaggaagagagcauagcuauuuucuuccacucccaaguccuuacagcagcuaagaaggugauauaaacaugagacgugggagguggucuguagaguggcugagagacaggaguguugugagugucuagaacuagagcaagcaugccaguuugaugguuggaaggugguuacuaagucccuaggaggaccuagcagccuucucuccuuauaaaaucaaauccaaaccaagucuugggaugcgaauuucaaagggaaccaccaguuuauaaagagaguaggaaaaagaggagacucucggucuccaauacugaagacucaacauuucuaagacaauuccccccaguaucuagauuuacagggaacaucuuugguucuaaaaaucuguagccagggauucuugcuacaucauuuggccugagagauaaggauagaugaggagagaccaagcaaggguugcaggaagaauagagaugaaaacaaguaaaguuaccuaggcugggguuuccccuucaucaccaaguuuaaggacuacuaguuucuuucuccagggcccagucucagucaagacugcagccaggacggcugagcugugcugggcauacggauggucggcuugccaaauagcaauagcaaauagcuucggggagcagccagagggagaaacugggcucacacaccccugacauuuccuucuuuugggucuucuaggcagaaggaacuggcuugcccuccucuaagcuggggaauuggguugaagucgggauacaauaaaaccuaaacuuaaaagggggaaacaggccugauaaacaauaaacgauuuuccaaaccuucaaaggaggguguuucuucuuuucuuguuucuaaaaugaagcaaauaagcggacaaguccguucucguuccaccccccaccaccaccacaccaguacaaaacccuagaaacagaccuucccccuuuauucucucucaacgagauucgaggauauuuacccagcccucccuugagggaacgggcccaugcaacgcagggguuaacuuuucugaaaacacaauuaacuuuucccuauuccugcguggggugggguggggggggagguuguauuuauuucaucacuggggaaugggaugaucuucaucuaacugcuuccuccucccucaaaagcacagacgucucuuucgcagaucauacguagguggaucagggcgcguuguggagagagagagagagagagagagagagagagagagagagagagagagagagagagagaggaaggagggggaaaagguugauagguuugugcgcgggucccucgugcaggcugcgcuccuccugggugcuauuugacaauuccugccucugccauuggucaguguuggaucagaugguuguauuuccuucuggcccucacuggcaccucgccauccccccucagcuaaaacccaaucucggcuauacuacuaauaggcgcggcgcucggacuauaaaacacaacaaaucauaaacccggcggagcagcagcggccucgcgcgccuccccucccgaugaguuccuauuucgugaacuccaccuuccccgucacucuggccagcgggcaggaguccuuccugggccagcugccgcucuacucgucuggcuaugcggacccgcugcggcacuaccccgcgccuuaugggccgggacccggccaggacaagggcuuugcggcguccuccuauuacccaccagccggcggcggcuacggccgggcggcgcccugugauuaugggccggcgccugccuucuaccgggagaaggacgcggccugcgcucucuccggcgccgacgagccgcccccguuccaccccgagccgcgcaaguccgacugcgcacaggacaagagcguguucggagagaccgaggagcagaagugcuccacgcccgucuacccguggaugcagcgcaugaauucgugcaacagugagugagacuucccgcugucccgugucugugugugugugugugugggggggggucggcaagcagaaagacugaaagugucagcaucccccaaccccaauucucccauugggaacuaggugggcaucucagcagauagagcaagauugcccccccccccgaccuccagaucaguccucuugcccgcagaaguugcaaaguuugcaaagucccagcugcacaguaaggcagggggaauaagugggcucucccuacuuaagucaggcuaggauuguugauccggaagagguuaggggacucagucucugguccuguauuccuuuauguucucccuagcucuuguccggaucugagggguggggggugccccgcacccaaagaccacuccauuaaaaacaagagugcgucaugaaaggggagggguggcaugacgccggcaagggcgaguuuacuuggguccuggauuguguuucccuggggcugggggaggagaacuggggaagggggaccagggagcugugagacacuaccauagggucguauagucugaggaaggaagaagagaggacaggcggagggagugagaagaacaaacuggcuccugggucucagguuggauuauuugugggcuucaagucccaauugauguccauuagcaggacacgaaagugaggggcuguuaaugcggacuaugaaucgauccacgucauuagggauuaagggccagaaucuaucaucgaguaggguagggagggcuggauggauggaaaggaagggaaagaaaagauacagcucguaggaggcacaccuggccagccccucccccaagcucaggugagaguccaagugccccuccucuccccccacugaaagucuaggcagaaagaaagcacaggccucggaguccaggagggaaucuggagggggcgcuggaggaguaggaaacggggaccagggaaugggagggggaaagacuacucccgacaggcuagcuuuacguuugagggccgagugggggaggggcuaugggcuuggugugaugaccccaggccucaguuucuccucucugcguaacagguuccucuuuugggcccagcggucggcgaggccgccagaccuacacacgcuaccagacccuggagcuggagaaggaauuucacuauaaucgcuaccugacccgccggcggcgcauagagaucgcgcacgcccugugccugaccgagcggcagaucaagauuugguuucagaaccggcgcaugaaguggaaaaaggagagcaaacugcucagugcgucucagcucagugcggaggaggaggaggaaaagccagccgagugaaggugcugcaaagggaggggggacgcgaagggagaggucugugggggaaccuagggcacccgaaagccccagaaggcucugcggucgggggagucuggggacuugcuguccagagcacgacgggcagggcccagugcuugccuggaugcccccuucugcagagcucuuccugggcgcuuggcggaugcccacccagcacccccagcgccuccucccucccccgaagaacccaccuuggccucaucaggcucucuggugagaacugagaaucggacucacuugaugucuccuggaagcagagcagaaugcucauguccuugucgagucucauuucguccaugucccccgugcacgguucaaugguagauucgcuguccccucagcagggaccuga

SEQ ID NO: 11418 - RNA, 8817 nt, Mus musculus
ucaggucccugcugaggggacagcgaaucuaccauugaaccgugcacgggggacauggacgaaaugagacucgacaaggacaugagcauucugcucugcuuccaggagacaucaagugaguccgauucucaguucucaccagagagccugaugaggccaagguggguucuucgggggagggaggaggcgcugggggugcugggugggcauccgccaagcgcccaggaagagcucugcagaagggggcauccaggcaagcacugggcccugcccgucgugcucuggacagcaaguccccagacucccccgaccgcagagccuucuggggcuuucgggugcccuagguucccccacagaccucucccuucgcguccccccucccuuugcagcaccuucacucggcuggcuuuuccuccuccuccuccgcacugagcugagacgcacugagcaguuugcucuccuuuuuccacuucaugcgccgguucugaaaccaaaucuugaucugccgcucggucaggcacagggcgugcgcgaucucuaugcgccgccggcgggucagguagcgauuauagugaaauuccuucuccagcuccagggucugguagcguguguaggucuggcggccucgccgaccgcugggcccaaaagaggaaccuguuacgcagagaggagaaacugaggccuggggucaucacaccaagcccauagccccucccccacucggcccucaaacguaaagcuagccugucgggaguagucuuucccccucccauucccugguccccguuuccuacuccuccagcgcccccuccagauucccuccuggacuccgaggccugugcuuucuuucugccuagacuuucaguggggggagaggaggggcacuuggacucucaccugagcuugggggaggggcuggccaggugugccuccuacgagcuguaucuuuucuuucccuuccuuuccauccauccagcccucccuacccuacucgaugauagauucuggcccuuaaucccuaaugacguggaucgauucauaguccgcauuaacagccccucacuuucguguccugcuaauggacaucaauugggacuugaagcccacaaauaauccaaccugagacccaggagccaguuuguucuucucacucccuccgccuguccucucuucuuccuuccucagacuauacgacccuaugguagugucucacagcucccuggucccccuuccccaguucuccucccccagccccagggaaacacaauccaggacccaaguaaacucgcccuugccggcgucaugccaccccuccccuuucaugacgcacucuuguuuuuaauggaguggucuuugggugcggggcaccccccaccccucagauccggacaagagcuagggagaacauaaaggaauacaggaccagagacugaguccccuaaccucuuccggaucaacaauccuagccugacuuaaguagggagagcccacuuauucccccugccuuacugugcagcugggacuuugcaaacuuugcaacuucugcgggcaagaggacugaucuggaggucgggggggggggcaaucuugcucuaucugcugagaugcccaccuaguucccaaugggagaauugggguugggggaugcugacacuuucagucuuucugcuugccgacccccccccacacacacacacacacagacacgggacagcgggaagucucacucacuguugcacgaauucaugcgcugcauccacggguagacgggcguggagcacuucugcuccucggucucuccgaacacgcucuuguccugugcgcagucggacuugcgcggcucgggguggaacgggggcggcucgucggcgccggagagagcgcaggccgcguccuucucccgguagaaggcaggcgccggcccauaaucacagggcgccgcccggccguagccgccgccggcugguggguaauaggaggacgccgcaaagcccuuguccuggccgggucccggcccauaaggcgcgggguagugccgcagcggguccgcauagccagacgaguagagcggcagcuggcccaggaaggacuccugcccgcuggccagagugacggggaagguggaguucacgaaauaggaacucaucgggaggggaggcgcgcgaggccgcugcugcuccgccggguuuaugauuuguuguguuuuauaguccgagcgccgcgccuauuaguaguauagccgagauuggguuuuagcugaggggggauggcgaggugccagugagggccagaaggaaauacaaccaucugauccaacacugaccaauggcagaggcaggaauugucaaauagcacccaggaggagcgcagccugcacgagggacccgcgcacaaaccuaucaaccuuuucccccuccuuccucucucucucucucucucucucucucucucucucucucucucucucucucucucucuccacaacgcgcccugauccaccuacguaugaucugcgaaagagacgucugugcuuuugagggaggaggaagcaguuagaugaagaucaucccauuccccagugaugaaauaaauacaaccuccccccccaccccaccccacgcaggaauagggaaaaguuaauuguguuuucagaaaaguuaaccccugcguugcaugggcccguucccucaagggagggcuggguaaauauccucgaaucucguugagagagaauaaagggggaaggucuguuucuaggguuuuguacugguguggugguggugggggguggaacgagaacggacuuguccgcuuauuugcuucauuuuagaaacaagaaaagaagaaacacccuccuuugaagguuuggaaaaucguuuauuguuuaucaggccuguuucccccuuuuaaguuuagguuuuauuguaucccgacuucaacccaauuccccagcuuagaggagggcaagccaguuccuucugccuagaagacccaaaagaaggaaaugucaggggugugugagcccaguuucucccucuggcugcuccccgaagcuauuugcuauugcuauuuggcaagccgaccauccguaugcccagcacagcucagccguccuggcugcagucuugacugagacugggcccuggagaaagaaacuaguaguccuuaaacuuggugaugaaggggaaaccccagccuagguaacuuuacuuguuuucaucucuauucuuccugcaacccuugcuuggucucuccucaucuauccuuaucucucaggccaaaugauguagcaagaaucccuggcuacagauuuuuagaaccaaagauguucccuguaaaucuagauacuggggggaauugucuuagaaauguugagucuucaguauuggagaccgagagucuccucuuuuuccuacucucuuuauaaacuggugguucccuuugaaauucgcaucccaagacuugguuuggauuugauuuuauaaggagagaaggcugcuagguccuccuagggacuuaguaaccaccuuccaaccaucaaacuggcaugcuugcucuaguucuagacacucacaacacuccugucucucagccacucuacagaccaccucccacgucucauguuuauaucaccuucuuagcugcuguaaggacuugggaguggaagaaaauagcuaugcucucuuccucucucauccaaagaaaauaaggacagaucccaaccugggggacacaagguauuucugacauucuaaaaugcacacccaagacaaacaguguauccaaccugaagacagggaggauugguuguaagacggugccuggggucaggccaggcugacccaccucugccuuguucuuuggguuccuuuuugugagccagcucugcccacgguuaauaggaaagggcugaggauggcugaucaagagggaggauuuauuuggcugcaauguggccucugaaguucuuugaacucauagcaacugcuaggcugucccuuuguggcaaaaugaccauucccggguaucucucuuagccucaauccagugguggaggugguggggcauaaaaagaagcucaaaccuccuaguggugaagaaagcauugcucuccagucuagaaaugcugggcccaugcugagagaggaauaggagcuauuucaucaaggcaacaaggcacgggaggacccucccccuuucuugccacugaggcugggccuugggccucagccuuucucccuggucacaauguccucaucauaggaaauacuguauagcuguccauguaaaguauggcccaaguaagaggaggcuuucuccuguaauagaggcgggaaaauaauugcuuuauccuuuagagcagcaaccccugaauuaaccucaccuccgcagguugcuugucugaagauggagccacaacggccagggccagggcgccuggagucgggcaugaaaggaaauagcgccucaucgcucuuaucuaagcccagagguauuuaugagcguuuauucaucugauccguuuguuugggaaaaggagcaggcaggcagagcugagccagagacugccugguuucuggagccagaucucuaaggaucugccugugguucuguccaccucaguuugucugucuucacugggaaauaaguagacacacagcaggcaccagccaguucuccauuaggguugccgcccccucacucacagaaggagggauguaaauauauaccaagucuugaguacacagcauugggacuguccugauaccccacaggcaggauuuauaauugugauuuucugugcuuugagucugcagucccguggguaagcauguacauuccagcucccagagaaauguugcuuaagucauuuucagcucaggagagaaaaucucuggaagguaaucuuaggaaugccuuuugccuguaugaggagguggugagacaauaucuaagcuuccuauuucucugagaugaccccccccccgccagauccuuggguaguggguaccuucuccuguuccauccucaacuuuacuuaggauggggggaaugaaaaaaucucucaaacccaauccccccccccuucugaucgucugaaauguuccccaguagugcaaugugauggcgccuauagauuggagauagacucuuuacguggacacucggcccuaaaaucgacuaguccaaaucgcgagguacaaagaccucauuuccauuaugcaaaugaucggcauccucucugaucuucuaggaggagugggcaauccuucucucccuccucugcuucacccuuacccuaagagcuccgaggugguucaagcccuguacuaaccugacuucccccucccuauguuuccuucugguugccaaaagaaaaaaaauuaggagggcccccagaccuuccugcuagaucccuuggggccuccugcagagcgagcaacucacuaagcugggucuggccuucuagccgccagaaagucacucuuaacgcacggaaggaaaaaaaaagcuuaaagauuugcucuagagaccucuaaggcuccuggaagcagcaauggugugugcccccagcacuacacagccccuaggcccucagcucccagccagaccuuaguaacaccuugcccagccuggcaccgcaagcaauuuccuggagcagcccuccccccgcccaagaacgggggggggcacagcaccuugaaaggggcggccagagcuuccuccagcagcuugaaagaccgagcuaaucaguaaccggugagacaggggccaagacuccaacgccucugcggaggcgcgcaccccgcccucgccacccccuuuugggaaagcgguuccguuaaccgggugugagggguccggcaggacaggaaauuacaguguuuuguuuuuuuuuuuuuuuuuuuuuuuuuacgauuucuccucacucaugauguucuaccaaagcuuuuuuuuuuuuuuuugcgcgauuucgcuugaaacggucgagaaugggggaggggaccaacacucacuugcagacaccaacaguuuccagaaaauucaguucaacuccuucaccacggacucgccagcuuaggaauuggcaaaacccacaaaccaacuggaagaauacagacuggguuugucuuuugacaaccgaguggaacugccuggccggcgccucccuuaacgggacccccucccucccuuggcagagaagaaaacuaaauaaaccuugaacagauuuggccucacaucucuccagcgguccccagucgugucucgugucuuagguggugaggaaggucguaggucugaacccucagcccuuuggcucaguacccccuguccguggguuacaguguuacuccucuagacucccuuucccacuaccagccuucagguuuguggcugggaugaguguggaaggguaugcaggagacgggagaagguugaggauaaugugacaagagacucauuccgcuuucuaaucugcacucggggacuaagaggacaucagcgugggccgguaucccaccgaacugcgcgacaggggcucaaagcaaacccgcagggcucggggagugucgagcgauuugcuguaccaaagccgccuguccccgaacggacgguagauggcagcaaacugcauaauuugggucagaggaaacugucuaagggacgauuuauaacccaccaagacuacaaggggaaaagaccuuuaguuugaguggguuuggaggguauuucccgccgcaaauaggauccgagcguccuagauguuggcgauuaauuucgcuugcuaagaaaccaaggucucucagugaggcccuuucaggccugugucuagagcuuuuuaucugggcccccagggaaccccagucuugugccacaaguggcuacguuucccucuccuaauagcccaggagaccaauguaccuacacacucucccaagacacuaaaaucggauaaccugagaccugagccugaaccaucuaucugcacaggcuccuuaagaaacaagaagacaauccuuauucaugcaaaccaaacgaaaccacaacgccuccuguccuucauucauacccacagucacuuaucucucugucacugauagcuucucuggggaccuuucgucccauuuuauaguccucaccagucagccugaagccuaucaaccacuuuaggaaucugucucauacccaagagaucuuuccccccccccauccccucccccacccccaggaagccagggaacaaaaauugggcggcgaaagacaggacuuaacuuugaacucagacuccaggagguuuucccagaucauacauaccauuacauuuuguaucccaacccacccacucccauccucccagacauacacaccaaauggauuuguguguacaagccugaaacaacaugcuaaaagucucuucccaaccgcauuaaaauccaggaaaaguuugaaaugugcccauagcagauauacaauuuucuccaccaaaauccauacaucuuauaccaauaaaacacaaguaacaagaucaaaucacacagagaccaacagacuuuaaccuaccgcauuaaaaccacaaaacucucucccugcaggcucccuccggcuggcgggaguggcaagagaccgguggcaaaagagcugggaggucuucggcuagcuucccuugcuuuggguuccuucacccacaacccuuuauuuucagaaaugucuccgaaggaagauagcgaacauuucucugugaauuguucuuuuuauaucacucuagacgccucuucgcccuaggcuggccucugcggagauuccaggccccacagagaccaggacuucccucagcgccaccgccccucgugccaaugcagccgggaaaucgccauuacccacacugggcaagagaaaccgcacgggggcaaucggagaggccaggaaaagggagagauggagggaggugagcacaaacccacaagggccagagcgacuggccagcguggcuguagcccagacaccccccacccucgcuuuugcagaccccucgcuggagaucucucccagcuaaaaaagcaacauaaaaccggccucauaggccccuuuccaucccuccuccccaucuucccugcagccggucccccuccaggaagcagccaccccugucucuacuacagaauuuccugggaagccucucccagcagcgcccagaggugggguucaacccugucuugaaauggggggaggaggagggagaaaaaucuaagccccacccccugcaagaaaaggaugcaaaagaauaagaauuguagaaucuuccuuaccuuugcagaacuugggggauuuugcccuccuccggauucaaaaggauguggagggagggauaaaggagcguucgguaucuucuucagcuuccagauaauauugucccaaccugagagccgucguuuccccuucucagacuugagagagagguuguuucgcuuuucugauauuugcauagaaaauggaguaaguucuggcuuugaaaaaugauaucaggcugcaguccugggcagauuguccauuuagccuucaugaugacuaaaaaucccagaucagcaaguaaauuaagaaucaaaauuauuuuagguucucucuuuuguguaauucccaccccuccuucccucucucagccuucucuccucuccccccucuccuucucucucucucucucucucucucucucucucucucucucucucucucucucucucucgcucuaucgagcugauauugaaguauaaaaauaucaagaggcuggagcccugaaggacgguagugcuccgaccu

SEQ ID NO: 11419 - RNA, 3358 nt, Mus musculus
ggauucuugucuucagagucuggaggaggagacaucaaugagcucuacuacccaagagcaucucuucuaauuccaaacugccugcugcauuucagagagugagcaaggcucuuccuguuuucccucccuugaucuuaacccaagagaaaggaagaaagaaagaaagagagagagagagagagagagugggagagagagagagagagagagagagagagagagaaaggaaggaagagagagagagagagagauccauuucuaagccuuaguuuagaagcucuacaccaauucucccauucucugagcaaacuaaacucccuuuaucuauucuagaacaugcauggaaauuuuggauagucuuugagacuuaacuagccuuggauuuauguauuugaggcuuggaacuuaaaaaaagaaacuuuuagggaaacuaaagauaauggaggggugucagggaggagaccagagaagugcagaggaucuuuacuaguuuugaacacuuuugaaaagagaauaaaaauucgcuuccuucucacccaucuguaaauaucaccuggcucucuucauugcugcucucuggagagauauagggaguuauuuaagucugagugagugagccagcuacagcuacggauggcuagagaaaggauaaauacaucuagagagaugaguugauggauagguagggagcgaauauaaauauggagagagauggacgaacacagagaugaauggagacagagggaauauaaagagaggcugagggagagaaauggccucgcgaaugaggagagagcguuuaugcagagagauggagagaggcgucccucaucuucccuccaccuuuccauuucccuucuccuguucccuugaaaugccaucguuuucccuccucuugauuugucaugaauucuucuggauuuuagaccccuggcucacacccugagguguuuuuacagucucccucucccuuccuagucauccuuuugucccaagauaacagaccuaaccaggcuguccuagaacaccaucccaagacaaacugggagaaagaaacauggaauggggguucugggauaaguaaggagucuggcucuccagucucuagcccuacagccuugggguggggguaggcuucuuugaggggagaagagagugaggggcagcuggguugaauuuggccaaaucuaauaauccaagaaccuauugaaggccuugggggguugggaggggaguaaaagucuugaauauucuuccaacuucuccccccccucccucuggucccuucuuuccaaaaagucuuugaagaaagauguuuuugacgcuuccaugucgcucucagauggaugggcucagagugauugaagugucuuugucaugcuaaugauuggggggugauggaugggcgcugggacugccaaacucuggcccgcuuagcccauuggccugggagagaucacaugugcccccccacccccacucccuagccccuuccuaggggaucgcuggcggggccaagcuggcccgggccaugggcucaagcuucagcucugugacauacugccgaaagguuguagggcaagagggugucucccccaaacggcccgacccuccuucggccucuacauggacuauaauaggaugaguuccuuuuuagaguacccacuuuguaaccggggacccagcgccuacagcgccccaaccucuuuuccccccugcucagcuccggccguugacagcuacgcaggggagagccgcuaugguggagggcugccuagcucagcgcuccaacaaaacucgggguauccuguccagcagccgccgucaucccuggggguguccuuucccagccccgcucccucgggguacgccccagccgccugcaaccccagcuaugggccuucucaguauuauucugugggucagucggaaggagauggaagcuauuuucauccgucgagcuacggagcccagcuagggggguugcccgacagcuauggagcggguggagucggcucagggccauauccuccgccgcagcccccauacggaacugagcagaccgcaaccuuugcaucagccuacgaccuccucucugaggacaaggaaucgccuugcucgucagaacccagcacucucacuccccggaccuucgacuggaugaaggucaagagaaacccaccuaagacagguagggcucagaggagccacuuccucuccuuggcucgggcauacacagaggggccugagccagggcuucauucauuccuucagcugcuuuuacuggcagguaaguacuuuccggguucaagucagcagauauuuucccacgggcuaaguucggggcuaccuccucccgaaggaggucuccgcagucuugucugugcgcccaguuuggaaccaguauuucacguuucuugucugaaggugaguaugggcggaaggcugguucuagauuuuguaauuacuaauggagggggugugugaugccacauaggaucugcauuggguagaugaugaaugaggaccaagccugaacuaggaggaguggacgggagggagaaagaggugagagaacugacguggcuuuucucccugccccgccccuagcgaagguguccgagcugggacugggcgcucccggcggucuccgcacaaacuucaccacgcgccagcugacggagcuggagaaggaauuucauuucaacaaauaccugagccgugcccggaggguggagaucgccgccacccuggagcucaaugaaacgcaggugaagaucugguuccagaaccggcgcaugaagcagaagaaacgcgagcgagaggggggcaggaugccugcaggccccccagguugcccaaaggaagccgcuggagaugccucugaccaguccgcgugcaccuccccagaagccucgcccaguuccaucaccucuugaauugaacuuccuaaguaacugggcuuccaacgcuugaccaguucucucgaagacuuucccaaacuucacagccuuggugacccuccucaaggccgaggcaccaguuuagagcugcccaggaaacugggcaggaguugggaaauguauuuuucucucucucagaucuagggguggagggaugauugauggcuggggauccuacaggucuugggaccuggggaacacucaacucaucagaggucgaaggaaggccuuuuggcuuugaucuggagucagcccauccuuucgggcuucuccuuucccuuccaacucaguucagugccuuugagcuuagagaguucuucuuucgaauucuuagcccaacucuucuuucuaggucugggaugucuaggcugggaguccuugggguuuuucugggg

SEQ ID NO: 11420 - RNA, 3358 nt, Mus musculus
ccccagaaaaaccccaaggacucccagccuagacaucccagaccuagaaagaagaguugggcuaagaauucgaaagaagaacucucuaagcucaaaggcacugaacugaguuggaagggaaaggagaagcccgaaaggaugggcugacuccagaucaaagccaaaaggccuuccuucgaccucugaugaguugaguguuccccaggucccaagaccuguaggauccccagccaucaaucaucccuccaccccuagaucugagagagagaaaaauacauuucccaacuccugcccaguuuccugggcagcucuaaacuggugccucggccuugaggagggucaccaaggcugugaaguuugggaaagucuucgagagaacuggucaagcguuggaagcccaguuacuuaggaaguucaauucaagaggugauggaacugggcgaggcuucuggggaggugcacgcggacuggucagaggcaucuccagcggcuuccuuugggcaaccuggggggccugcaggcauccugccccccucucgcucgcguuucuucugcuucaugcgccgguucuggaaccagaucuucaccugcguuucauugagcuccaggguggcggcgaucuccacccuccgggcacggcucagguauuuguugaaaugaaauuccuucuccagcuccgucagcuggcgcguggugaaguuugugcggagaccgccgggagcgcccagucccagcucggacaccuucgcuaggggcggggcagggagaaaagccacgucaguucucucaccucuuucucccucccguccacuccuccuaguucaggcuugguccucauucaucaucuacccaaugcagauccuauguggcaucacacacccccuccauuaguaauuacaaaaucuagaaccagccuuccgcccauacucaccuucagacaagaaacgugaaauacugguuccaaacugggcgcacagacaagacugcggagaccuccuucgggaggagguagccccgaacuuagcccgugggaaaauaucugcugacuugaacccggaaaguacuuaccugccaguaaaagcagcugaaggaaugaaugaagcccuggcucaggccccucuguguaugcccgagccaaggagaggaaguggcuccucugagcccuaccugucuuagguggguuucucuugaccuucauccagucgaagguccggggagugagagugcuggguucugacgagcaaggcgauuccuuguccucagagaggaggucguaggcugaugcaaagguugcggucugcucaguuccguaugggggcugcggcggaggauauggcccugagccgacuccacccgcuccauagcugucgggcaaccccccuagcugggcuccguagcucgacggaugaaaauagcuuccaucuccuuccgacugacccacagaauaauacugagaaggcccauagcugggguugcaggcggcuggggcguaccccgagggagcggggcugggaaaggacacccccagggaugacggcggcugcuggacaggauaccccgaguuuuguuggagcgcugagcuaggcagcccuccaccauagcggcucuccccugcguagcugucaacggccggagcugagcaggggggaaaagagguuggggcgcuguaggcgcuggguccccgguuacaaaguggguacucuaaaaaggaacucauccuauuauaguccauguagaggccgaaggagggucgggccguuugggggagacacccucuugcccuacaaccuuucggcaguaugucacagagcugaagcuugagcccauggcccgggccagcuuggccccgccagcgauccccuaggaaggggcuagggagugggggugggggggcacaugugaucucucccaggccaaugggcuaagcgggccagaguuuggcagucccagcgcccauccaucaccccccaaucauuagcaugacaaagacacuucaaucacucugagcccauccaucugagagcgacauggaagcgucaaaaacaucuuucuucaaagacuuuuuggaaagaagggaccagagggaggggggggagaaguuggaagaauauucaagacuuuuacuccccucccaaccccccaaggccuucaauagguucuuggauuauuagauuuggccaaauucaacccagcugccccucacucucuucuccccucaaagaagccuacccccaccccaaggcuguagggcuagagacuggagagccagacuccuuacuuaucccagaacccccauuccauguuucuuucucccaguuugucuugggaugguguucuaggacagccugguuaggucuguuaucuugggacaaaaggaugacuaggaagggagagggagacuguaaaaacaccucagggugugagccaggggucuaaaauccagaagaauucaugacaaaucaagaggagggaaaacgauggcauuucaagggaacaggagaagggaaauggaaagguggagggaagaugagggacgccucucuccaucucucugcauaaacgcucucuccucauucgcgaggccauuucucucccucagccucucuuuauauucccucugucuccauucaucucuguguucguccaucucucuccauauuuauauucgcucccuaccuauccaucaacucaucucucuagauguauuuauccuuucucuagccauccguagcuguagcuggcucacucacucagacuuaaauaacucccuauaucucuccagagagcagcaaugaagagagccaggugauauuuacagaugggugagaaggaagcgaauuuuuauucucuuuucaaaaguguucaaaacuaguaaagauccucugcacuucucuggucuccucccugacaccccuccauuaucuuuaguuucccuaaaaguuucuuuuuuuaaguuccaagccucaaauacauaaauccaaggcuaguuaagucucaaagacuauccaaaauuuccaugcauguucuagaauagauaaagggaguuuaguuugcucagagaaugggagaauugguguagagcuucuaaacuaaggcuuagaaauggaucucucucucucucucucuuccuuccuuucucucucucucucucucucucucucucucucucccacucucucucucucucucucucuuucuuucuuucuuccuuucucuuggguuaagaucaagggagggaaaacaggaagagccuugcucacucucugaaaugcagcaggcaguuuggaauuagaagagaugcucuuggguaguagagcucauugaugucuccuccuccagacucugaagacaagaaucc

SEQ ID NO: 11421 - RNA, 1725 nt, Mus musculus
gugaggaaguuacgagaguuuagcugcaggcagccggccaccagauucguggugggcugugacagccccuugcacagagucugcacguaggacaccagauccggccgcuucccggagcgcaagaucuccgagagagcccagauguaguucuuggccaggcgcagggucucgaucuuggacagcuucugcgucuuggaguagcagggcaccaccuugcgcagguuguccagagccgcguucaggucgugcaugcgguugcgcucccgcgcguuggccuucugucgccgcagcuuggagcgcuccagacgcgccuuggucaucuugcguuucuucggcccgcgcuucuugggccgcucgccuuccgccucguccaguccuuccuccuccuccucuuccuccuccuccucgccgcccagcucuccuuccuccuugaccucagccaacguggguucagggaucucuucuccuccacgaagagacacuggcuuggcggcccgggcggguccuggagcccccgacccgggagcaggaggaggcugcggcggcgcgucgcccuugucgcuccucggcucgucgucgucgccgucgccccagcuggcgaacuugggcacguccgagaggaggccgggcucgcugaacaggcgggucagcauggugccugagggcgccccgggggcggggagacagacagcacagagugaggggcgcgccggggucaccacgaccccccaacccgccuccaccccccaagucuccgugagcgccccagcucaggggcccccgaugcccacuacguccugcugccccgcccagagccggcccagcccugcccggcugccagugggggaccgcggcccaggcccuugcccgagauccgggcuccugcuccgccccuggcccggaaggaagcugcucucggccggugucggggucccagagagcuugaccaggugggggguuaagggaccagguccaucuucccggggaggcggugcucucgcccgaaagccagcucucucccggugacggagagaagcugggcggccgccguggggacgcugccccgguuccuccucuccacgguccggccccucggccuggcuccccaagcccuccggugccucucacccccaagcucccuaauccaauuugcaaguuggccgcgcgccgcccccggccgggcccccacccccgcagccccaauucuagacaccggagcaccgucuccucucuagcugcugcuuacgggucucccggagcgggcuccgggugcggggacugaagaagccgggcguggggaggagacccaaaagcgaacccuguucgucucccuugcggucagggacccucuuccccucuucaaacucccucccucccacacgucucuacagaucucguuguauuuugagauccuuggggaaaaauccaaauuuauuuguuugcuuaucuuuuuugguggugggaaaaggucacagguuccuucgggacagucauggggggggucccaucuucgcuucuucgagugccucaugacccuucccccucagcccauccuaggcauaccaucuccuuccgcagccccuuaagcugcggccccaaugggagagagaacacggggcgcccccgcugcccaucccguaaggggguagggucccaggaauaggagaacugggggggacuuccauguccgaagcagcgcccccccaccacuaauagcaggucaga

SEQ ID NO: 11422 - RNA, 1725 nt, Mus musculus
ucugaccugcuauuaguggugggggggcgcugcuucggacauggaagucccccccaguucuccuauuccugggacccuacccccuuacgggaugggcagcgggggcgccccguguucucucucccauuggggccgcagcuuaaggggcugcggaaggagaugguaugccuaggaugggcugagggggaagggucaugaggcacucgaagaagcgaagaugggaccccccccaugacugucccgaaggaaccugugaccuuuucccaccaccaaaaaagauaagcaaacaaauaaauuuggauuuuuccccaaggaucucaaaauacaacgagaucuguagagacgugugggagggagggaguuugaagaggggaagagggucccugaccgcaagggagacgaacaggguucgcuuuugggucuccuccccacgcccggcuucuucaguccccgcacccggagcccgcuccgggagacccguaagcagcagcuagagaggagacggugcuccggugucuagaauuggggcugcgggggugggggcccggccgggggcggcgcgcggccaacuugcaaauuggauuagggagcuugggggugagaggcaccggagggcuuggggagccaggccgaggggccggaccguggagaggaggaaccggggcagcguccccacggcggccgcccagcuucucuccgucaccgggagagagcuggcuuucgggcgagagcaccgccuccccgggaagauggaccuggucccuuaaccccccaccuggucaagcucucugggaccccgacaccggccgagagcagcuuccuuccgggccaggggcggagcaggagcccggaucucgggcaagggccugggccgcggucccccacuggcagccgggcagggcugggccggcucugggcggggcagcaggacguagugggcaucgggggccccugagcuggggcgcucacggagacuugggggguggaggcggguuggggggucguggugaccccggcgcgccccucacucugugcugucugucuccccgcccccggggcgcccucaggcaccaugcugacccgccuguucagcgagcccggccuccucucggacgugcccaaguucgccagcuggggcgacggcgacgacgacgagccgaggagcgacaagggcgacgcgccgccgcagccuccuccugcucccgggucgggggcuccaggacccgcccgggccgccaagccagugucucuucguggaggagaagagaucccugaacccacguuggcugaggucaaggaggaaggagagcugggcggcgaggaggaggaggaagaggaggaggaggaaggacuggacgaggcggaaggcgagcggcccaagaagcgcgggccgaagaaacgcaagaugaccaaggcgcgucuggagcgcuccaagcugcggcgacagaaggccaacgcgcgggagcgcaaccgcaugcacgaccugaacgcggcucuggacaaccugcgcaagguggugcccugcuacuccaagacgcagaagcuguccaagaucgagacccugcgccuggccaagaacuacaucugggcucucucggagaucuugcgcuccgggaagcggccggaucugguguccuacgugcagacucugugcaaggggcugucacagcccaccacgaaucugguggccggcugccugcagcuaaacucucguaacuuccucac

SEQ ID NO: 11423 - RNA, 508 nt, Mus musculus
aggacuugggagagccuaaaggugacggucuggaaccaaaccagugcuaaagacgucucacaugucugcagggaaggagcuaaaguauuauagaaauaaauggagacagacuucuggcaucauacaaguguaagaacuuggcuucuggucccagggugcccagggugauagccguguguuucugugacuaucucuuuaagagagggcuaauagugucuacauuugacguaugguaagacuguaguguguaauauguguauaacggaauguuacacguacuaggcagacagacguuacccuuuauuacauagauuugcaugggaagcacaacuaaauguuaaaaaugcuauguuaacgugauuuauggagugcugguccccaauauaauuauuuauauugcucuguguguuuuucucuuugcucuccugauuuuccuuuguauccaguuguguggccaucaugccucaaaccagaucccagacacaagcuaccaucgguuuuccgaaaa

SEQ ID NO: 11424 - RNA, 508 nt, Mus musculus
uuuucggaaaaccgaugguagcuugugucugggaucugguuugaggcaugauggccacacaacuggauacaaaggaaaaucaggagagcaaagagaaaaacacacagagcaauauaaauaauuauauuggggaccagcacuccauaaaucacguuaacauagcauuuuuaacauuuaguugugcuucccaugcaaaucuauguaauaaaggguaacgucugucugccuaguacguguaacauuccguuauacacauauuacacacuacagucuuaccauacgucaaauguagacacuauuagcccucucuuaaagagauagucacagaaacacacggcuaucacccugggcacccugggaccagaagccaaguucuuacacuuguaugaugccagaagucugucuccauuuauuucuauaauacuuuagcuccuucccugcagacaugugagacgucuuuagcacugguuugguuccagaccgucaccuuuaggcucucccaaguccu

SEQ ID NO: 11425 - RNA, 550 nt, Mus musculus
acugccccccuugcuccgaggagaagcuggcgcgcugccgcccccccguggguugcgaggaguuggugcgggagccaggcugcgguuguugcgccacuugcgcccugggcuuggggaugcccugcgggguguacaccccacgcuguggcucaggcaugcgcugcuacccuccccgggggguggagaagccccugcguacauugaugcacgggcaaggcgugugcacggagcugucggaaaucgaagccauccaggaaagccugcagaccucugguaagguacaccuaccuucccucggccacauuucccaaacacccuccucccugcaacuuaguucccauucuggcuggccuggaaggcccgucaaugcccccugugaguugaggagaagggagguacguggcagagcuuagaaacagccaagaaugcuggcauuuaaucccagcaccaguugccacuggucgagggaaaccuaccccaccucuucaucucaaaccuccuaaguacuucuuugggaagaggggccuuggccucagugguaagccuggcu

SEQ ID NO: 11426 - RNA, 550 nt, Mus musculus
agccaggcuuaccacugaggccaaggccccucuucccaaagaaguacuuaggagguuugagaugaagaggugggguagguuucccucgaccaguggcaacuggugcugggauuaaaugccagcauucuuggcuguuucuaagcucugccacguaccucccuucuccucaacucacagggggcauugacgggccuuccaggccagccagaaugggaacuaaguugcagggaggaggguguuugggaaauguggccgagggaagguagguguaccuuaccagaggucugcaggcuuuccuggauggcuucgauuuccgacagcuccgugcacacgccuugcccgugcaucaauguacgcaggggcuucuccaccccccggggaggguagcagcgcaugccugagccacagcgugggguguacaccccgcagggcauccccaagcccagggcgcaaguggcgcaacaaccgcagccuggcucccgcaccaacuccucgcaacccacgggggggcggcagcgcgccagcuucuccucggagcaaggggggcagu

SEQ ID NO: 11427 - RNA, 848 nt, Mus musculus
cccagaaaggugcaaagaaugcaacggguggagcccguggagugcggcagccuccacccaccagcaccuucacagcucgggacauggcccccgcaaucaugcggggguggggugauucacugcgcccagaccgccaccuccacccgccccacuuacacuccuaacgcccacccuaccugccccacccgcucccagcaggcgccaagggcgcccgcgcacugcaagacccuugggaacugaaagugccuggaggccaggggcagaucgcggccuagggacaugcguggguagccgagguuggugcgggggcgcggggauaggguguggggggcugacgaucgugucccuugcauggcgcccccgccacugcgugccugagcccugaaucacccgcuauaucgggcccgcagcgccggaggccccaggucccgggccccaccuuuagugucugcuuacagaggggcauacagagaccaccagagaccucgggcauucccucccuuuucccucucuccgccccaccaaaaaaaaaacuuccuccaaguggaaaggcguuugacagagacaagcugggagcauucagcguucccaagucuagcccgcuaacuuuuccgauaggaguuagagaccguggggaggagccuggagaggaaggcgcagggugcgccccucugugagccccaagaguuugccacucccuaaaccccacuccaacuggguucacaggaaggggggaggagcuccugaccgcucucaccaggccgggcuggcggagagacgagccucggccggguguccccacccggaucccaggccgggaccccagcucugggcgcgguccgccccgc

SEQ ID NO: 11428 - RNA, 848 nt, Mus musculus
gcggggcggaccgcgcccagagcuggggucccggccugggauccggguggggacacccggccgaggcucgucucuccgccagcccggccuggugagagcggucaggagcuccuccccccuuccugugaacccaguuggagugggguuuagggaguggcaaacucuuggggcucacagaggggcgcacccugcgccuuccucuccaggcuccuccccacggucucuaacuccuaucggaaaaguuagcgggcuagacuugggaacgcugaaugcucccagcuugucucugucaaacgccuuuccacuuggaggaaguuuuuuuuuugguggggcggagagagggaaaagggagggaaugcccgaggucucugguggucucuguaugccccucuguaagcagacacuaaagguggggcccgggaccuggggccuccggcgcugcgggcccgauauagcgggugauucagggcucaggcacgcaguggcgggggcgccaugcaagggacacgaucgucagccccccacacccuauccccgcgcccccgcaccaaccucggcuacccacgcaugucccuaggccgcgaucugccccuggccuccaggcacuuucaguucccaagggucuugcagugcgcgggcgcccuuggcgccugcugggagcggguggggcagguagggugggcguuaggaguguaaguggggcggguggagguggcggucugggcgcagugaaucaccccacccccgcaugauugcgggggccaugucccgagcugugaaggugcugguggguggaggcugccgcacuccacgggcuccacccguugcauucuuugcaccuuucuggg

SEQ ID NO: 11429 - RNA, 763 nt, Mus musculus
agcugggcgccccacccuguucaggaugguuggaauaguuggagcgggagucuagggccccccuuggcaguggaggcugcggcagcgggacuggggcagaggaaugugagcugcggaaaggaauuaggucuucggagugugcucuacucuuucucuuuccucacccacaaacccacuccagccuuuuaagaucaagcugagguccaaauggcgcgugaauuggguguaaacgaguaguuugugucuaugccucauguccuuggaggauccuugcccuauacaaucuuuuucaaagauuugggggucugcccccaucgucuaucuauacacugaguuaccacugucccccaaaucuugugggguuguuagugagagagagggaagagaugaaaugacagaaagggugacggccuagaaagggccucuagguuucucuuagaauuguaaggacagggcaugauuaaggcgagaaguaaauuauaaaguaaaagcuuuuggucacuucucccagggcccccuccagcagauaucuagcuaauucuaagaaugugagcgucggacucguucuucccuuggguucucggauauuaggugagcauucagggagaucacggaaccccaucucuuuaccuagcagagaaaagaaggccaagaggaggcagguggcucuccaggguucacuccagguuacuguugccaucuguucuuagcuccaggucucugaacuccaccgguacucaguaccuuucccuggggcaggaau

SEQ ID NO: 11430 - RNA, 763 nt, Mus musculus
auuccugccccagggaaagguacugaguaccgguggaguucagagaccuggagcuaagaacagauggcaacaguaaccuggagugaacccuggagagccaccugccuccucuuggccuucuuuucucugcuagguaaagagaugggguuccgugaucucccugaaugcucaccuaauauccgagaacccaagggaagaacgaguccgacgcucacauucuuagaauuagcuagauaucugcuggagggggcccugggagaagugaccaaaagcuuuuacuuuauaauuuacuucucgccuuaaucaugcccuguccuuacaauucuaagagaaaccuagaggcccuuucuaggccgucacccuuucugucauuucaucucuucccucucucucacuaacaaccccacaagauuugggggacagugguaacucaguguauagauagacgaugggggcagacccccaaaucuuugaaaaagauuguauagggcaaggauccuccaaggacaugaggcauagacacaaacuacucguuuacacccaauucacgcgccauuuggaccucagcuugaucuuaaaaggcuggaguggguuugugggugaggaaagagaaagaguagagcacacuccgaagaccuaauuccuuuccgcagcucacauuccucugccccagucccgcugccgcagccuccacugccaaggggggcccuagacucccgcuccaacuauuccaaccauccugaacaggguggggcgcccagcu

SEQ ID NO: 11431 - RNA, 822 nt, Mus musculus
gcagaugcucugccucuggccuuccuucuccaugcuagacacuaugcagggcacuuggcacagguuaucucacuucacaagccgcccuagcucuuaaggcauaccgggaugaguaaacagagcggguagguaacuggaccccaaauggacaugagaacccuucccuagcacacucagcucugcaaucuccauaguucugccagcaucugcuuccagcguucagccccuuucugugccuucccuuugcaaaaccagggccaaguuuguggucccugcuaguaaccgguugcuguugcaucacccuuuccccuuccccgcagugugagccucaucgaguguggggcagugcacacagccuucuaugaaaagcuggugggcggccccggcggggcucuggaacgagcagaugcccagacccgccaccucuuugcgcacuaccugcgugguuaugagcaagcccugagcgaggcgcaggacccagaggaggugacggaggugagugcaaacggagucucgggcaccguuucugggugggggcgugguaauacacccccaggggugccccacagacacgcgcugcucuuccugcuucagcucuucuugacugcaaugcgagccccgcagcccgcgcugcgcuacuucuccacgaaccgcuuccuaccccuggcccgaaugcgcacagaggaucccaguggcagcagcuaugucgcggccaugcaccaagaagccuucucuaaucugcagacccaggagaaugccaaggcuggggcccaagucccgggggucucggacacggccuccagcgcccucauuugccucccu

SEQ ID NO: 11432 - RNA, 822 nt, Mus musculus
agggaggcaaaugagggcgcuggaggccguguccgagacccccgggacuugggccccagccuuggcauucuccugggucugcagauuagagaaggcuucuuggugcauggccgcgacauagcugcugccacugggauccucugugcgcauucgggccagggguaggaagcgguucguggagaaguagcgcagcgcgggcugcggggcucgcauugcagucaagaagagcugaagcaggaagagcagcgcgugucuguggggcaccccuggggguguauuaccacgcccccacccagaaacggugcccgagacuccguuugcacucaccuccgucaccuccucuggguccugcgccucgcucagggcuugcucauaaccacgcagguagugcgcaaagagguggcgggucugggcaucugcucguuccagagccccgccggggccgcccaccagcuuuucauagaaggcugugugcacugccccacacucgaugaggcucacacugcggggaaggggaaagggugaugcaacagcaaccgguuacuagcagggaccacaaacuuggcccugguuuugcaaagggaaggcacagaaaggggcugaacgcuggaagcagaugcuggcagaacuauggagauugcagagcugagugugcuagggaaggguucucauguccauuugggguccaguuaccuacccgcucuguuuacucaucccgguaugccuuaagagcuagggcggcuugugaagugagauaaccugugccaagugcccugcauagugucuagcauggagaaggaaggccagaggcagagcaucugc

SEQ ID NO: 11433 - RNA, 1393 nt, Mus musculus
auuccagaccugcuaccauucgguggacaagcccuucgccgucauggagguaagccgaucccggugucgucgugucacugucaugagauggugacuguucaauaguacgucguaggucucagcaugccuaacugugaaucuggagagcagaggcguugaguuagugcuggggauggagaaagccauaaggcuacgaaaaccgcccuuggcgcuaaggagaaggcugggaagcccgggccuccagaagugaugucugacaaaggccucucaccguggaagcaguuagggguucagucggcugagcugucgcacuaccccuccccccaaggugucccagaguccaaggccgcugggaggagcugagggaggaacauuagugcuagauaaggggguggcuaagacccaacgggcaaagggcggagcagucggccaaaaguggggcccaauggcuccuaaguagaauguggucacugaggguccuaaagcccgauuaggaacaggcggcuuagagucagugucgcgucccugaacguccacuucuguacaggucgaugaggaggugauccggugcccgcaggcgguaucccgccuggcuuucgcccuggccuucuugcaacgcauggacaugaagccacuggugguucuggggcugccuacccccacggcaccuucuggcugucuuuccuucugggaagcuaaggcgcagcuugcucagagcugcaaggugcugguggaugaacuaaggcacaacgcggcuacugcugugcccuuuuuuggcggcggaucaguacugagcgcugcggagccagcuccccaugccagguuagugucaacccaaccugccccggcauccucagagagggcggaccacucugcuggcccugcccuggucccgcucaagcaccacaucuggcccacagcuacgguggcaucgucgcgguggagacagaccuguugcaguggugucuggaauccaacagcauccccauccugugccccauuggggaaacggcugcgcgccguuccgugcuccuugacucgcuggaggugacugcaucucuagccaaggcuuugcagcccaccaaaaucaucuuccucaauaauucaggcggccugcggaauaacagucagaaggugcgccccucuccugugccacgucauaacacuaagcaagacugaguccccggcccugugaccccuacguaaacccauaacaggcuacagucacucucaagccaauagaguaggaagaccuaacagaagaucggggggggggggggugguguuccucgguucccagaucugagcgcuucccagcagagaagauaaaaguuaaguggucacggagagguccacagggcuaggcucaguuugguaugggugugaaucugcu

SEQ ID NO: 11434 - RNA, 1393 nt, Mus musculus
agcagauucacacccauaccaaacugagccuagcccuguggaccucuccgugaccacuuaacuuuuaucuucucugcugggaagcgcucagaucugggaaccgaggaacaccaccccccccccccccgaucuucuguuaggucuuccuacucuauuggcuugagagugacuguagccuguuauggguuuacguaggggucacagggccggggacucagucuugcuuaguguuaugacguggcacaggagaggggcgcaccuucugacuguuauuccgcaggccgccugaauuauugaggaagaugauuuuggugggcugcaaagccuuggcuagagaugcagucaccuccagcgagucaaggagcacggaacggcgcgcagccguuuccccaauggggcacaggauggggaugcuguuggauuccagacaccacugcaacaggucugucuccaccgcgacgaugccaccguagcugugggccagauguggugcuugagcgggaccagggcagggccagcagagugguccgcccucucugaggaugccggggcagguuggguugacacuaaccuggcauggggagcuggcuccgcagcgcucaguacugauccgccgccaaaaaagggcacagcaguagccgcguugugccuuaguucauccaccagcaccuugcagcucugagcaagcugcgccuuagcuucccagaaggaaagacagccagaaggugccguggggguaggcagccccagaaccaccaguggcuucauguccaugcguugcaagaaggccagggcgaaagccaggcgggauaccgccugcgggcaccggaucaccuccucaucgaccuguacagaaguggacguucagggacgcgacacugacucuaagccgccuguuccuaaucgggcuuuaggacccucagugaccacauucuacuuaggagccauugggccccacuuuuggccgacugcuccgcccuuugcccguugggucuuagccacccccuuaucuagcacuaauguuccucccucagcuccucccagcggccuuggacucugggacaccuuggggggagggguagugcgacagcucagccgacugaaccccuaacugcuuccacggugagaggccuuugucagacaucacuucuggaggcccgggcuucccagccuucuccuuagcgccaagggcgguuuucguagccuuauggcuuucuccauccccagcacuaacucaacgccucugcucuccagauucacaguuaggcaugcugagaccuacgacguacuauugaacagucaccaucucaugacagugacacgacgacaccgggaucggcuuaccuccaugacggcgaagggcuuguccaccgaaugguagcaggucuggaau

SEQ ID NO: 11435 - RNA, 555 nt, Mus musculus
aagguggagcauuccagggggguugcaaaggguguucguucagcucgauggucccuucucuagggccagggauguacugcaguuaaggcuauugggcaacgaacucccucugccuuugugcgcaaaacauuuccugcagcccuccuccuucuucuccugagcgcacagccacucgucuuagcgcccuccggcgcggagacugcuucuccuuauccuugcccuagagcauccuugcuguucccuuaaagccagucggcgucagcuugaaucuuagcucucaagagaaaucagccugaaucagucucccacgggccaaaccccuacggaccaguucgugcgcccuagagcccugugaucugacuaguuggauuuaucuuuacgcauuuccacuccgcgggugcccuguagccucucccuuaagagcucaagcccaaggguugaagacucaggggugcccgcuaauuacaaccauucuucacaugauaguuaagggggccgcuuuagggucuccaccuacgccugcccggugugccugucgacucugauccaauacgc

SEQ ID NO: 11436 - RNA, 555 nt, Mus musculus
gcguauuggaucagagucgacaggcacaccgggcaggcguagguggagacccuaaagcggcccccuuaacuaucaugugaagaaugguuguaauuagcgggcaccccugagucuucaacccuugggcuugagcucuuaagggagaggcuacagggcacccgcggaguggaaaugcguaaagauaaauccaacuagucagaucacagggcucuagggcgcacgaacugguccguagggguuuggcccgugggagacugauucaggcugauuucucuugagagcuaagauucaagcugacgccgacuggcuuuaagggaacagcaaggaugcucuagggcaaggauaaggagaagcagucuccgcgccggagggcgcuaagacgaguggcugugcgcucaggagaagaaggaggagggcugcaggaaauguuuugcgcacaaaggcagagggaguucguugcccaauagccuuaacugcaguacaucccuggcccuagagaagggaccaucgagcugaacgaacacccuuugcaaccccccuggaaugcuccaccuu

SEQ ID NO: 11437 - RNA, 458 nt, Mus musculus
uaaacuaaggaagagaccugaaauggaggugucggcugugugguagaacaccuuucaacuccuuuucuugccucugccucuagagcaccaggauuacaggcuugcaccaucacaacuugcugaaauauaauuuuauuuauguauuuuaagacagggucucuaaccggcuuaaccuggccuugaauucaaggcccugcuucuguuuuccaaguccagggaguccaagcguguaaccaucacacccaguucaaguauuuaaaauguacaguguacucagauuuaauuugaacugcuauaaauuguuugguuuuguauuugacaaaaagaaaaaauaagaaaaguuucaucaacaaaagguaugagaaagggaggaaaggagggagagagaaaagaaccuuaacaaaaaguaucauuguagaauuuucauuuuauacaacagaaucuaauuucuacuucag

SEQ ID NO: 11438 - RNA, 458 nt, Mus musculus
cugaaguagaaauuagauucuguuguauaaaaugaaaauucuacaaugauacuuuuuguuaagguucuuuucucucucccuccuuuccucccuuucucauaccuuuuguugaugaaacuuuucuuauuuuuucuuuuugucaaauacaaaaccaaacaauuuauagcaguucaaauuaaaucugaguacacuguacauuuuaaauacuugaacugggugugaugguuacacgcuuggacucccuggacuuggaaaacagaagcagggccuugaauucaaggccagguuaagccgguuagagacccugucuuaaaauacauaaauaaaauuauauuucagcaaguugugauggugcaagccuguaauccuggugcucuagaggcagaggcaagaaaaggaguugaaagguguucuaccacacagccgacaccuccauuucaggucucuuccuuaguuua

SEQ ID NO: 11439 - RNA, 1703 nt, Mus musculus
cuaaaaccuggcagaagaggcuggauggaggggaugcugggggcccaagacuggccaccugagucagucgcgcaucccauccuucggcuggccaggccucgcagcagcccaggcuucgccacgcggugaaguucugcggaaaguuuugcaguugcuucgccucucgcgccagcaggagaagcugugacgcagcgucuggggcuccaggcccggucugaaaagagaggguagacaaggcgggaaggaauuaagaagcagaauaggggaagauaaagagcgcacacugggauccuuguggaccucgcugauccucuucuccagccuucgccuccucucccucccgacacgcacucccuugcggccggguccccagcccugcgcccccgcgccuccuccguccccucccacgcugcccgcuucccuuccccucugccccucaaacccuccuccaggguucugcgcuccucccuccgcccucccucugcggggccugccuccucccuccuccucuccgggaggcaucacuucguccggacccggaggaggaugcgauccccucgccggcggucaucugagcacagcgcuagggcugucucugcacgcagcccugccgugcgcccuccguacucucguccuccgagcgccgcagggaugguacccauccgaccugcccucgcgcccuggccucgucaccugcugcgcugcgucuugcuucucgggggacugcgucucggccacccggcggacuccgccgccgcccuccuggguaaggcgcugccaacuuggccaacuucgggagucgggccucuugacuuuucccuccuuuuuuucucccaucuuuucugaagaagugcgugcgugcgugugugugugugugugugugugcgcgcgcacgcgugugugugcgugugugugugugugugugugugugugugugugugugugugugugacuggauuuuuuaaauucgucuccacuuuucugggagcaagggaggagaugggaggaggagcgcgccuggaggugggggaggaccugaguggaaccagauguggcaggcggcgggggaggggagccaaggcaccgcggccugggagggagagggagggcugguguccgggccacccggacccccggcgcucgccccgcgcuggucuggguaccuugauauacaaccagagagccagaggcgcauuguuucuuacucuguacgugaggggucagucuguucagcgucuggcaauggggucuuuauguuuucuuacuuggucuuuaaggacagcuuguggcagaggacuuaugcaccguucgaucguaacccuguggaacaguuuugugccaggagaaccgaaugcgcgugcgugcguguguguguguguguguguguguguguguguguguguguguguucguuucucacuuuguguguucaauucugaucaaauuggcacuucuccagaguggacagucuuuggugcaaaagaguuucuaaagauacaaaccacaacccacagaagaccaaccacacaagccccccaaacugcacccuucucuuuucuguauguuuuuuuuuguuguuguguuguuguuguuguugucgucgucgucgucguuauuuuagaacuaucugaaaugugaggucagacaggucccucgacaagaaccugaacacucauaaacauugauaggguagaucuuggggg

SEQ ID NO: 11440 - RNA, 1703 nt, Mus musculus
cccccaagaucuacccuaucaauguuuaugaguguucagguucuugucgagggaccugucugaccucacauuucagauaguucuaaaauaacgacgacgacgacgacaacaacaacaacaacacaacaacaaaaaaaaacauacagaaaagagaagggugcaguuuggggggcuugugugguuggucuucuguggguugugguuuguaucuuuagaaacucuuuugcaccaaagacuguccacucuggagaagugccaauuugaucagaauugaacacacaaagugagaaacgaacacacacacacacacacacacacacacacacacacacacacacgcacgcacgcgcauucgguucuccuggcacaaaacuguuccacaggguuacgaucgaacggugcauaaguccucugccacaagcuguccuuaaagaccaaguaagaaaacauaaagaccccauugccagacgcugaacagacugaccccucacguacagaguaagaaacaaugcgccucuggcucucugguuguauaucaagguacccagaccagcgcggggcgagcgccggggguccggguggcccggacaccagcccucccucucccucccaggccgcggugccuuggcuccccucccccgccgccugccacaucugguuccacucagguccucccccaccuccaggcgcgcuccuccucccaucuccucccuugcucccagaaaaguggagacgaauuuaaaaaauccagucacacacacacacacacacacacacacacacacacacacacacacgcacacacacgcgugcgcgcgcacacacacacacacacacacacgcacgcacgcacuucuucagaaaagaugggagaaaaaaaggagggaaaagucaagaggcccgacucccgaaguuggccaaguuggcagcgccuuacccaggagggcggcggcggaguccgccggguggccgagacgcagucccccgagaagcaagacgcagcgcagcaggugacgaggccagggcgcgagggcaggucggauggguaccaucccugcggcgcucggaggacgagaguacggagggcgcacggcagggcugcgugcagagacagcccuagcgcugugcucagaugaccgccggcgaggggaucgcauccuccuccggguccggacgaagugaugccucccggagaggaggagggaggaggcaggccccgcagagggagggcggagggaggagcgcagaacccuggaggaggguuugaggggcagaggggaagggaagcgggcagcgugggaggggacggaggaggcgcgggggcgcagggcuggggacccggccgcaagggagugcgugucgggagggagaggaggcgaaggcuggagaagaggaucagcgagguccacaaggaucccagugugcgcucuuuaucuuccccuauucugcuucuuaauuccuucccgccuugucuacccucucuuuucagaccgggccuggagccccagacgcugcgucacagcuucuccugcuggcgcgagaggcgaagcaacugcaaaacuuuccgcagaacuucaccgcguggcgaagccugggcugcugcgaggccuggccagccgaaggaugggaugcgcgacugacucagguggccagucuugggcccccagcauccccuccauccagccucuucugccagguuuuag

SEQ ID NO: 11441 - RNA, 1443 nt, Mus musculus
cccacccucccagcuuuagguucuuugugucucgcguggagccagcgccgcgcccaccccucccccggcccacuccccggggcaaugugugcgugugcaugugugcguguuaugugugugcguuggggguagggguccuaccuucgaugcaacacacccgccacagucccgaaugggugaggucgccgcgagcgcggcggggcgggggcccgucguccauggucagguuggugccguugcagaugugcgcgcuggaguacagccaguagucggugccgauggcgauggccaugagcgagaaggcggcgaaggcuccggccguggucagcagcaucugcagcccgcggucgcaucgcaccauggugggcgccucauaguccgccgcccgccggcccggcccgccgcgcccgcccgcccuccucccucggcgcgcggcuccgggggcuccaggggcuggggggccgagggccggggggcggcgccgcgcugcgcgcuccgaccccgcgccccgggcgugccugcgcuccggcugcgcggggcucaaacuccgaggcgcggcggcgagugagggcugcgcgggcuacgcgggccgccgggcgggcuggcggcggcggcagcggcggcgguggcggccgggggcuccucccucucggcccgcccuccccuccgcucuuggcccgcgcccuccgcgccuccacccaccgcccgccgcccggcgcgcucucucggcgccgccccuccgccucuggccccgcgcucgcucucccacggccgggauuuucccuccccucucuccccucccugcgcucacgcgcgcucucuuuucucucccaggcuucauucacauuaucagagcgaaggaagccgagggaaagaaagauugguucccuggaaggaccccggggaagcugcgucuccagucaccucucuuuccaacccgggacagccaggaucuccuuaguccccaggauucuguaucccauucugugggauggagauugcguccccuuuccuucuuuccccacggccuuauggcuguaccugguuaugaaggucuaggcagggauguacugugagacuccucgcguuuccaaagggcccagaugugggucacagacgggagacauucuuuaugggccaagccagaugaagaucaccuccauuucaaccgaagcaagccaagggguucuagcaggcacuggggagcucuggacuucuucgaagggggacugaggaugugacacacuacagucacacuucugauaguccauugcugauagaggcaggaacaccagcaacuacauuguagccuccagcuguuucuucucccuguccuucucugaaccuuuacuuuuucuccgguuggcucuuccucagccuaaccggcucuuccucaccuccccuuaaccuugucagacucugccucggggccucuggccucuu

SEQ ID NO: 11442 - RNA, 1443 nt, Mus musculus
aagaggccagaggccccgaggcagagucugacaagguuaaggggaggugaggaagagccgguuaggcugaggaagagccaaccggagaaaaaguaaagguucagagaaggacagggagaagaaacagcuggaggcuacaauguaguugcugguguuccugccucuaucagcaauggacuaucagaagugugacuguagugugucacauccucagucccccuucgaagaaguccagagcuccccagugccugcuagaaccccuuggcuugcuucgguugaaauggaggugaucuucaucuggcuuggcccauaaagaaugucucccgucugugacccacaucugggcccuuuggaaacgcgaggagucucacaguacaucccugccuagaccuucauaaccagguacagccauaaggccguggggaaagaaggaaaggggacgcaaucuccaucccacagaaugggauacagaauccuggggacuaaggagauccuggcugucccggguuggaaagagaggugacuggagacgcagcuuccccgggguccuuccagggaaccaaucuuucuuucccucggcuuccuucgcucugauaaugugaaugaagccugggagagaaaagagagcgcgcgugagcgcagggaggggagagaggggagggaaaaucccggccgugggagagcgagcgcggggccagaggcggaggggcggcgccgagagagcgcgccgggcggcgggcgguggguggaggcgcggagggcgcgggccaagagcggaggggagggcgggccgagagggaggagcccccggccgccaccgccgccgcugccgccgccgccagcccgcccggcggcccgcguagcccgcgcagcccucacucgccgccgcgccucggaguuugagccccgcgcagccggagcgcaggcacgcccggggcgcggggucggagcgcgcagcgcggcgccgccccccggcccucggccccccagccccuggagcccccggagccgcgcgccgagggaggagggcgggcgggcgcggcgggccgggccggcgggcggcggacuaugaggcgcccaccauggugcgaugcgaccgcgggcugcagaugcugcugaccacggccggagccuucgccgccuucucgcucauggccaucgccaucggcaccgacuacuggcuguacuccagcgcgcacaucugcaacggcaccaaccugaccauggacgacgggcccccgccccgccgcgcucgcggcgaccucacccauucgggacuguggcggguguguugcaucgaagguaggaccccuacccccaacgcacacacauaacacgcacacaugcacacgcacacauugccccggggagugggccgggggaggggugggcgcggcgcuggcuccacgcgagacacaaagaaccuaaagcugggaggguggg

SEQ ID NO: 11443 - RNA, 535 nt, Mus musculus
gccuuugccuuggccugggccugcagaaggaaguuguugugaggagaaaaaagccccgcccccgcccaccccacccccccacgaccucuagccuugacugcccaacuuucccuggaugccugggaaauucuaauugaguggggaggugggcucuuaguaauagucugggggaggggaaugaggguuugucuggaagaagccauuugcaaccaacagacuccuuguguaacagaggucuacuugggauggcuggagggggggugggaaugaaggccuucuggugcagcuaaguccugccucuagaacuccgugauggggccucugacagaaguccagauuacaaauacacacaaggcaagggcacccauugauuuacaagcccugcagauccucccugaacggcacacuccaccucuggagaucgcaacauaccuugagaaggaagguuuuaggcuuggguccucgcuuuuuggggccauagagcuccaucucccguucccuaaagaaagaaaagagagagaaggggguguguccu

SEQ ID NO: 11444 - RNA, 535 nt, Mus musculus
aggacacacccccuucucucucuuuucuuucuuuagggaacgggagauggagcucuauggccccaaaaagcgaggacccaagccuaaaaccuuccuucucaagguauguugcgaucuccagagguggagugugccguucagggaggaucugcagggcuuguaaaucaaugggugcccuugccuuguguguauuuguaaucuggacuucugucagaggccccaucacggaguucuagaggcaggacuuagcugcaccagaaggccuucauucccacccccccuccagccaucccaaguagaccucuguuacacaaggagucuguugguugcaaauggcuucuuccagacaaacccucauuccccucccccagacuauuacuaagagcccaccuccccacucaauuagaauuucccaggcauccagggaaaguugggcagucaaggcuagaggucguggggggguggggugggcgggggcggggcuuuuuucuccucacaacaacuuccuucugcaggcccaggccaaggcaaaggc

SEQ ID NO: 11445 - RNA, 1778 nt, Mus musculus
cauuucucugcauuguuuuuuugggacggucugguucucugucucagaggcacgagggauccguuuucauucagcauaugaccaacauggaccgguccuucugagggcuacccauucaacauaucagcugggauuagccacuucacagggugccuuuauuggggucucugccacagauaggggcagagugaagagagguuuccuauaucccaaguuugccuuuaugauaucuccuagagggcugagccaccugagaaggugaaagcagucauaucauuugaugucagcaacgauaagacaucagggcugcuacucaaacccagacuccuguuaacuuccagaaucauggcucauggucccaggguucuuucccucuucacacuaccugggccaccagcacaggccucguugcucaccuuuacaguaagucauaaauaaaucuuuaagccucagucugacccuggugguuacaagagguauggaggggauggaacccccagcauaaacagaguccuucccgcucccaagccuggcaaaccccucugugaccgcuaccucggccgggaucuggcgccuaucucagccgaggagaccucgccagggcccgcguggccgguuauuaauacccagaccggcgcauucccagcuggcagugggacaggugguggcggcagcgcaggagcgggcgcggcgugggacucuagggaggccggcgauccgcgaccacaccgugugcccagagcccaaauaggcucagaaccuugcuccgcgcugcccugguugggggagcgcucggggacguuccugcaacacagcuuuccauacgcgacauuagccaaccugugcacggugauggccauugggucucgaguaucugagugacaggacgcggcgcgucucuuaagccccgggcuggaaggcagccaaugacuucgugacauaggugagcgcacguucacgggcugcaaaaccugggacgcauggcccagggcgugcggagcguccggggaccccgaacccagcucgcaccucuugaucucggagggugcggcccugagggcuucgggagugccgggagcgcacgccgccuggccugugagcgcgguuuggccggcuucgcagcagcgccuggcacuggaaacuuucaucuucucugaacuggugucuucugcguccuuucgccuuccuagugaggcuggaggaccucagugucucuggagcugaccugugaggugagacagcagcggggcgagggcuucggagcagaugaagcuaggagcugcaagugcagggaccugaggaugcuuccucaccuuagaccugccgggauucuucagcuuugacuaaagggaaagaugacuucuagagguaucauucauuccuaggccuggauguuggagaggccuguacaaagaggucuucuuuacuccuucuuagaaagucuacccuuuagggcuuccuuuuucuugugaggcuaaccuaauccagucagcaggagucguaaguauacgaaccuuagagggguuuuuuguuuguuuguuugguugguugguugguugguugguugguugguuugguagagacaggguuucucuguguagcagcccugacuguccuggaacuugagauguagacuaggccggccucaaacccagagaucugcuugccucugccuccugauugcugccauuaaagaugucugccaccacagccuggcugaagcuuagaguuugggggauugggugguagggggugagggaguuguuauuguuuuguuu

SEQ ID NO: 11446 - RNA, 1778 nt, Mus musculus
aaacaaaacaauaacaacucccucacccccuaccacccaaucccccaaacucuaagcuucagccaggcugugguggcagacaucuuuaauggcagcaaucaggaggcagaggcaagcagaucucuggguuugaggccggccuagucuacaucucaaguuccaggacagucagggcugcuacacagagaaacccugucucuaccaaaccaaccaaccaaccaaccaaccaaccaaccaaacaaacaaacaaaaaaccccucuaagguucguauacuuacgacuccugcugacuggauuagguuagccucacaagaaaaaggaagcccuaaaggguagacuuucuaagaaggaguaaagaagaccucuuuguacaggccucuccaacauccaggccuaggaaugaaugauaccucuagaagucaucuuucccuuuagucaaagcugaagaaucccggcaggucuaaggugaggaagcauccucaggucccugcacuugcagcuccuagcuucaucugcuccgaagcccucgccccgcugcugucucaccucacaggucagcuccagagacacugagguccuccagccucacuaggaaggcgaaaggacgcagaagacaccaguucagagaagaugaaaguuuccagugccaggcgcugcugcgaagccggccaaaccgcgcucacaggccaggcggcgugcgcucccggcacucccgaagcccucagggccgcacccuccgagaucaagaggugcgagcuggguucgggguccccggacgcuccgcacgcccugggccaugcgucccagguuuugcagcccgugaacgugcgcucaccuaugucacgaagucauuggcugccuuccagcccggggcuuaagagacgcgccgcguccugucacucagauacucgagacccaauggccaucaccgugcacagguuggcuaaugucgcguauggaaagcuguguugcaggaacguccccgagcgcucccccaaccagggcagcgcggagcaagguucugagccuauuugggcucugggcacacgguguggucgcggaucgccggccucccuagagucccacgccgcgcccgcuccugcgcugccgccaccaccugucccacugccagcugggaaugcgccggucuggguauuaauaaccggccacgcgggcccuggcgaggucuccucggcugagauaggcgccagaucccggccgagguagcggucacagagggguuugccaggcuugggagcgggaaggacucuguuuaugcuggggguuccauccccuccauaccucuuguaaccaccagggucagacugaggcuuaaagauuuauuuaugacuuacuguaaaggugagcaacgaggccugugcugguggcccagguagugugaagagggaaagaacccugggaccaugagccaugauucuggaaguuaacaggagucuggguuugaguagcagcccugaugucuuaucguugcugacaucaaaugauaugacugcuuucaccuucucagguggcucagcccucuaggagauaucauaaaggcaaacuugggauauaggaaaccucucuucacucugccccuaucuguggcagagaccccaauaaaggcacccugugaaguggcuaaucccagcugauauguugaauggguagcccucagaaggaccgguccauguuggucauaugcugaaugaaaacggaucccucgugccucugagacagagaaccagaccgucccaaaaaaacaaugcagagaaaug

SEQ ID NO: 11447 - RNA, 1596 nt, Mus musculus
gugggagcaagcuagacagaggcccugggccauauuccccgucccugcuuuuccucucaaagacccuucucugcagccuccgccucaccccgcuuccucggccuugcuaccuccccagggagggagggagaaaagguggcccgccucugggucuugcugguggagcagagcuacgccggaaggaauuagcugguuuuauaaccuuguacacuuagccagcccuaacaaagucggaugcuucuguuacuuuaggccccucucacuguuggcagcuugagagcguccuaugcagggacagguuaggaguuuuuccugauucugcugcacacugggauuggaguuuccuguaaggaucccaccagucaguguggcgugccaugacagacccuuggaaaauagaugcugguccuaagugcccccauaggaccgucagggccagagaguucuauguauggaaacaaagcugucugugcguacaugcugcgcacugaguguguuucugagauggcugaugcgugguagccacagccuguuuucccacgcugguaucaaaggccugcagacugccaaaggcugccuagccucacuuuucagcccuacuugccuuccuuucccuccugauuuccaagcuagaucuuuggcugggcagaauugaagccaaaauuacuugcauuuccgccugaaauuaguuaaauuuucccuaucugucugcuuuaaugacuucaauggagauuaauaaaagccagaugacacacacauacuacaaccaccccacaaccccacccacauccuaccuuuggagggcccuacacaggguaaaaugugauguuugagcuccaaccaucccuuuucuccccacacaagccgaggcccuggacucuggcugcuggggccuacugucacagaaggaaggcaggcacccaaacucucuucccauacacaagccaccauccacccgaaacggccugccugagagggguccuucugauaccgagaggccaugacuuuaauuggauaccagcugcucuacccugaauuccccugagcuucaauuuguguauaguccccagucccccgcugaacacaaggcacuaccaucacugcucucgucccucuuggcgggaacucaaaggccacaacuccugcccuucuuucuucucccagggcuccaggcccaaggcuacacuagacccuucccccaaagaagcggaucuugagcuccgcuuggcuugaggggaaccugccagccuguucugaagagcggcucccacucccuuagcccucggagaccaagccuugacuggcuuagggguucgugaacaaugacuucgaagacaacuuuuucucuccagcaccugaggauaacuauagggaucauaguucaggaucgaaucgggcagaggcuugccucccccggcucgucuccagucaagaguagacgggaugggcuggugcgcagaagacgcguaaaguaccuugaguugcuuggucugugaagccggugauuguguccacacgcccgugcccugaagcugccgcgaccggagcccuccccgccaggcuccuguaaagcgacaucaugaagugguguggcac

SEQ ID NO: 11448 - RNA, 1596 nt, Mus musculus
gugccacaccacuucaugaugucgcuuuacaggagccuggcggggagggcuccggucgcggcagcuucagggcacgggcguguggacacaaucaccggcuucacagaccaagcaacucaagguacuuuacgcgucuucugcgcaccagcccaucccgucuacucuugacuggagacgagccgggggaggcaagccucugcccgauucgauccugaacuaugaucccuauaguuauccucaggugcuggagagaaaaaguugucuucgaagucauuguucacgaaccccuaagccagucaaggcuuggucuccgagggcuaagggagugggagccgcucuucagaacaggcuggcagguuccccucaagccaagcggagcucaagauccgcuucuuugggggaagggucuaguguagccuugggccuggagcccugggagaagaaagaagggcaggaguuguggccuuugaguucccgccaagagggacgagagcagugaugguagugccuuguguucagcgggggacuggggacuauacacaaauugaagcucaggggaauucaggguagagcagcugguauccaauuaaagucauggccucucgguaucagaaggaccccucucaggcaggccguuucggguggaugguggcuuguguaugggaagagaguuugggugccugccuuccuucugugacaguaggccccagcagccagaguccagggccucggcuuguguggggagaaaagggaugguuggagcucaaacaucacauuuuacccuguguagggcccuccaaagguaggaugugggugggguuguggggugguuguaguaugugugugucaucuggcuuuuauuaaucuccauugaagucauuaaagcagacagauagggaaaauuuaacuaauuucaggcggaaaugcaaguaauuuuggcuucaauucugcccagccaaagaucuagcuuggaaaucaggagggaaaggaaggcaaguagggcugaaaagugaggcuaggcagccuuuggcagucugcaggccuuugauaccagcgugggaaaacaggcuguggcuaccacgcaucagccaucucagaaacacacucagugcgcagcauguacgcacagacagcuuuguuuccauacauagaacucucuggcccugacgguccuaugggggcacuuaggaccagcaucuauuuuccaagggucugucauggcacgccacacugacuggugggauccuuacaggaaacuccaaucccagugugcagcagaaucaggaaaaacuccuaaccugucccugcauaggacgcucucaagcugccaacagugagaggggccuaaaguaacagaagcauccgacuuuguuagggcuggcuaaguguacaagguuauaaaaccagcuaauuccuuccggcguagcucugcuccaccagcaagacccagaggcgggccaccuuuucucccucccucccuggggagguagcaaggccgaggaagcggggugaggcggaggcugcagagaagggucuuugagaggaaaagcagggacggggaauauggcccagggccucugucuagcuugcucccac

SEQ ID NO: 11449 - RNA, 560 nt, Mus musculus
uuucuguagcccuauggggcacccgagugugcgcucaggaaccggaguucagcuauggcugcgcagaaggcagcugcuacccugccacuggcgaccuucucaucggccgagcgcaaaagcucuccgugacuucgacauguggacugcacaaaccagagcccuacuguauuguuagccaccugcagguaagacacgagucuagagaaugcauugugggcugcauccuccuccuggccgaucaaaggggcuugcccaggagacuccacauccugcugucaauccagauaggaaguacaaccagcagaggagccccgggaugaagccaguagcucagucccaaucuccauuugcacagucgcacccgccaaacauuuccugccaccuaacaccaccaucaguaggagaagcccggggcugcagaugagcuuagccucuguccugugcccuguacgguccccuguauuuuauucuguuguuauuuauacuguuugaucaaacccuuuugaaauuguguauuguagaugguucaguucucuucuugcauuguugguguuggguuu

SEQ ID NO: 11450 - RNA, 560 nt, Mus musculus
aaacccaacaccaacaaugcaagaagagaacugaaccaucuacaauacacaauuucaaaaggguuugaucaaacaguauaaauaacaacagaauaaaauacaggggaccguacagggcacaggacagaggcuaagcucaucugcagccccgggcuucuccuacugauggugguguuagguggcaggaaauguuuggcgggugcgacugugcaaauggagauugggacugagcuacuggcuucaucccggggcuccucugcugguuguacuuccuaucuggauugacagcaggauguggagucuccugggcaagccccuuugaucggccaggaggaggaugcagcccacaaugcauucucuagacucgugucuuaccugcagguggcuaacaauacaguagggcucugguuugugcaguccacaugucgaagucacggagagcuuuugcgcucggccgaugagaaggucgccaguggcaggguagcagcugccuucugcgcagccauagcugaacuccgguuccugagcgcacacucgggugccccauagggcuacagaaa

SEQ ID NO: 11451 - RNA, 950 nt, Mus musculus
cuguucaccucgccaccgugcuggguaucccccccccaucccccuccacucuccucgcugcccuccaccuagccaggcaccgccaccucauuccacccgcaucccuggcaagcaguucaguccccacaggggaaacagguccuagggucggggagaaccagugugcccaggagagguguaugugugugugcgcgugcgggggugugcaugacagaagauugagaaagucaagcauaggggccuugugcccaaaacgccaucccccaaaccccuuucuuucuucuuuaaaauucccuucuuaaaacaacuguuuccaaauuccacccccuccuuuccgcccacccacuuccucuugcccuugggcugaaauccuuccagguuguucagcgaaaauucucgcugguagugauaacagggcuuagcggucauagaaaacagccacagagacauccucaauaaccgacuuuccccucuggguuuuugcagaugucauuguuuccagagaaggagaaaauggacagucuagagacucuggagcuggauaacuaaaaauaaaucuauaugacaaagauuuucauggaaauuagaagagcagagaccaaauucacaagaaucagggcguggggcacacuuuuaaaagagaaagcgagacaggcccguggacagagauucccagaggggcagcagcagaccccccacaccucugcauucugauagaagucugaacacucguuuguguccccccaccccacuuuuugacgaagaauguuuuauuuuuauuuuucaugcaugcauucucaagaggucuugccaaucagccacugacaggaaaggcaucccuguggacuggcuccauuuuaaaaugguaacaaucagaggaauuuuaacaccuuuagaaauaaaaacgcugggaucaaacuggccugcaaaaucauagucagugaauuccu

SEQ ID NO: 11452 - RNA, 950 nt, Mus musculus
aggaauucacugacuaugauuuugcaggccaguuugaucccagcguuuuuauuucuaaagguguuaaaauuccucugauuguuaccauuuuaaaauggagccaguccacagggaugccuuuccugucaguggcugauuggcaagaccucuugagaaugcaugcaugaaaaauaaaaauaaaacauucuucgucaaaaagugggguggggggacacaaacgaguguucagacuucuaucagaaugcagagguguggggggucugcugcugccccucugggaaucucuguccacgggccugucucgcuuucucuuuuaaaagugugccccacgcccugauucuugugaauuuggucucugcucuucuaauuuccaugaaaaucuuugucauauagauuuauuuuuaguuauccagcuccagagucucuagacuguccauuuucuccuucucuggaaacaaugacaucugcaaaaacccagaggggaaagucgguuauugaggaugucucuguggcuguuuucuaugaccgcuaagcccuguuaucacuaccagcgagaauuuucgcugaacaaccuggaaggauuucagcccaagggcaagaggaagugggugggcggaaaggaggggguggaauuuggaaacaguuguuuuaagaagggaauuuuaaagaagaaagaaagggguuugggggauggcguuuugggcacaaggccccuaugcuugacuuucucaaucuucugucaugcacacccccgcacgcgcacacacacauacaccucuccugggcacacugguucuccccgacccuaggaccuguuuccccuguggggacugaacugcuugccagggaugcggguggaaugagguggcggugccuggcuagguggagggcagcgaggagaguggagggggaugggggggggauacccagcacgguggcgaggugaacag

SEQ ID NO: 11453 - RNA, 224 nt, Mus musculus
accuuaacgccgaucuuguuggauguacacguaacggaguggaccgaguccgccuuaauuggcuugaguggaggcucgggggcugccucgcguuuguuuuagcccggcgccagguuuuaggcagccaccagaggcggggcauaagcgcuaaagcaacaagacaauagaagccuacaucuugcccgagauaauuagcuuacaugcugaugacaagguaaacaccu

SEQ ID NO: 11454 - RNA, 224 nt, Mus musculus
agguguuuaccuugucaucagcauguaagcuaauuaucucgggcaagauguaggcuucuauugucuuguugcuuuagcgcuuaugccccgccucugguggcugccuaaaaccuggcgccgggcuaaaacaaacgcgaggcagcccccgagccuccacucaagccaauuaaggcggacucgguccacuccguuacguguacauccaacaagaucggcguuaaggu

SEQ ID NO: 11455 - RNA, 9512 nt, Mus musculus
aaaguggggaggugggcuccuuagcagggacugcuuggcugaaauuuuuuagauaggcuuuggcagaaguaagaaggaaagguuuucucuggucucagaagggaguuucuuggggcagauaaucugcaauagaagguccuaccugcuccuguccaaucuccaaugagagucaagggcaggcagcaagaagaagcacugcuuguuggcaccuggcuggagaccgaugcaggugggucgaccgcuguuaagcugcuugaagccugcagggcuccguugacccaugccaaaaugcgggcugagacauccuagucuggacuggaaauucaguugaaaauaccuguuugaaauguccucaaucuagucaacugggaagugacuucgcucaucucccauuuaggggcgacaacagaaggaauucgccugugguccacagccaaagcaagucucccaauccaggaaaaaucgcuuucucuucacuugauugccacgucucccagagcccacuaaagucauuuugucauuauguuuuaaacaugaaauaguucaucucuacgcugucuucaggguaaugcaaggaggggaugacuugaaauggauucuccaugcaucuccaggaaaggaaggcggugguagcagggacuccgcagagaaagcagcuaacuuuaucuaacacgggcacuuucaggucacucgggcccacuagcugugcuaauaaucaguccuaauuguauuguuucagggcaucucccgauuuuguucccacuauagugcuccggugacccacggagaaacacacaacagaugccaguacagauccccagaaaagugaauauuuucugugcuuugguugacauguuaacaugucaucccguggacaggucaugccagucgcaaaauaaauugagccgcagaacaaaauuucuucugguccugccuuggcccucuuuuugcuaugaggcugggcaccguuggaagaugcguggucccccuucuggcugcacucugcguucuugccccuggcucacaaguccuagggagggucagagcaaacagcuggaauucaagcgcgcuuucuggcucucuucuggucaacccugaccuauucagcuggcauucuguccauagugaggagucccaggaagcagguccucuuugacaggcucugggguuuggcuuaggggagguugucuuuccuaagauguggaggggguagggaguguuuacucccauuguagacaccugcagugcggagucuucuucuuuucuggggccuuuaguaaugagcuauucccggagagugggaaaccggaaagagcgaggguagugggagccuagcugggcuucacacuuuccucuuguuucauauguaaugcggccuucuuuaaaugucuuagguguucacauuugaucuacacgcguguuuuaucguuguaaaggccacugccacuuuggaaggcuaucauguuugacuucguggccucucacuaaauagugggaugagccagcaaagaaccagcccaccauucucuucccuuccuuuagaggaacuucuuuucaguuuuuagcuuucccagcccauagaggaaggaaaauccaugacccugagugccccccacccccaccccagggcggugaaagauccugcaaaguagggugugggagggagauagguguuuccaguaacgugaaaagaucggugcuuggguuuaacgcgauggcgcgugacgaagcgcggugcgcgacuuagaauucagcacaauguuaaggugaauugaagccuucgauuugcaaacgcccuucccagacuugucggagcuggagucaauccggcgccuguagguggcgcugcgaugaggugccggggugaagggaacucuggcugaagucugaaagacauuaaagggggaaaaaaaaaccugaagaaaauuuccacaacucccuuucugccucuccaccucggccugcuacuuuuauuucgggggaauagcggagauaauaccgcgggacucugagcucuauuaggggagagagcacagagaccgcuggacagagagauucuaccucacuguccagugucucgugcaaagaaaacauccugucaccagcuguccggagggaacgugcaaugauuuacuccuaggucgucgcaucaacgaauaugcuagugacugaccugaccgcuucuugugggcugaccuucaaaugccauaaaugaaccuucaaaugccauaaaugaaccuucaaaugucauaaaucgugucuaaagcccuaggucaacaguucgugcccauccaaagcuuggcuagucuagggcugccgacuggcccuaguaagugcucuucgaucccguagccugugagcagccccggaccccgacuguccgauaacccugcauagagcauaaccugaccacaguaacccgcacucaauucccggccuucacaauugcuguccugaaaucagaauuagaggcgcagccugguucuccuuuaucuuuuccaggcagcuuuaggcuaauagggucuuuccaggagucugccucauugagcuagcacaacaaacgcccauggggaagcucacaaaccacuguacuaaagggccccgcaguuuugcuuccccucuccccacgucccgccccccagcugcagcucucaaagucgaguggaagcguaaggucauucauugaaagaccaaggccagcuuccucgccaucauacauucacuacuaaaauugcaacccuggcaaaagcgaggucuccucuggacaauuacagggucaacggggccuuccccgacccccaaacuccuccuagucgccuucucucaguagagaccugauucaugcucgcaauugcugucccucagccaggaguauugcuccuugaacaaaaauacauucucauucucucucuaucucugucucucucucugucugucucugucucugucucugucucugucugucucucucucucuaauaaacaaacgcaaucauaccauaggaggcucaaagccauccuucuaaaagcaauuccacuguugaaaacugaaaaauggguguaauuugcguucagaaagugauguuagggucacggcaauuucccgggccguuauuuauuuuuacuuuaaagucuuuagggaagauuugcuuauagacucggauacaguaugagaaccccggcaaccccgcucgccuucaaagcgggagggggccugaagguggagaacaauuacugagugacgcuaauauggggaaacugaaaagaaaugucgauuguuuuuauuguaacagaaggagugagcaaacagaaaaaccaaccccggcugaucggaaacaggcaggcggagaaugaaaaguggguuucaggccgcaacaggccccucccuccccuggccugggaaggagcgagccgggcuaagcgcucgcuggacuccagcacuggcaucucgcgaccguccagccccugcucuccggggacgucuucccagcucucgcccacccucccgcagccucaccugccgcagaggaggaagccuucucgguaugcgagguuccuccaucuggcggaaggcugaacagccaguaagcaacgcuucgguagucagugggcuccaauugaaguccccugaagcuucuggcugcgcggguucguccacagcgucgucgucgccagcgagccaagggcaacaggucagugugagcgccccucucgcgcuacccuauccuucccugucagaagaucccuguagcuggcuccguccucagcccccagugcuuguuucuucuagcugcagccacccgccgcuugggacauagaguugcugggcgagccuucuugggugaaccuggccuggcugugguugcggggcgcgccgguugcccugacacuuucuggggagcuuaguugggugcgcugaacacugacccugcaaggcugggcccuaacugggaggccagauccgaaugagucuaguugcuuuuuuuuuaaagucaagugcaaugccacacucaccuaacacaggcgugcuguagaggaacucaacucgagguccagccuuugccugaaaacuucccccagacagcugcaagaacucacaguacugguuuuugugugucuuucuuucuuuucuuucuuucuuucuuucuuucuuucuuucuuucuuucuuucuuucuuucuuucuuucuuucuuuccuucuuucuuuuucuuauccauguccaggagcuguccuggacacuggcugcuucccaaggagcuucgguagggcauagugaccuggaccuugcuugacccaguaugcuccuagcaggggacaaguugcagaguucggugccuacauacucugcucuaacucccguguucaccucaaccgcgaguagaaaaagagacccuuccauucucgcgccucccccuacuuucucuuccacggucgcagucgaccuccagggacacagacgcugaguacucaccgagaucaagugagugcucacacacagccuagagugcugccuuccgauggcggcggcgacugcccggauacucugugagccgccgugggaagagcuagauuccacuuccugcgcaucucuccucagaccucgcucgugcccaaagggacuuggugcacugcaaguggcgggcccguggcauugggaccacugacagauuuaugaagacuuuacaagcaucgagccugggucguuggaggcaggguugaguucaacagaggaggagaagcccuggagauaaaacuccgcagcacugugcgggccuagcugccccugcauuucugggcuuggcuuccacagugggcugcccggugccaaguguguagaauccugguguaaccuccuccuucacacccucugguccucuagcuuccagucuccuacugaguaaauauuuacccagagaaggggucgccccagaggaggccuuggaguuuagagaaaggcuuuugguuuccuucuggcccgagccagcugcaggccuuucugguuguguuuugguuuuggucuuagauuuuuccuuucaguaaaaauucuccugauucccccaugaccucuuggauccagaucucaguaaccaggggcccuggaccucagugacccuugcucuuucuugaaguccugcaucucuauguccacuagggcucacuggagggcucucuucuccaucuccuacccucuucuacccacuccuucauuucuugucucucaccucacacaucuccgcccuccugguuuuugcuaagacuccugggaucuguggcuacuugaucccuagggcacugugugcccuugcuugggaaggggaguuuccucacaggccccuucuuggagaugacauggcucuccucuauuccagcaucuucgguuuauaaggucucuaagcaccggguggucaugggcgcugaaaguggcccaaagugcccaagguugauuuauucugggccuccaagaauauucugguaggagagccugagggacacugaggagacccaguaaaaugcuguccgcgcaugcccagggagaucaccaacagccagguccaacagauagaaagaaaaaaaaaaaaccgauagaugaccaacaguagaccugugcaagagcaagggaggugugcgacagcuaaagggggcggcaguagauguuauguacuaaaccccaaacuagacacacaggucucuugaucacuccggguugauguagcuagauucucauuaggacaccacaucuugcuaguccacacgggcuggggcacuaucucuguacaccaguucagaagggugugaaauacucagugggugcacggaaguagagcaaagagcacacucagagaacacuucuugcccgugaggaugaagguuccucaucacggagcagagcacaguaucuucugugagcaagucucaggcgaaguucugaucuccacucagucucugaguugcaaguaauuuauacuauagcauggggcugggggugcuucugaaaucuuggcuuuccuuguuauaaagcaccugacuacgcaauacaaguauugagcggagacaaggaugaaaccacaaagucgagccuugaaaugacuuugaacaucugaaaccaacaaauaaaggggggggggggcuauguucaaguauuucuauuugugaagccucauuguggaaauaccugacugcaauaaaagacauuugaaguaaucuuucaauccuuaacuugauuguaacuugaauucagggugcacacccaccacagaagcagaugccuggagaucaauggucagcuccaagacugauuacuagacguccugggcucuugucauuuacuggugaacaucgggauuccucugauuucuuugugugcagaaccuucgggagagugcgcgcaucaccuacauccuggauauguguuaaagagagggcuguugugauggagacgaaguaauaucauccacuuuccggugucacacaaauacccgaauccauucacaaugcuucucuuccuuauuucguccacauacgucacaaccuugucuccauaaagaaaugcauuucucugucccaaacucuucuauccguuucggauuugggugaaugaaagugaaaaauccccagguaggcagaaccacacagcaucugugguagcuaagcugaagucgcggggaauuacauacagaugcucagaggcagugucagcggguaccuccuuggggcugacuuucauauuuaaaaucaaaccuuucaagguggcucuaugguguugagaacccuggcaaauucuuacacacggaaaccaggacccugggugagugaugcaagggggugggaugggauggacguggccacugccaccagcgcuccggggaucaacccuccuuccccguggacguccugugcuccucuuuagucugguuuuuuaauuuuuuuuuccucacugcaccuggccucugcuaggauccugcuugacugagguuuagccccucacugcuggacuaaccacuucgggcgggguacgggaaggagucucuuguccuuacaccucaagcgccuccuccacucgacuucuccccauccugagugaacuggaaggagauagaauuuguggacaagauucugacaguccccaaaggucagcaugacagguaguucucagucaucccuuaagggucgugccacuuguucucugagagcucuaaccuccaacuuuaauuugacaaauucaucucuuccccaaaagguguccucggucucuacccacuuaaaguuauucaaaccgagaccaaagcuucuguucgcuuauucagcauuuuuaucagcuugauuuugcacucuguuugcggcgccccugggaagacgucaaacacucuuauucauuguauuuagucacccaggugcggagccagccagaaacagacggcggaaggaguuucccggacugagcugucacucaccggccugcaccaauuacaacgcagauugcucgcgggcccaccucuuuuggggugugucacaagugagugauagacugagccgcccggcccugcucagcccagcccacguugcugcuuagauugaaaugcagaacucaagccucuuucagcccggcacagacuuccuuuuacucuuuccuuuggcacucuugucgccuccucccgggaagaagccaaggcacccucggcuuggagcagcgacaggccggcucagugagaacaagaaaaaaguuucuuucugggagugcggaacuggggccggguugguguacugcucagagcaaugggugaguggcugaugggggacguugucagauccgaggagggagggagcgagcaggcgagggcuagagggagggagcugaggcgcgccaccgcgcuguauugacucagacugcguccgucgagcuguaagcacccuccaagggucaguggcggaaaggguucugugagagccacugggugacaauugaugccauuuugcgauuuaagggaagagggccguggcauuggcgaaucucgcagcuccagugucaauccaaguuuuguugcacacguguuuacacuugcaagcaaaacagaacaaaaacaccccccccccagcuuucucuggacugcgucuaaccccgcagaagggagggguaaggcgguggaagggagcaagggccgaguguuuugguaccaggcaggcaaagaggggcgcgcuggagccucagaaccgauuuccccgccugcuucggagaguuuuaaguguccggaguugcccugggucucucuucuuguuuguuguugggaaucgcaaaguaggagcgaggucuggccgcagcuuguuuugagacguuuggcucaggccggaacagucugguuucggggcaaccccaguccuuauagaagggugucauaacccugccccuggacgcucuuggaggccgaguggcaggcggcugucccaagcaguuggugcgcguuguggcgcgcucugugcuccuuuugcagagccagccuucggggaggugaaccagcugggaggaguguucgugaacggaaggccgcugcccaacgccauucggcuucgcaucguggaauuagcccaacugggcauccgaccuugugacaucagccgccagcuacgggucucgcacggcugcgucagcaagauccuggcgcgcuacaacgagaccgguucgauuuugccgggagcuauuggggggagcaagccccgggucaccaccccuacuguggugaaacacauccggacuuacaagcagagggacccaggcaucuucgcuugggagauccgggaccgccugcuggcggauggcgugugcgacaaguacaacgugcccucggugaguuccaucagccguauucugcgcaacaagaucggcaacuuggcccagcagggucauuacgacucauacaagcagcaccagcccgcgccgcagcccgcgcugcccuacaaccacauuuacucauaucccagucccaucacggcggcagcagcuaaggugccuacaccaccuggggugccggccauccccggaucgguggccuugccgcgcaccuggcccuccucucacuccgucacggacauucugggcauccgcuccaucaccgaccaagguaaggagcucagaggcagugugcagagcggaguggguuccugcacgcguucgggaaccccaguaccuucggccucuagcgagugucuaucccaccaccuguggcucuuuucuuuuggaaaccuaaggagucuucccaggggguguccugaucucauuaacuugaaacucuugccccucuguuuccuugccacacacagucuccagccucaucucaaacuaccagacccauaacauacccccccccccaaacacaugguucgcauuuuccacccucccccgccucucgcgcacucagccucagccgggcuagacuguuuggagagcgcagccuggcgauuuggggagcacaagaggaggcccuagcaggcuuggggcugcggguuguagguagccacugu

SEQ ID NO: 11456 - RNA, 9512 nt, Mus musculus
acaguggcuaccuacaacccgcagccccaagccugcuagggccuccucuugugcuccccaaaucgccaggcugcgcucuccaaacagucuagcccggcugaggcugagugcgcgagaggcgggggaggguggaaaaugcgaaccauguguuuggggggggggguauguuaugggucugguaguuugagaugaggcuggagacuguguguggcaaggaaacagaggggcaagaguuucaaguuaaugagaucaggacacccccugggaagacuccuuagguuuccaaaagaaaagagccacagguggugggauagacacucgcuagaggccgaagguacugggguucccgaacgcgugcaggaacccacuccgcucugcacacugccucugagcuccuuaccuuggucggugauggagcggaugcccagaauguccgugacggagugagaggagggccaggugcgcggcaaggccaccgauccggggauggccggcaccccaggugguguaggcaccuuagcugcugccgccgugaugggacugggauaugaguaaaugugguuguagggcagcgcgggcugcggcgcgggcuggugcugcuuguaugagucguaaugacccugcugggccaaguugccgaucuuguugcgcagaauacggcugauggaacucaccgagggcacguuguacuugucgcacacgccauccgccagcaggcggucccggaucucccaagcgaagaugccugggucccucugcuuguaaguccggauguguuucaccacaguagggguggugacccggggcuugcuccccccaauagcucccggcaaaaucgaaccggucucguuguagcgcgccaggaucuugcugacgcagccgugcgagacccguagcuggcggcugaugucacaaggucggaugcccaguugggcuaauuccacgaugcgaagccgaauggcguugggcagcggccuuccguucacgaacacuccucccagcugguucaccuccccgaaggcuggcucugcaaaaggagcacagagcgcgccacaacgcgcaccaacugcuugggacagccgccugccacucggccuccaagagcguccaggggcaggguuaugacacccuucuauaaggacugggguugccccgaaaccagacuguuccggccugagccaaacgucucaaaacaagcugcggccagaccucgcuccuacuuugcgauucccaacaacaaacaagaagagagacccagggcaacuccggacacuuaaaacucuccgaagcaggcggggaaaucgguucugaggcuccagcgcgccccucuuugccugccugguaccaaaacacucggcccuugcucccuuccaccgccuuaccccucccuucugcgggguuagacgcaguccagagaaagcugggggggggguguuuuuguucuguuuugcuugcaaguguaaacacgugugcaacaaaacuuggauugacacuggagcugcgagauucgccaaugccacggcccucuucccuuaaaucgcaaaauggcaucaauugucacccaguggcucucacagaacccuuuccgccacugacccuuggagggugcuuacagcucgacggacgcagucugagucaauacagcgcgguggcgcgccucagcucccucccucuagcccucgccugcucgcucccucccuccucggaucugacaacgucccccaucagccacucacccauugcucugagcaguacaccaacccggccccaguuccgcacucccagaaagaaacuuuuuucuuguucucacugagccggccugucgcugcuccaagccgagggugccuuggcuucuucccgggaggaggcgacaagagugccaaaggaaagaguaaaaggaagucugugccgggcugaaagaggcuugaguucugcauuucaaucuaagcagcaacgugggcugggcugagcagggccgggcggcucagucuaucacucacuugugacacaccccaaaagaggugggcccgcgagcaaucugcguuguaauuggugcaggccggugagugacagcucaguccgggaaacuccuuccgccgucuguuucuggcuggcuccgcaccugggugacuaaauacaaugaauaagaguguuugacgucuucccaggggcgccgcaaacagagugcaaaaucaagcugauaaaaaugcugaauaagcgaacagaagcuuuggucucgguuugaauaacuuuaaguggguagagaccgaggacaccuuuuggggaagagaugaauuugucaaauuaaaguuggagguuagagcucucagagaacaaguggcacgacccuuaagggaugacugagaacuaccugucaugcugaccuuuggggacugucagaaucuuguccacaaauucuaucuccuuccaguucacucaggauggggagaagucgaguggaggaggcgcuugagguguaaggacaagagacuccuucccguaccccgcccgaagugguuaguccagcagugaggggcuaaaccucagucaagcaggauccuagcagaggccaggugcagugaggaaaaaaaaauuaaaaaaccagacuaaagaggagcacaggacguccacggggaaggaggguugauccccggagcgcugguggcaguggccacguccaucccaucccacccccuugcaucacucacccaggguccugguuuccguguguaagaauuugccaggguucucaacaccauagagccaccuugaaagguuugauuuuaaauaugaaagucagccccaaggagguacccgcugacacugccucugagcaucuguauguaauuccccgcgacuucagcuuagcuaccacagaugcugugugguucugccuaccuggggauuuuucacuuucauucacccaaauccgaaacggauagaagaguuugggacagagaaaugcauuucuuuauggagacaagguugugacguauguggacgaaauaaggaagagaagcauugugaauggauucggguauuugugugacaccggaaaguggaugauauuacuucgucuccaucacaacagcccucucuuuaacacauauccaggauguaggugaugcgcgcacucucccgaagguucugcacacaaagaaaucagaggaaucccgauguucaccaguaaaugacaagagcccaggacgucuaguaaucagucuuggagcugaccauugaucuccaggcaucugcuucuguggugggugugcacccugaauucaaguuacaaucaaguuaaggauugaaagauuacuucaaaugucuuuuauugcagucagguauuuccacaaugaggcuucacaaauagaaauacuugaacauagccccccccccccuuuauuuguugguuucagauguucaaagucauuucaaggcucgacuuugugguuucauccuugucuccgcucaauacuuguauugcguagucaggugcuuuauaacaaggaaagccaagauuucagaagcacccccagccccaugcuauaguauaaauuacuugcaacucagagacugaguggagaucagaacuucgccugagacuugcucacagaagauacugugcucugcuccgugaugaggaaccuucauccucacgggcaagaaguguucucugagugugcucuuugcucuacuuccgugcacccacugaguauuucacacccuucugaacugguguacagagauagugccccagcccguguggacuagcaagaugugguguccuaaugagaaucuagcuacaucaacccggagugaucaagagaccugugugucuaguuugggguuuaguacauaacaucuacugccgcccccuuuagcugucgcacaccucccuugcucuugcacaggucuacuguuggucaucuaucgguuuuuuuuuuuucuuucuaucuguuggaccuggcuguuggugaucucccugggcaugcgcggacagcauuuuacugggucuccucagugucccucaggcucuccuaccagaauauucuuggaggcccagaauaaaucaaccuugggcacuuugggccacuuucagcgcccaugaccacccggugcuuagagaccuuauaaaccgaagaugcuggaauagaggagagccaugucaucuccaagaaggggccugugaggaaacuccccuucccaagcaagggcacacagugcccuagggaucaaguagccacagaucccaggagucuuagcaaaaaccaggagggcggagaugugugaggugagagacaagaaaugaaggaguggguagaagaggguaggagauggagaagagagcccuccagugagcccuaguggacauagagaugcaggacuucaagaaagagcaagggucacugagguccagggccccugguuacugagaucuggauccaagaggucaugggggaaucaggagaauuuuuacugaaaggaaaaaucuaagaccaaaaccaaaacacaaccagaaaggccugcagcuggcucgggccagaaggaaaccaaaagccuuucucuaaacuccaaggccuccucuggggcgaccccuucucuggguaaauauuuacucaguaggagacuggaagcuagaggaccagagggugugaaggaggagguuacaccaggauucuacacacuuggcaccgggcagcccacuguggaagccaagcccagaaaugcaggggcagcuaggcccgcacagugcugcggaguuuuaucuccagggcuucuccuccucuguugaacucaacccugccuccaacgacccaggcucgaugcuuguaaagucuucauaaaucugucaguggucccaaugccacgggcccgccacuugcagugcaccaagucccuuugggcacgagcgaggucugaggagagaugcgcaggaaguggaaucuagcucuucccacggcggcucacagaguauccgggcagucgccgccgccaucggaaggcagcacucuaggcugugugugagcacucacuugaucucggugaguacucagcgucugugucccuggaggucgacugcgaccguggaagagaaaguagggggaggcgcgagaauggaagggucucuuuuucuacucgcgguugaggugaacacgggaguuagagcagaguauguaggcaccgaacucugcaacuuguccccugcuaggagcauacugggucaagcaagguccaggucacuaugcccuaccgaagcuccuugggaagcagccaguguccaggacagcuccuggacauggauaagaaaaagaaagaaggaaagaaagaaagaaagaaagaaagaaagaaagaaagaaagaaagaaagaaagaaagaaagaaagaaaagaaagaaagacacacaaaaaccaguacugugaguucuugcagcugucugggggaaguuuucaggcaaaggcuggaccucgaguugaguuccucuacagcacgccuguguuaggugaguguggcauugcacuugacuuuaaaaaaaaagcaacuagacucauucggaucuggccucccaguuagggcccagccuugcagggucaguguucagcgcacccaacuaagcuccccagaaagugucagggcaaccggcgcgccccgcaaccacagccaggccagguucacccaagaaggcucgcccagcaacucuaugucccaagcggcggguggcugcagcuagaagaaacaagcacugggggcugaggacggagccagcuacagggaucuucugacagggaaggauaggguagcgcgagaggggcgcucacacugaccuguugcccuuggcucgcuggcgacgacgacgcuguggacgaacccgcgcagccagaagcuucaggggacuucaauuggagcccacugacuaccgaagcguugcuuacuggcuguucagccuuccgccagauggaggaaccucgcauaccgagaaggcuuccuccucugcggcaggugaggcugcgggagggugggcgagagcugggaagacguccccggagagcaggggcuggacggucgcgagaugccagugcuggaguccagcgagcgcuuagcccggcucgcuccuucccaggccaggggagggaggggccuguugcggccugaaacccacuuuucauucuccgccugccuguuuccgaucagccgggguugguuuuucuguuugcucacuccuucuguuacaauaaaaacaaucgacauuucuuuucaguuuccccauauuagcgucacucaguaauuguucuccaccuucaggcccccucccgcuuugaaggcgagcgggguugccgggguucucauacuguauccgagucuauaagcaaaucuucccuaaagacuuuaaaguaaaaauaaauaacggcccgggaaauugccgugacccuaacaucacuuucugaacgcaaauuacacccauuuuucaguuuucaacaguggaauugcuuuuagaaggauggcuuugagccuccuaugguaugauugcguuuguuuauuagagagagagagacagacagagacagagacagagacagagacagacagagagagagacagagauagagagagaaugagaauguauuuuuguucaaggagcaauacuccuggcugagggacagcaauugcgagcaugaaucaggucucuacugagagaaggcgacuaggaggaguuugggggucggggaaggccccguugacccuguaauuguccagaggagaccucgcuuuugccaggguugcaauuuuaguagugaauguaugauggcgaggaagcuggccuuggucuuucaaugaaugaccuuacgcuuccacucgacuuugagagcugcagcuggggggcgggacguggggagaggggaagcaaaacugcggggcccuuuaguacagugguuugugagcuuccccaugggcguuuguugugcuagcucaaugaggcagacuccuggaaagacccuauuagccuaaagcugccuggaaaagauaaaggagaaccaggcugcgccucuaauucugauuucaggacagcaauugugaaggccgggaauugagugcggguuacuguggucagguuaugcucuaugcaggguuaucggacagucgggguccggggcugcucacaggcuacgggaucgaagagcacuuacuagggccagucggcagcccuagacuagccaagcuuuggaugggcacgaacuguugaccuagggcuuuagacacgauuuaugacauuugaagguucauuuauggcauuugaagguucauuuauggcauuugaaggucagcccacaagaagcggucaggucagucacuagcauauucguugaugcgacgaccuaggaguaaaucauugcacguucccuccggacagcuggugacaggauguuuucuuugcacgagacacuggacagugagguagaaucucucuguccagcggucucugugcucucuccccuaauagagcucagagucccgcgguauuaucuccgcuauucccccgaaauaaaaguagcaggccgagguggagaggcagaaagggaguuguggaaauuuucuucagguuuuuuuuucccccuuuaaugucuuucagacuucagccagaguucccuucaccccggcaccucaucgcagcgccaccuacaggcgccggauugacuccagcuccgacaagucugggaagggcguuugcaaaucgaaggcuucaauucaccuuaacauugugcugaauucuaagucgcgcaccgcgcuucgucacgcgccaucgcguuaaacccaagcaccgaucuuuucacguuacuggaaacaccuaucucccucccacacccuacuuugcaggaucuuucaccgcccugggguggggguggggggcacucagggucauggauuuuccuuccucuaugggcugggaaagcuaaaaacugaaaagaaguuccucuaaaggaagggaagagaauggugggcugguucuuugcuggcucaucccacuauuuagugagaggccacgaagucaaacaugauagccuuccaaaguggcaguggccuuuacaacgauaaaacacgcguguagaucaaaugugaacaccuaagacauuuaaagaaggccgcauuacauaugaaacaagaggaaagugugaagcccagcuaggcucccacuacccucgcucuuuccgguuucccacucuccgggaauagcucauuacuaaaggccccagaaaagaagaagacuccgcacugcaggugucuacaaugggaguaaacacucccuacccccuccacaucuuaggaaagacaaccuccccuaagccaaaccccagagccugucaaagaggaccugcuuccugggacuccucacuauggacagaaugccagcugaauaggucaggguugaccagaagagagccagaaagcgcgcuugaauuccagcuguuugcucugacccucccuaggacuugugagccaggggcaagaacgcagagugcagccagaagggggaccacgcaucuuccaacggugcccagccucauagcaaaaagagggccaaggcaggaccagaagaaauuuuguucugcggcucaauuuauuuugcgacuggcaugaccuguccacgggaugacauguuaacaugucaaccaaagcacagaaaauauucacuuuucuggggaucuguacuggcaucuguuguguguuucuccgugggucaccggagcacuauagugggaacaaaaucgggagaugcccugaaacaauacaauuaggacugauuauuagcacagcuagugggcccgagugaccugaaagugcccguguuagauaaaguuagcugcuuucucugcggagucccugcuaccaccgccuuccuuuccuggagaugcauggagaauccauuucaagucauccccuccuugcauuacccugaagacagcguagagaugaacuauuucauguuuaaaacauaaugacaaaaugacuuuagugggcucugggagacguggcaaucaagugaagagaaagcgauuuuuccuggauugggagacuugcuuuggcuguggaccacaggcgaauuccuucuguugucgccccuaaaugggagaugagcgaagucacuucccaguugacuagauugaggacauuucaaacagguauuuucaacugaauuuccaguccagacuaggaugucucagcccgcauuuuggcaugggucaacggagcccugcaggcuucaagcagcuuaacagcggucgacccaccugcaucggucuccagccaggugccaacaagcagugcuucuucuugcugccugcccuugacucucauuggagauuggacaggagcagguaggaccuucuauugcagauuaucugccccaagaaacucccuucugagaccagagaaaaccuuuccuucuuacuucugccaaagccuaucuaaaaaauuucagccaagcagucccugcuaaggagcccaccuccccacuuu

SEQ ID NO: 11457 - RNA, 1300 nt, Mus musculus
uagcgugacuuugcauguauagcucuucacgcuauacaaaaccucgcguuaauucuguuaccuguuuguaguccucuggcaauugaaaacuuugguaacacaauucacacacacacacacacacacacacacacacacacacacacacacacacacacccuguaaccgauaguugcugcugcucacaccaaagccuaggcuuuagagcuauaguucggaccaacuuaaaauucccaagugaaacucuacuugcuuucucuuaaugcuauucugcuuccuaauucucagcuuugagauguaagaaagcucuuucuaugggggucuucucuggugggccgaggugauugcaucaaaauuaaacuccugaaaguggucugagcgccuacuaaaaguuaucgguaagcgaaaucuccauccguagcagucgagauaauaacuagguggcuaaaaaacaagaguccugacguauaacugcuuauuugguaaucuaacagaaaauauugacguccuuaaauuuauguucaucagcaaauguaacuccaugugaaacuauaagagaugaauagauuucaaaaagaagacucaaaaaagagaugguucccaaagaaacacagaaacgaauaaauaaaucgccgcgaaggucuuuucggacucuguacuuuucuguacagaucuuaaaguacuuugggauuuauuucuaguccucucuccaagaucgcacgaggcuuucucgguaagcgcuuucgauaacgguaauuacacuuuugaagguaaucggcagcuguuucuagaaaauacuuucaauagguaguggcccugccuguaccugauucuccucgcaaugcuuuugugcacaauguaaaauaaacccagugaacaugccaccaaggggacaaugaagagaaacagguucuuggccccgaguucuggaaaaagauucuguucgcacuagcgccacccagcgguccuagagacgaacgaauagacacuuuucuacaaauggcuuuugaagaauuaaguuuuauaaaauuuagaaaucauucuuuacgaaaaacuccaacuucugcaacagaucauuuuuauccaaagacgucggcuaauuacauggugugaccgagaggccucccgguaagcgagcaccgacucucucaguuauucuuuacucaagccagagcccgccugcccgcccgcggcucccggggcugggcuccagccccggcucucuagcgggcaaagacaagugcuucccuuccggagcccguguuuucaaagcccagaguuucccaaaacucuccgcugg

SEQ ID NO: 11458 - RNA, 1300 nt, Mus musculus
ccagcggagaguuuugggaaacucugggcuuugaaaacacgggcuccggaagggaagcacuugucuuugcccgcuagagagccggggcuggagcccagccccgggagccgcgggcgggcaggcgggcucuggcuugaguaaagaauaacugagagagucggugcucgcuuaccgggaggccucucggucacaccauguaauuagccgacgucuuuggauaaaaaugaucuguugcagaaguuggaguuuuucguaaagaaugauuucuaaauuuuauaaaacuuaauucuucaaaagccauuuguagaaaagugucuauucguucgucucuaggaccgcuggguggcgcuagugcgaacagaaucuuuuuccagaacucggggccaagaaccuguuucucuucauuguccccuugguggcauguucacuggguuuauuuuacauugugcacaaaagcauugcgaggagaaucagguacaggcagggccacuaccuauugaaaguauuuucuagaaacagcugccgauuaccuucaaaaguguaauuaccguuaucgaaagcgcuuaccgagaaagccucgugcgaucuuggagagaggacuagaaauaaaucccaaaguacuuuaagaucuguacagaaaaguacagaguccgaaaagaccuucgcggcgauuuauuuauucguuucuguguuucuuugggaaccaucucuuuuuugagucuucuuuuugaaaucuauucaucucuuauaguuucacauggaguuacauuugcugaugaacauaaauuuaaggacgucaauauuuucuguuagauuaccaaauaagcaguuauacgucaggacucuuguuuuuuagccaccuaguuauuaucucgacugcuacggauggagauuucgcuuaccgauaacuuuuaguaggcgcucagaccacuuucaggaguuuaauuuugaugcaaucaccucggcccaccagagaagacccccauagaaagagcuuucuuacaucucaaagcugagaauuaggaagcagaauagcauuaagagaaagcaaguagaguuucacuugggaauuuuaaguugguccgaacuauagcucuaaagccuaggcuuuggugugagcagcagcaacuaucgguuacagggugugugugugugugugugugugugugugugugugugugugugugugugugugaauuguguuaccaaaguuuucaauugccagaggacuacaaacagguaacagaauuaacgcgagguuuuguauagcgugaagagcuauacaugcaaagucacgcua

SEQ ID NO: 11459 - RNA, 3985 nt, Mus musculus
cucuggacccaaagagcugugcugcgggagaaggaccugggugguggcaucagagcuacagcgcaaggaucgugcucgcugaaugaccccgaguucccuccuagaggugcucaccacccccuggaccuuacuacgacuccgcucuugguccacuuggcuccuuugcuccccucauccugauucuugacccaaaguucaacccuggaagacuaccccuacuucccggccuucggggcuuggagaggggaaaagccccacuuuugccucgucacuagaaacccagucaucugagucagccgagcaaagugacguuaggccgaccugggcuccuggcgagcagaacggaggcgcugccacgaaacucguaccugcggcuaagagcaggugagucacagcaccguuuuauauuuuuaugacauaacuuuuuuuuuccgccucaguccacuccacuccccuugucaacugcagcgaucagaaagaggaagaaacugcgcgcagauguuugugugauaaggcaggcggauccuagucaagccugccucucugccgggcuccuccuccuccuccucccccccuucuacagccucugggaccaagcuagaggcgaccgucugguuucugauagagaaaggucagggggaggggacaucuuccuaaacaccggcauaaacugggaguguaugggccugggugcuggaacgcaucugccacgcuaaaugaggugccagccugaagcuggagucagcccacagaggugccuggucgucucugagcuggaagagcagggcuaggcuaucagacucucaaaagguccuggguagauggggaaaauucucccccacucaaagucucucgcuuucuuccaguucuucauaguuaguggcuugcccucguauccagcggaaagagacuaaccaaagagauuaggcuagacagagugugugauagguuuggagaaggugcuuacccccccccccauugacugcaaguguucgugaaaauguauacuaccucgugcauuucgaaguaagugugacugugcggcccuuccuguguguugcuccagucuguagguauacuagauuuccauuagaaacaaucaaguuaacuuuaaagucaccaagagacuaaaauauucuugguuugcaaagcuuuuuuuuuaagguaauuaaucucaugugaaggaauguguuuucacuugucuuccaaauagauuaccccccccccaacacacacacacuccgugcuuuguucuuuuaaaucuuucuucccugaaaucuggcaagagaaucagguuaaauccuugaaccaaauaaaucucuuagaucaguaggagagcagagaaggugaagauguguaguuaaggaaauaaaaaaaaagauaaaagcauuggauuacaauuccuuuuugaacaaaaaguguguguguguguguguguguguguguguguguguguguguguguguguagacaucacauuauaagcaaaggaaugagagugaaauuaaauccgccuggaacacaacagagcagacaacucuccccaacugcaauuugccccugugacuagaagucacucccaucggcuguguaaauguaccuguggauauaugucagaaacuaauucuuuuugcaaaguucccaccgacagcaggaucuccguuucauuuguaaaacgcggggaugcguggcuuccucagucugguccuggggacuuccagcagggccgagaagcuuccuuguuccugcaugguugauugucugauguccucuuggcuuuucuacagcagcagcuagcaugacuuggacgguuccuguggguaguaacaacuuagcaauauauauauauauauaguguauaacaaguugaugacuuuuggggggcccugucauguggaaggaguuaauuaaaauaucacacguccuuucagcccgguuuccaaaucuacuuugccccccuuucaagucuacuuaaaaggcgaagggggccauucauagcgugagaccacauugaaguuucucaaaagcaucgucaaaauccgagagugguguuacagaauggacucugcucccuuuaaagccuugauccggguguucuuggguuuguggcaacaacacagcgccuccugcacguacguucccgcaaugccggcgggcuagacuggauugaaccggggaaggugccaggcagcaggggcuuugacucagaguggacugaagccacgaaguaggaaaagcaguacuucaguuacuucuuugcauuuagugaaggccuuuguggacaccuaacaaauucuguuggugaaguuguuuagugcaccaagagaccagguucccccagauuaaaaagugaaacaguggggucauuuccuucuaagucuucgacuuggcaaccgcaccuccccccaacccgcguggcggcgggagggaggggaagcgaagggcuguugccuucacuuucugcuuaguugguacccagauaaggaguccaagcauccuaaaccuuguuguaucuaacaucuuuccaccaguaggccccuaugacauagaagacagggcaauuauaccugccuucaacuugggggcggcggcgggggguggugguggacugagagaacgcaagagaagggaaccacgccacguggucucuucugugaugcccauaccgaacuugcccaggaucaggauugucggccauagccuaggucgccccagguagccuaaaggcuaaaguauauccaggaagccaagggcagucgggaaggcggucugcucugguaugccagucgguuucaacagaggaagcagcucugucaugccuggaagcugauccagcuauggccuucaaagcuaucugcucaaugccccaccaguagcacaaggucccuugacugacucuucugccuuagccuacccuucccagagugaccugggaaucccgcagguuaucacgggacagaaggacgcaagggauguggcaugaaaggaggacaaaaaaaauccccauaggauccugagaccagcuggugccucuugugaugcuagugaccuucgcuguguugcugaacuaagacagggcguagggcuucgagccuggaccaccccugcccggcccccguaguacccgcuggagucucuagagcgcucccucccuggaucucccuagugugcccccuuuccucgcugacucuaccucccaucuccccaggguuguggccaggucaaggccgcuguggccccaggcaugcucggugcuggguggucggaguuccuccccugggccccacccucucaccagauaagaagcuuaaauccuccuccugcggggggggggggauuagacucaaagcaacuaaguuaacuggguucaaagccaauucagacucagacccgcugaaggcugcacccagagaccugcacuggaagcguccccuugcacuugcugugcggcgcccugaggguucgaggugggcaaggcuggggagguagcuugggugccuucccagggugaagccagcucugguuaccccuggcccggcggcccuaaccagcgagugccacuacuacccaaacaagacugauaucaauucagggcaagcauucggguuccugcucuuucgcugcuccuucuuuucccaucuucacacgauccuuuuacucuuucuucugccauuaaaucuucgugaaggaaucaguucacggccugcaagaaguccagucuccaguaggugagagcccuggggccaccugauaggccaaaucaucuacuguucugagcccgcacaccuguucaggugugccuuugcgcuacacauauucgcauuuagggcuuucgguuauuuuguuuaaaacgaacaaaaacaggcauugaguuugucguucucucgcuccuugagcugucgccagguuucagaaaguccgggggaguccgugauccaggcuuguccguccgcagccggaugucuaagccggagcugcuccccac

SEQ ID NO: 11460 - RNA, 3985 nt, Mus musculus
guggggagcagcuccggcuuagacauccggcugcggacggacaagccuggaucacggacucccccggacuuucugaaaccuggcgacagcucaaggagcgagagaacgacaaacucaaugccuguuuuuguucguuuuaaacaaaauaaccgaaagcccuaaaugcgaauauguguagcgcaaaggcacaccugaacaggugugcgggcucagaacaguagaugauuuggccuaucagguggccccagggcucucaccuacuggagacuggacuucuugcaggccgugaacugauuccuucacgaagauuuaauggcagaagaaagaguaaaaggaucgugugaagaugggaaaagaaggagcagcgaaagagcaggaacccgaaugcuugcccugaauugauaucagucuuguuuggguaguaguggcacucgcugguuagggccgccgggccagggguaaccagagcuggcuucacccugggaaggcacccaagcuaccuccccagccuugcccaccucgaacccucagggcgccgcacagcaagugcaaggggacgcuuccagugcaggucucugggugcagccuucagcgggucugagucugaauuggcuuugaacccaguuaacuuaguugcuuugagucuaauccccccccccccgcaggaggaggauuuaagcuucuuaucuggugagaggguggggcccaggggaggaacuccgaccacccagcaccgagcaugccuggggccacagcggccuugaccuggccacaacccuggggagaugggagguagagucagcgaggaaagggggcacacuagggagauccagggagggagcgcucuagagacuccagcggguacuacgggggccgggcaggggugguccaggcucgaagcccuacgcccugucuuaguucagcaacacagcgaaggucacuagcaucacaagaggcaccagcuggucucaggauccuauggggauuuuuuuuguccuccuuucaugccacaucccuugcguccuucugucccgugauaaccugcgggauucccaggucacucugggaaggguaggcuaaggcagaagagucagucaagggaccuugugcuacugguggggcauugagcagauagcuuugaaggccauagcuggaucagcuuccaggcaugacagagcugcuuccucuguugaaaccgacuggcauaccagagcagaccgccuucccgacugcccuuggcuuccuggauauacuuuagccuuuaggcuaccuggggcgaccuaggcuauggccgacaauccugauccugggcaaguucgguaugggcaucacagaagagaccacguggcgugguucccuucucuugcguucucucaguccaccaccaccccccgccgccgcccccaaguugaaggcagguauaauugcccugucuucuaugucauaggggccuacugguggaaagauguuagauacaacaagguuuaggaugcuuggacuccuuaucuggguaccaacuaagcagaaagugaaggcaacagcccuucgcuuccccucccucccgccgccacgcggguuggggggaggugcgguugccaagucgaagacuuagaaggaaaugaccccacuguuucacuuuuuaaucugggggaaccuggucucuuggugcacuaaacaacuucaccaacagaauuuguuagguguccacaaaggccuucacuaaaugcaaagaaguaacugaaguacugcuuuuccuacuucguggcuucaguccacucugagucaaagccccugcugccuggcaccuuccccgguucaauccagucuagcccgccggcauugcgggaacguacgugcaggaggcgcuguguuguugccacaaacccaagaacacccggaucaaggcuuuaaagggagcagaguccauucuguaacaccacucucggauuuugacgaugcuuuugagaaacuucaauguggucucacgcuaugaauggcccccuucgccuuuuaaguagacuugaaaggggggcaaaguagauuuggaaaccgggcugaaaggacgugugauauuuuaauuaacuccuuccacaugacagggccccccaaaagucaucaacuuguuauacacuauauauauauauauauugcuaaguuguuacuacccacaggaaccguccaagucaugcuagcugcugcuguagaaaagccaagaggacaucagacaaucaaccaugcaggaacaaggaagcuucucggcccugcuggaaguccccaggaccagacugaggaagccacgcauccccgcguuuuacaaaugaaacggagauccugcugucggugggaacuuugcaaaaagaauuaguuucugacauauauccacagguacauuuacacagccgaugggagugacuucuagucacaggggcaaauugcaguuggggagaguugucugcucuguuguguuccaggcggauuuaauuucacucucauuccuuugcuuauaaugugaugucuacacacacacacacacacacacacacacacacacacacacacacacacacuuuuuguucaaaaaggaauuguaauccaaugcuuuuaucuuuuuuuuuauuuccuuaacuacacaucuucaccuucucugcucuccuacugaucuaagagauuuauuugguucaaggauuuaaccugauucucuugccagauuucagggaagaaagauuuaaaagaacaaagcacggaguguguguguguugggggggggguaaucuauuuggaagacaagugaaaacacauuccuucacaugagauuaauuaccuuaaaaaaaaagcuuugcaaaccaagaauauuuuagucucuuggugacuuuaaaguuaacuugauuguuucuaauggaaaucuaguauaccuacagacuggagcaacacacaggaagggccgcacagucacacuuacuucgaaaugcacgagguaguauacauuuucacgaacacuugcagucaauggggggggggguaagcaccuucuccaaaccuaucacacacucugucuagccuaaucucuuugguuagucucuuuccgcuggauacgagggcaagccacuaacuaugaagaacuggaagaaagcgagagacuuugagugggggagaauuuuccccaucuacccaggaccuuuugagagucugauagccuagcccugcucuuccagcucagagacgaccaggcaccucugugggcugacuccagcuucaggcuggcaccucauuuagcguggcagaugcguuccagcacccaggcccauacacucccaguuuaugccgguguuuaggaagauguccccucccccugaccuuucucuaucagaaaccagacggucgccucuagcuuggucccagaggcuguagaagggggggaggaggaggaggaggagcccggcagagaggcaggcuugacuaggauccgccugccuuaucacacaaacaucugcgcgcaguuucuuccucuuucugaucgcugcaguugacaaggggaguggaguggacugaggcggaaaaaaaaaguuaugucauaaaaauauaaaacggugcugugacucaccugcucuuagccgcagguacgaguuucguggcagcgccuccguucugcucgccaggagcccaggucggccuaacgucacuuugcucggcugacucagaugacuggguuucuagugacgaggcaaaaguggggcuuuuccccucuccaagccccgaaggccgggaaguagggguagucuuccaggguugaacuuugggucaagaaucaggaugaggggagcaaaggagccaaguggaccaagagcggagucguaguaagguccaggggguggugagcaccucuaggagggaacucggggucauucagcgagcacgauccuugcgcuguagcucugaugccaccacccagguccuucucccgcagcacagcucuuuggguccagag

SEQ ID NO: 11461 - RNA, 281 nt, Mus musculus
caggccucgucccugcccugcccccucugcggggccucccccgcccgcgucguacagcugggccagugacgcuggcgcagccgucgccaccgccgccgcguuccauccucaggagccggccaccgcucgcguccucguccucguccuccuccuucgucagcgcccggccgcgugagccagaccagggcacgcgaggcgucgcgggggacccgacagggagugcaggcaggcgggcgcgcucagcggcggagcggguucggcgacgcgggagcugcuagcgc

SEQ ID NO: 11462 - RNA, 281 nt, Mus musculus
gcgcuagcagcucccgcgucgccgaacccgcuccgccgcugagcgcgcccgccugccugcacucccugucgggucccccgcgacgccucgcgugcccuggucuggcucacgcggccgggcgcugacgaaggaggaggacgaggacgaggacgcgagcgguggccggcuccugaggauggaacgcggcggcgguggcgacggcugcgccagcgucacuggcccagcuguacgacgcgggcgggggaggccccgcagagggggcagggcagggacgaggccug

SEQ ID NO: 11463 - RNA, 1078 nt, Mus musculus
ccuuugcuccaccccgcccccagcccuauccccucuucagugcucacccggugagccgcccucgccgugcagccgcgggucgcugagggguuuccaggcgcgcgacagaaggugcagcccuggcugcuaucugcugcuggccccggggauggcuucuccgagucuggacagguggcuggacucgacgcagcugcuggguucgggguggccuccuggccucggccucugcgagccucccaggguuccccugggccggcugguuccacucagagggcgacaagccggggaccggcgcgucaggcucucggaacagacuguacaccuuggcugcagccgcugcgggguggcugcccacggggugccacaaccgauucgcaucccugcuagcugguucguaucucccuauggaaucccguugggcaugacuuguccccaucaagacagccaggacaaguggcaggaagccccuccaacgcacccgucggaugcauccggagcagcgagcgguggucggcgcucucauggcgccagaguggcugcagagcugugggcaccggagaccucgcggggaggugcuuuccaucguucgcuccacagacccgccuggcgacuugccccuucccgucuaggggaccucugaaacagccguuuggggguccagggguuccuagguaagggcuguauggcgugagcugcccgggcugcgcaccgagcccgagccugccgcaccuucgcucccgcacugccgccgucugaaggggaaccgaaggguuuuauuuuuggaaaccgcccccugcuuuuucgccucuuuuauccacgccaugccccccuccuuggagggacagcucggcccccuuauuacgggagacaagaauuccagcaacacccucuuuggcaccgagaagcgagcgggcggcgaggggauuaacccgugaggagcugcgggcgacagggcagacccggggacuggaaagacagauggcgucugccuggaccagcgcaccugagcugccuuuuuccuguccugggcaaacucaaguuguccaccuguccuggauguauuuucuguuccugaccu

SEQ ID NO: 11464 - RNA, 1078 nt, Mus musculus
aggucaggaacagaaaauacauccaggacagguggacaacuugaguuugcccaggacaggaaaaaggcagcucaggugcgcugguccaggcagacgccaucugucuuuccaguccccgggucugcccugucgcccgcagcuccucacggguuaauccccucgccgcccgcucgcuucucggugccaaagaggguguugcuggaauucuugucucccguaauaagggggccgagcugucccuccaaggaggggggcauggcguggauaaaagaggcgaaaaagcagggggcgguuuccaaaaauaaaacccuucgguuccccuucagacggcggcagugcgggagcgaaggugcggcaggcucgggcucggugcgcagcccgggcagcucacgccauacagcccuuaccuaggaaccccuggacccccaaacggcuguuucagagguccccuagacgggaaggggcaagucgccaggcgggucuguggagcgaacgauggaaagcaccuccccgcgaggucuccggugcccacagcucugcagccacucuggcgccaugagagcgccgaccaccgcucgcugcuccggaugcauccgacgggugcguuggaggggcuuccugccacuuguccuggcugucuugauggggacaagucaugcccaacgggauuccauagggagauacgaaccagcuagcagggaugcgaaucgguuguggcaccccgugggcagccaccccgcagcggcugcagccaagguguacagucuguuccgagagccugacgcgccgguccccggcuugucgcccucugaguggaaccagccggcccaggggaacccugggaggcucgcagaggccgaggccaggaggccaccccgaacccagcagcugcgucgaguccagccaccuguccagacucggagaagccauccccggggccagcagcagauagcagccagggcugcaccuucugucgcgcgccuggaaaccccucagcgacccgcggcugcacggcgagggcggcucaccgggugagcacugaagaggggauagggcugggggcgggguggagcaaagg

SEQ ID NO: 11465 - RNA, 3429 nt, Mus musculus
gggacugccugucuccuuucucaacauauugaguggcgucccucucucaaucagcgagcucuccgaaaggccucuagcuguccuuccaggcccgcgcuggccuccgggggaccccagcggccuggacaaaagucgggccacugcgggcggccgugaugauuugcgggauucuccgugaggcacggccgaaccgcgggaggcgcagccagccuagaucugcgcgcuggcggcugggcgaccugcgggaagguaggcgacccucugggcagaacgaaaacagaggcccaaagucgugcgucccggugccagcccgggaauugcaccgccaucgcgcaggccacucuccagcuacuccaggagagaccuggguagaggacuuccauaccauuuguggagauuccucucucacugauaagucugagauaacuucaacgcugucuaaagccguacaauaaaugcuaaguccucccuggcacuggaggagauccugggaccucuccuuauugcucuuccuggguuagagaaucauugcgguaaguuuggucccgccugggcgcagaacuaggcagugcgugggagcagccacccggaacuuaggaaagcguguaccuccgugcccuccagcccacccacgcauggccuaggacacuugauuugcuuacguugcaaauuggggguggugguaaggauuggauagagaccggcuucaguuggggaggugacaguuucuuguuuuuguuuuaagagaaacaaagucuucucgggaacgcuucagaaaggccaagcccaccuagagaagugaccuuuuuccauuacaaugacuuuacugucaccagguuccaggacacaccugcugcccuccaacauuuucccacguucgguucuaaagggagauaaauugauugacaagaacuggaggcugcagugacuucgcuguguucguuuguguuggugguugugaguggauaaggcgcaugcaggggcaggucucuuauaugaccuuuacagggguacaggcagaaacaggagagccugggguagauuccugaaccccugaaacuucugaaaggggacucagauccagacccgacagguacucagccucagauuugaaagagcaguggaauuuugaaaagaauaaaacaaacccacgcccacccauucaugucucuuucagcuugguacuuagugaucaguuuuaacaaguccgggauuucgcugcagggcucgauuucccgaagcccuguagcuauaucagugacccuagaaggaagaggcuguucaccuguagucaagggugccaggguucaagaccuaacauugccaccuggcaaacuaccccuccuuuggaggccucaggauuuuaaauaaucuaaccaaauccgagauuaauugaaucccuuaaaaccuuaguauuuaaugaguuuuuuucuuuucuuuucacugggacaaaggaguguguuggccccaccccugcccaaaggcaaaagcagggucucuucagcuggguucaagauaaagaaaaaucacuuggcucuuuuccuugaaaacaagacuuucccagaaagaagcucccggacccaagccucacaacuacauggguuuaaccgcuacacuccgggagagcucacccguggcguggcugagccuuccugguacaauuguccccucagcccaagguuguucuacuuugucggcugggaggcggacuccgugaaggaagucaggggcccagcucccucgcugugcuuucucugaggaaacccuacaaguguccccaacgcacuaggaacaauccagaauggccgggcgcaauugaaauaacaaaugcgaggcacgcaaauugucccccuccaguugcuaagcgauuguuugucgccccgcaugcccagcucagcaugggagaaccagcgaguccggaggcagccagcgaggcuucggugagaaauaaguaaacacgcaguugauuuucucuauuaucacacaaacacgauuucacacaaagcaaucaccacgcagaagucuaugaaaauguguuuguugggggacucacuugucccaguaauagcccucauuuuuaagcuauuaaagaccagaucaguggauuccacgugcauaagguauaucugcuguuuggggucuuuugaagacucugguaccaucaucaucuccgaauugauucggaguguugaauucaauugcuuuucuaauuuaaaaccuagagcccaaguuuggagugcucaucuggcuaucuuucagagggcugucuccccauuauccuuauaucccagccucaucgcuuuucucuucccuuggggauggggguggggugggggcgggggacgggucagaggccccaacuccucaggguuuauuucuuaaacacucaauuucuggccuguacauggagcaauuucuaauuagacauuuuagguaggguuuuuagguacgugguuuagguaggaguuuuuugagcuaugugcaaaaaaaaaaaaaaaaaaaaaaaaagcugaugcguccuuuucagaaguaugugagauacuguaagagagacauaggaauuaggaaaaauagacgaacccucacgggaaccagagcguacugagaccuccuacgguuuuaaccaagcaaauugguuuugcuguuugcauuuuggcuuuuuuuuuuuuccagugucucaaaaacaguuuccuguuucugcugcuccuuggaggaugucucaggagcuccgagugaucuuccuccgggaguuuggaacugugccgcugagcagagagcucagaaccaccuuaauguagggcacagccagcagaauguggggacugcggcuuccgauccuuggacauuagcuagcugauucuuuguuagaaauuuugcaaguucgaaauaaaauaacacuaaucaaaguguuaggaaagugccccagaauccugggagggaaaaggaugucccccuaaaugacgcguuucccagggccucgggaagagaaaauaacuugggcuucccgguuugcagagagcagcugaguuauuuacccaaagcucguuucaaagugacuccgcagcaccgaggcuuuuguaaaucacagaaugcaaaugaggauaauuuguucuuaaaggaacuuucucuugaaaugauuagcaaagucagucauuugaaaaaaaaaaaaaaagcggccagcacagaccuucccgaagccccuagcuaacccauaucagcuucuaacguuuucauucauguaaaccucauuaaugaagaucuuuuauuuaaacgucaaggggauuugaaauuuagaguaaauuaugaagcuuguaugucuagccaagucaugggucagaugcguuugugaaaaacugcuaaaagagcauaugguuuugaauucuucuacaaugacuaguguuuaaauaaauugcuuguacugcuuaacuu

SEQ ID NO: 11466 - RNA, 3429 nt, Mus musculus
aaguuaagcaguacaagcaauuuauuuaaacacuagucauuguagaagaauucaaaaccauaugcucuuuuagcaguuuuucacaaacgcaucugacccaugacuuggcuagacauacaagcuucauaauuuacucuaaauuucaaauccccuugacguuuaaauaaaagaucuucauuaaugagguuuacaugaaugaaaacguuagaagcugauauggguuagcuaggggcuucgggaaggucugugcuggccgcuuuuuuuuuuuuuuucaaaugacugacuuugcuaaucauuucaagagaaaguuccuuuaagaacaaauuauccucauuugcauucugugauuuacaaaagccucggugcugcggagucacuuugaaacgagcuuuggguaaauaacucagcugcucucugcaaaccgggaagcccaaguuauuuucucuucccgaggcccugggaaacgcgucauuuagggggacauccuuuucccucccaggauucuggggcacuuuccuaacacuuugauuaguguuauuuuauuucgaacuugcaaaauuucuaacaaagaaucagcuagcuaauguccaaggaucggaagccgcaguccccacauucugcuggcugugcccuacauuaaggugguucugagcucucugcucagcggcacaguuccaaacucccggaggaagaucacucggagcuccugagacauccuccaaggagcagcagaaacaggaaacuguuuuugagacacuggaaaaaaaaaaaagccaaaaugcaaacagcaaaaccaauuugcuugguuaaaaccguaggaggucucaguacgcucugguucccgugaggguucgucuauuuuuccuaauuccuaugucucucuuacaguaucucacauacuucugaaaaggacgcaucagcuuuuuuuuuuuuuuuuuuuuuuuuugcacauagcucaaaaaacuccuaccuaaaccacguaccuaaaaacccuaccuaaaaugucuaauuagaaauugcuccauguacaggccagaaauugaguguuuaagaaauaaacccugaggaguuggggccucugacccgucccccgcccccaccccacccccauccccaagggaagagaaaagcgaugaggcugggauauaaggauaauggggagacagcccucugaaagauagccagaugagcacuccaaacuugggcucuagguuuuaaauuagaaaagcaauugaauucaacacuccgaaucaauucggagaugaugaugguaccagagucuucaaaagaccccaaacagcagauauaccuuaugcacguggaauccacugaucuggucuuuaauagcuuaaaaaugagggcuauuacugggacaagugagucccccaacaaacacauuuucauagacuucugcguggugauugcuuugugugaaaucguguuugugugauaauagagaaaaucaacugcguguuuacuuauuucucaccgaagccucgcuggcugccuccggacucgcugguucucccaugcugagcugggcaugcggggcgacaaacaaucgcuuagcaacuggagggggacaauuugcgugccucgcauuuguuauuucaauugcgcccggccauucuggauuguuccuagugcguuggggacacuuguaggguuuccucagagaaagcacagcgagggagcugggccccugacuuccuucacggaguccgccucccagccgacaaaguagaacaaccuugggcugaggggacaauuguaccaggaaggcucagccacgccacgggugagcucucccggaguguagcgguuaaacccauguaguugugaggcuuggguccgggagcuucuuucugggaaagucuuguuuucaaggaaaagagccaagugauuuuucuuuaucuugaacccagcugaagagacccugcuuuugccuuugggcagggguggggccaacacacuccuuugucccagugaaaagaaaagaaaaaaacucauuaaauacuaagguuuuaagggauucaauuaaucucggauuugguuagauuauuuaaaauccugaggccuccaaaggagggguaguuugccagguggcaauguuaggucuugaacccuggcacccuugacuacaggugaacagccucuuccuucuagggucacugauauagcuacagggcuucgggaaaucgagcccugcagcgaaaucccggacuuguuaaaacugaucacuaaguaccaagcugaaagagacaugaaugggugggcguggguuuguuuuauucuuuucaaaauuccacugcucuuucaaaucugaggcugaguaccugucgggucuggaucugaguccccuuucagaaguuucagggguucaggaaucuaccccaggcucuccuguuucugccuguaccccuguaaaggucauauaagagaccugccccugcaugcgccuuauccacucacaaccaccaacacaaacgaacacagcgaagucacugcagccuccaguucuugucaaucaauuuaucucccuuuagaaccgaacgugggaaaauguuggagggcagcagguguguccuggaaccuggugacaguaaagucauuguaauggaaaaaggucacuucucuaggugggcuuggccuuucugaagcguucccgagaagacuuuguuucucuuaaaacaaaaacaagaaacugucaccuccccaacugaagccggucucuauccaauccuuaccaccacccccaauuugcaacguaagcaaaucaaguguccuaggccaugcgugggugggcuggagggcacggagguacacgcuuuccuaaguuccggguggcugcucccacgcacugccuaguucugcgcccaggcgggaccaaacuuaccgcaaugauucucuaacccaggaagagcaauaaggagaggucccaggaucuccuccagugccagggaggacuuagcauuuauuguacggcuuuagacagcguugaaguuaucucagacuuaucagugagagaggaaucuccacaaaugguauggaaguccucuacccaggucucuccuggaguagcuggagaguggccugcgcgauggcggugcaauucccgggcuggcaccgggacgcacgacuuugggccucuguuuucguucugcccagagggucgccuaccuucccgcaggucgcccagccgccagcgcgcagaucuaggcuggcugcgccucccgcgguucggccgugccucacggagaaucccgcaaaucaucacggccgcccgcaguggcccgacuuuuguccaggccgcuggggucccccggaggccagcgcgggccuggaaggacagcuagaggccuuucggagagcucgcugauugagagagggacgccacucaauauguugagaaaggagacaggcaguccc

SEQ ID NO: 11467 - RNA, 820 nt, Mus musculus
gcggcuguaguugggcgauguggacgugggcgcuguugcagcugcugcuacuaguggggcccggaggcugccugaaucgccaggagcucuuccccuucggcccugggcagggggaccuagagcuggaggccggggacgacgugguaucccccucccuggaacugaucggagaacugagcuucuaugaucguacggacaucacgucggucuaugugaguuggggccgggaggggaggaaggccaggcuaugcuggggucgccaguccagagagacagauguggaacuugggcgucgcccuccgggacccgagugcuagcugucccagugaggggcucuccguugaaucugcgcaucuagaggaucgcauugcuugucugucaccccaguagcacucgaaguuuaggguggcaucugccuccgggauccacucaucuaugcgcgcgcccugccaggaucuggggaccucgaguagaguuuuccuucucgauuccgugcgcuucucgccuuccuacugggacaggucccaguacccugcagcucaauggccagaguuggguuguauccugugagcgcuccuagggacucugccgauggcaagcuagaaaggacagaggaacccuccugcuccgccccagaguuucaguggacagccccugcaucugugugcguggguucuggcuacgucuuggcagagauuuugcucucuuaguugggcugguuucagaguacagaggucaggacugagaacgcagggcgccccggugauccaauuuccuguggcugagggugucacccaggggccccagaugaggagcggga

SEQ ID NO: 11468 - RNA, 820 nt, Mus musculus
ucccgcuccucaucuggggccccugggugacacccucagccacaggaaauuggaucaccggggcgcccugcguucucaguccugaccucuguacucugaaaccagcccaacuaagagagcaaaaucucugccaagacguagccagaacccacgcacacagaugcaggggcuguccacugaaacucuggggcggagcaggaggguuccucuguccuuucuagcuugccaucggcagagucccuaggagcgcucacaggauacaacccaacucuggccauugagcugcaggguacugggaccugucccaguaggaaggcgagaagcgcacggaaucgagaaggaaaacucuacucgagguccccagauccuggcagggcgcgcgcauagaugaguggaucccggaggcagaugccacccuaaacuucgagugcuacuggggugacagacaagcaaugcgauccucuagaugcgcagauucaacggagagccccucacugggacagcuagcacucgggucccggagggcgacgcccaaguuccacaucugucucucuggacuggcgaccccagcauagccuggccuuccuccccucccggccccaacucacauagaccgacgugauguccguacgaucauagaagcucaguucuccgaucaguuccagggagggggauaccacgucguccccggccuccagcucuaggucccccugcccagggccgaaggggaagagcuccuggcgauucaggcagccuccgggccccacuaguagcagcagcugcaacagcgcccacguccacaucgcccaacuacagccgc

SEQ ID NO: 11469 - RNA, 503 nt, Mus musculus
cuuggagaguccugaucuaauaauuuaugcugagacaggauuccuguucucuacguggaagucaagggcagucacagaggauauggcgauaaugccgcuaagagauucuggugguuuggaauaguagcccacagugagcgcuuuagcauucuuuggauagaaagacgagaauggagggugagagaaagauaaaaacagggagagaaagaguuagagaugacaagagaaagauuaagaacacagagaaagauuaagacacagcgguggauacuaacagaacauuccuguccaaacaccuuccuuccccacucacgcauggcggcuggacaaguagcgaagcagggccagauccaggcccccagcaggcauacucaaaccauagaaucuguguucuaggcuuaucaccagggccccccaggcaggggccagugccgcaggaugcccuguggagagcgcaugguagagagguggaugugaguugaaaaugagcuacggagcuucuc

SEQ ID NO: 11470 - RNA, 503 nt, Mus musculus
gagaagcuccguagcucauuuucaacucacauccaccucucuaccaugcgcucuccacagggcauccugcggcacuggccccugccuggggggcccuggugauaagccuagaacacagauucuaugguuugaguaugccugcugggggccuggaucuggcccugcuucgcuacuuguccagccgccaugcgugaguggggaaggaagguguuuggacaggaauguucuguuaguauccaccgcugugucuuaaucuuucucuguguucuuaaucuuucucuugucaucucuaacucuuucucucccuguuuuuaucuuucucucacccuccauucucgucuuucuauccaaagaaugcuaaagcgcucacugugggcuacuauuccaaaccaccagaaucucuuagcggcauuaucgccauauccucugugacugcccuugacuuccacguagagaacaggaauccugucucagcauaaauuauuagaucaggacucuccaag

SEQ ID NO: 11471 - RNA, 820 nt, Mus musculus
uucaagcgcacgcccacugcagacuuucugguguccaaggauuguguuugaaagggaggaagcauucuugaaguggugggugacagauugucuaaacccuucuaagauauucugcacgggagauuuuugaggcagcucagccaugaagauccccuggaggaaagggguaagcgaagagcgcccacacgcagcccaaucucgagccagacccacacaagaauauuggaguuaggcugagacugucgggagggggaaugcccaggacagaugggaaccucuguccuguauccaugaaccccacucuuucaggcucaccucauaggugcacguggaggggggaggacuugguggggagaggagacucccaacaccccagcuucaggagagagaagagaagggguauggaguuguggaacacacccucaacccaccuucuuucgggucuugcugguuucucugccacuuuugcuggcugugguuugccuuacuguugagcuguuuucuaaucccaguggaaacccuaacagaacuagaaaguguuccuacgaggcgaacaggcuuaagguugacuaaacccaugccaacacgugaguuuggcaggcugauagcccaguuaucagcugcacaagguugacuaaacccaugccaacacgugaguuuggcaggcugauagcccuguuaucagcugcacagucuccucgcugacucugggugagcagcagcagccuuaggaaugcccaaggaguauucucggccugauguggggucuuccggaguccuccuggaacuacugaaacccgaggccaugaggcaccaggag

SEQ ID NO: 11472 - RNA, 820 nt, Mus musculus
cuccuggugccucauggccucggguuucaguaguuccaggaggacuccggaagaccccacaucaggccgagaauacuccuugggcauuccuaaggcugcugcugcucacccagagucagcgaggagacugugcagcugauaacagggcuaucagccugccaaacucacguguuggcauggguuuagucaaccuugugcagcugauaacugggcuaucagccugccaaacucacguguuggcauggguuuagucaaccuuaagccuguucgccucguaggaacacuuucuaguucuguuaggguuuccacugggauuagaaaacagcucaacaguaaggcaaaccacagccagcaaaaguggcagagaaaccagcaagacccgaaagaagguggguugaggguguguuccacaacuccauaccccuucucuucucucuccugaagcugggguguugggagucuccucuccccaccaaguccuccccccuccacgugcaccuaugaggugagccugaaagagugggguucauggauacaggacagagguucccaucuguccugggcauucccccucccgacagucucagccuaacuccaauauucuugugugggucuggcucgagauugggcugcgugugggcgcucuucgcuuaccccuuuccuccaggggaucuucauggcugagcugccucaaaaaucucccgugcagaauaucuuagaaggguuuagacaaucugucacccaccacuucaagaaugcuuccucccuuucaaacacaauccuuggacaccagaaagucugcagugggcgugcgcuugaa

SEQ ID NO: 11473 - RNA, 1903 nt, Mus musculus
ugugagcccgaguggcaagccacccuagccaccuccaagguggaagaaaggaggggguugagaaaacucaaagagggagagagaggguagggagagagguaggugggaagggaggggugugcaugcgaauucccaagagaaaagauaaccagggacaggcaagguggccacuccugaguguacugugcugucugcuauagugucaaggccaugaggccaccagacucccacagguuucuagauaaucucaaagccccaaagccagcagauauuuucccccagcuguacaagaggccucucagaaucaacgugccuagggggcaucugcacucacacucucuucccagauacgaagugcaggucucccaacuucuucaucuuccuuugagggggacccuggccugugcccuuggcaccgccaucccuaaacauagcaggcuguagaaaccuaaauggcacuuguuccuuccugcagggguggggugagaguggguacuguggggacagguuccucguggaacucucauuauggccaucuagaaauggauagaaagaggccuaggaguuuuuguuguuguuguguuguuuuguuuugaaaggaggggaggucugguagauuagcccuuuguccucccacuccaagcaccucuaugaccuggccaacugggucacacagagucuugccuauagccagaccuccugagcuguggcacugaucuuugaggaggguggcuuuaagaguccugcccugaacacaugcacuuggagugcugauggaugaaugcaaauaaaaucuggcucuugccucucucacuaggcauauauagaaguauagaaggaguauagaaguucuuggccaaggaaagagagcagacuguaaaacgagguuuaaaauuauuagcuaugccuuccagauuaaguuccucucuccaaucccugcugguggagcaaucaccuacggccacaaagcucaacguugccacugaccaauucugaaaggucuggccugugguagcagcaggcaaagacuacccaaggaaacccaaacccugugccacaagcaauuauugaaaggcaucgugggcgcucaaaaaccuaagcacggaucuaaacacgugguuaaaaugaugaguucuuccgacccaggcucaggcuaaaggaagagaaagguacagagcaugccagcucacccaagacccguccugaauacccuuaaauacgccuaguguagaugggucucugccauccuuacugguuuagucuaagccaguucauguaaaacccacgaaacaaaggaagcaugcuaagaaaagauuuaaaccacaacaauggagcgauuuccuagaauaaaguauggacugcagaacaaaaucagagcaauccaauuuuugcuaguuuacauucccuugcuaagggguaagggugguacucuauggguuuggaggaggaagggugcccacagcccagauggaaacaguugaccaacccaauaucgaugggaugagaacaguucugagcuguguggcuuuucucuucuuuuucuuuuuucuuuuuucuuuuuccuucuuuacuuuuucuuugucuuuuuuuguuauuguuaaacaagcccguaagcugaucuagaaucauuuaaugaaccauaccuguacuucuucauuuaaaaaaaaaucaagguuuuuuguuguuguuguuguuuauagggacuaaaaucaguaggagagggcucacaccagaagaagggaccuccuagagagugggaccaaucuaaacaaaucagcaaggagacuuccauuuuaaccauggcugggagggggcugggacucagguagagagccucccuuguuugucucaaucugcaucgcaacacaaguaaacaaauaagcaaaagccugcccaccagaaa

SEQ ID NO: 11474 - RNA, 1903 nt, Mus musculus
uuucuggugggcaggcuuuugcuuauuuguuuacuuguguugcgaugcagauugagacaaacaagggaggcucucuaccugagucccagcccccucccagccaugguuaaaauggaagucuccuugcugauuuguuuagauuggucccacucucuaggaggucccuucuucuggugugagcccucuccuacugauuuuagucccuauaaacaacaacaacaacaaaaaaccuugauuuuuuuuuaaaugaagaaguacagguaugguucauuaaaugauucuagaucagcuuacgggcuuguuuaacaauaacaaaaaaagacaaagaaaaaguaaagaaggaaaaagaaaaaagaaaaaagaaaaagaagagaaaagccacacagcucagaacuguucucaucccaucgauauuggguuggucaacuguuuccaucugggcugugggcacccuuccuccuccaaacccauagaguaccacccuuaccccuuagcaagggaauguaaacuagcaaaaauuggauugcucugauuuuguucugcaguccauacuuuauucuaggaaaucgcuccauuguugugguuuaaaucuuuucuuagcaugcuuccuuuguuucguggguuuuacaugaacuggcuuagacuaaaccaguaaggauggcagagacccaucuacacuaggcguauuuaaggguauucaggacgggucuugggugagcuggcaugcucuguaccuuucucuuccuuuagccugagccugggucggaagaacucaucauuuuaaccacguguuuagauccgugcuuagguuuuugagcgcccacgaugccuuucaauaauugcuuguggcacaggguuuggguuuccuuggguagucuuugccugcugcuaccacaggccagaccuuucagaauuggucaguggcaacguugagcuuuguggccguaggugauugcuccaccagcagggauuggagagaggaacuuaaucuggaaggcauagcuaauaauuuuaaaccucguuuuacagucugcucucuuuccuuggccaagaacuucuauacuccuucuauacuucuauauaugccuagugagagaggcaagagccagauuuuauuugcauucauccaucagcacuccaagugcauguguucagggcaggacucuuaaagccacccuccucaaagaucagugccacagcucaggaggucuggcuauaggcaagacucugugugacccaguuggccaggucauagaggugcuuggagugggaggacaaagggcuaaucuaccagaccuccccuccuuucaaaacaaaacaacacaacaacaacaaaaacuccuaggccucuuucuauccauuucuagauggccauaaugagaguuccacgaggaaccuguccccacaguacccacucucaccccaccccugcaggaaggaacaagugccauuuagguuucuacagccugcuauguuuagggauggcggugccaagggcacaggccagggucccccucaaaggaagaugaagaaguugggagaccugcacuucguaucugggaagagagugugagugcagaugcccccuaggcacguugauucugagaggccucuuguacagcugggggaaaauaucugcuggcuuuggggcuuugagauuaucuagaaaccugugggagucugguggccucauggccuugacacuauagcagacagcacaguacacucaggaguggccaccuugccugucccugguuaucuuuucucuugggaauucgcaugcacaccccucccuucccaccuaccucucucccuacccucucucucccucuuugaguuuucucaacccccuccuuucuuccaccuuggagguggcuaggguggcuugccacucgggcucaca

SEQ ID NO: 11475 - RNA, 2284 nt, Mus musculus
caaacugagagcuaaugauguggaagguuaucaaaccuugccuugguuguaaaaggcuuagugccuucauucucuucagaccuaaaacuuuuaaggccaguauuuaaaagcaaguaccaugcgggagugagagucguagaguccccgggugcaggaaacagaacagguggagagcuggcugaccacaauacugacuucauacaaguuucucaaacguguagccugccuacaaaacagcaugccuccccuccuccccacucuucuuccagaaccaauguuuuccccacuuccauacacacucacuugaaaacacuuuuaccaacaccgaagucugcccacaaagcuccuuugggccauuuccuauccucacccaaguuccaccucaucuaagcaauucuuuucagacacguagaacuuugguuuauugagcacauauuugcuuccauauuaagucucauaaaaaaaaauuagaccaggcaagaugacaaagggaaggcggggaucagcaugaaauaaauggggacuugucccccaaauguucacuagucagucaaaaagaaauucuuagaaagucgaaacaucaacccccccccccccaacccaagcaaaacaucccuuccggaaaagagcgacuuguuucuuucuuuuuuuuuuucuuuuuucuuuuccucucuugaaaaugagagguccacucaguucugcucagcgguguuuucuuagcugacucugggcuacaaucgggccauuuucggacacauucccauguagguaccaggggugcucuggaggaagcugucgacgccuguucagcuaauuuagguuuucuuugucuaauuacuguggagcuuagggaaaaggagccgggcucagggcaguaaacugacacucgggcucugugugugguauccaggcaggguuugauggaaaaagccugcuuccacucaacuccaggucacugucuggggccagcccccucccccccccccugcacccgcccuuuccucuguuccucagacccaccaacagucuccaucaggggcaguccccaugcacuagggcacagagcuggugcaggcucccccacccccaggaggccagaccccacuugcucaaccaggcucuuuguagcaucuuuacugggcccugcacucuccucucugccuugucucccaucuucccaggcuuucugcguacacaacacaaacccaguccucucagggcuggcgcagugcugugccuaccauuugcuacucugaugggcaucuccuucccucugggccaggccaccagcccugguguggucaggccuccuucagcuugcaacucgcuuugcagccccuguccggggucagacuacauuuccccgcacguguaauccaauaacuaacugucgggucucauuggaaugauuucucccgagggccaucucucucugagccgacucuuacuuagaggaauaagccacaacuggaggaguguucucgaauggagggagcugggccacggaacauagggaguggggggggggugcaccggaagacagacgcuguaaacccacuggcagcugugcagaccuuccuuguugauaauaaauacaacuaucuccuuacucagggucucucuugcucucucucagcaugaaguggaaaugacaagucaguggaaaauggaagcaaauaaaaaaccgaauccauucgacucaaaagagugucuaagagguggccccagguuucuccacccaaaccccuugcucagcugacaaucuguucauaacugccccgggcacagcucaagggcguccaguguuugcccucugcugugaccucucagaagccugcauguccagccagagagagagagagagagagagagagagagagagagagagagagagagacccggaguuggcacguuaccuugggacgucuggcacccuggcguguggcugagggcagcacugccuaaaugaaguugacagauggugucaguucgggcacuggggaccguggcuaaggaagcucuuccagggcacagucuccccaagacucagcccccacaggguccggcggggguggaggaggggcaggguguguccgggcacggaucgcuagguugggggcacuucugggauaggauacgggcugcuggaaggaacagagaaugaauugcugaaguuaggaguaaucgagucuggccaagguugggaguucucccugcugaaugcggguguaucugcggcuuugaagaggacagacugggaaagggaaagagccccgagaggaau

SEQ ID NO: 11476 - RNA, 2284 nt, Mus musculus
auuccucucggggcucuuucccuuucccagucuguccucuucaaagccgcagauacacccgcauucagcagggagaacucccaaccuuggccagacucgauuacuccuaacuucagcaauucauucucuguuccuuccagcagcccguauccuaucccagaagugcccccaaccuagcgauccgugcccggacacacccugccccuccuccacccccgccggacccugugggggcugagucuuggggagacugugcccuggaagagcuuccuuagccacgguccccagugcccgaacugacaccaucugucaacuucauuuaggcagugcugcccucagccacacgccagggugccagacgucccaagguaacgugccaacuccgggucucucucucucucucucucucucucucucucucucucucucucucucuggcuggacaugcaggcuucugagaggucacagcagagggcaaacacuggacgcccuugagcugugcccggggcaguuaugaacagauugucagcugagcaagggguuuggguggagaaaccuggggccaccucuuagacacucuuuugagucgaauggauucgguuuuuuauuugcuuccauuuuccacugacuugucauuuccacuucaugcugagagagagcaagagagacccugaguaaggagauaguuguauuuauuaucaacaaggaaggucugcacagcugccaguggguuuacagcgucugucuuccggugcaccccccccccacucccuauguuccguggcccagcucccuccauucgagaacacuccuccaguuguggcuuauuccucuaaguaagagucggcucagagagagauggcccucgggagaaaucauuccaaugagacccgacaguuaguuauuggauuacacgugcggggaaauguagucugaccccggacaggggcugcaaagcgaguugcaagcugaaggaggccugaccacaccagggcugguggccuggcccagagggaaggagaugcccaucagaguagcaaaugguaggcacagcacugcgccagcccugagaggacuggguuuguguuguguacgcagaaagccugggaagaugggagacaaggcagagaggagagugcagggcccaguaaagaugcuacaaagagccugguugagcaaguggggucuggccuccugggggugggggagccugcaccagcucugugcccuagugcauggggacugccccugauggagacuguuggugggucugaggaacagaggaaagggcgggugcagggggggggggagggggcuggccccagacagugaccuggaguugaguggaagcaggcuuuuuccaucaaacccugccuggauaccacacacagagcccgagugucaguuuacugcccugagcccggcuccuuuucccuaagcuccacaguaauuagacaaagaaaaccuaaauuagcugaacaggcgucgacagcuuccuccagagcaccccugguaccuacaugggaauguguccgaaaauggcccgauuguagcccagagucagcuaagaaaacaccgcugagcagaacugaguggaccucucauuuucaagagaggaaaagaaaaaagaaaaaaaaaaagaaagaaacaagucgcucuuuuccggaagggauguuuugcuuggguuggggggggggggguugauguuucgacuuucuaagaauuucuuuuugacugacuagugaacauuugggggacaaguccccauuuauuucaugcugauccccgccuucccuuugucaucuugccuggucuaauuuuuuuuuaugagacuuaauauggaagcaaauaugugcucaauaaaccaaaguucuacgugucugaaaagaauugcuuagaugagguggaacuugggugaggauaggaaauggcccaaaggagcuuugugggcagacuucgguguugguaaaaguguuuucaagugaguguguauggaaguggggaaaacauugguucuggaagaagaguggggaggaggggaggcaugcuguuuuguaggcaggcuacacguuugagaaacuuguaugaagucaguauuguggucagccagcucuccaccuguucuguuuccugcacccggggacucuacgacucucacucccgcaugguacuugcuuuuaaauacuggccuuaaaaguuuuaggucugaagagaaugaaggcacuaagccuuuuacaaccaaggcaagguuugauaaccuuccacaucauuagcucucaguuug

SEQ ID NO: 11477 - RNA, 1631 nt, Mus musculus
cccggcuccggcgccgccgaucccgguccgggguccgccccccaggcccggccucguucccgauucccagaugagcaccgagggcgggccuccgccacccccgccgcgcccgccgccugccccacuccgccgcgcgugcagcccggcgcccggcgcgcuccaggccgccuugaugagcccgccacccgccgccacccuggaguccacuucgucgucgucaucaucauccucugccuccugugccucguccucuucuaacuccgucagcgccucggccggugcuugcaagagugcggcuagcagcggcggcgcgggcgccgggaguggaggcaccaagaaggcaaccucggggcugcggcggccggagaagccuccuuacucguacaucgcgcucaucgucauggccauccagagcucgcccagcaagcgccugacgcucagugagaucuaccaguuccuacaggcgcgcuuccccuuuuuccguggcgccuaccagggcuggaagaacuccgugcgccacaaccucucgcucaacgagugcuucaucaagcugcccaagggccucgggagaccugguaagggccacuacuggaccaucgacccggccagcgaauucauguuugaggaggguucguuccgccgccggccgcgcggcuucaggcggaagugccaggcucucaaacccauguaccaucgcguggugagcggcuugggcuucggggccucgcugcugccccagggcuucgacuuccaagcgcccccgucggcgccucuggguugccacggucaaggcgguuaugguggccucgacaugaugcccgcgggcuaugauacaggggcgggugcuccgggccacgcgcauccacaccaccuccaccaccaccacgucccccacaugucgcccaacccgggcuccaccuauauggccagcugcccggugcccgcagguccugcgggcgucggugcggcagcggguggcggcgguggcggcggggacuaugggccggacagcagcagcagcccugugcccucauccccggcuauggcaagcgccauugagugucacucgcccuacacuagcccugcggcacauuggagcucgccuggcgcuucaccuuaccucaagcagccgccugcccugacgccaagcaguaaucccgcggccucugcuggucugcaccccagcaugucuuccuacucguuggagcagagcuacuugcaccagaacgcccgcgaggaucucucagguaauaaagagcgccaaggcuggcugcaagcggagccucugagagccucugagggccagggcuacugcacccuugguccucaacgcuggggucuucagaacuagaaugcugggggugggguggggauucgguucccuauuccuaagugagagaaggggauuugaucuuguacccuucucuaaugcucugggccuguuggugggccccagaauucccaaauuggagaaggguggugccaaguccuaagucucuuggccuucauuaggacacuguggacuuucucccaauuaggucagacucagcucugaaagaaggccugugaccuuuggagaccuuggucgaggaauugagucuggaucauuucguuucuuccuacucuuuuca

SEQ ID NO: 11478 - RNA, 1631 nt, Mus musculus
ugaaaagaguaggaagaaacgaaaugauccagacucaauuccucgaccaaggucuccaaaggucacaggccuucuuucagagcugagucugaccuaauugggagaaaguccacaguguccuaaugaaggccaagagacuuaggacuuggcaccacccuucuccaauuugggaauucuggggcccaccaacaggcccagagcauuagagaaggguacaagaucaaauccccuucucucacuuaggaauagggaaccgaauccccaccccacccccagcauucuaguucugaagaccccagcguugaggaccaagggugcaguagcccuggcccucagaggcucucagaggcuccgcuugcagccagccuuggcgcucuuuauuaccugagagauccucgcgggcguucuggugcaaguagcucugcuccaacgaguaggaagacaugcuggggugcagaccagcagaggccgcgggauuacugcuuggcgucagggcaggcggcugcuugagguaaggugaagcgccaggcgagcuccaaugugccgcagggcuaguguagggcgagugacacucaauggcgcuugccauagccggggaugagggcacagggcugcugcugcuguccggcccauaguccccgccgccaccgccgccacccgcugccgcaccgacgcccgcaggaccugcgggcaccgggcagcuggccauauagguggagcccggguugggcgacaugugggggacgugguggugguggaggugguguggaugcgcguggcccggagcacccgccccuguaucauagcccgcgggcaucaugucgaggccaccauaaccgccuugaccguggcaacccagaggcgccgacgggggcgcuuggaagucgaagcccuggggcagcagcgaggccccgaagcccaagccgcucaccacgcgaugguacauggguuugagagccuggcacuuccgccugaagccgcgcggccggcggcggaacgaacccuccucaaacaugaauucgcuggccgggucgaugguccaguaguggcccuuaccaggucucccgaggcccuugggcagcuugaugaagcacucguugagcgagagguuguggcgcacggaguucuuccagcccugguaggcgccacggaaaaaggggaagcgcgccuguaggaacugguagaucucacugagcgucaggcgcuugcugggcgagcucuggauggccaugacgaugagcgcgauguacgaguaaggaggcuucuccggccgccgcagccccgagguugccuucuuggugccuccacucccggcgcccgcgccgccgcugcuagccgcacucuugcaagcaccggccgaggcgcugacggaguuagaagaggacgaggcacaggaggcagaggaugaugaugacgacgacgaaguggacuccaggguggcggcggguggcgggcucaucaaggcggccuggagcgcgccgggcgccgggcugcacgcgcggcggaguggggcaggcggcgggcgcggcggggguggcggaggcccgcccucggugcucaucugggaaucgggaacgaggccgggccuggggggcggaccccggaccgggaucggcggcgccggagccggg

SEQ ID NO: 11479 - RNA, 3528 nt, Mus musculus
aauuugggacagcuucuauccaugaauuaauaaagacugaggcuccaauggggggcgggggagaaagguagauauuuaggaacauacauuuuaauuccacuaugaaaauuuuggucaucuucaggcugagguucaucaaaugcaucucuccugaaauuacuguuucauuauuucuauucucaucuacuaggaaaacagaguccccaaacauccuccaggugaagucccuaucuuaaaacauuagcuguuucuuaaucuaugaacauuagucgucuaacugcaaaaugccacacucacuuauuucuaacacuuacagcauuugcugcccuugggaucuauguccuaggaugguugcagcucuuugaacuaaugucaaaggcacaaaaccaccagaugcaaagcauuaagucaucuccuaaaauuaaaggaaaaggcaacaucccggugcaugcuccuugcuuugcaaaaaucccaguuucugcaaaacaauaaacaaauaaacaaccaaaaaaaucccccaaacaaauucucaagaauauggcaaaugcauauggaccccauagaaagaaucaguuuuaaugcuccgaaagccccaauuucucuauauuucuuaugaagaaaaaauguuaaguauuucuucucuugucccacacaaauucccugacgcaccccugaaaugcugcaaggauuugucuguaaagaacgcuccagccuggcacgaacaguuuucuccaucugcagaauaaccacugggagacuuucuauuuuuuuccuuuuguccauucuauuaauaagcugcuuuaauuucccuuuucaguuacauuaauuaauguuuccauccaguaucacauaagcggauucacuaguacuuaaaacauuugcauuuuggauggaaaaauauaaacuuuaaaaaagccucccaacaguguagcugagacucacauuccuuaacaugaaaugggggggggggcuaaauaaauccauccaauaaaccgccacaaacaaaaauuacaaacccacgaaaagacaaaaugcgaacacguuaaaccacuuuccuguauaaaaauaauagagaugcuaaucugccaaaaaucacagacacacaugacccugaaaaaguauaucagugaauauuugguugauuuauccuucucggaguagucugcggugcccggagcaaacgcugcagcuaagaucuagggggaggggcggaggaaggacaaaguucuaaaugcugcaguuugagggcagccuuagaauaucuuugcuuucugcauauaaacuuuucagcccuagcuaccuaggcaucuuauuccucccuuuaccuuuugaccccucaagauaguaucuugcaguauaacaggggacaaaugcuacgagcgcucagauccuguuuuaaccccaaagagggaggaaaaaaauggaugugcgcuuuggagaaaagggagaaccccccuuggaaaacagccggucacacacacacacuucccugcaaaagaaaucacuuucuuuaggaaaaccaaaccagaacuccuuccagaguccccaagagcuaaugccccgacucagggagucugcaggguuuucugcaaccagcggcagacccuggccagcaaguccccuuaggcgccucugggguaggcaaucuccggucgccuaccaagccguaccgggcggccacuuaccuauuugcaccgcgaggaucagugaaauauaucugccguucaacuuaagucccauccuacguuuagucaaaccauuugcgaccgcagaccuuuaaauaguuaguuuagagaacgcgggggaaagcugaaaaauaggcauugccaacaaguuccgggagcgacagagacuuuaugcacugggaaggcagagggaggagagaaagagagggagcgaggaagagacagaaagagagugagagagugagaggcuggggggggggggggagagcugggaaugguucacuccauuaggagggggcggaggaaguacagccucacgcccacgagcaggccugacgugggggaugacacggauugauuuuuuuuuuuuuuuauaauauagacaccuugguagagaaucaccauuuauagucauaagacucuggaauuaaucagauaucuccaauuaaugugcgaucucaacgaaaucucgccucucuguagugacugauuuucaucccaguggccacccccgccuccucguuccaggggcccccagccccgcccccucccugcgcagaaucggggcucccucuccucuccccgccccggagacggggaguccuggugcgcccacucgauuguucaaccugcucccuccuucacuggcgccacaacgaacccagacacuuccaacccugcagagagguuuggggagcuuugggcccagggaggacagaggggagagacuccuccgguccgaaucacccuucucucgcccucaguggggugcagacccccucacuugccuacccuaguuuucucuccagccccacaguugagcucuaggcgcagccuagagcgcgugagcacauaacccggccccccagcacacgcacacacucacaaaagcgcacgcccgggagcgcccccgagcucgcccgcacacuccgcacgcgagcgcgcguacacacccaggccccggggguucguucggcucgcaugggggcccccagaaauagacucugcgugcccucuugugaaugucacuauucgcgacgcucacccaccgaggggcaucuauaccaggcauagagacaccuauuuuaggggguuggaaaggcugucgggcaagaagccuaggcuaggguaaauuucgguuucuugugguuuacaaacucuucgcgcuuuaggaaauuuccaaggcaagcucugguguacaacuccuuucuggggccuccugaagucaucuguagggucacacugacauguugauacacgcacccacguccaucacguacacacccagacccacacacaccugcgcucuuuauuuuauuuuuugaugauccagcacugacugcaguaaagaaauaucucuucagcugcguucgugcaagguccuguaguggaucguguaagauggaaaaauaaucagggcuacuucuuaaaugaaauuaaguuuugauuuuuuuucuccuuuucugcaaugcaccacacccucuuucccagucugaauucuagcgucuuuaaucaaauguugauggccgcauuggcuaacuguauuacuugagccaaugaagagauaugcgaaaggagaaaaauaaaagagccuucauauuuuauaagacugcagggcgaccgcguaaggcuagguuaguggcagaaaugaaaggggauuagggagaccgggcuuccguuuaauuugccuuucgaagccccugcacugggagcccacacagucagccaucugugcacacagacggagaaagggagaaaagggugcaaaacuggggucaggugacgggcgguggagggacugaguaggaccgcgagggucuugaggcaacuagaagcugaaaag

SEQ ID NO: 11480 - RNA, 3528 nt, Mus musculus
cuuuucagcuucuaguugccucaagacccucgcgguccuacucagucccuccaccgcccgucaccugaccccaguuuugcacccuuuucucccuuucuccgucugugugcacagauggcugacugugugggcucccagugcaggggcuucgaaaggcaaauuaaacggaagcccggucucccuaauccccuuucauuucugccacuaaccuagccuuacgcggucgcccugcagucuuauaaaauaugaaggcucuuuuauuuuucuccuuucgcauaucucuucauuggcucaaguaauacaguuagccaaugcggccaucaacauuugauuaaagacgcuagaauucagacugggaaagaggguguggugcauugcagaaaaggagaaaaaaaaucaaaacuuaauuucauuuaagaaguagcccugauuauuuuuccaucuuacacgauccacuacaggaccuugcacgaacgcagcugaagagauauuucuuuacugcagucagugcuggaucaucaaaaaauaaaauaaagagcgcaggugugugugggucuggguguguacgugauggacgugggugcguguaucaacaugucagugugacccuacagaugacuucaggaggccccagaaaggaguuguacaccagagcuugccuuggaaauuuccuaaagcgcgaagaguuuguaaaccacaagaaaccgaaauuuacccuagccuaggcuucuugcccgacagccuuuccaacccccuaaaauaggugucucuaugccugguauagaugccccucggugggugagcgucgcgaauagugacauucacaagagggcacgcagagucuauuucugggggcccccaugcgagccgaacgaacccccggggccuggguguguacgcgcgcucgcgugcggagugugcgggcgagcucgggggcgcucccgggcgugcgcuuuugugagugugugcgugugcuggggggccggguuaugugcucacgcgcucuaggcugcgccuagagcucaacuguggggcuggagagaaaacuaggguaggcaagugagggggucugcaccccacugagggcgagagaagggugauucggaccggaggagucucuccccucuguccucccugggcccaaagcuccccaaaccucucugcaggguuggaagugucuggguucguuguggcgccagugaaggagggagcagguugaacaaucgagugggcgcaccaggacuccccgucuccggggcggggagaggagagggagccccgauucugcgcagggagggggcggggcugggggccccuggaacgaggaggcggggguggccacugggaugaaaaucagucacuacagagaggcgagauuucguugagaucgcacauuaauuggagauaucugauuaauuccagagucuuaugacuauaaauggugauucucuaccaaggugucuauauuauaaaaaaaaaaaaaaaucaauccgugucaucccccacgucaggccugcucgugggcgugaggcuguacuuccuccgcccccuccuaauggagugaaccauucccagcucuccccccccccccccagccucucacucucucacucucuuucugucucuuccucgcucccucucuuucucuccucccucugccuucccagugcauaaagucucugucgcucccggaacuuguuggcaaugccuauuuuucagcuuucccccgcguucucuaaacuaacuauuuaaaggucugcggucgcaaaugguuugacuaaacguaggaugggacuuaaguugaacggcagauauauuucacugauccucgcggugcaaauagguaaguggccgcccgguacggcuugguaggcgaccggagauugccuaccccagaggcgccuaaggggacuugcuggccagggucugccgcugguugcagaaaacccugcagacucccugagucggggcauuagcucuuggggacucuggaaggaguucugguuugguuuuccuaaagaaagugauuucuuuugcagggaagugugugugugugaccggcuguuuuccaagggggguucucccuuuucuccaaagcgcacauccauuuuuuuccucccucuuugggguuaaaacaggaucugagcgcucguagcauuuguccccuguuauacugcaagauacuaucuugaggggucaaaagguaaagggaggaauaagaugccuagguagcuagggcugaaaaguuuauaugcagaaagcaaagauauucuaaggcugcccucaaacugcagcauuuagaacuuuguccuuccuccgccccucccccuagaucuuagcugcagcguuugcuccgggcaccgcagacuacuccgagaaggauaaaucaaccaaauauucacugauauacuuuuucagggucaugugugucugugauuuuuggcagauuagcaucucuauuauuuuuauacaggaaagugguuuaacguguucgcauuuugucuuuucguggguuuguaauuuuuguuuguggcgguuuauuggauggauuuauuuagcccccccccccauuucauguuaaggaaugugagucucagcuacacuguugggaggcuuuuuuaaaguuuauauuuuuccauccaaaaugcaaauguuuuaaguacuagugaauccgcuuaugugauacuggauggaaacauuaauuaauguaacugaaaagggaaauuaaagcagcuuauuaauagaauggacaaaaggaaaaaaauagaaagucucccagugguuauucugcagauggagaaaacuguucgugccaggcuggagcguucuuuacagacaaauccuugcagcauuucaggggugcgucagggaauuugugugggacaagagaagaaauacuuaacauuuuuucuucauaagaaauauagagaaauuggggcuuucggagcauuaaaacugauucuuucuaugggguccauaugcauuugccauauucuugagaauuuguuugggggauuuuuuugguuguuuauuuguuuauuguuuugcagaaacugggauuuuugcaaagcaaggagcaugcaccgggauguugccuuuuccuuuaauuuuaggagaugacuuaaugcuuugcaucuggugguuuugugccuuugacauuaguucaaagagcugcaaccauccuaggacauagaucccaagggcagcaaaugcuguaaguguuagaaauaagugaguguggcauuuugcaguuagacgacuaauguucauagauuaagaaacagcuaauguuuuaagauagggacuucaccuggaggauguuuggggacucuguuuuccuaguagaugagaauagaaauaaugaaacaguaauuucaggagagaugcauuugaugaaccucagccugaagaugaccaaaauuuucauaguggaauuaaaauguauguuccuaaauaucuaccuuucucccccgccccccauuggagccucagucuuuauuaauucauggauagaagcugucccaaauu

SEQ ID NO: 11481 - RNA, 742 nt, Mus musculus
ccgaagcucggcgggagaaacuccuuagaacuucaaggacuauagcagcuaaagagugacaccaagggcugacgugugggcucccaagccgaacgugcuuuacaggucagggcgaagugugugcgcccuucuccaaaugcaagaagggaacgucuuuagggagaaagaaaagaaugaaugaaaaaggggguauuaaugucagggagggagugaaaggggggacaugguuuuauuuucuuccugcuacuguaggcacccccaggaucucgcucaaacacaccagagugcacaggcacgugcccaguugccagcuuuuuuuuuuuuuuuuuuuuuuuuaaauccaagcucuucucuuccuuccacucucaggcagaaccaaaaguaaccaggagaaaaggggaaagaguggaacacgagcuucgaaagacaaaagugaaagaaccgagauccauguccacuaucuccagcgucuccccugugcuauucgggcgacauggaggggugggagcugcgcggguguuaaguuugucccacucgcauuucgcguggagagaaggaggaggaggagagggagggucgaucuccaagccuguggccgcaaggaugacugagucggcgccgcgcuuaccucgcagucuucguacuugauauuauccgucaguuuccaaagcauuuucauggaucggcgugaucggauuugccccucugcgccucgcaccccagcggagcuacucucuggguu

SEQ ID NO: 11482 - RNA, 742 nt, Mus musculus
aacccagagaguagcuccgcuggggugcgaggcgcagaggggcaaauccgaucacgccgauccaugaaaaugcuuuggaaacugacggauaauaucaaguacgaagacugcgagguaagcgcggcgccgacucagucauccuugcggccacaggcuuggagaucgacccucccucuccuccuccuccuucucuccacgcgaaaugcgagugggacaaacuuaacacccgcgcagcucccaccccuccaugucgcccgaauagcacaggggagacgcuggagauaguggacauggaucucgguucuuucacuuuugucuuucgaagcucguguuccacucuuuccccuuuucuccugguuacuuuugguucugccugagaguggaaggaagagaagagcuuggauuuaaaaaaaaaaaaaaaaaaaaaaaagcuggcaacugggcacgugccugugcacucugguguguuugagcgagauccugggggugccuacaguagcaggaagaaaauaaaaccauguccccccuuucacucccucccugacauuaauacccccuuuuucauucauucuuuucuuucucccuaaagacguucccuucuugcauuuggagaagggcgcacacacuucgcccugaccuguaaagcacguucggcuugggagcccacacgucagcccuuggugucacucuuuagcugcuauaguccuugaaguucuaaggaguuucucccgccgagcuucgg

SEQ ID NO: 11483 - RNA, 7253 nt, Mus musculus
uccaugccccugggaggacccaaaucccuucugaggcaaaagcaucaccagagcugacaauguccuccugagggaguggaaggaaagagccucgcaaagcugcccagcucugcugcucucacccguuugaguuuccugacaagccuuguauuuggagcgcugucagggaggaccagggacuccucccacgaaugcagugcagcuaaagagcucgugggauagcgucuagauagauuccggucugucucaccaccgcugacuccucauggugcucaggcuagaaugagacccuaccccauaaacaagccagaaaccccuccaagggcucuguagauuuaauuccuuacuagaagcauuaaagaucagggugucugcaacgggugccacaggccuuugugacugccucuaccuuagcuguuagaaauaaugggggaacuaugauuuagcgaucccgggcgggcgggggggggggggacgacagaaaggcgcaagggauccugugcuagaguuggggagauaagaagagggagaaaugggugaaugggaaauugaaaaaaaaaaaaaacaaaaggaagagaguaaaaagagggucgucuuccaucccgacauuucuuacuaucuuccagcugccaccacucuggugccucuucuuuucugcagcaaaaacuuuucugcaaggccagucugcgguuuuuaaauuuaaccaggacuuuggcagaaucccgggugcgagccaggcggccagagcggguggcggggcaccugcccacaaagggcuuggaagcguugccucaagacugucagucaccacgacggucaucucuuuacccaaagggacaggaaucuugcaguccccagccugcacucugcgcggaguucagaaucucuguuggcccgggcucccagguucugcauucgcuguccaguggagccacaucaccacgcgagccacggagccggagccgcagucagcgaccacugucuugggagugaccugguucucaccucuagucuggggucgcaccggaagccgcuaaaggcaggggugggugugaaacaccagcgaagaaucgccaggaaccuugaccaucaacaaccgguuccuuggagagcgcuauggauauaucuuaacucaaaauuccaaaggaaaucacacauuguuaaacaacaacccccaaggacacaaaggaaccaaucucaaagaucguaucugcaaaggcacugucacgcaaaaugcauuucgacuuccaagcuccgggaagagucaggaaagacucaaaacgaaaguccacaaggauaucgaacuacccauaaugaaacaguuacagagaccggcucuccaacgaaaggcaacuuagaugugaucugugaguguggggaccgcguauuuuuauaaucucgacgguuuuguguauugaagccaaacugaugaccucuuucuagcaaagugcagggcgcagacggcagccugcccagaucacacguugcccuccagguccaggcgauggucaucugaguugaaacguauuccgugcugaaggccacccgccaaggccaccaccgcaaaccugccuggagaggcaggcuuaaaacacccuaguuggggcucuccaggguguuuguuccuggaaagaagacccagagcgcugcucuggggcgaacgaacuuaguggggcuuagagcuuacuguaaacuggggacgguuuccggaaaguuguuuggcccacagaaguuuuaagaaaucuuccuuccagacacccggggucccaaauucaauuugcugaaugagauacagaucgguugcaagugggaaaguagacaaaaaagaaaucuucaagguuuagggaggcuuggaggggagccccacuuagaagcccccugaggcugguggcugaacuggcuuuggguugcuccaucugcuuaguggcauaagggacuaccacuucccgguuagauugccugcagaauuccuucccucuuggaggugcuuuggaaagaaacugcagcuggaagcggugcgcguugaaaccucacaucccugcucugggguucagcugugacccaucccucccuucuaaccugccacagccagcugaagccccggggucuuccggguucgcaagugggaaaugggacggguuccgcguacaaggguccccucuuggcggaagaaacugcgccaaggaucuccugcggccuggaguccuucguugcugggccacccgggaggguggcuggccugggacgcugaggucaccuuuuccaccgugccugccucucccagagcggccaguuuccgggauuuuaguuuaggcgacaggcgggaggcccuggcgggcuuuaggcuuaggacucaguggcugcgccucuaguggggacuucccuucguccugugccguccaaguggaagggggaaccccuuuccuugugaacuaaccccuuuccagccagccaaugcagaauuccuaaacaaaggaucccugaagccauuucuucgcaauuuuuuuuucgccuaaaagggguuuauucgcagguuugcuuuagggucccucuggacuuugagaagaauguaguuugaaaaggaugcgucaggggcucgagcuuaaagagggcauggggcaucggggcauagccuggcucugagccuuuggugccaggcuaagcuuuuaguccuuggggcuucauucccagcaggcaggaaucacugcaggcauucggccugggcggcuugaaacaguccuggccagcguccaaggagcuggagggugugugugggagggggagaggcgcaccuguggaauggaguggggguggggucucuuucuagaauuaagaccuucaugccagaaaaaaaugagccuccucuguucagcuugaccuuaaacuccuuccuggcaauaaaaacagagcuguugacuggauaucgacaauaggaaugaguggucuugguagcucagacccauuuccaggaucaaccuugcguuuuggggaaaccuggcugaaauuggaaggaaggcgcauaguguucaaauacaggguggcuucugucgggaucaaaaucagagaagauaggaugggagcuggcugggacuccuccccaguagaacccauuccaagcuauacuccuuccgaugcccaagaggaaguggaggggccugauguugagcccuccagggauggacagaguggaagcaguauaggcagaaaggccuuuguucugguauagguaugguaccuagaaagccgcuucuacucacuggaaugccugaaccaguccuuggauugaguuguauugagaaaggagguuguuggccaagauuccuauguccugaguagacaccgacuuuccuuucuguucagugggaagaugcccauugccacucugucucugauaugugugcggguggucuuaguggguccuguaucacccuucuaaagaguuauuuugguuaccugauuauccccuuucaggagucuaaagcaacgggaagccacuaaagacugcuucccuucaguccugaugguggucuccugacucagaaagucgcugcacauuuggcugagcuguagcaaugagcuuuggggggggggggucugcaucucagcagaacauuuggaaagaugcccuuuguccccuucccaggcucaauggucaaaggcuauuggucauuucuuagugucccggaugcuacaguccaguaggcuucugagcccuccaccccaaccccgucagcaggcagaagaaauuauuucaacuuggagaguugggauauagugugaugaacucaguuucccagcagugagggcuuaggcucuguggagagcauucgugggaaguaggaguggcuuaaaacauggaguccagucuaggaaggcuggacaggguggagacagaacccaagacuccugagagaggcagauaggaaauacagcaaguccucuccuagccuccugaggacacccuacccuucuugcuaccccugaacagcuggcaugggucacccuggguauagaaaagucucaccuuccauccccacaaacucccuggagccaagagucaagucuuccagacuugagacagcucagaaacugucagugccaagacucaaagaggcacacucaacagagguuaauuuggggagagaaaaagagaaugaucuaacagccccaucuuuaguccugugagagacuggaggcucagagauggagcuagguccccagacucucagaguauuccaugauccccugccucaaaguucauccagugacagucuuuccccuuuuuauucaucugcccuuauucuaucccuugcucuaaguaaacauaacucagcccacuaagucuggugguugccagagaaaauguguccagguaagcuuaaauuagaaauuuagguaaauccuaguuggagaaucuuuuuuuuuuucucccaggguagcuucagagauuugagaucaaaaugguaaacugagguugggguggacagggaagggggggaaguggugcacaggcauggucaccacccugcgaguuacaccccgguguauugcacuggaucccuacagcaucucgcagaccugggaaagcuguuuaaggcuaccccuuucccagcuuggcuuuugccccuccuccucaccaccacuccagccccuccccaucccacccaguccgcuggccuugcugcugugcccuccccgugcccuccugcaccucuggggcucucuccucucuacgucucggcgcacucacgucuaagaggcgucuuggacaccuucacaucacugccuaggauccugcgugguccuugcugucugucuucagacuuuuucacgccucucauucaagauccucgguuugcccaucuccgcaguguccuauccucagggcuguccucuugggcgagcucuccucuuuuucccuuggucccggccugcgagccccuaucccgggcucuuucccuccuucccuccucucaaccuccuuuccucccuccugggucccucccuccggcugggccuaguggguggggggcggcagcgcggggcggggcggggcagggcgggcggggcaaggcagugacgcggggcuggccaggcuagaggcgcggcggcgcggggcggggacgcagucccggguccgacuggccgagccccgcgcgccccgcccgcgcccugcgccuccgcccggccagccggcgggggagggggcaugagccggcgcccgcgcgccgccgcgagcugcgggccggccuagagccccgcgcgggccccgcgccggagcuuagccgccgucgcuuccuagccgcgggcgcauccccgggagccgcgaugcagcggccaggggagccgggagccgcgcgcuucgguccgcccgagggcugugcggaucaccgaccgcaucgcuaccgcagcuucaugaucgaagagauccucacugagccuccggggcccaagggcgcagcgcccgcggccgccgcugccgccgcgggcgagcugcucaaguucggcguacaggcgcugcuggccgcccggcccuuccacagccaccuggguacgugcagcggccgccgcgcagaggacugggcuuggcgggcgggugggagucggagaccugggguuguccguaauucauccucuuucuccccuguuucuggagcgaccugggaugcagcucagcgcaggcccgaggcaccuaccucucuucgcgcacuccaacgggaaaguggagggugcgagcaaugagcuaggcagaaaccaggccuuguguccucgcgucagaccagaagagaguuugucuucugcuucagggcggcuucgaguuuuuucgaaucgggugauaggcgaggccaggagccagagaccgcaucccuaugguugcuacaaaaucaaucuaccgagcacucuggaucaaaaugacuucaaaccaggggaagccugaguuucgcgguaggguuggcugggcauaacaguagcugcccagacugggaaagcucuggagaagagggucgugucgcauaguguuggaugcccaagccauccaggagccuuucagaaccccgugcuuuccagucagcaaccgaccgaggccugugcugcggccagggucuccguaggccuuguuugagggaaagaggccugguugugauccgcugcccaguugguccuuccaucccgagaucugcugggcuuucgugcgucuugaagcacuugcucagaucuuuucugucuccgucuugucucuugggagauugugaggcagucugcccuguacugcaucucggcuuagggcuuagugacucucuuugguugaccuccuuccuagccuuuugguaaaguggaucugucuccccucuaccucucccccuccgcaagauucucuucccacuuccugcuauguuuucuaugcuccccuuacccugaugguucucagccaggcagauccauccuuuccaguaucucuuuuaggagaagccuaccaggaaaggaagcguccaauauagacuccagcucagcuagcggccuccggaaccggccccagauucuguccagucuugguagcagccaguccaguuugccucuuugauguucaucugguucacagccucucugcugccguucacuauaaaaggacucuguuguuggcaauucguuugaagcgggcaaacagccgauuuagggcuaaagaacauggagaggucuucaugcuucuuggggggagggggucugaacagaggaaacaagaaagacaauuuucagguucaaaggaugcuuuggugacccuuuccucgccaauguccaagccucagccagugauguagguacagcgcccagaaaaacaaaugcucacauuccacaacguucuuuucccaaugcaaaagcucccccacccccgcccccgcuuccaaauucacccguuucuucuuaguuucucuuuuucacgaaaggcauacucuauguccucggagcagcgaacuugcucuaaagcauccugaaaucucggagccuacuggcucauggggacuccaaaaaagagcaaaggaugcgagggauacucuuuucuagacuccucgggauagcuaccugaaggagggucgcccaggaugcuggguuuaaauccccagggaguggcugguucgggcucccaaacgcagcaaagcgcuguggcgugggaggcuggaauccaguucacccagaucuuucucucuucucucucuccccuucucucuuugcucuguagcggugcugaaggcuga

SEQ ID NO: 11484 - RNA, 7253 nt, Mus musculus
ucagccuucagcaccgcuacagagcaaagagagaaggggagagagagaagagagaaagaucugggugaacuggauuccagccucccacgccacagcgcuuugcugcguuugggagcccgaaccagccacucccuggggauuuaaacccagcauccugggcgacccuccuucagguagcuaucccgaggagucuagaaaagaguaucccucgcauccuuugcucuuuuuuggaguccccaugagccaguaggcuccgagauuucaggaugcuuuagagcaaguucgcugcuccgaggacauagaguaugccuuucgugaaaaagagaaacuaagaagaaacgggugaauuuggaagcgggggcgggggugggggagcuuuugcauugggaaaagaacguuguggaaugugagcauuuguuuuucugggcgcuguaccuacaucacuggcugaggcuuggacauuggcgaggaaagggucaccaaagcauccuuugaaccugaaaauugucuuucuuguuuccucuguucagacccccuccccccaagaagcaugaagaccucuccauguucuuuagcccuaaaucggcuguuugcccgcuucaaacgaauugccaacaacagaguccuuuuauagugaacggcagcagagaggcugugaaccagaugaacaucaaagaggcaaacuggacuggcugcuaccaagacuggacagaaucuggggccgguuccggaggccgcuagcugagcuggagucuauauuggacgcuuccuuuccugguaggcuucuccuaaaagagauacuggaaaggauggaucugccuggcugagaaccaucaggguaaggggagcauagaaaacauagcaggaagugggaagagaaucuugcggagggggagagguagaggggagacagauccacuuuaccaaaaggcuaggaaggaggucaaccaaagagagucacuaagcccuaagccgagaugcaguacagggcagacugccucacaaucucccaagagacaagacggagacagaaaagaucugagcaagugcuucaagacgcacgaaagcccagcagaucucgggauggaaggaccaacugggcagcggaucacaaccaggccucuuucccucaaacaaggccuacggagacccuggccgcagcacaggccucggucgguugcugacuggaaagcacgggguucugaaaggcuccuggauggcuugggcauccaacacuaugcgacacgacccucuucuccagagcuuucccagucugggcagcuacuguuaugcccagccaacccuaccgcgaaacucaggcuuccccugguuugaagucauuuugauccagagugcucgguagauugauuuuguagcaaccauagggaugcggucucuggcuccuggccucgccuaucacccgauucgaaaaaacucgaagccgcccugaagcagaagacaaacucucuucuggucugacgcgaggacacaaggccugguuucugccuagcucauugcucgcacccuccacuuucccguuggagugcgcgaagagagguaggugccucgggccugcgcugagcugcaucccaggucgcuccagaaacaggggagaaagaggaugaauuacggacaaccccaggucuccgacucccacccgcccgccaagcccaguccucugcgcggcggccgcugcacguacccagguggcuguggaagggccgggcggccagcagcgccuguacgccgaacuugagcagcucgcccgcggcggcagcggcggccgcgggcgcugcgcccuugggccccggaggcucagugaggaucucuucgaucaugaagcugcgguagcgaugcggucggugauccgcacagcccucgggcggaccgaagcgcgcggcucccggcuccccuggccgcugcaucgcggcucccggggaugcgcccgcggcuaggaagcgacggcggcuaagcuccggcgcggggcccgcgcggggcucuaggccggcccgcagcucgcggcggcgcgcgggcgccggcucaugcccccucccccgccggcuggccgggcggaggcgcagggcgcgggcggggcgcgcggggcucggccagucggacccgggacugcguccccgccccgcgccgccgcgccucuagccuggccagccccgcgucacugccuugccccgcccgcccugccccgccccgccccgcgcugccgccccccacccacuaggcccagccggagggagggacccaggagggaggaaaggagguugagaggagggaaggagggaaagagcccgggauaggggcucgcaggccgggaccaagggaaaaagaggagagcucgcccaagaggacagcccugaggauaggacacugcggagaugggcaaaccgaggaucuugaaugagaggcgugaaaaagucugaagacagacagcaaggaccacgcaggauccuaggcagugaugugaagguguccaagacgccucuuagacgugagugcgccgagacguagagaggagagagccccagaggugcaggagggcacggggagggcacagcagcaaggccagcggacugggugggauggggaggggcuggagugguggugaggaggaggggcaaaagccaagcugggaaagggguagccuuaaacagcuuucccaggucugcgagaugcuguagggauccagugcaauacaccgggguguaacucgcaggguggugaccaugccugugcaccacuucccccccuucccuguccaccccaaccucaguuuaccauuuugaucucaaaucucugaagcuacccugggagaaaaaaaaaaagauucuccaacuaggauuuaccuaaauuucuaauuuaagcuuaccuggacacauuuucucuggcaaccaccagacuuagugggcugaguuauguuuacuuagagcaagggauagaauaagggcagaugaauaaaaaggggaaagacugucacuggaugaacuuugaggcaggggaucauggaauacucugagagucuggggaccuagcuccaucucugagccuccagucucucacaggacuaaagauggggcuguuagaucauucucuuuuucucuccccaaauuaaccucuguugagugugccucuuugagucuuggcacugacaguuucugagcugucucaagucuggaagacuugacucuuggcuccagggaguuuguggggauggaaggugagacuuuucuauacccagggugacccaugccagcuguucagggguagcaagaaggguaggguguccucaggaggcuaggagaggacuugcuguauuuccuaucugccucucucaggagucuuggguucugucuccacccuguccagccuuccuagacuggacuccauguuuuaagccacuccuacuucccacgaaugcucuccacagagccuaagcccucacugcugggaaacugaguucaucacacuauaucccaacucuccaaguugaaauaauuucuucugccugcugacgggguugggguggagggcucagaagccuacuggacuguagcauccgggacacuaagaaaugaccaauagccuuugaccauugagccugggaaggggacaaagggcaucuuuccaaauguucugcugagaugcagaccccccccccccaaagcucauugcuacagcucagccaaaugugcagcgacuuucugagucaggagaccaccaucaggacugaagggaagcagucuuuaguggcuucccguugcuuuagacuccugaaaggggauaaucagguaaccaaaauaacucuuuagaagggugauacaggacccacuaagaccacccgcacacauaucagagacagaguggcaaugggcaucuucccacugaacagaaaggaaagucggugucuacucaggacauaggaaucuuggccaacaaccuccuuucucaauacaacucaauccaaggacugguucaggcauuccagugaguagaagcggcuuucuagguaccauaccuauaccagaacaaaggccuuucugccuauacugcuuccacucuguccaucccuggagggcucaacaucaggccccuccacuuccucuugggcaucggaaggaguauagcuuggaauggguucuacuggggaggagucccagccagcucccauccuaucuucucugauuuugaucccgacagaagccacccuguauuugaacacuaugcgccuuccuuccaauuucagccagguuuccccaaaacgcaagguugauccuggaaaugggucugagcuaccaagaccacucauuccuauugucgauauccagucaacagcucuguuuuuauugccaggaaggaguuuaaggucaagcugaacagaggaggcucauuuuuuucuggcaugaaggucuuaauucuagaaagagaccccacccccacuccauuccacaggugcgccucucccccucccacacacacccuccagcuccuuggacgcuggccaggacuguuucaagccgcccaggccgaaugccugcagugauuccugccugcugggaaugaagccccaaggacuaaaagcuuagccuggcaccaaaggcucagagccaggcuaugccccgaugccccaugcccucuuuaagcucgagccccugacgcauccuuuucaaacuacauucuucucaaaguccagagggacccuaaagcaaaccugcgaauaaaccccuuuuaggcgaaaaaaaaauugcgaagaaauggcuucagggauccuuuguuuaggaauucugcauuggcuggcuggaaagggguuaguucacaaggaaagggguucccccuuccacuuggacggcacaggacgaagggaaguccccacuagaggcgcagccacugaguccuaagccuaaagcccgccagggccucccgccugucgccuaaacuaaaaucccggaaacuggccgcucugggagaggcaggcacgguggaaaaggugaccucagcgucccaggccagccacccucccggguggcccagcaacgaaggacuccaggccgcaggagauccuuggcgcaguuucuuccgccaagaggggacccuuguacgcggaacccgucccauuucccacuugcgaacccggaagaccccggggcuucagcuggcuguggcagguuagaagggagggaugggucacagcugaaccccagagcagggaugugagguuucaacgcgcaccgcuuccagcugcaguuucuuuccaaagcaccuccaagagggaaggaauucugcaggcaaucuaaccgggaagugguagucccuuaugccacuaagcagauggagcaacccaaagccaguucagccaccagccucagggggcuucuaaguggggcuccccuccaagccucccuaaaccuugaagauuucuuuuuugucuacuuucccacuugcaaccgaucuguaucucauucagcaaauugaauuugggaccccgggugucuggaaggaagauuucuuaaaacuucugugggccaaacaacuuuccggaaaccguccccaguuuacaguaagcucuaagccccacuaaguucguucgccccagagcagcgcucugggucuucuuuccaggaacaaacacccuggagagccccaacuaggguguuuuaagccugccucuccaggcagguuugcggugguggccuuggcggguggccuucagcacggaauacguuucaacucagaugaccaucgccuggaccuggagggcaacgugugaucugggcaggcugccgucugcgcccugcacuuugcuagaaagaggucaucaguuuggcuucaauacacaaaaccgucgagauuauaaaaauacgcgguccccacacucacagaucacaucuaaguugccuuucguuggagagccggucucuguaacuguuucauuauggguaguucgauauccuuguggacuuucguuuugagucuuuccugacucuucccggagcuuggaagucgaaaugcauuuugcgugacagugccuuugcagauacgaucuuugagauugguuccuuuguguccuuggggguuguuguuuaacaaugugugauuuccuuuggaauuuugaguuaagauauauccauagcgcucuccaaggaaccgguuguugauggucaagguuccuggcgauucuucgcugguguuucacacccaccccugccuuuagcggcuuccggugcgaccccagacuagaggugagaaccaggucacucccaagacaguggucgcugacugcggcuccggcuccguggcucgcguggugauguggcuccacuggacagcgaaugcagaaccugggagcccgggccaacagagauucugaacuccgcgcagagugcaggcuggggacugcaagauuccugucccuuuggguaaagagaugaccgucguggugacugacagucuugaggcaacgcuuccaagcccuuugugggcaggugccccgccacccgcucuggccgccuggcucgcacccgggauucugccaaaguccugguuaaauuuaaaaaccgcagacuggccuugcagaaaaguuuuugcugcagaaaagaagaggcaccagagugguggcagcuggaagauaguaagaaaugucgggauggaagacgacccucuuuuuacucucuuccuuuuguuuuuuuuuuuuuucaauuucccauucacccauuucucccucuucuuaucuccccaacucuagcacaggaucccuugcgccuuucugucgucccccccccccccgcccgcccgggaucgcuaaaucauaguucccccauuauuucuaacagcuaagguagaggcagucacaaaggccuguggcacccguugcagacacccugaucuuuaaugcuucuaguaaggaauuaaaucuacagagcccuuggagggguuucuggcuuguuuaugggguagggucucauucuagccugagcaccaugaggagucagcgguggugagacagaccggaaucuaucuagacgcuaucccacgagcucuuuagcugcacugcauucgugggaggagucccugguccucccugacagcgcuccaaauacaaggcuugucaggaaacucaaacgggugagagcagcagagcugggcagcuuugcgaggcucuuuccuuccacucccucaggaggacauugucagcucuggugaugcuuuugccucagaagggauuuggguccucccaggggcaugga

SEQ ID NO: 11485 - RNA, 562 nt, Mus musculus
ugggguugggaccccccucccgugcacagccgcuccaagacaggacaggccuggaaacggacauggccgaagccacccaaucucgggcccagcucaagagaucgggguuguuuuguuuuguuuuguuuuuuaaaagacaacugggggauuuguggagucgagaacccacccuggcuggaccccugguggcucugggcugagguguccacgugggccaggauccccgcugcagcaggguucugccggcucugccgggagucaggccgcgccuccuagcuggcuggcucucgcuguccccagagcucgagcucggcuuuacggaccccucucuucuagccugcucugugaccccaccucuucuuuuaggauucuuuccuccaucugucaaggugucucuuugggcacuuugucuggccaccccuucuacucccugcacaucugcuucucgcccugagccccagcgacuccucagcaaccaguuagggaaaacucaacuuuuuucucccgcgugcuaucugcuccugcuccagaggggcugccagucccacucagggcuuggcgu

SEQ ID NO: 11486 - RNA, 562 nt, Mus musculus
acgccaagcccugagugggacuggcagccccucuggagcaggagcagauagcacgcgggagaaaaaaguugaguuuucccuaacugguugcugaggagucgcuggggcucagggcgagaagcagaugugcagggaguagaagggguggccagacaaagugcccaaagagacaccuugacagauggaggaaagaauccuaaaagaagagguggggucacagagcaggcuagaagagagggguccguaaagccgagcucgagcucuggggacagcgagagccagccagcuaggaggcgcggccugacucccggcagagccggcagaacccugcugcagcggggauccuggcccacguggacaccucagcccagagccaccagggguccagccaggguggguucucgacuccacaaaucccccaguugucuuuuaaaaaacaaaacaaaacaaaacaaccccgaucucuugagcugggcccgagauuggguggcuucggccauguccguuuccaggccuguccugucuuggagcggcugugcacgggaggggggucccaacccca

SEQ ID NO: 11487 - RNA, 1036 nt, Mus musculus
gcaucuggccagcuagccccgggcggcuggugcacaccuugggggccccaagugacuuguuucgcugagagucaacuccugucugggccaccucaaguccccagccacgggagagaacaacuuagaaugagugaagguucgcugagcaggaucgcucugagccggcgccuccgagccagcgccagggcagucaguggcagagccggggggccgguucccgguugcugcagcucccagcgguggugucguccucgaggggcagacgggccccuccuaccucagucgcuucucccaggaacucggggccggcugagugacagcagccugcgagcucuaaugggccccggaugcugucuucuaauuaguuuggacccucuccccuaaggcugcucucauggccuuccucucugcaccgcagucaauuuuccggaauugggguagagaugacggcuucuaaucagacgaaacguuucuguuggcucuaggccauggcgagugggacuggagaccccaagagccccaccaggcccguggccuuuccacaucccccuuuguuuugcaccuacaaugaucaggucuuuggcagccaccagguaggccuugccagccucugcccuccuuuaggguaacuuugcuccaguguggggccuacuuucugaauucucagggcuucagcagaggccugguaggccaggugacugaugucucacaacccugggcugggagcuuaggaagccuuuggguuuucucccgauacacugcuaggaaacuguagcuccagagcuccccccuccccaagcaaagacuuuacccucuaggcucacaagagugguccccuccuuagcuccucacgcuccaaugaaguuuguccaaggauuuuauccaacaauuguuaacuggcccagggacuucagcuucuugaguaaacaggucacaacugagguggcccugaccugccucuguagccacggaggaccccuaggcugucucugggccucaccugcagaccucuccccugaaccagccacugaugggg

SEQ ID NO: 11488 - RNA, 1036 nt, Mus musculus
ccccaucaguggcugguucaggggagaggucugcaggugaggcccagagacagccuagggguccuccguggcuacagaggcaggucagggccaccucaguugugaccuguuuacucaagaagcugaagucccugggccaguuaacaauuguuggauaaaauccuuggacaaacuucauuggagcgugaggagcuaaggaggggaccacucuugugagccuagaggguaaagucuuugcuuggggaggggggagcucuggagcuacaguuuccuagcaguguaucgggagaaaacccaaaggcuuccuaagcucccagcccaggguugugagacaucagucaccuggccuaccaggccucugcugaagcccugagaauucagaaaguaggccccacacuggagcaaaguuacccuaaaggagggcagaggcuggcaaggccuaccugguggcugccaaagaccugaucauuguaggugcaaaacaaagggggauguggaaaggccacgggccugguggggcucuuggggucuccagucccacucgccauggccuagagccaacagaaacguuucgucugauuagaagccgucaucucuaccccaauuccggaaaauugacugcggugcagagaggaaggccaugagagcagccuuaggggagaggguccaaacuaauuagaagacagcauccggggcccauuagagcucgcaggcugcugucacucagccggccccgaguuccugggagaagcgacugagguaggaggggcccgucugccccucgaggacgacaccaccgcugggagcugcagcaaccgggaaccggccccccggcucugccacugacugcccuggcgcuggcucggaggcgccggcucagagcgauccugcucagcgaaccuucacucauucuaaguuguucucucccguggcuggggacuugagguggcccagacaggaguugacucucagcgaaacaagucacuuggggcccccaaggugugcaccagccgcccggggcuagcuggccagaugc

SEQ ID NO: 11489 - RNA, 4608 nt, Mus musculus
guggacacacacaugugcuguuuaauguccaauuggauagcaugaaauaggagguccaucaagucagaucgaggugggaacgccugggagugugucucagacagggacagggaaauggugaaguuagguccuacauggacuguguggagaagcaucugucguucacaucaccauuguguuaauacauuggcaguguaucagugcaguuauuaagcuauugcugugugcccuucugggccuaagccuuaagcacugcucuggguuagacacagcaguccuuuuauuuggagauaucaagguuugcuguguggguggaguggucuucagacccuuucagauacuccuuccacuauccucauagauccugagccccaaagaagcacugaggcuaauggggacugccagaggagugugcuuuucaguagcacauauagugaucaaggggguggggggugggguggacgugggaggaccaacaagaggcugugccccgacucugggcauauugaagaaugagacuagcauaaauucucuguucuuccacagcccccuccccuccucacucacuguccuacucuaagcaggggcuuccgguaugcacaugcagauacacaccgggaggaaagcuacaaucuuucuggggcagaggcucaugcacagcccccuucauuuugaugcgugacuuggaggagguuugagguuugaccuucaagugaaucucaguucuccuguucagugugagaguuggucuccagauggggcaggagggguggaagaaaggggguucacugaagcaggucgaguucuauuccacuacccuucccaccugugcagaguccgaaauauuucucuguccuucaagaaaccgggagacggugaucuggagaugccugcauuguugugggaguuagaggagagacagcccaaggaccugugcugaucugggcuuagucaaauagaaucuggcaaaagaaugguuuaguaauuuaauucuugagaaggccgaguggaggacucucaugggggccacccuuaggucccuaucuggguaugcugcccuaaaaucuguacucuuggagaaugaagggauuuuaggaaaaaggaaggaaugugcuauggcuugcccccagggccauccgugauuccccgggacauuccaacccuaagccucuuaggcuguagaguaguucaaacuagaaaacccaguuuuuggaguguaucggggaccaccuaccucuuucugccccaucuaauacccccuccccaauaaaagcucuugguuuuuauuuuuuucaagcaauuauagacaccuagugcccagguagaaauuggaucaaacuuggaggauuuuaucaguuucccagaagguugcagccuauugagguuucuuugagggacgggguuguaugggaauacugacugcuggauaggacaucagccaccagcuacaauggauguauagggcuugucucucuccauggcugauaugaucugugacucuccaugcuguuuuucacccaagucugccaccauguuuucugauuccagaagaguggcugagcuaagggaauauagggcggcuaagaaaaugguagcguuugucacucugcucuggagcagaggaggacccgcuuuuauuuuucacucucccagggcugcuuucuugggagaagggugcuggaaaccugaaaguuaucaauugccuguguguuuccacagcguccucagacccuacuuuuucucucugguggaggcaccaaggcccaaaaccacaagggaaugggcaggaacugggagucuucucccagggugccccgcuacagguaguuuaugucuuuacccuagaccuggccagucccuuaguccuccaucauucacaaguggacaauaaccuagggauuucuccaguugcagagaugcuaagauaauaucuaaaucuucauuucucauaaauuugggauauauauauuagauuuuguugaauuccuagauuagaaaauaaucuugggacccagaauuuuagcuugagauuuucccuacagcgaucagaggugaaccucgacacccccccccccccaccgacccaggcuuugcuucagcguuauucagccucagugugggaaacuggacaauuuuagaaauugaagacccgguucuagagaaaccguugugugcucagagauucuguaucaacaaccaaacccaggagaggcuucgggagcaauuuuauuggacuuuacgagguguauuuggguuuucucuuaggggaaguaaaagcccgaaccaugcagcagggagcaggccaccauaggcugggacauuucugaaggugacagcuggacaucgugguccagagcgaagaagucgggacuuugaccggucccuacuacuuuuuggcggcauugcuacccuaacgaacuaacuaacgaaugaagcaguuucguuugggaaaaauacccuugugacgcgaagcuaugucccaaguccuuagccauucccaggggccagcguuuccauuugcgguggggccccauuccuggaugcggcagcugccaguccgcucacgggccacugucucccgcaggcccucgggaagcacugccaggggcuuccagggcugcgccuuugcugugccugagccugugcccuggacaccguagcccucugggaguguggggccgaggcacagagugggcccacccguaggugaguuagcaauccggugauggcacgauccacccggcccgcaggaaccaguaucuccugcugccucgaugaucuuggccucuucccugcuuaagacuguggagaccccucgccccagccuggcgucucuuaccguauggaggcagcucugugucugaggcuagucggcuccgggcucgcccgccgcagacucccgcucagguggccacuggcucugcucugcgcgcagugugggucuccgccgguucgguucguuacauccuagcacgcaaggucggggcugccuccguucaacccgcuccucccgccgccgcccgucgcccgucgcccguggggaaggcggggacaccggccggggaggcgggaaugggggggguggggagaagcgaggcgcucgccuggacccaaggggagggggcggcgcggagucccacgggcguggggccggggccuuucuccacgcgcaggagacgucgguacagcucaccgccaaagccggggccggggagguugcccaggacugcaugcauagggaggggcucagcuguggguccccugagaugccucgagucccacuggucuagggacuuucucccgggucucaguuucccaccuggcacuugagggacuugucugauuucgguuuagucuaggucuggccagaguuuccuugcguccugucaggugaaggucaagccgggucuaucauuucccacuuuccugccuggcuugaggaguguuuucgccacagauguuguuauccacagaaaauugaggacaaacucgggggggggguucugugugcaggggugggcugugcuaggggcagccucuguaccugccccgccugagggauuccuuucuccucaaagugcggggcuggcuaaaaagacucucccugcugccuuuugucuugcucuuuccccugaacccucucccggucauccugaugugggaugggaugcagaguggcagggagcccagugacucucuaggccugucuugacuuagcagccuuuggaagaugaggagaauucaggcaaacugauaguuagcccuucauacacucgcagcccgcugggugcucuaguggugcucugggaccaaauagugcuacaagaagagccuucgauuccgggcggcgauagggggaccaaucgacugaaaccacugcuuccucugucuuccagaccuagccugucccuucagagggucagccugugagauuagaggcgaaucaggcugugccugggacuccuggacugagagcgacccaggcuggcuuccaacuucccggggcaucagaucgagggcggcugguucgauguaaggugcugggggagauugcauuaaaguuucaugaggugcagucacaggcggcgccugccugccuaguucuagccgacagcugcugugguggaugggugcccgacucugcuccgguucggauugguaccuuuagggccaccuggccuaggaacggggagacccaagacccugccaccaaacugcagcuccaggcuagccgagguccggggaguuagauccccagcaaggaugaggaagagaaacacacaacauccaucuacucuaagggccgguucuaggagcuucacucucacuggcuucaaaggguuaagaauucugguccccaguacuugccuauagugccuggcagaaaauccauccccuaccccagagccucuggucccccucuccgaugucuaugguaaaaauggccuucucaccuaaucaccagccaccgaguguaccggcaucuuuuaacauaaaagcaaaccagcggauccuuacugaaggacacgcacucucgggcgccugguugggguagcauucucucugacuggaguaggaaaucacguuguuuuauucuccugcccuggu

SEQ ID NO: 11490 - RNA, 4608 nt, Mus musculus
accagggcaggagaauaaaacaacgugauuuccuacuccagucagagagaaugcuaccccaaccaggcgcccgagagugcguguccuucaguaaggauccgcugguuugcuuuuauguuaaaagaugccgguacacucgguggcuggugauuaggugagaaggccauuuuuaccauagacaucggagagggggaccagaggcucugggguaggggauggauuuucugccaggcacuauaggcaaguacuggggaccagaauucuuaacccuuugaagccagugagagugaagcuccuagaaccggcccuuagaguagauggauguuguguguuucucuuccucauccuugcuggggaucuaacuccccggaccucggcuagccuggagcugcaguuugguggcagggucuugggucuccccguuccuaggccagguggcccuaaagguaccaauccgaaccggagcagagucgggcacccauccaccacagcagcugucggcuagaacuaggcaggcaggcgccgccugugacugcaccucaugaaacuuuaaugcaaucucccccagcaccuuacaucgaaccagccgcccucgaucugaugccccgggaaguuggaagccagccugggucgcucucaguccaggagucccaggcacagccugauucgccucuaaucucacaggcugacccucugaagggacaggcuaggucuggaagacagaggaagcagugguuucagucgauuggucccccuaucgccgcccggaaucgaaggcucuucuuguagcacuauuuggucccagagcaccacuagagcacccagcgggcugcgaguguaugaagggcuaacuaucaguuugccugaauucuccucaucuuccaaaggcugcuaagucaagacaggccuagagagucacugggcucccugccacucugcaucccaucccacaucaggaugaccgggagaggguucaggggaaagagcaagacaaaaggcagcagggagagucuuuuuagccagccccgcacuuugaggagaaaggaaucccucaggcggggcagguacagaggcugccccuagcacagcccaccccugcacacagaaccccccccccgaguuuguccucaauuuucuguggauaacaacaucuguggcgaaaacacuccucaagccaggcaggaaagugggaaaugauagacccggcuugaccuucaccugacaggacgcaaggaaacucuggccagaccuagacuaaaccgaaaucagacaagucccucaagugccaggugggaaacugagacccgggagaaagucccuagaccagugggacucgaggcaucucaggggacccacagcugagccccucccuaugcaugcaguccugggcaaccuccccggccccggcuuuggcggugagcuguaccgacgucuccugcgcguggagaaaggccccggccccacgcccgugggacuccgcgccgcccccuccccuuggguccaggcgagcgccucgcuucuccccaccccccccauucccgccuccccggccgguguccccgccuuccccacgggcgacgggcgacgggcggcggcgggaggagcggguugaacggaggcagccccgaccuugcgugcuaggauguaacgaaccgaaccggcggagacccacacugcgcgcagagcagagccaguggccaccugagcgggagucugcggcgggcgagcccggagccgacuagccucagacacagagcugccuccauacgguaagagacgccaggcuggggcgaggggucuccacagucuuaagcagggaagaggccaagaucaucgaggcagcaggagauacugguuccugcgggccggguggaucgugccaucaccggauugcuaacucaccuacgggugggcccacucugugccucggccccacacucccagagggcuacgguguccagggcacaggcucaggcacagcaaaggcgcagcccuggaagccccuggcagugcuucccgagggccugcgggagacaguggcccgugagcggacuggcagcugccgcauccaggaauggggccccaccgcaaauggaaacgcuggccccugggaauggcuaaggacuugggacauagcuucgcgucacaaggguauuuuucccaaacgaaacugcuucauucguuaguuaguucguuaggguagcaaugccgccaaaaaguaguagggaccggucaaagucccgacuucuucgcucuggaccacgauguccagcugucaccuucagaaaugucccagccuaugguggccugcucccugcugcaugguucgggcuuuuacuuccccuaagagaaaacccaaauacaccucguaaaguccaauaaaauugcucccgaagccucuccuggguuugguuguugauacagaaucucugagcacacaacgguuucucuagaaccgggucuucaauuucuaaaauuguccaguuucccacacugaggcugaauaacgcugaagcaaagccugggucggugggggggggggggugucgagguucaccucugaucgcuguagggaaaaucucaagcuaaaauucugggucccaagauuauuuucuaaucuaggaauucaacaaaaucuaauauauauaucccaaauuuaugagaaaugaagauuuagauauuaucuuagcaucucugcaacuggagaaaucccuagguuauuguccacuugugaaugauggaggacuaagggacuggccaggucuaggguaaagacauaaacuaccuguagcggggcacccugggagaagacucccaguuccugcccauucccuugugguuuugggccuuggugccuccaccagagagaaaaaguagggucugaggacgcuguggaaacacacaggcaauugauaacuuucagguuuccagcacccuucucccaagaaagcagcccugggagagugaaaaauaaaagcggguccuccucugcuccagagcagagugacaaacgcuaccauuuucuuagccgcccuauauucccuuagcucagccacucuucuggaaucagaaaacaugguggcagacuugggugaaaaacagcauggagagucacagaucauaucagccauggagagagacaagcccuauacauccauuguagcugguggcugauguccuauccagcagucaguauucccauacaaccccgucccucaaagaaaccucaauaggcugcaaccuucugggaaacugauaaaauccuccaaguuugauccaauuucuaccugggcacuaggugucuauaauugcuugaaaaaaauaaaaaccaagagcuuuuauuggggaggggguauuagauggggcagaaagagguaggugguccccgauacacuccaaaaacuggguuuucuaguuugaacuacucuacagccuaagaggcuuaggguuggaaugucccggggaaucacggauggcccugggggcaagccauagcacauuccuuccuuuuuccuaaaaucccuucauucuccaagaguacagauuuuagggcagcauacccagauagggaccuaaggguggcccccaugagaguccuccacucggccuucucaagaauuaaauuacuaaaccauucuuuugccagauucuauuugacuaagcccagaucagcacagguccuugggcugucucuccucuaacucccacaacaaugcaggcaucuccagaucaccgucucccgguuucuugaaggacagagaaauauuucggacucugcacaggugggaaggguaguggaauagaacucgaccugcuucagugaacccccuuucuuccaccccuccugccccaucuggagaccaacucucacacugaacaggagaacugagauucacuugaaggucaaaccucaaaccuccuccaagucacgcaucaaaaugaagggggcugugcaugagccucugccccagaaagauuguagcuuuccucccgguguguaucugcaugugcauaccggaagccccugcuuagaguaggacagugagugaggaggggagggggcuguggaagaacagagaauuuaugcuagucucauucuucaauaugcccagagucggggcacagccucuuguugguccucccacguccaccccaccccccacccccuugaucacuauaugugcuacugaaaagcacacuccucuggcaguccccauuagccucagugcuucuuuggggcucaggaucuaugaggauaguggaaggaguaucugaaagggucugaagaccacuccacccacacagcaaaccuugauaucuccaaauaaaaggacugcugugucuaacccagagcagugcuuaaggcuuaggcccagaagggcacacagcaauagcuuaauaacugcacugauacacugccaauguauuaacacaauggugaugugaacgacagaugcuucuccacacaguccauguaggaccuaacuucaccauuucccugucccugucugagacacacucccaggcguucccaccucgaucugacuugauggaccuccuauuucaugcuauccaauuggacauuaaacagcacauguguguguccac

SEQ ID NO: 11491 - RNA, 2009 nt, Mus musculus
gggaugaaacagggcgucguguggagcaggucuuugggcaggccaggaaaggagaaaaggggaucgcccgggccauaggugaagucuucugaagccgagggacuacuggggucagagaguggugaugccacaguggcgcagggggaggcagcggccccggaaccccaggacucagugucgcuggccgggcucgggggcccgggcagacaggggacacacugcggaggcaggaggcgcucccgggcacugcccccggggagcccuugaucugccaggcgcagugucucagccagggcccagauguaguuguaggcgaagcgcagcgucucaaucuuggugagcuuggugucgucggggaacgagggcagcacgcugcgcaaggcguccagcgcagcguugagguugugcaugcgguugcgcucgcgaucguuggcuuugacgcgacgacuccuccgcagggagugcagcagagccucggaccgcacccgagcgcgaccucgccgccuccgccguuccugcucuucguccugggcaccgggaacauucgaugccccggagagggcgggagcgcuccuccgggcuggcacggacagccccgagguggaggcuaggggcuguagccuggcacaguccuccucgucggugaggaagcuggacaggucgcugcugcuguugcugcuggagcagucgagaucagagaugcaggucuccaaaggggcaggcaucuugcagugugcaggaccgacagacggacaggagguuuggaggucggccuucgaagcgcacuuacuguccguacgacccggggcuagccugugccugcugcaggcgcgagggccgggaagaucgcaggggcucagggagugaaugggcuuggcccuccucgccucgccugcaggggccacgcgccgggcuggucuccugagugaugucgccggcgaucagaucagcuccugugagcaccaaguguggcacacgaccggccucaggaccccuuaaguacggcgcgcaacaaugggcgcccccucccuggccaccuccgcccccgaggcggcgcgggugaauggcgagaggcggcaggucagccccgugcggcgccugcuauuugcauaauuuaugcucgcgggaggccgcccccgcccagccccccuccuggagcgugcccguaauuaccgccggccaaucgguggcccggccugcuccgggagccggaucaagcgagggaggccggggcgucucuggccgggaaacccgggcgaaggcgggggccgggggcgauuagcggcgggccgaggcacacuccucccaggggcgcgcgggugucccucgcugggguggauggggaggaggagcccuggcagaaagugugagcucuguggcgggugauggagagcuggggcugaggcuggaggcuggguucgcaucccuuugccugcuacugaguucgcaucccuuugccugcuacugauugacuauucgcaucuaaacagacaggaccaguaaacaguuacacgucuugaggagggauagaugucccugcuccgccaagguuaaugaagaagacagcaagagaaagaucuaaagauccaaugaguucccagacugagcuggggcuugaccccacucugccccugcccgcguaccccuccucaaagacucacgagguaauaugggggugugcagacccccucuucuccugaaaucuugcucucuccauuuccaagcauccucuugugccgcacguuuuggaauggugccagccucaggggcucaccccagugccagcuggcuaagggacuuagcuucuggccaggagagagaugucccacagaaggcagcaagcacacaguggaauuccguccccaucccuucugccaauuugccuauaaacuugccuaguccagagaaauguccucauucugugggucgagucauuuuccuguuugccggacagcaauagaggcucaggcagccucucaaaugcaccugagaggaguuauuuauuaagg

SEQ ID NO: 11492 - RNA, 2009 nt, Mus musculus
ccuuaauaaauaacuccucucaggugcauuugagaggcugccugagccucuauugcuguccggcaaacaggaaaaugacucgacccacagaaugaggacauuucucuggacuaggcaaguuuauaggcaaauuggcagaagggauggggacggaauuccacugugugcuugcugccuucugugggacaucucucuccuggccagaagcuaagucccuuagccagcuggcacuggggugagccccugaggcuggcaccauuccaaaacgugcggcacaagaggaugcuuggaaauggagagagcaagauuucaggagaagagggggucugcacacccccauauuaccucgugagucuuugaggagggguacgcgggcaggggcagaguggggucaagccccagcucagucugggaacucauuggaucuuuagaucuuucucuugcugucuucuucauuaaccuuggcggagcagggacaucuaucccuccucaagacguguaacuguuuacugguccugucuguuuagaugcgaauagucaaucaguagcaggcaaagggaugcgaacucaguagcaggcaaagggaugcgaacccagccuccagccucagccccagcucuccaucacccgccacagagcucacacuuucugccagggcuccuccuccccauccaccccagcgagggacacccgcgcgccccugggaggagugugccucggcccgccgcuaaucgcccccggcccccgccuucgcccggguuucccggccagagacgccccggccucccucgcuugauccggcucccggagcaggccgggccaccgauuggccggcgguaauuacgggcacgcuccaggaggggggcugggcgggggcggccucccgcgagcauaaauuaugcaaauagcaggcgccgcacggggcugaccugccgccucucgccauucacccgcgccgccucgggggcggagguggccagggagggggcgcccauuguugcgcgccguacuuaagggguccugaggccggucgugugccacacuuggugcucacaggagcugaucugaucgccggcgacaucacucaggagaccagcccggcgcguggccccugcaggcgaggcgaggagggccaagcccauucacucccugagccccugcgaucuucccggcccucgcgccugcagcaggcacaggcuagccccgggucguacggacaguaagugcgcuucgaaggccgaccuccaaaccuccuguccgucugucgguccugcacacugcaagaugccugccccuuuggagaccugcaucucugaucucgacugcuccagcagcaacagcagcagcgaccuguccagcuuccucaccgacgaggaggacugugccaggcuacagccccuagccuccaccucggggcuguccgugccagcccggaggagcgcucccgcccucuccggggcaucgaauguucccggugcccaggacgaagagcaggaacggcggaggcggcgaggucgcgcucgggugcgguccgaggcucugcugcacucccugcggaggagucgucgcgucaaagccaacgaucgcgagcgcaaccgcaugcacaaccucaacgcugcgcuggacgccuugcgcagcgugcugcccucguuccccgacgacaccaagcucaccaagauugagacgcugcgcuucgccuacaacuacaucugggcccuggcugagacacugcgccuggcagaucaagggcuccccgggggcagugcccgggagcgccuccugccuccgcaguguguccccugucugcccgggcccccgagcccggccagcgacacugaguccugggguuccggggccgcugccucccccugcgccacuguggcaucaccacucucugaccccaguagucccucggcuucagaagacuucaccuauggcccgggcgauccccuuuucuccuuuccuggccugcccaaagaccugcuccacacgacgcccuguuucauccc

SEQ ID NO: 11493 - RNA, 1605 nt, Mus musculus
ggagaagccggggcaggaaauugucaauuuguuccuuauuuuaccuuaaugcgcccuaaauggacuaauuucuuuaaaaguaauugugcuguauuaaaguuuaauuugauuuaacaucgucuuaaaaaaaaucuauggaauauguagauuccaaaacaaaacggaguuggggaugcugacaccuuuuuguuuuucuuauuuuuuucuuucucucuccccuucauuauuaauauuauuauuuuuggaaggaguucuagcccgcgauaauuuguuuggagguguuucucucuuuuuccacucuuguuugcuuugauuuggaauuucuuucaucccuuuuuccccuucuuccuuucuaucaucaccuucuccucuaagugugcuuaaauuuguuuucuuuuuuuaaaaaaaaaucuucuccuuugugaaggagaagccgcuguaugaagguggauuugcuaagugugcugguugagaagaaaagcccaacucauccucucgggcaucccugccuucuacaagggacucgguguuaccagugacggggagggacgagccguuuauuucucgggagagaaaaguugaauucucuaaaguuugauucacuguuauggcuauagaguuuacuuaaauuucuuugaagcuaucuggguuaccaaguucugggcuucaggcuuggggagcuuuagugauggaugugacuccguuucccaaacacuuucucugauuugagggggaggcggagcugauuugggcuuauuuugagagguggaaggcuuggagacauauucaucuuccgaaagucagagggaauuggccagaguucauuuagcgccuuugcucaggaggagcagccuccaaaggcucucucuugauuucuuuuucucccgcaccacccgacuaagaauuuucucaagguuuccugggacaccaggguuacaguuagugaaaggacucggguguguuucauugucaggccugggagugguuuuuuuguuuuuguuuuuguuuuguuuuuuguuuuguuuugugggagacacgaaggccggagcugugaagcaccagagcgggcuguggagagaaggaggccaggagaugcuauuucaaccuagcuguccaauuccugggaaaccgggcugaggaccaggcaguuuccgccucggggcaagcgugggcgcagagggagcgguggauggggcugaagcagaaccucucagggaagucaccggcuccucacgucgccaggacaguacugaucgagaucccuuucccuccucagguaugaaagaugccgccgagcuucugggccaccgggaggcggugaaguguaggcuggguguggggggcucugacccugggggucauccaggggaccuggcacccaacucggacccggucgaaggagccacucugcugccgggcgaggacaucaccaccgugggcucuaccccugcuucgcuggcggugagcgccaaagacccagacaagcagccggggccccagggcggccccaaccccagccaagccggccaacagcagggccaacagaaacagaagcgccaccggacacgcuucaccccagcacagcucaacgaauuggagaggagc

SEQ ID NO: 11494 - RNA, 1605 nt, Mus musculus
gcuccucuccaauucguugagcugugcuggggugaagcguguccgguggcgcuucuguuucuguuggcccugcuguuggccggcuuggcugggguuggggccgcccuggggccccggcugcuugucugggucuuuggcgcucaccgccagcgaagcagggguagagcccacgguggugauguccucgcccggcagcagaguggcuccuucgaccggguccgaguugggugccagguccccuggaugacccccagggucagagccccccacacccagccuacacuucaccgccucccgguggcccagaagcucggcggcaucuuucauaccugaggagggaaagggaucucgaucaguacuguccuggcgacgugaggagccggugacuucccugagagguucugcuucagccccauccaccgcucccucugcgcccacgcuugccccgaggcggaaacugccugguccucagcccgguuucccaggaauuggacagcuagguugaaauagcaucuccuggccuccuucucuccacagcccgcucuggugcuucacagcuccggccuucgugucucccacaaaacaaaacaaaaaacaaaacaaaaacaaaaacaaaaaaaccacucccaggccugacaaugaaacacacccgaguccuuucacuaacuguaacccuggugucccaggaaaccuugagaaaauucuuagucggguggugcgggagaaaaagaaaucaagagagagccuuuggaggcugcuccuccugagcaaaggcgcuaaaugaacucuggccaauucccucugacuuucggaagaugaauaugucuccaagccuuccaccucucaaaauaagcccaaaucagcuccgccucccccucaaaucagagaaaguguuugggaaacggagucacauccaucacuaaagcuccccaagccugaagcccagaacuugguaacccagauagcuucaaagaaauuuaaguaaacucuauagccauaacagugaaucaaacuuuagagaauucaacuuuucucucccgagaaauaaacggcucgucccuccccgucacugguaacaccgagucccuuguagaaggcagggaugcccgagaggaugaguugggcuuuucuucucaaccagcacacuuagcaaauccaccuucauacagcggcuucuccuucacaaaggagaagauuuuuuuuuaaaaaaagaaaacaaauuuaagcacacuuagaggagaaggugaugauagaaaggaagaaggggaaaaagggaugaaagaaauuccaaaucaaagcaaacaagaguggaaaaagagagaaacaccuccaaacaaauuaucgcgggcuagaacuccuuccaaaaauaauaauauuaauaaugaaggggagagagaaagaaaaaaauaagaaaaacaaaaaggugucagcauccccaacuccguuuuguuuuggaaucuacauauuccauagauuuuuuuuaagacgauguuaaaucaaauuaaacuuuaauacagcacaauuacuuuuaaagaaauuaguccauuuagggcgcauuaagguaaaauaaggaacaaauugacaauuuccugccccggcuucucc

SEQ ID NO: 11495 - RNA, 2540 nt, Mus musculus
guacacagcucagcuuuaagguccuuagagcugagcccuaaauuguauuccccaauguguaaaacuguucaauguguaaaugauacuuagucauuucuauuuuaaagguggaagugguacaaugggcugguuugauaauugccucggcucgcuauaguaguuauuuucucugaaauucucuacaguuaacuacuccuugugaguuugcuuaaguuuucuguauccugccuucuguagauuuuugaagcuuugcugagauuccaaccuuagccuaccccccccccuuccccaaccuuuaaaauagaguucugguaggauuuaccuuucacaaagaugcucauacuuucuaaguugccuggaagcugcuggaauguggacugugcccacucccuacuuaagucuaucuggccaaccucgccauuccauugccuaacaaagaaagcacuaacaacuaagauaaauccaaacgaaaaaagaaaagaaaaccaccaacaguggaaauuuaagauuuauacauacggcgcaaaggaacuacaguuauacucagggauauguaguugaacaacgcacgaaccacugaaagcgucaccagaaagcgcauuacugagaggcauuccucuuuuccggugaucccaacaacacaccuguuguauaugaaagccacgcauugcuaaccugccuggaaagcugccuucuccccgccccagguaauuccccuaguggcaguuugcccggugagccccgggcaggcccgaggauaccuccgcucccgcuggaaccccgguuacuccaccugggucgaaaggggcucagaguuguuccagcgccaagaugcagaggccauuuugguccccacccauuuguccccgcauacuuccucugaugcaaggccacucgccgcuagacucgcggggccgacuuugcccaggaggucugcaaaguggaccgccuauacaggcugcggguccccgagaccgugcgccccaccgcagcuuugcgcucgggagccgccaggccagagcagggcagcagagcaggcccugccccggggcagguccccggcccgcggucacggaugagaauccaccgcgugagcagcuucccucgaaauccagccucacucgaaaagaacaccaaaagcugaaaucaacaaggacgcacgcaccgcccccuguuccaaacagccagaauaauacacuccacgacucuggggacgcugcagaggacccccggccucccuccugggaugaauuacccaaaagagcggaaaccagaagggccacagggaucuuuaucgcccugcgucgcccagcaccagcccuaacuagagaccccgaguaacccacagaucuccagcgcccaguugagcgcuggauccgcccccgacgcucccgccucggcaaaaguagaaaguagcucgggcauuucugguggacaagguuucgcccgcgacuccgagagagaaagggagccccccagauccucccgcgcugcgcucaggcacacgcgcuucucugguuuccgugagagccgaguccagggcgaaacugccaccgaaacuggcuccgcgugcccuccccgcgccucgccucccagccccggcgcgucacccugggggaccccgggcaccgcaccugccucgcacccaccuuggcggccggaaucccaaggugcucaccuggccggugcaccugccgccgcccgcgcugccaauccacaguucaacugagccaggaggaccguccuccgcuucccccacccccuacccccgggcaugcgcaccaauuucuggccgaacccgcccggggcugugcgcugggacccaccugccgagccccuagccgguugcuccgugcgcuggaccgcucucccgcaacuccaccgcugucgccuaaggaaagaggggccgggaggugggcacuagcgacgagguguggcguggccagccuccucccucggugacccauucaccugaaacuccgaugggagggggagggagcgacggagaaggaggcgggaggaccgggcagggcucaccacccagagcaagccgaguuaaaggaacagcaccgacguugccuggagaggggcgggggcgugcggagagaagggucucaagaucguggaggcaauggggugauccuagaccauuuugggugugcucggagauacgccugcuucagggccccugugggguguugguuccgggaggagagucagaggucaggagggagcuguugugcugcuacucagagaggguccaagggcgccuggaggcugaugagaaggucugaguucucuuccuacuguguucugcugccagguuugauuaaaugucugguggaaaacaguacccgaugcuugguccagcgaaagaguggacuuuuuucagaagugcuuauuacuagcaccuuccgauucagaggauucggaaaaagacuacccucuggucuggagugguuaaaaugaagagagauuacuguagcugugugagucacacggaauccccaggccacaggguccuuguccacgcaugcacg

SEQ ID NO: 11496 - RNA, 2540 nt, Mus musculus
cgugcaugcguggacaaggacccuguggccuggggauuccgugugacucacacagcuacaguaaucucucuucauuuuaaccacuccagaccagaggguagucuuuuuccgaauccucugaaucggaaggugcuaguaauaagcacuucugaaaaaaguccacucuuucgcuggaccaagcaucggguacuguuuuccaccagacauuuaaucaaaccuggcagcagaacacaguaggaagagaacucagaccuucucaucagccuccaggcgcccuuggacccucucugaguagcagcacaacagcucccuccugaccucugacucuccucccggaaccaacaccccacaggggcccugaagcaggcguaucuccgagcacacccaaaauggucuaggaucaccccauugccuccacgaucuugagacccuucucuccgcacgcccccgccccucuccaggcaacgucggugcuguuccuuuaacucggcuugcucuggguggugagcccugcccgguccucccgccuccuucuccgucgcucccucccccucccaucggaguuucaggugaaugggucaccgagggaggaggcuggccacgccacaccucgucgcuagugcccaccucccggccccucuuuccuuaggcgacagcgguggaguugcgggagagcgguccagcgcacggagcaaccggcuaggggcucggcaggugggucccagcgcacagccccgggcggguucggccagaaauuggugcgcaugcccggggguagggggugggggaagcggaggacgguccuccuggcucaguugaacuguggauuggcagcgcgggcggcggcaggugcaccggccaggugagcaccuugggauuccggccgccaaggugggugcgaggcaggugcggugcccggggucccccagggugacgcgccggggcugggaggcgaggcgcggggagggcacgcggagccaguuucgguggcaguuucgcccuggacucggcucucacggaaaccagagaagcgcgugugccugagcgcagcgcgggaggaucuggggggcucccuuucucucucggagucgcgggcgaaaccuuguccaccagaaaugcccgagcuacuuucuacuuuugccgaggcgggagcgucgggggcggauccagcgcucaacugggcgcuggagaucuguggguuacucggggucucuaguuagggcuggugcugggcgacgcagggcgauaaagaucccuguggcccuucugguuuccgcucuuuuggguaauucaucccaggagggaggccggggguccucugcagcguccccagagucguggaguguauuauucuggcuguuuggaacagggggcggugcgugcguccuuguugauuucagcuuuugguguucuuuucgagugaggcuggauuucgagggaagcugcucacgcgguggauucucauccgugaccgcgggccggggaccugccccggggcagggccugcucugcugcccugcucuggccuggcggcucccgagcgcaaagcugcgguggggcgcacggucucggggacccgcagccuguauaggcgguccacuuugcagaccuccugggcaaagucggccccgcgagucuagcggcgaguggccuugcaucagaggaaguaugcggggacaaauggguggggaccaaaauggccucugcaucuuggcgcuggaacaacucugagccccuuucgacccagguggaguaaccgggguuccagcgggagcggagguauccucgggccugcccggggcucaccgggcaaacugccacuaggggaauuaccuggggcggggagaaggcagcuuuccaggcagguuagcaaugcguggcuuucauauacaacagguguguuguugggaucaccggaaaagaggaaugccucucaguaaugcgcuuucuggugacgcuuucagugguucgugcguuguucaacuacauaucccugaguauaacuguaguuccuuugcgccguauguauaaaucuuaaauuuccacuguuggugguuuucuuuucuuuuuucguuuggauuuaucuuaguuguuagugcuuucuuuguuaggcaauggaauggcgagguuggccagauagacuuaaguagggagugggcacaguccacauuccagcagcuuccaggcaacuuagaaaguaugagcaucuuugugaaagguaaauccuaccagaacucuauuuuaaagguuggggaagggggggggguaggcuaagguuggaaucucagcaaagcuucaaaaaucuacagaaggcaggauacagaaaacuuaagcaaacucacaaggaguaguuaacuguagagaauuucagagaaaauaacuacuauagcgagccgaggcaauuaucaaaccagcccauuguaccacuuccaccuuuaaaauagaaaugacuaaguaucauuuacacauugaacaguuuuacacauuggggaauacaauuuagggcucagcucuaaggaccuuaaagcugagcuguguac

SEQ ID NO: 11497 - RNA, 873 nt, Mus musculus
ccuucagggcucggggacgcgggcuccccccccacccccaacgagcggagccccgggagcagcgcgccccgcucgcuucauucauugcccgcccggccccggcccgccgcucacccggagggggccgcugcagagggcggcucggcccccgcggggcuccgggcgccgcugucccgcgcggccgccagcucggcagagugggagccgcagcgacucgccgcucccggggguggcggucccgccgcgggcuggaagcgacucgcuccugcagccgcguccgcgggcuccggcgacggggaaguagaugggcagggcggcgaggcggcggcgaggaagagcggcugcuccggcagcugguccagcuccacacuccgcacuuugcgcagcugccgccgccgccaguccgcgcgcucgcggcccgcgcugccaggcucccgcagcagccccgccgcgcccgcugcgggcgcgccgcuucccuggagagcuccuccuccuccgccgccgccgcccgccucgggacucgccgccgcggcgcccgggaaucccgacgacgaggcgcgaucgcccgccgccgccgccauuuucucucgcgggcuacauucgcucgugccugcgggggagggagggggcggggagagcgcggggggcgggcggagcggcgggcgggugggcgggcgcgcgcugcugccgagggcgcgggcgcgggcgcgagcggggccgcgccucccggccggggcccgggagcgcggagcggcgggcgggcgcgcggcgcaggugggagggcaggggcaaugcggggaaccgggcgccgggcguugugcgcugcaaccaggccgccgccagguagugcgagaccgggcggggcagcggcuc

SEQ ID NO: 11498 - RNA, 873 nt, Mus musculus
gagccgcugccccgcccggucucgcacuaccuggcggcggccugguugcagcgcacaacgcccggcgcccgguuccccgcauugccccugcccucccaccugcgccgcgcgcccgcccgccgcuccgcgcucccgggccccggccgggaggcgcggccccgcucgcgcccgcgcccgcgcccucggcagcagcgcgcgcccgcccacccgcccgccgcuccgcccgccccccgcgcucuccccgcccccucccucccccgcaggcacgagcgaauguagcccgcgagagaaaauggcggcggcggcgggcgaucgcgccucgucgucgggauucccgggcgccgcggcggcgagucccgaggcgggcggcggcggcggaggaggaggagcucuccagggaagcggcgcgcccgcagcgggcgcggcggggcugcugcgggagccuggcagcgcgggccgcgagcgcgcggacuggcggcggcggcagcugcgcaaagugcggaguguggagcuggaccagcugccggagcagccgcucuuccucgccgccgccucgccgcccugcccaucuacuuccccgucgccggagcccgcggacgcggcugcaggagcgagucgcuuccagcccgcggcgggaccgccacccccgggagcggcgagucgcugcggcucccacucugccgagcuggcggccgcgcgggacagcggcgcccggagccccgcgggggccgagccgcccucugcagcggcccccuccgggugagcggcgggccggggccgggcgggcaaugaaugaagcgagcggggcgcgcugcucccggggcuccgcucguuggggguggggggggagcccgcguccccgagcccugaagg

SEQ ID NO: 11499 - RNA, 4346 nt, Mus musculus
gcacacaaacggucuagcuccgguguggacaggcauguggcgggugagguuauagugagcauugaacaccuauggaaggaugagagcggaacuuaggcugagucugccaagggccuagaaucaggcccggaggcuacaauuuaccucccuuaaccaaccaucccaucugaagccagcaaguccuuuugucaacuguguggcgauuuuacagccccauuuuacagaauaggaaacugaggcucaacugagcaucgaacggagcgcgcagcuauugggaagcuccucugcuugagagaaagguguacaaggcagcccaagaaagucaggggcuacuagcucccuccccccagaaccguaggccucaccuugccgcacacuucgcaggugaaguuuuuggguuugcugucaguagagccccccgguaguuugcuguggcucuugacucccccucguucagcugucaaggccgaguucuccuucagcaccugcuccaguggcgcaugcaagcgcuccuuauggggauaggaagcugggugggggaacuuguccgcagccaggcuggccaguuuggcguucuccagcagaaaaagcuuggggugagcagccagggaagugggggccugugcguugaggaggccggaugggaaaagguggccuccgaggagcuccgaagguggguaagcgguggaguccagguaguugaaguaguagagagagccgcuggcaggcagccccacagccugguugaugaccugcgguuugaugacccugccggcgggcagcgcagaaggcgcgaggcccaguucggccuugcagcacacgccacaguugguuuugcacaagccgcuggcgccgcacacuggggcccccccgccgcugccuccuccuccaccgccgcccgcccggaggcugcucuuccagaacuccgaguaacugagcagcgucuuggacggcaccucguagccuagaggcuggagagggaucauacagggcagcggcgagcagagguugagcaguuucuugcucuggcugcugucugccucuaacgcagcaggccggggcucgaaaggcgcucggggcucggacgucuuggccaugaugcgcucgauagagaaagcuaguguuuuagaaguggccggugacgcuccagcgcgcgggcaggccgggggcaccauggucuccagggaagcugagcuggccauggcgcgccaagcugggccaggcugggccagggcacagccucucuccucuaagucugcauuccggaaaaggcaggggggaaaccgcaauuuaauaagcaccuagucggcccggucacccauuugcauucaaaugaacagaagcagaacaaagugcacccaaggguaccaaauuaccgcccauuaacccggcgcgcaaaggaacccaccagcuauugcccugggacuaugaaagggggaagaagggggaggcuguacaaaggaaaggagaagggguagaagaaaggagucucaaauuaacacucccagcccuucccuggacccaggccuucgccacgcgugcugggaacugggcacugaaagagcaaaguuaaagagggccggaagaaccaccucgcuuuuaccucuuucccccaccgccaaggagaugcguuccgagccaugcagcgugucucuucugucacauuuugauggcaaacaucuuccccuccgcgugagaucacugucuuuuacauucagcugacaucacaugaagucacuugaaguggaaugacaugggcggcggcgcgacucccguugaggacccugcguucccccgcgccugccggccgccgccaccgccccucaaacuuuaaaggaggcaacuagcgcccgcgcucccuucgggaaagugcgagcgguuugcgaaucgggaaggagggaagagagggaggggggagggggaagaaucgugaugguuuugccgguggaaggaggugggggccgcccaaacccaaaccuaggcagaguuccuugggugauucacaacuuuggggggccuacaguuuuaggguacgcggggaaggcgggguguccccgacgcgcuaccucaaagggccccugguguccgucuaaucaccaaaguaucccuuagcccugcgcagccgaacugggcaccgugcuaauaaacugccauuuaccuacggagccagcgccagccccgaacacgcgcaaaugauaauuaccucauuaggauguggcgcauggacgcgggcgucgcguuuggaggggggaacuuguuaauggggaaauauuaauuuaugcaaaagcaacgagcucgccuuggcuggcgucggaggucgagagagagcuccccgccgccuaaggacgaccucgaagaguccgggagggcaggcggcgugccgggguccuggggaccuggggaagggugggugcgccugcagcucucuggcccacuuuuucaguagggcugggggauucuugcccugagaggccuagggcucuuugagaagcuaaucgauccgaauugcugauuugugaucggguuugagaggcaaaggcaggcucugcgccugguuuagggcugcgugcggggaggauucggagggcagcucucccgcuguuggguacuuacuguuuguauaauugagaagguccaaucuccaccuguuuaaggagcagauugaaacagcagaaccuccccuggauccuauuaaaacguuuuuccuccuaaggccauucagucgaaccaauuuuccgaagugauucauagagcugaauucugccaaggcagcucuuucacuuuuagccacuaaagcaccgcguggaaccggguuuuguguuuuucuaaaauaaaaagaaggauuaucagaggggagaaggagggggucugaaggggggcgggcaaagacuuaguguggccagagguacaagcagagggaagaaaaggcucuuuucuagacaggccccaaguaaguucggaggaauucagcguuuuugugccgggcgcacaaaagcagagcgcucggcgcuggguuuggaggggcugaauucauguuugcagaccauuccaccugcguaucacaacaaacugcucaaagaagcuccagcacuuucaacaggccgggugcucuuggugacaacaaaaguggucgaggcugaggguucuuaugggggggggggggcuagcuagagaaggagagaauuagguuuagggaaaagaggggcugugcaugggguuuuugaaaacuuuuggcuguuuuuguucgucggacaauuauaucuugccagccggcuuuugcaagaccaagagcuuuguagccgcaaaggcaguuuaagaggauuacgguggguauaauaugagcaaacaggguugaggguuugauagucaauuccuucuccagagauauagcaucagcggagccggggaaagugccggugaaggcaaacccucuucuccguuugcagcugaguguccaucugauccccggcccacuacuacccaucccagggaaaacuguccauccaacgccagacggacgagcaaagcucuaguuuggacugcagccgaacaacauccuauccucggcaaaacucuuuccuuccauccaccuaucuagcugugucuccuccgauggccauuucagaucagguguggauggagcagguagagaaaagaaaaguauagcuggggaacgggugggggugggggccaacagacagagaucuccaaggagaagugacaguggaaauggucuaugauagacuaauaaucucauccugccaaacucugaaacuguccucaaauucagcaauuaugagucugucuccuuaauauccaccaccacacacacaaagcugaaacuuccagguaucaaagcuagaguccugcccaacuggagaagaauauuuucacaccgcccauucaauuuaagacauucccacgggggauguaaguccacacccaaugucccccaucucuauguaaaugacaaacuuauagaugacccuucucucccaccaaaucugaagcaaaccacucacccagcacugacugagauaauaucaguucaccugcauccucaaaaccugaauuucuaucccgacuuuccuguggaauccugcuugccaccagccuugcaccccagcccuuuccccacauugggcaauuauggaucuccgcggcaccugaaagacaugcugguuugaacacuccaucaggcugauaggcuuccaaggacuuucuaagagccugcuuuaccaucccuucugcuuucuguuaaucucucucucucucucucucucucucucucucucucucucucucucucucucucccaucacaaagcagaacuaccuccacagaaa

SEQ ID NO: 11500 - RNA, 4346 nt, Mus musculus
uuucuguggagguaguucugcuuugugaugggagagagagagagagagagagagagagagagagagagagagagagagagagagauuaacagaaagcagaagggaugguaaagcaggcucuuagaaaguccuuggaagccuaucagccugauggaguguucaaaccagcaugucuuucaggugccgcggagauccauaauugcccaauguggggaaagggcuggggugcaaggcugguggcaagcaggauuccacaggaaagucgggauagaaauucagguuuugaggaugcaggugaacugauauuaucucagucagugcugggugagugguuugcuucagauuuggugggagagaagggucaucuauaaguuugucauuuacauagagaugggggacauuggguguggacuuacaucccccgugggaaugucuuaaauugaaugggcggugugaaaauauucuucuccaguugggcaggacucuagcuuugauaccuggaaguuucagcuuuguguguguggugguggauauuaaggagacagacucauaauugcugaauuugaggacaguuucagaguuuggcaggaugagauuauuagucuaucauagaccauuuccacugucacuucuccuuggagaucucugucuguuggcccccacccccacccguuccccagcuauacuuuucuuuucucuaccugcuccauccacaccugaucugaaauggccaucggaggagacacagcuagauagguggauggaaggaaagaguuuugccgaggauaggauguuguucggcugcaguccaaacuagagcuuugcucguccgucuggcguuggauggacaguuuucccugggauggguaguagugggccggggaucagauggacacucagcugcaaacggagaagaggguuugccuucaccggcacuuuccccggcuccgcugaugcuauaucucuggagaaggaauugacuaucaaacccucaacccuguuugcucauauuauacccaccguaauccucuuaaacugccuuugcggcuacaaagcucuuggucuugcaaaagccggcuggcaagauauaauuguccgacgaacaaaaacagccaaaaguuuucaaaaaccccaugcacagccccucuuuucccuaaaccuaauucucuccuucucuagcuagcccccccccccccauaagaacccucagccucgaccacuuuuguugucaccaagagcacccggccuguugaaagugcuggagcuucuuugagcaguuuguugugauacgcagguggaauggucugcaaacaugaauucagccccuccaaacccagcgccgagcgcucugcuuuugugcgcccggcacaaaaacgcugaauuccuccgaacuuacuuggggccugucuagaaaagagccuuuucuucccucugcuuguaccucuggccacacuaagucuuugcccgccccccuucagacccccuccuucuccccucugauaauccuucuuuuuauuuuagaaaaacacaaaacccgguuccacgcggugcuuuaguggcuaaaagugaaagagcugccuuggcagaauucagcucuaugaaucacuucggaaaauugguucgacugaauggccuuaggaggaaaaacguuuuaauaggauccaggggagguucugcuguuucaaucugcuccuuaaacagguggagauuggaccuucucaauuauacaaacaguaaguacccaacagcgggagagcugcccuccgaauccuccccgcacgcagcccuaaaccaggcgcagagccugccuuugccucucaaacccgaucacaaaucagcaauucggaucgauuagcuucucaaagagcccuaggccucucagggcaagaaucccccagcccuacugaaaaagugggccagagagcugcaggcgcacccacccuuccccagguccccaggaccccggcacgccgccugcccucccggacucuucgaggucguccuuaggcggcggggagcucucucucgaccuccgacgccagccaaggcgagcucguugcuuuugcauaaauuaauauuuccccauuaacaaguuccccccuccaaacgcgacgcccgcguccaugcgccacauccuaaugagguaauuaucauuugcgcguguucggggcuggcgcuggcuccguagguaaauggcaguuuauuagcacggugcccaguucggcugcgcagggcuaagggauacuuuggugauuagacggacaccaggggcccuuugagguagcgcgucggggacaccccgccuuccccgcguacccuaaaacuguaggccccccaaaguugugaaucacccaaggaacucugccuagguuuggguuugggcggcccccaccuccuuccaccggcaaaaccaucacgauucuucccccuccccccucccucucuucccuccuucccgauucgcaaaccgcucgcacuuucccgaagggagcgcgggcgcuaguugccuccuuuaaaguuugaggggcgguggcggcggccggcaggcgcgggggaacgcaggguccucaacgggagucgcgccgccgcccaugucauuccacuucaagugacuucaugugaugucagcugaauguaaaagacagugaucucacgcggaggggaagauguuugccaucaaaaugugacagaagagacacgcugcauggcucggaacgcaucuccuuggcggugggggaaagagguaaaagcgaggugguucuuccggcccucuuuaacuuugcucuuucagugcccaguucccagcacgcguggcgaaggccuggguccagggaagggcugggaguguuaauuugagacuccuuucuucuaccccuucuccuuuccuuuguacagccucccccuucuucccccuuucauagucccagggcaauagcugguggguuccuuugcgcgccggguuaaugggcgguaauuugguacccuugggugcacuuuguucugcuucuguucauuugaaugcaaaugggugaccgggccgacuaggugcuuauuaaauugcgguuuccccccugccuuuuccggaaugcagacuuagaggagagaggcugugcccuggcccagccuggcccagcuuggcgcgccauggccagcucagcuucccuggagaccauggugcccccggccugcccgcgcgcuggagcgucaccggccacuucuaaaacacuagcuuucucuaucgagcgcaucauggccaagacguccgagccccgagcgccuuucgagccccggccugcugcguuagaggcagacagcagccagagcaagaaacugcucaaccucugcucgccgcugcccuguaugaucccucuccagccucuaggcuacgaggugccguccaagacgcugcucaguuacucggaguucuggaagagcagccuccgggcgggcggcgguggaggaggaggcagcggcgggggggccccagugugcggcgccagcggcuugugcaaaaccaacuguggcgugugcugcaaggccgaacugggccucgcgccuucugcgcugcccgccggcagggucaucaaaccgcaggucaucaaccaggcuguggggcugccugccagcggcucucucuacuacuucaacuaccuggacuccaccgcuuacccaccuucggagcuccucggaggccaccuuuucccauccggccuccucaacgcacaggcccccacuucccuggcugcucaccccaagcuuuuucugcuggagaacgccaaacuggccagccuggcugcggacaaguucccccacccagcuuccuauccccauaaggagcgcuugcaugcgccacuggagcaggugcugaaggagaacucggccuugacagcugaacgagggggagucaagagccacagcaaacuaccggggggcucuacugacagcaaacccaaaaacuucaccugcgaagugugcggcaaggugaggccuacgguucuggggggagggagcuaguagccccugacuuucuugggcugccuuguacaccuuucucucaagcagaggagcuucccaauagcugcgcgcuccguucgaugcucaguugagccucaguuuccuauucuguaaaauggggcuguaaaaucgccacacaguugacaaaaggacuugcuggcuucagaugggaugguugguuaagggagguaaauuguagccuccgggccugauucuaggcccuuggcagacucagccuaaguuccgcucucauccuuccauagguguucaaugcucacuauaaccucacccgccacaugccuguccacaccggagcuagaccguuugugugc

SEQ ID NO: 11501 - RNA, 2162 nt, Mus musculus
aaagugcgcaggugcacccaggacuccuagucuggagcaccggccugggaugugcucacucccucuugggguuguggagacagacacaccuucuaccuuugggugcuucggucaauccgggucgcccaguucgggucugcugaguaccuaagaacgacgcuggaggcgacgucuaacgcggagguuucccgccucucuggcauaaucccucccgggaauguaacuugaggauguccaguugucgaccucgguaguguucccaccccagacucgggaauuucuuuccaaagagccaugccaucaaauauagcccgaguucuggagguuacuuguagaauaaaccuccuuaauucugugacccguguucguagcgagaguugaauagcucaagagaagaggccugaccaugugcauaggcaaacaggucucaggcucgcucuccuccucucccggguccuucgccacuacccuccgcuggccaucccgacaguccugggagccgggacuuaaucgggcugcuggacggcaugauguagaccauccagacaggacugaccuaugcggggagaggagagggaaggaacgcgagagggaggggcggcugccuguggaaaccgguucuuccagggaagcggagcgggacuucggcguuccccucgauuugcgccgucgcucgggcuguuuggaaagaagaggggaggcgcugugcaugcugacuuguaccuggaucugggugcacagugcguaugcacuccugugccgcugggcgacuuccauaacguccgcuccgggguuacucccagaaacucguagaaaguagaagggggugagaagaggacacacccccuugcucggagggacuugggagacuuugaauuuccccuccccccacuuuuccgcagagcucuucuuuuguugucaaguccuuuugauaaaugguggggcugggagagcugggagccaggagccgaucugcgcccugcgcaggggcgggggcccagccuggagaccggguucggaccaccgcgcacccugagcugaaccgggcacgcucaggggacuuuuccuucuguuugccagccuauuucuuuccuaccaucccagucccccuucccuucuguuucuguccacgcggauaacgagaacuuucuggggugggggugaguuauauaauuuucucguaaguauucuuucacagaguuuugauuuuauuccuugauuccuuagguuggcaaaguuaaugggaugguaacucgauuaaugguaauuuggaaagaagagcggcuggggcugguguguguguguguguguguguguguguguguguguguguuaagaacauuggcuguuugugauccuccugcgacaauugagaaagguaaauuugugagacuauggcaagaucacaggcaccuuugugaaggugccugaaugaucucuggaguaagaaguccagcuuacguuuuggcagaauggcaaccccaaacucugccggguaaggucucugaagcugcuugcagccugcgggguguuagugccugccggugucucccacuguauggcucuaaaggugucacccucuggucagcuccugugguccuagcauaggaagcuaggccuugggccaccugccauauuggccucuuucauaggccuggagagugagaguugacgcuguggacagaacugaggagagcaggagcaagcgcgggccuaggguguccucuucgcuccggggguucaguuucuaggcucaguuugucucuuuuccuccaauuccaguaguuuucucauugcgcugggcaguucaagggaggccaccccagcucuucaagacugguagaaucguggaauggcucucgucccacguagauuacaugcgcucaccggugugcgccgccgggcuccgugagcuccgacugccgcguuaaaacucaacuccgaaggucggagcgcacgggggcgccugggggucugcguuccccgggcuuuggggaggcaccagcaucugagccugcgcaccucucaagggaggccaaaucucugaaggccgaguaagcuguggaaguuggaggggguguggggggauauauuguuauuaauuacuucaggcuaggccuaaugcuuccaacccucagaggugguuggcauggacguccugc

SEQ ID NO: 11502 - RNA, 2162 nt, Mus musculus
gcaggacguccaugccaaccaccucugaggguuggaagcauuaggccuagccugaaguaauuaauaacaauauauccccccacacccccuccaacuuccacagcuuacucggccuucagagauuuggccucccuugagaggugcgcaggcucagaugcuggugccuccccaaagcccggggaacgcagacccccaggcgcccccgugcgcuccgaccuucggaguugaguuuuaacgcggcagucggagcucacggagcccggcggcgcacaccggugagcgcauguaaucuacgugggacgagagccauuccacgauucuaccagucuugaagagcugggguggccucccuugaacugcccagcgcaaugagaaaacuacuggaauuggaggaaaagagacaaacugagccuagaaacugaacccccggagcgaagaggacacccuaggcccgcgcuugcuccugcucuccucaguucuguccacagcgucaacucucacucuccaggccuaugaaagaggccaauauggcagguggcccaaggccuagcuuccuaugcuaggaccacaggagcugaccagagggugacaccuuuagagccauacagugggagacaccggcaggcacuaacaccccgcaggcugcaagcagcuucagagaccuuacccggcagaguuugggguugccauucugccaaaacguaagcuggacuucuuacuccagagaucauucaggcaccuucacaaaggugccugugaucuugccauagucucacaaauuuaccuuucucaauugucgcaggaggaucacaaacagccaauguucuuaacacacacacacacacacacacacacacacacacacacaccagccccagccgcucuucuuuccaaauuaccauuaaucgaguuaccaucccauuaacuuugccaaccuaaggaaucaaggaauaaaaucaaaacucugugaaagaauacuuacgagaaaauuauauaacucacccccaccccagaaaguucucguuauccgcguggacagaaacagaagggaagggggacugggaugguaggaaagaaauaggcuggcaaacagaaggaaaaguccccugagcgugcccgguucagcucagggugcgcggugguccgaacccggucuccaggcugggcccccgccccugcgcagggcgcagaucggcuccuggcucccagcucucccagccccaccauuuaucaaaaggacuugacaacaaaagaagagcucugcggaaaaguggggggaggggaaauucaaagucucccaagucccuccgagcaaggggguguguccucuucucacccccuucuacuuucuacgaguuucugggaguaaccccggagcggacguuauggaagucgcccagcggcacaggagugcauacgcacugugcacccagauccagguacaagucagcaugcacagcgccuccccucuucuuuccaaacagcccgagcgacggcgcaaaucgaggggaacgccgaagucccgcuccgcuucccuggaagaaccgguuuccacaggcagccgccccucccucucgcguuccuucccucuccucuccccgcauaggucaguccugucuggauggucuacaucaugccguccagcagcccgauuaagucccggcucccaggacugucgggauggccagcggaggguaguggcgaaggacccgggagaggaggagagcgagccugagaccuguuugccuaugcacauggucaggccucuucucuugagcuauucaacucucgcuacgaacacgggucacagaauuaaggagguuuauucuacaaguaaccuccagaacucgggcuauauuugauggcauggcucuuuggaaagaaauucccgagucuggggugggaacacuaccgaggucgacaacuggacauccucaaguuacauucccgggagggauuaugccagagaggcgggaaaccuccgcguuagacgucgccuccagcgucguucuuagguacucagcagacccgaacugggcgacccggauugaccgaagcacccaaagguagaaggugugucugucuccacaaccccaagagggagugagcacaucccaggccggugcuccagacuaggaguccugggugcaccugcgcacuuu

SEQ ID NO: 11503 - RNA, 2402 nt, Mus musculus
cccuccguccucucgcucuguucucucuggaaaggcggggggguggaaagaagaagguuaacccgaagaaaggaagaaagaaagaaggggaccagaagggggaagccaacguucccccacaggcuagcuguccaucaaccgcucaagccaccaagcggcagaaaguucagggcugccuugaacccauuuucuuugcgccugguuuuugccagacucuaaaaugaaaggacaaaauuuggcgcugacucuugcagcucugauggcgacuugugcgauuucagcggcaucucccggagaaaaaaccaugcgugccugauuguucuguggucccauagccgccgccgcugcugcugcucugugugugugugugugugucugugugugugugugagcgcgugucucugugucugcgugugugugcguuuguguguguguauguguguguguuugggugugugucuguguguacacagagguucacuagcuaacucagcugcaggagcagucccuggaagcagacguuucggccacagacccagagaggaggagcugacaaucaggaggcgugagccgccuggagucugcagaauucguggugugaaugaacugggggcaucuugggcacagggauugcccccccuccuuccccgccucgggccacaguugaguaguggggcauuuuuuuucaccuucuugugaagaauuuuuuuuauuauuuguuguaaagucuuuugcacaaucacgcccacauuugggguuggaaagcccuaauuaccgccgucgcugauggacguuagagagggagcgccucgccgcggaacagucgccugcgcgcccucgucggacccgcggcuccugcacuguguccccgcucggcccugcgcuugcugcucgcccgcgcgcgccggcgcccucucgguuccugggcacauuuccacgcuauaccaacuccucugcccgaguccgggcgccagugcucgcuuccgcuccgggucgcugcgcccacccgacgcgcccaggaggacuccgcagcccugcuuuggauugucccccaaggcuuaaccccgacgcuucgcuugaauuccucggccgccuucgcucggguggcgacuuccucuccgugcccccucccccucgccaugaagguaaguguucugugcgcacggacgcucccuacuuuuucccccccuuuucaaaguuaacugaacucuuucaaucuaucccuauccucuccauuucucuaacugccuggagaaagcuaaacuccaauaucgccggcagggacuccuaucuuuucgucccuuacccuggggacacugccucugcguccuuggagacuuuuugcaccggcuauucuucaaaccuuuucaacuauggagaagagcgagggcaggaaagacaguucgggucacaggcggcgcgccuuuuuaccucgagaacuggaguguaguuuuacuacguguauuucagugacuggauaaugauucgauucaucaaguauauaucaaacgcucauuucaccggcacgcggagauuguguggcugaagcucugaggccggaugaggacuguguuaggagaaacggcugcgagacuaaggaaacuaggggccaccuacccuagagcaacgcacaccccacccccaaccuccgaucagggcccaguucccggcucuccaggucgaguaacccgagcguucccggccccugugccuuuaagagugccuggcggggggccagagcgcaccccgcgcggggagcagggucgcguuauuagcuuuauuagcggccucugggugagcucagguccuuuacugcagcauugggggcggggaguagugguccuaguggcuuuaauccugcccccugagcggagucaaccuagugcuuuggagacucuagggccucugcguuucgagaucgggcggggguuaguuugugaacucguguuuguuuuaauugucaguuguauguuaaagccgagucacacacucugagggucaccgagaguucacuuuuacaaaaaaguuaacguuucgucuugaaauauaacuagcaauuuuccaaacaacuuuuccuucgguuauccuccacgccucgauaacaauuuccauuuauacuucauaccucucauuuccagcuuucuaguagggaguaaggugaagaucgguacgaagcuguuuccuaaaagcaaacaacguucuuucuucaaagaaaggguuuuaaaccccggugcuucuaaggcccuguuuuacccucuaugcccuguccgagccacagcuccguggucucacuuuaaaugaacaauucgcuccugggaaauaacuugggucgggugaugaggucguaccuccucagcaucugcugucuugacgauauuagcacaccuagccagauuuaauuu

SEQ ID NO: 11504 - RNA, 2402 nt, Mus musculus
aaauuaaaucuggcuaggugugcuaauaucgucaagacagcagaugcugaggagguacgaccucaucacccgacccaaguuauuucccaggagcgaauuguucauuuaaagugagaccacggagcuguggcucggacagggcauagaggguaaaacagggccuuagaagcaccgggguuuaaaacccuuucuuugaagaaagaacguuguuugcuuuuaggaaacagcuucguaccgaucuucaccuuacucccuacuagaaagcuggaaaugagagguaugaaguauaaauggaaauuguuaucgaggcguggaggauaaccgaaggaaaaguuguuuggaaaauugcuaguuauauuucaagacgaaacguuaacuuuuuuguaaaagugaacucucggugacccucagagugugugacucggcuuuaacauacaacugacaauuaaaacaaacacgaguucacaaacuaacccccgcccgaucucgaaacgcagaggcccuagagucuccaaagcacuagguugacuccgcucagggggcaggauuaaagccacuaggaccacuacuccccgcccccaaugcugcaguaaaggaccugagcucacccagaggccgcuaauaaagcuaauaacgcgacccugcuccccgcgcggggugcgcucuggccccccgccaggcacucuuaaaggcacaggggccgggaacgcucggguuacucgaccuggagagccgggaacugggcccugaucggagguuggggguggggugugcguugcucuaggguagguggccccuaguuuccuuagucucgcagccguuucuccuaacacaguccucauccggccucagagcuucagccacacaaucuccgcgugccggugaaaugagcguuugauauauacuugaugaaucgaaucauuauccagucacugaaauacacguaguaaaacuacacuccaguucucgagguaaaaaggcgcgccgccugugacccgaacugucuuuccugcccucgcucuucuccauaguugaaaagguuugaagaauagccggugcaaaaagucuccaaggacgcagaggcaguguccccaggguaagggacgaaaagauaggagucccugccggcgauauuggaguuuagcuuucuccaggcaguuagagaaauggagaggauagggauagauugaaagaguucaguuaacuuugaaaagggggggaaaaaguagggagcguccgugcgcacagaacacuuaccuucauggcgagggggagggggcacggagaggaagucgccacccgagcgaaggcggccgaggaauucaagcgaagcgucgggguuaagccuugggggacaauccaaagcagggcugcggaguccuccugggcgcgucgggugggcgcagcgacccggagcggaagcgagcacuggcgcccggacucgggcagaggaguugguauagcguggaaaugugcccaggaaccgagagggcgccggcgcgcgcgggcgagcagcaagcgcagggccgagcggggacacagugcaggagccgcggguccgacgagggcgcgcaggcgacuguuccgcggcgaggcgcucccucucuaacguccaucagcgacggcgguaauuagggcuuuccaaccccaaaugugggcgugauugugcaaaagacuuuacaacaaauaauaaaaaaaauucuucacaagaaggugaaaaaaaaugccccacuacucaacuguggcccgaggcggggaaggagggggggcaaucccugugcccaagaugcccccaguucauucacaccacgaauucugcagacuccaggcggcucacgccuccugauugucagcuccuccucucugggucuguggccgaaacgucugcuuccagggacugcuccugcagcugaguuagcuagugaaccucuguguacacacagacacacacccaaacacacacacauacacacacacaaacgcacacacacgcagacacagagacacgcgcucacacacacacacagacacacacacacacacacagagcagcagcagcggcggcggcuaugggaccacagaacaaucaggcacgcaugguuuuuucuccgggagaugccgcugaaaucgcacaagucgccaucagagcugcaagagucagcgccaaauuuuguccuuucauuuuagagucuggcaaaaaccaggcgcaaagaaaauggguucaaggcagcccugaacuuucugccgcuugguggcuugagcgguugauggacagcuagccugugggggaacguuggcuucccccuucugguccccuucuuucuuucuuccuuucuucggguuaaccuucuucuuuccacccccccgccuuuccagagagaacagagcgagaggacggaggg

SEQ ID NO: 11505 - RNA, 758 nt, Mus musculus
accaucagcgcagcuuucugagacgauuucucuauuccccgaccagcgucgccgcugggaauaacugggaaagcgcuggaaagggcaaagggcuuauuguugauuuguuuauuugcuuuuaagggggaaagagauggcgauaugcuagcgacuggcgcacgcggagcgagggcaccguggaaccgccgacgcucaggauccccggacaauccugugccuuuggcgguguguggagcgcucucgacguuaaagcccaguaaauagacgaaggacuuguuucaauuucaacuucacaaggaucccuuucuaaucacuccuuucuucccugauuuuuuuuaauuaaaaaauacagaucaaaguaaauuuucaucuccugguauuuuuuuuuuucuuaaugggguugauacagcuccuggaggcaguuacccuucacuuucuccccagaaucuucuucuaaaaccaaaauuuaauaguagccucgguuugccaaauaugacccugcuagugauucaacaucucacaaaaccuucaguucauaaaccaggauacuaaaaaaacuaucaaccaaagccguggcgggaaaccuucugaguccccggggcccaacuccacugcguguaaggaccccgcaauucccgaacccuuuggaguaucgcaagcuccucauuagcccugcuggcauguccgcacagacacagcauggcagaagacccgcacagguagccuuucggcauccuggccacgguccgucgaaccuu

SEQ ID NO: 11506 - RNA, 758 nt, Mus musculus
aagguucgacggaccguggccaggaugccgaaaggcuaccugugcgggucuucugccaugcugugucugugcggacaugccagcagggcuaaugaggagcuugcgauacuccaaaggguucgggaauugcgggguccuuacacgcaguggaguugggccccggggacucagaagguuucccgccacggcuuugguugauaguuuuuuuaguauccugguuuaugaacugaagguuuugugagauguugaaucacuagcagggucauauuuggcaaaccgaggcuacuauuaaauuuugguuuuagaagaagauucuggggagaaagugaaggguaacugccuccaggagcuguaucaaccccauuaagaaaaaaaaaaauaccaggagaugaaaauuuacuuugaucuguauuuuuuaauuaaaaaaaaucagggaagaaaggagugauuagaaagggauccuugugaaguugaaauugaaacaaguccuucgucuauuuacugggcuuuaacgucgagagcgcuccacacaccgccaaaggcacaggauuguccggggauccugagcgucggcgguuccacggugcccucgcuccgcgugcgccagucgcuagcauaucgccaucucuuucccccuuaaaagcaaauaaacaaaucaacaauaagcccuuugcccuuuccagcgcuuucccaguuauucccagcggcgacgcuggucggggaauagagaaaucgucucagaaagcugcgcugauggu

SEQ ID NO: 11507 - RNA, 833 nt, Mus musculus
gugaacguaagauucuuuaaaaacccagucguuccuuauuuaaauacccucuaaagaggaauucuuugaaaauacacucuuauucccuuggacaguucugaccuguuauauaugauguuaagaugggcauguauuuauuuacuagucuagcucucacccaauuagaucgccuaaacagaucauuugauaaaagcggcauguuccaggauaaaaagcaguaacagaaaguucggggcgagguccuucuuggagagucaaaacggcucaaauugucagggaaaacuauuuucacuuuuccuccuggagaugugggcggaauaaaacaaaacaaaaacaaaacaggaaaaccaaaacccaaaccacggucacuucuccacagcgagcuuagauaauaaacacggauagauaauaaagacggcugcggggcccuuccaccuaacuuucaccgcuugcuaaggauuccauucuagcuuccucuccacgcacagugcaaaggggaauggggguggggacucuuucuaagacacaagaguuaaggugaccgcucucgaggagagauggcuuccgagagcucauaccuaggagcaaauagcgauagcgcggcgacuccccgacugcucucuccuccaggagcaagcgacuggguccggcgucucugcccugcaguccggcagaucagcagcucugaugcccaagccccgucuccacugccugcgccggccugcacagccuuauaucuaacggucaauucgugcaaucugucgcuucccccuccagaucgcccccccuccuuggugguuuuuuuuccccuucuuccaagaagcccaucuacc

SEQ ID NO: 11508 - RNA, 833 nt, Mus musculus
gguagaugggcuucuuggaagaaggggaaaaaaaaccaccaaggagggggggcgaucuggagggggaagcgacagauugcacgaauugaccguuagauauaaggcugugcaggccggcgcaggcaguggagacggggcuugggcaucagagcugcugaucugccggacugcagggcagagacgccggacccagucgcuugcuccuggaggagagagcagucggggagucgccgcgcuaucgcuauuugcuccuagguaugagcucucggaagccaucucuccucgagagcggucaccuuaacucuugugucuuagaaagaguccccacccccauuccccuuugcacugugcguggagaggaagcuagaauggaauccuuagcaagcggugaaaguuagguggaagggccccgcagccgucuuuauuaucuauccguguuuauuaucuaagcucgcuguggagaagugaccgugguuuggguuuugguuuuccuguuuuguuuuuguuuuguuuuauuccgcccacaucuccaggaggaaaagugaaaauaguuuucccugacaauuugagccguuuugacucuccaagaaggaccucgccccgaacuuucuguuacugcuuuuuauccuggaacaugccgcuuuuaucaaaugaucuguuuaggcgaucuaauugggugagagcuagacuaguaaauaaauacaugcccaucuuaacaucauauauaacaggucagaacuguccaagggaauaagaguguauuuucaaagaauuccucuuuagaggguauuuaaauaaggaacgacuggguuuuuaaagaaucuuacguucac

SEQ ID NO: 11509 - RNA, 836 nt, Mus musculus
cuuagacagggguaggcugggcacaacagagagagguauacuuaccauaccccugaaugaaagaggaagacugagcccaggccucuaagacccaccugcagagggaucagaauucuccaaccuaaguucucagugugcucagucuauugugaccaauugguggcuucugugacuuaagccccaugucacuggggugggggauaaaagcuuuguggucucccaaaggaccagcgaacccuaggggacuguugcacuuucguugcugagagcugcuaauugguauuugacugacggcuguugcuucuguaacaggaaaucagagccacaugaucagaauacagcaucaaccugaagaggacuacauucggcacuggaccagacgcaggcgugaacagauuggcauggugccucuugggcuuaguacccacacgcuaagaccuaugugaaggaccggagaaagauaggaggcugcaugaaguccaaaacagaugauaaaggaaaaggcauuguucuuuguggacaugggggacgcauguguuaauuuuugaagcugcgauccuaggaaaagcugggcuagaggaagaagaaccugagguggugagaaucaacgcacugggauccaaagcccauaauuaugaauuucauuuuuuucuuucgccucgaggcugcgaugaaggcucuugcuacacaaaaaccuauguggcacccaggauauuauauaagcccuuggcaggaggggagauaguccgguuugugcgcuucagccgccgcaguugcaguagccacagcgcagcagcgagagccgcucagguugauuuagaacgcgggugacagug

SEQ ID NO: 11510 - RNA, 836 nt, Mus musculus
cacugucacccgcguucuaaaucaaccugagcggcucucgcugcugcgcuguggcuacugcaacugcggcggcugaagcgcacaaaccggacuaucuccccuccugccaagggcuuauauaauauccugggugccacauagguuuuuguguagcaagagccuucaucgcagccucgaggcgaaagaaaaaaaugaaauucauaauuaugggcuuuggaucccagugcguugauucucaccaccucagguucuucuuccucuagcccagcuuuuccuaggaucgcagcuucaaaaauuaacacaugcgucccccauguccacaaagaacaaugccuuuuccuuuaucaucuguuuuggacuucaugcagccuccuaucuuucuccgguccuucacauaggucuuagcguguggguacuaagcccaagaggcaccaugccaaucuguucacgccugcgucugguccagugccgaauguaguccucuucagguugaugcuguauucugaucauguggcucugauuuccuguuacagaagcaacagccgucagucaaauaccaauuagcagcucucagcaacgaaagugcaacaguccccuaggguucgcugguccuuugggagaccacaaagcuuuuaucccccaccccagugacauggggcuuaagucacagaagccaccaauuggucacaauagacugagcacacugagaacuuagguuggagaauucugaucccucugcaggugggucuuagaggccugggcucagucuuccucuuucauucagggguaugguaaguauaccucucucuguugugcccagccuaccccugucuaag

SEQ ID NO: 11511 - RNA, 545 nt, Mus musculus
ccaguucucucuaaaaagaacgccagcgugguggccuaccaaggaggaggggaggagauggccagcccggaucagguggacgacaccuaucucccggaauucugggacauguugucccagacugaggaccaaggacaaggaacucaagaaggcgcagcgaaggcagccacugcuuccgacaucaaguuggccccugagaccuccagugauacccgguguggggaagcagccaaggacauguccucggucaagcgcaggaggcuccacagaauucccauugagucccagcagaaggaggagcccaaacauccggagaaggagcaucaagaagguguuccuaacagcgaugagggcuacugggacuccaccaccccuggcccagaagaagagagcaucagcaacagcagcagcagcaagaagguggucauccccagggauagcgacaguggcgaugcucucugcgaucucuacguugaaccugaagcaagcccagccacccuuccugccacagaggacccacccugcuugucccggcuaaagccggu

SEQ ID NO: 11512 - RNA, 545 nt, Mus musculus
accggcuuuagccgggacaagcaggguggguccucuguggcaggaaggguggcugggcuugcuucagguucaacguagagaucgcagagagcaucgccacugucgcuaucccuggggaugaccaccuucuugcugcugcugcuguugcugaugcucucuucuucugggccaggggugguggagucccaguagcccucaucgcuguuaggaacaccuucuugaugcuccuucuccggauguuugggcuccuccuucugcugggacucaaugggaauucuguggagccuccugcgcuugaccgaggacauguccuuggcugcuuccccacaccggguaucacuggaggucucaggggccaacuugaugucggaagcaguggcugccuucgcugcgccuucuugaguuccuuguccuugguccucagucugggacaacaugucccagaauuccgggagauaggugucguccaccugauccgggcuggccaucuccuccccuccuccuugguaggccaccacgcuggcguucuuuuuagagagaacugg

SEQ ID NO: 11513 - RNA, 721 nt, Mus musculus
gcccagacgccagccuagggaggggugaggaggaggcugcacuggcgcucgggucgccgcaccgccccgcagccucgcgcucuccgcagugacagcaaccacaaccgcagcagcacccagcuccauccucaccagccuggcugagcuacagcccggcaauucgggcugaggacgacaagcagaaggugugcaagugcccccgagcuccccacuccauugaccgaagcucaagaaaccgggagugggcuagcggcgguauugcacggaggggacugagaaaaagaggacuggagaccaugaagcuauucaggcagggguaggauugagccccccgaguccacccagaggacuuuggcagggucuggggcggccaggguggcuucaagggaucggagggcucugaccacugcagaugcggcgcgugugggugcggugaaagcacccacuucucccaggaucuaaacggauaaacggaagcgaguguaagugugggggugcgaaucgccaccuccggccuuggcuuucccguucgugagagcacccccacuucucacuuuccccaaauccgcauuuuucuuggcacaacccucccgaacaccgagcgaggagagggaggugcccgggggcagugagagugacgugugcuggugcagagggggggggggggggcugcgggccgggcucuguggaccuacuccuaauccucuuguuuucggaacug

SEQ ID NO: 11514 - RNA, 721 nt, Mus musculus
caguuccgaaaacaagaggauuaggaguagguccacagagcccggcccgcagcccccccccccccccucugcaccagcacacgucacucucacugcccccgggcaccucccucuccucgcucgguguucgggaggguugugccaagaaaaaugcggauuuggggaaagugagaagugggggugcucucacgaacgggaaagccaaggccggagguggcgauucgcacccccacacuuacacucgcuuccguuuauccguuuagauccugggagaagugggugcuuucaccgcacccacacgcgccgcaucugcaguggucagagcccuccgaucccuugaagccacccuggccgccccagacccugccaaaguccucuggguggacucggggggcucaauccuaccccugccugaauagcuucauggucuccaguccucuuuuucucaguccccuccgugcaauaccgccgcuagcccacucccgguuucuugagcuucggucaauggaguggggagcucgggggcacuugcacaccuucugcuugucguccucagcccgaauugccgggcuguagcucagccaggcuggugaggauggagcugggugcugcugcgguugugguugcugucacugcggagagcgcgaggcugcggggcggugcggcgacccgagcgccagugcagccuccuccucaccccucccuaggcuggcgucugggc

SEQ ID NO: 11515 - RNA, 6852 nt, Mus musculus
ccauuccagaacuccuucaccauuccugcaauucuccagggaacucucacccuuauccccagcuggaccuucagguccucaguguaccccuccuggucugcauacaacuugccauuguugacuggacagugcaucaaaaccggcggauuuccuccuugggagaugccacuucaugguugccuucugggaccucugccaccugcagguaaaauacagguuccaaagcacuuuccucgauagaauuccacgaggaagacaaugacagaguccacugaggaaccuuccacccaggccaggccaaagcgaaugcggggcaguagggcagggcccucguguugggagcacgaggacucaugaagacacagugugugcacugaguaaauacugaacucacguguagcauacacgugcagaugggagcaggagagaauaccuacuaagugcaggaugcuuuccaagugaucuucuguauguaaagcaaagcuccgagggaaccacacccccauuuuaccacugagaagucaagcucagaggacuuagaucaaacgccuguuucuaaccagaguggaccuugcuggaaguguuuuccacugcaaggucccaaggucuggggacaacuguagcgaccagcuuccaagugcagaaggugaguuucucagccgguaguccagcgcccccuauaaggcauugcccuaaacacaggucuaggaguuucuucagcuuuggaccuuucuugaacuuugugauguccugccuagagagucuugccuguguuccuuuagaucagcguaaauggacuugcguuuccucugcugcgacacuaggucaaagcugcccggaaucaagaacgacuuguuuucucagcugguucugaugucuaugugaugcaucuuagaucuaaccucuccaaagcgaaggaaggacccaugcaccuccgaagucuuggaaggugcauggguggaaguggggccuuggucagaguuugaggagacaccacccuuagagguccaauuucuaacuggaagccacgcauuuagcucaagagcccuuucucgauuugcauuccuacaaccgagguauguggcgugggcggagguguuggugugcggggugugcguugaaggagaucgcuagugccagcuggauugaaauucgaacuggugugauauuuguagcugccucccuaaacacacacacacacacacacacacacacacacacacacacacacacaccuaccuggagagugacuugggaagguuaguguuucauggagaaaaaaaguuggaccaagaagccaugagugagcguuuuuuggggcgagggucaggggagggagagaaaagggccuagugugugcuuucugucacccccuacggguucagagccagggcuccccugugggcagucucucccgcacugagcauugagugcccgacaagugcgcgcaccaaguguguacgugaguauacgugugaaauguggcggcgcuggccgcugcggagugugcgcuccgcaaaaauaugaauaaucaacacaucgcucacaccuccgccgggagcgggaagggagcugggaggucccgcgggcuuuccccugccggcuggcagggggcgggggaccaccaggaaaaaaaagggggggggcauuucagagaggcuuucugcuuaucucaagugagcugaaaagcuaggaggggguaagguuaggcgagucacauuuaauuuucccccuuuaaaggucaucccuugccuauccuguuuggaaauggaagaccagugaggggauuguuuuucugcuuugcagcggagcugugacuuggcaccucagccccugcccaagcucucuuugcaacuccgcgguguggaaguucaucagccacugaaccggugucaaccugaauggaggaaugcgcagccagugccuggcaccccaaaacuucuuggugugcaucugucccuuccugaucguggcuuccugaguacaauuugggacaguauaccgggccuuucugcauagguuucuggaaguggccgaaaccaggccaguuuauucaagcguggccccaaggaaaggccuugucuagucuagacacccagcagcggaaacgcugaauuccaguguuaagaguagaagcugccagucaccuguguccugucgcauacccuagccauuccugcgcugccagcgggcccagugcagaugacaccagggcuccgaaggccacuguuacagcuguugccaccgcuggcauuguugcuccuccuuaccuuacuccuuacugucguaagguaaggacuuuuugcgaucgaucgcucggaaugagcgagugggaaaaaaaauaaagcguauuucuuugcgcuugcuaccaaggagguaugagagaagccgaggaugggugaggaaggaggaguugaggaagacuuuucuggagcaaguguuagguuccuucgguucauuuuuaguaaacacuucccaguugacuugggcaccauaccggcgagccucuaaaacuuucuauccuguaauuuuaguguuucucuagguggucccgcuugacccuguuucaucguguuaaaaacaaaucaaaaucguacccaagucuaaucgaacuguccuugaaggaaauuucuugguguggacaugugagauauuuaucaugaaaccauaaaugaaguaauuucuuugcucuccccucucuggggaauucacacuuauguacuauacaaaucuaguuucuggaaggagaaaaaaaaugcccagcuuggaauuuggugugggaaucagugaaaucagaguuuuuauauaaaaaucauuuacaaauuguggauuaaauacccaguaggucucugagauagagcaaagccauuuguuacuaguugggcaaauaaaagcccgguuuaaauaaaaacaaaaacugguaaaugaaaaaugcuuguccaaagauagcuuauggagaccaaaccuuuuaaauuuacagggcucauacuagcugucccgguauucaggaaggguccaggucugugcuuugggaugcauagaggcagacacacgagagagagagagagagagagagagagagagagagagagagagagaguuaguuguggggugagggauguguuaugacgccuggagggcauaccucaaaccuccgacuuugagaagggccccagcgcacaggaugucagggcugguaaauucugggccaaccgggccuuaaaaccaauuucggccugaacauauugucuuaagcugcaguacaacacgaacaagggggagggggaauucaaaccuggacucugguauuuuagaagggugaacaaaagcggugacaacguauaaaaugagaucccaaaccacuuccccaguuuguguaacuagauggucgugaaaaauaguaauacugugaguucugauuuuuucucgaggauggaacgcgagacuccccaguccuugguggaggaagcuugaggcugcgagugggguuggguaugggggggagggggcggacacccagccgggucccgguccuggucccggacccggcggcauuuguguuucagguuccuaauggaggguuauucucacguagcuggaggcgaaggagauggaagcaacccucugggcgccacgauugcgcgccgcagccaccagcaccgcuucuuuagcacggguggucaauucuuccgccaccccucccuaagaccuugacaaacauaaucaaagccaaggcgguuggcagaaccgcucucggcgcgcacaagcguuacagcuuagggcacaaggccgacugcuccucuauacucggucuggaacuucauuuaugcguaaaagggacuucuggacuuugggcucaccacccuaggaaccccaaguggucgguccgcagucuguccccaguguucagaggagccgcaggggagguggggugguuccucagugcagaccacuaagagccaagcgucccacugaguucuagagguaaggcacccacacacuaucuuccagcagggcaccgccaccccugaacuugucacugggaaggagggaggugagacgccacugacaguaugcuuuggagaaggcagcagggagcaaggagaaaggaacaauucauucgcuuccugagggguauaauuugggcggcagcuguuacuggugagaaaagaggcgucagcgaccuuggcucugcccuuuaaccuggagccucugggggccggcgggccgggcuaggccggagcccguugcugccccgcagucccucaggcucuccgcaucuuucgcgaacauuuucgagguggagcugaucaaagucuccuuggggagguuaaaacaaaacuaaacaaaagccagccguuucauccacacgucggagggcucauuggcugguccacacucuucaccgaggaaccugaggccuugcccagcugggaacauggccgggacaagaaagaaggacaagagauuaguuaaauucagcagacuuaaaaaaaacaaaaacaaaacaaaacuaaaacuaaaaccaaaccaaaacaaaaacgagcaggcccagcucgaagacucugggugguuaguuuuuccuggggucgcaauuauccguaaagucuuguguaacugaacugcgcagcugaaagagcagagguggaucuuaucucgaccauuuucucccccacccucccucuuuuguuggauaacugccgaaugcaacuaggccucuuauuuucuuacacucaacuguaccucaagccacccugccuccccuuuaagccugaaauuaaagaccuggaguuaggguacaccaucaacgcgacuccagccccccuccccagucugugcaaagagagccccagccagcuuucaagucagucacugcuguagagagagaccaagucuuccggagcaccaucccgccugcgcagucuguagucacaguuugccccugaggugaagugacgugcucagguccccuucaauggagacucaagcagucucugaaagcgcaagcuuccuuuucgcucgccgggcaaacgugcaccccaggcgcuguguccucuagcggcgaacucucgcagcucgucugugagcgcucaccuacagcuaggggguccggucaggagucaauugacacucaaaccugagcccugagccgggaggaaagacucccgacuguaaugaugcugagaggcucgggugcagucgcucgaaccgcggcgcagcugauugucugcuccacggcagauggucuuugagcacagauuugcauucauugucuucaaaucuguuuucgcgcuggcguucuagauuucaacagcagaucuacgcgcagaucagaauacaaaaagagaagcaagaaaauaacacccagccaggaggauuuuuuuuuaauaggcaccuccagccgucuaggguuucagcuauuuuguggagccucggcuucccgaccaccaaccuucgcgaccacagcgcucggcggacaaaguuuccaggacuucuucacagacgccucgugucucuaacgcaggguuccccggccuucagggauuggggagggagauuuuaaaaggggggaggauucgaaacuucaucccgcaguucucagccagccaagcugucagcaaccucuccuaucugcaaaggugcguacucccgcccucccggggcuguuuuccuuaacuccuucaccauuucccuucacaguauauuuauuuaaacugcacuugagccucauucguccacacuccgcucucuccuuccuucaucucgccucuccuucuaacacuuguggccuucgcacgaaaugauugcuucccuggaacucucugagacuugguagaccgguucagaaagacggaugcccugaggguaguguuugcgaaaagcauaaauacagguggucacagguccaaaccccgggaaugaaucuguagggucucccgcaggcgacaaaaaaccugcaucuagaggcaaauccgcgcuggcuuccugcucccgcgaucggaaagaaccaucaugauccuaacucucagaguccugcuacucuguuuuggugcaggauuuggggacccccuuucccacucaggccaaacacucgggacucuggucgggacucggugcuuguggcuugcuguagccuuucaccucccggacuucgggcaaagcaaagcuuggcuaacgccgcgggaggacguccgcccagcuugcccagagccggccaaucccgggcguccaugcaaaugaggcuccuuaucgggccucggcuccgccucccgcggccuggguuguaguaaccauucauggggcccgcgcgcugcagcagcccggcucugcggcgcucucagccaccgccuccuccccgcuccgggucuuccccuuccucuuacaacugauccuguuggggauuuuuuuuuuuuuuccuauaucggaacgguggggaggagcagggaggggggaacaaggaggaaggggagagaucaggcagcuaucuaucuccuccuguuuuucccagaacaggugaugcuuccaaauuguggccacuuucuggagaacguucugcagcuggaaggaugcgggcgaccuagaguggaagccccgaggcggcagaucugaagccaccgaggauaaaaaacgcaaacuuugcauugugcguggaggaacgggcuggcuauuucuuuccaagagggcccccaaacuucggcccuugccgccuuucucggauugcuuuuggagaacaccauuugcuggcagcauuggagagugaggacgguguuguuguaaagucacuuuuaaggcgacaguagaggaccagacuuuuuaaauguuugggauucaagauacgcuaggaagaggacc

SEQ ID NO: 11516 - RNA, 6852 nt, Mus musculus
gguccucuuccuagcguaucuugaaucccaaacauuuaaaaagucugguccucuacugucgccuuaaaagugacuuuacaacaacaccguccucacucuccaaugcugccagcaaaugguguucuccaaaagcaauccgagaaaggcggcaagggccgaaguuugggggcccucuuggaaagaaauagccagcccguuccuccacgcacaaugcaaaguuugcguuuuuuauccucgguggcuucagaucugccgccucggggcuuccacucuaggucgcccgcauccuuccagcugcagaacguucuccagaaaguggccacaauuuggaagcaucaccuguucugggaaaaacaggaggagauagauagcugccugaucucuccccuuccuccuuguuccccccucccugcuccuccccaccguuccgauauaggaaaaaaaaaaaaaauccccaacaggaucaguuguaagaggaaggggaagacccggagcggggaggaggcgguggcugagagcgccgcagagccgggcugcugcagcgcgcgggccccaugaaugguuacuacaacccaggccgcgggaggcggagccgaggcccgauaaggagccucauuugcauggacgcccgggauuggccggcucugggcaagcugggcggacguccucccgcggcguuagccaagcuuugcuuugcccgaaguccgggaggugaaaggcuacagcaagccacaagcaccgagucccgaccagagucccgaguguuuggccugagugggaaaggggguccccaaauccugcaccaaaacagaguagcaggacucugagaguuaggaucaugaugguucuuuccgaucgcgggagcaggaagccagcgcggauuugccucuagaugcagguuuuuugucgccugcgggagacccuacagauucauucccgggguuuggaccugugaccaccuguauuuaugcuuuucgcaaacacuacccucagggcauccgucuuucugaaccggucuaccaagucucagagaguuccagggaagcaaucauuucgugcgaaggccacaaguguuagaaggagaggcgagaugaaggaaggagagagcggaguguggacgaaugaggcucaagugcaguuuaaauaaauauacugugaagggaaauggugaaggaguuaaggaaaacagccccgggagggcgggaguacgcaccuuugcagauaggagagguugcugacagcuuggcuggcugagaacugcgggaugaaguuucgaauccuccccccuuuuaaaaucucccuccccaaucccugaaggccggggaacccugcguuagagacacgaggcgucugugaagaaguccuggaaacuuuguccgccgagcgcuguggucgcgaagguugguggucgggaagccgaggcuccacaaaauagcugaaacccuagacggcuggaggugccuauuaaaaaaaaauccuccuggcuggguguuauuuucuugcuucucuuuuuguauucugaucugcgcguagaucugcuguugaaaucuagaacgccagcgcgaaaacagauuugaagacaaugaaugcaaaucugugcucaaagaccaucugccguggagcagacaaucagcugcgccgcgguucgagcgacugcacccgagccucucagcaucauuacagucgggagucuuuccucccggcucagggcucagguuugagugucaauugacuccugaccggacccccuagcuguaggugagcgcucacagacgagcugcgagaguucgccgcuagaggacacagcgccuggggugcacguuugcccggcgagcgaaaaggaagcuugcgcuuucagagacugcuugagucuccauugaaggggaccugagcacgucacuucaccucaggggcaaacugugacuacagacugcgcaggcgggauggugcuccggaagacuuggucucucucuacagcagugacugacuugaaagcuggcuggggcucucuuugcacagacuggggaggggggcuggagucgcguugaugguguacccuaacuccaggucuuuaauuucaggcuuaaaggggaggcaggguggcuugagguacaguugaguguaagaaaauaagaggccuaguugcauucggcaguuauccaacaaaagagggagggugggggagaaaauggucgagauaagauccaccucugcucuuucagcugcgcaguucaguuacacaagacuuuacggauaauugcgaccccaggaaaaacuaaccacccagagucuucgagcugggccugcucguuuuuguuuugguuugguuuuaguuuuaguuuuguuuuguuuuuguuuuuuuuaagucugcugaauuuaacuaaucucuuguccuucuuucuugucccggccauguucccagcugggcaaggccucagguuccucggugaagaguguggaccagccaaugagcccuccgacguguggaugaaacggcuggcuuuuguuuaguuuuguuuuaaccuccccaaggagacuuugaucagcuccaccucgaaaauguucgcgaaagaugcggagagccugagggacugcggggcagcaacgggcuccggccuagcccggcccgccggcccccagaggcuccagguuaaagggcagagccaaggucgcugacgccucuuuucucaccaguaacagcugccgcccaaauuauaccccucaggaagcgaaugaauuguuccuuucuccuugcucccugcugccuucuccaaagcauacugucaguggcgucucaccucccuccuucccagugacaaguucagggguggcggugcccugcuggaagauagugugugggugccuuaccucuagaacucagugggacgcuuggcucuuaguggucugcacugaggaaccaccccaccuccccugcggcuccucugaacacuggggacagacugcggaccgaccacuugggguuccuaggguggugagcccaaaguccagaagucccuuuuacgcauaaaugaaguuccagaccgaguauagaggagcagucggccuugugcccuaagcuguaacgcuugugcgcgccgagagcgguucugccaaccgccuuggcuuugauuauguuugucaaggucuuagggagggguggcggaagaauugaccacccgugcuaaagaagcggugcugguggcugcggcgcgcaaucguggcgcccagaggguugcuuccaucuccuucgccuccagcuacgugagaauaacccuccauuaggaaccugaaacacaaaugccgccggguccgggaccaggaccgggacccggcuggguguccgcccccucccccccauacccaaccccacucgcagccucaagcuuccuccaccaaggacuggggagucucgcguuccauccucgagaaaaaaucagaacucacaguauuacuauuuuucacgaccaucuaguuacacaaacuggggaagugguuugggaucucauuuuauacguugucaccgcuuuuguucacccuucuaaaauaccagaguccagguuugaauucccccucccccuuguucguguuguacugcagcuuaagacaauauguucaggccgaaauugguuuuaaggcccgguuggcccagaauuuaccagcccugacauccugugcgcuggggcccuucucaaagucggagguuugagguaugcccuccaggcgucauaacacaucccucaccccacaacuaacucucucucucucucucucucucucucucucucucucucucucucucgugugucugccucuaugcaucccaaagcacagaccuggacccuuccugaauaccgggacagcuaguaugagcccuguaaauuuaaaagguuuggucuccauaagcuaucuuuggacaagcauuuuucauuuaccaguuuuuguuuuuauuuaaaccgggcuuuuauuugcccaacuaguaacaaauggcuuugcucuaucucagagaccuacuggguauuuaauccacaauuuguaaaugauuuuuauauaaaaacucugauuucacugauucccacaccaaauuccaagcugggcauuuuuuuucuccuuccagaaacuagauuuguauaguacauaagugugaauuccccagagaggggagagcaaagaaauuacuucauuuaugguuucaugauaaauaucucacauguccacaccaagaaauuuccuucaaggacaguucgauuagacuuggguacgauuuugauuuguuuuuaacacgaugaaacagggucaagcgggaccaccuagagaaacacuaaaauuacaggauagaaaguuuuagaggcucgccgguauggugcccaagucaacugggaaguguuuacuaaaaaugaaccgaaggaaccuaacacuugcuccagaaaagucuuccucaacuccuccuuccucacccauccucggcuucucucauaccuccuugguagcaagcgcaaagaaauacgcuuuauuuuuuuucccacucgcucauuccgagcgaucgaucgcaaaaaguccuuaccuuacgacaguaaggaguaagguaaggaggagcaacaaugccagcgguggcaacagcuguaacaguggccuucggagcccuggugucaucugcacugggcccgcuggcagcgcaggaauggcuaggguaugcgacaggacacaggugacuggcagcuucuacucuuaacacuggaauucagcguuuccgcugcugggugucuagacuagacaaggccuuuccuuggggccacgcuugaauaaacuggccugguuucggccacuuccagaaaccuaugcagaaaggcccgguauacugucccaaauuguacucaggaagccacgaucaggaagggacagaugcacaccaagaaguuuuggggugccaggcacuggcugcgcauuccuccauucagguugacaccgguucaguggcugaugaacuuccacaccgcggaguugcaaagagagcuugggcaggggcugaggugccaagucacagcuccgcugcaaagcagaaaaacaauccccucacuggucuuccauuuccaaacaggauaggcaagggaugaccuuuaaagggggaaaauuaaaugugacucgccuaaccuuacccccuccuagcuuuucagcucacuugagauaagcagaaagccucucugaaaugcccccccccuuuuuuuuccugguggucccccgcccccugccagccggcaggggaaagcccgcgggaccucccagcucccuucccgcucccggcggaggugugagcgauguguugauuauucauauuuuugcggagcgcacacuccgcagcggccagcgccgccacauuucacacguauacucacguacacacuuggugcgcgcacuugucgggcacucaaugcucagugcgggagagacugcccacaggggagcccuggcucugaacccguagggggugacagaaagcacacacuaggcccuuuucucucccuccccugacccucgccccaaaaaacgcucacucauggcuucuugguccaacuuuuuuucuccaugaaacacuaaccuucccaagucacucuccagguagguguguguguguguguguguguguguguguguguguguguguguguguuuagggaggcagcuacaaauaucacaccaguucgaauuucaauccagcuggcacuagcgaucuccuucaacgcacaccccgcacaccaacaccuccgcccacgccacauaccucgguuguaggaaugcaaaucgagaaagggcucuugagcuaaaugcguggcuuccaguuagaaauuggaccucuaaggguggugucuccucaaacucugaccaaggccccacuuccacccaugcaccuuccaagacuucggaggugcauggguccuuccuucgcuuuggagagguuagaucuaagaugcaucacauagacaucagaaccagcugagaaaacaagucguucuugauuccgggcagcuuugaccuagugucgcagcagaggaaacgcaaguccauuuacgcugaucuaaaggaacacaggcaagacucucuaggcaggacaucacaaaguucaagaaagguccaaagcugaagaaacuccuagaccuguguuuagggcaaugccuuauagggggcgcuggacuaccggcugagaaacucaccuucugcacuuggaagcuggucgcuacaguuguccccagaccuugggaccuugcaguggaaaacacuuccagcaagguccacucugguuagaaacaggcguuugaucuaaguccucugagcuugacuucucagugguaaaaugggggugugguucccucggagcuuugcuuuacauacagaagaucacuuggaaagcauccugcacuuaguagguauucucuccugcucccaucugcacguguaugcuacacgugaguucaguauuuacucagugcacacacugugucuucaugaguccucgugcucccaacacgagggcccugcccuacugccccgcauucgcuuuggccuggccuggguggaagguuccucaguggacucugucauugucuuccucguggaauucuaucgaggaaagugcuuuggaaccuguauuuuaccugcagguggcagaggucccagaaggcaaccaugaaguggcaucucccaaggaggaaauccgccgguuuugaugcacuguccagucaacaauggcaaguuguaugcagaccaggagggguacacugaggaccugaagguccagcuggggauaagggugagaguucccuggagaauugcaggaauggugaaggaguucuggaaugg

SEQ ID NO: 11517 - RNA, 3920 nt, Mus musculus
gggauccucucuuccuucuugucaacacucccacucccccugagagaugcaaguucccccaaccccgacucuccagcgggggccgcgggauucaccgcgcccacgcggccacugaggagggaauccucccccgccaacccggugugauucggggucgcgccuccgugcucccucccucuccucccccucgcucucagccaggcugcgcgcuucaggagcaggccucggggaacacaucacccacccccgggauccgcugucgaggugacagcacccugggucggcacagggggccgcccuugacugcaaggcacccucaggcagcaaugaggacaacccugcgggagacagagaguagagacuggaggagaccgccuugguggcuuagaaucuguggguuucacaucuucccgcaguaacucagccgcaagcccuucgccggcugcaguagauagcgacugugccccggccugcugggcccuccugccauccuguggccaaagggguuugcuuuagaaccguuagggaauuuaucugggaauuauuuggugcacguguuuucuauccccuaaacuucacucuuuccuaaucuccacaacaacaacaacaacaacaaaacccucauacccucgccccuaaaaguucuugcccacugcgcaacuagcuaauccgcuacacauucccgggccacugcgcucaacugagagucagcgcggggucaggaaccccaagggaggggccggggcugcgggcggugaaucagaaugauguccgcacgaaaguucuaaguguccaagaauaagaagccuuaggacauuagaaccccuuccccaaaggaaaauacuucaucucuccaucugaauccagucaaggauaagaaggaaagacagaaguugugugggggagccuggcuugaagcggucaccucucccauuccuagacugcuaaggaaccuguguccugguguacugaacucuuucuaaaugcugggagugcuggagaccaauugcaaacaacuccacuccuccaacgacuaaauucugucucuaaugcuguccucaaauaaaaaccuacauguuuaguuacaggguuuuucaacugugcacugcgcaucgcgcgcuuugcauucggcuucgucccucuuucuuuuuucucuucucgcuuuccuucuuucuaaucuaauugacuuuuuuuuuuuuuuuuuuuuuuuuuuuaaagaacggagagcggugcgggcgcugcacguuggcugcggcccgcuuccugcuuucuaauguuccauugugaggagcuuccauugugacgucgcgccccuucggcugggcuuugucuguccauauaugggcagcuacgucacggagcuuucccggggcucagauaaauagacugguggaguucccuggcugggagcuuuugggcagcagugagcuagcuaggaagcggcggggcugguugguggugauagcagcggcggcggcagcagcagcagaggagguggcggcggcagcggcggcggcggcuguggcagaucggggggcggggggggucggcgggcucgugucugugagaucaauacugaagccgcgucugacccccuggagccuagaucacccccccagcccagcccccaucccacuccucgcacacgccccaccccacccccacgacccagcgucgcaccgcaccagccgaggcacccgagaggauuacccucuuugccccucucccauccaccccuccaaaaaagaauagauccccuccccugacccaccccuuccccuuuucacuccccccucccuccgaacuuucccucucgcaugcuuuuccccugcaccacggaucgccucucggaugccgcucgccuggaagcugcguuaggaacaggcggcggcggcgguggcggcggcggcgguggcggcgguagcucgggagugcuaugaccggcaaacucgccgagaagcugccggugaccaugagcaguuugcuaaaucaauugccugacaaucuguaccccgaggagauccccagcgcgcucaaccucuucuccggcagcagcgacucgguagcccauuacaaucagauggcuacagguaaggguggcggugaggcggcgaggcagcgaggaaggaaagggggaggacgaggaggagggagcgagcuagcgauggaugcacauaucgauggaugcagaaauggauggauggagagacggauggaaagauggggggcgcgcugggaauuuucuggggggcgaguugcuuuucccacccacuccucccgcccuccgagaucgggaaggcuugguuggagacgccacgguugaggcuucgguucucccgggugggggcagccgccgacuggagggagguaggugcgagcagcucugggguucucccuccccacgcagggggcccgaucgcugggcugcgugcaaggcguggugcuguagcccccuuucucgggaggagcccagcgucuuuuucacccgcgcucuccccccuccuuacucccucagccucccacccgggauggagccaugugcggcguggaguccccacggugggagagguacugcgacgcugccuuuccggggcguucagcaaagccauuggggguguggggacgguggggagagggagggggcucacccacggggcgggggaaaggguuugccaccgggggcgauccugggacccgggagcuugggaacggcggccgcucccgccguggagacaugggcugguuuuccgccgcucuccacucuccuuagcuggguuuaggcuuuuccccuccagcccgagcagaaagcuccuucaggccgggaggagacuggggccgggagaggcucccuuuacgggcggcacccuucugcgcuccgaggacaaaagcgucgaagcucuuugggucggccacccgggcucagcgcgcguagggggaccucgcuuggggcaugaaggcgcggcgucuuggaguagacagggccgggggaagaggccgaguugugugugcuggagagcgagagccgggcgcgcuccgggucugaaacuaccuguagcugcagcuaccuguccgccccaccucgggaagaacaacaaugcucucuugcgcgcgugcgugucugugugugguacgugagugugugcgcggcgugugcggugugugugccggagccacuccacaccccgauccguaguauuuugcuguauccagguugcgccggggagcgcggcaccgcccgcuuugcgccgggcucggcguuccucuuaccccacgcgcugcgcacuccagccggccgcacccucuacuccugggcaaggaccugggcgccgcggccgggagccggcucggcuucacucaccccuccccucucucccccgcucuccgcagagaaugugauggacaucggucugaccaacgagaagcccaauccggaacucucuuauucgagcucuuuccagccagcccccggcaacaagaccgugaccuacuugggaaaguucgcuuucgacucuccuuccaacuggugccaggacaacaucauuagccucaugagugccggcaucuugggggugcccccggccucaggggcgcucaguacgcagacguccacggcuagcauggugcagccuccucagggagacguggaggccauguauccggcgcugccuccuuauuccaacugcggcgaucucuacucggagcccgugucuuuccacgacccccagggaaacccugggcucgccuauuccccccaggauuaccaaucggccaagccggccuuggacagcaaucuuuuccccaugauuccugacuacaaccuguaccaccaucccaacgacaugggcuccauuccggaacauaagcccuuccagggcauggaccccauccgggucaacccacccccuauuaccccacuggag

SEQ ID NO: 11518 - RNA, 3920 nt, Mus musculus
cuccagugggguaauaggggguggguugacccggaugggguccaugcccuggaagggcuuauguuccggaauggagcccaugucguugggauggugguacagguuguagucaggaaucauggggaaaagauugcuguccaaggccggcuuggccgauugguaauccuggggggaauaggcgagcccaggguuucccugggggucguggaaagacacgggcuccgaguagagaucgccgcaguuggaauaaggaggcagcgccggauacauggccuccacgucucccugaggaggcugcaccaugcuagccguggacgucugcguacugagcgccccugaggccgggggcacccccaagaugccggcacucaugaggcuaaugauguuguccuggcaccaguuggaaggagagucgaaagcgaacuuucccaaguaggucacggucuuguugccgggggcuggcuggaaagagcucgaauaagagaguuccggauugggcuucucguuggucagaccgauguccaucacauucucugcggagagcgggggagagaggggaggggugagugaagccgagccggcucccggccgcggcgcccagguccuugcccaggaguagagggugcggccggcuggagugcgcagcgcgugggguaagaggaacgccgagcccggcgcaaagcgggcggugccgcgcuccccggcgcaaccuggauacagcaaaauacuacggaucgggguguggaguggcuccggcacacacaccgcacacgccgcgcacacacucacguaccacacacagacacgcacgcgcgcaagagagcauuguuguucuucccgagguggggcggacagguagcugcagcuacagguaguuucagacccggagcgcgcccggcucucgcucuccagcacacacaacucggccucuucccccggcccugucuacuccaagacgccgcgccuucaugccccaagcgaggucccccuacgcgcgcugagcccggguggccgacccaaagagcuucgacgcuuuuguccucggagcgcagaagggugccgcccguaaagggagccucucccggccccagucuccucccggccugaaggagcuuucugcucgggcuggaggggaaaagccuaaacccagcuaaggagaguggagagcggcggaaaaccagcccaugucuccacggcgggagcggccgccguucccaagcucccgggucccaggaucgcccccgguggcaaacccuuucccccgccccgugggugagcccccucccucuccccaccguccccacacccccaauggcuuugcugaacgccccggaaaggcagcgucgcaguaccucucccaccguggggacuccacgccgcacauggcuccaucccgggugggaggcugagggaguaaggaggggggagagcgcgggugaaaaagacgcugggcuccucccgagaaagggggcuacagcaccacgccuugcacgcagcccagcgaucgggcccccugcguggggagggagaaccccagagcugcucgcaccuaccucccuccagucggcggcugcccccacccgggagaaccgaagccucaaccguggcgucuccaaccaagccuucccgaucucggagggcgggaggagugggugggaaaagcaacucgccccccagaaaauucccagcgcgccccccaucuuuccauccgucucuccauccauccauuucugcauccaucgauaugugcauccaucgcuagcucgcucccuccuccucguccucccccuuuccuuccucgcugccucgccgccucaccgccacccuuaccuguagccaucugauuguaaugggcuaccgagucgcugcugccggagaagagguugagcgcgcuggggaucuccucgggguacagauugucaggcaauugauuuagcaaacugcucauggucaccggcagcuucucggcgaguuugccggucauagcacucccgagcuaccgccgccaccgccgccgccgccaccgccgccgccgccuguuccuaacgcagcuuccaggcgagcggcauccgagaggcgauccguggugcaggggaaaagcaugcgagagggaaaguucggagggaggggggagugaaaaggggaaggggugggucaggggaggggaucuauucuuuuuuggagggguggaugggagaggggcaaagaggguaauccucucgggugccucggcuggugcggugcgacgcugggucgugggggugggguggggcgugugcgaggagugggaugggggcugggcugggggggugaucuaggcuccagggggucagacgcggcuucaguauugaucucacagacacgagcccgccgaccccccccgccccccgaucugccacagccgccgccgccgcugccgccgccaccuccucugcugcugcugccgccgccgcugcuaucaccaccaaccagccccgccgcuuccuagcuagcucacugcugcccaaaagcucccagccagggaacuccaccagucuauuuaucugagccccgggaaagcuccgugacguagcugcccauauauggacagacaaagcccagccgaaggggcgcgacgucacaauggaagcuccucacaauggaacauuagaaagcaggaagcgggccgcagccaacgugcagcgcccgcaccgcucuccguucuuuaaaaaaaaaaaaaaaaaaaaaaaaaaagucaauuagauuagaaagaaggaaagcgagaagagaaaaaagaaagagggacgaagccgaaugcaaagcgcgcgaugcgcagugcacaguugaaaaacccuguaacuaaacauguagguuuuuauuugaggacagcauuagagacagaauuuagucguuggaggaguggaguuguuugcaauuggucuccagcacucccagcauuuagaaagaguucaguacaccaggacacagguuccuuagcagucuaggaaugggagaggugaccgcuucaagccaggcucccccacacaacuucugucuuuccuucuuauccuugacuggauucagauggagagaugaaguauuuuccuuuggggaagggguucuaauguccuaaggcuucuuauucuuggacacuuagaacuuucgugcggacaucauucugauucaccgcccgcagccccggccccucccuugggguuccugaccccgcgcugacucucaguugagcgcaguggcccgggaauguguagcggauuagcuaguugcgcagugggcaagaacuuuuaggggcgaggguaugaggguuuuguuguuguuguuguuguuguggagauuaggaaagagugaaguuuaggggauagaaaacacgugcaccaaauaauucccagauaaauucccuaacgguucuaaagcaaaccccuuuggccacaggauggcaggagggcccagcaggccggggcacagucgcuaucuacugcagccggcgaagggcuugcggcugaguuacugcgggaagaugugaaacccacagauucuaagccaccaaggcggucuccuccagucucuacucucugucucccgcaggguuguccucauugcugccugagggugccuugcagucaagggcggcccccugugccgacccagggugcugucaccucgacagcggaucccgggggugggugauguguuccccgaggccugcuccugaagcgcgcagccuggcugagagcgagggggaggagagggagggagcacggaggcgcgaccccgaaucacaccggguuggcgggggaggauucccuccucaguggccgcgugggcgcggugaaucccgcggcccccgcuggagagucgggguugggggaacuugcaucucucagggggagugggaguguugacaagaaggaagagaggauccc

SEQ ID NO: 11519 - RNA, 4187 nt, Mus musculus
gcgacccacgucagggucgcgggcugccacuguggccagguaggcgccuggaggguuguuuucgcggaccgacaccucauagacuggcuuggugaagaucggugcguugucguucucgucccccacucgcacgguguagggccugacggugcgaagagggggugugccacggucuucggccaccagcgucagguuguacuccgcgaugcgcucccgguccagagaugcagcggucaccaccagguagcugccagcauaggccggcugcagccuaaagugcucgugcccguagagggcgcagcgcaccugcccguuggcgcccgagucccuguccgaggugcugaccagcgccacuagacucucgcgcgccgcccccucuggcaccagcgaggugauaccggcuuccugugucccggacccagucgacgaggccgcguccgcuccuccgagugcggcggcagcggcggcggcggcgaagggcgagguggcuggagcccccggggcggccagaggagugauagaaauuucaggagcguugucguugacgucucggaugcgcacgauaaccuugcagguggcuguccggggcccuggaccucggucuugagcccgcacguccagcucguagguguccuggcgcucguaguccaccugcccagccaaggugaggcggccagagcgcgggucgagccggaagagguggcgggcuucgggaggggugcgggcgccgaaggugaacacaacgucgccguugggaccuucgucgggaucggcagcguccaggucgagcagcagcgaucccacaggugcguccucggccaauuccaccucugccacggcacccugugggaaggccgggcuguggucauuggcaucuagcacacgcacgcugagggcugcuguggcggaacgcggcggucgcccgccauccugagccaccagcuccaggcuguaggaggccuggcucucgcgguccaacuccuguagcagcaccagguccgcacacugggcaccguccgcgcgcgucugcagcuccacgcggaaggggcugugaggcucggcuaggcguacacucugcagcccguuggcacccacguccucguccacgggcaccuccagggggaugcgugugccuaccggagcgcucucugagaccuccaccgggaucugggcucggggaaagcggggcgcguggucguuuacaucccucaccuccaccuccacgugcaccaggcggaacuguuccugcgagaagcugacaacaucgaaggccagcacgcacuguggggacgggccacacagacgcucacgguccaggcccgcauccccgacggucagcugcccgucgcccucgcguacccggagcagagagcuguugaauugcuucaucaggcggaagcuugugucuccagacacuuucaugugcaggucuucugcaaggguuccgaugacugugccaggggcauccucuucgaacgugcuguaucggacugucuugcucugggccacugagagcacccagcagagacuaaauagcugcaaggggaaaaggcaagggcugccccagcgcuucgcaggacucauaucgccaauccccaacugcuauuccgaaaggcuaaccuaaagagucuuccccggcgugcagaucggagcgugagucccaggcucugcgagccccgugcgggaaaagcugcagcuccggcucgggcuggcucggaggacgcgcagacccacccucacucggcgccuccgccuccuuucccugggcuggagcugcgcuggcgagcgccgccuccgucuuuauagcugccgauaugcaaaucacuggaaggggccagccaauggucgcuuagccacagcgccgcuccuccgccaaccaccgacaaucccuuuaauguggaaaggcuuagaggagaaaacagggaaggaaaaugagggaaucuuuccuuuguuuuaaaaacuccugcucccauuuucuguuagcaccuugcuugcaaugaguuagcacugggcucugaaguaaacgaagcugaugauuuuuggaaauugggugccaggcacccggucucuucugcccgccgcugcggguacuaagcccgaacaagcuggguuucucuucagaagcuccgggucucacauccuaccccccauccgccccuuuauuuugcauuuuaaaggcuucaaaacuugcucuggggagcgaggcucucuguucgccuccucccucagcuucccaccgguguggggaauaaccugucgaugaagaagagugaaggguagagcaaaacugauuuuauucacauuuguguacgcaauuguguuuugcucgugugagcaccggugccacuugccuuucagaaaagagcccugcgauacacguuaguaugcaugucacuguucaaauggcuuccuuaagcccuaggugcuagcaggcaaggaaaaauaaaguuccaaauaggauuuagcauaagcuugaggagauuuggaaagguuucaaagaucagacuguaucaaaggcuuaugaagcccucguuaguaguggaaauagaauggcguggcaggcgaucccauuggaggccccgaugucuguauuauuucacuaugacaagcuagagggggagagaaaguugaacaguuuccacaguagaguugggcuaacuugaauauaaugagcaaacgccacaugucuccauuaugccucucuauucacccucaauccgugccauaacucucaggcuaaacggugaugggcgcugaaucccacacaauaccggguuccuacuaaagugcauuuagagaucguuuuccuccugaugccuuguuccgccuauuuagaggauuugcuuucuguucuaauagggccucucuggaagcaacacucgcccuguuccagaagaacaaaaucacagcgugacguugaaaccuggcaggaaccugggguaacuuagccaucugccuaugaaaccguagaacuucagcauuaccacuuucccuggcugggguccucgagaugccuccguagguauccagguaucuccacucccggagcugaaggacagguugugccaaccuggaacaagacugauucuuauugauucuuaccgaaggacucuauugaacaggcgauguaaauacacaggaagaagggagaguuacaaacacaagucacacacuuggagaaauaaagacaaugaguuugcuaagcauguugcauugggccucuauucuucggaaucuggaccauguuccuucuguaagggccuuuugcaggucucuucccuucagacucauuuggaccgcuuucagaagaggagcagggguuugccccgaguagggagaauaccugagagguaggacuggguggacagugcacuggaggggauaggggauguuugggauugcaggaaaugcauucugagccauuaaauaaaaaucuuuaugggguugaggaggggcaguggguaguuugggggcucccuucaucuuuuccaccuuccagugcugguauuugcaggcagugaggccagaugucugaagccacugagacauuagaaaggcaacacuccuacagaaccuuaauuucuauucucccugucucucugucuuucucucucuccgucucucucucugucucugucucucucugucucucucucucucucucucucucucugucuagugccauuuuagguuuuggcucucacccuggguggagagauaaauauuguaugaaugcucagucuuuuuucgaaccccagaccacccugaccuggacccacacuugacucuuggcuuuuccaggcucacucccucuuccuuuauggccucucucagacccacacccaaacagguucggaaccuuagugauggacagcagccaaccugggaaccuucguugucucuggcacugugcuaucaaggcagagaauguguuggccuggaccuggagggaacaugaggugggauuugaccacgguucuguaauacacacucucucacagcucagugucugggagcugaacuccaaccugagauuccagguuucaccgagggagcucagcaggaugcuaagugcacuuccugucaccuucucucucuucccucccacaccccccaaaggcaagugcuuggaaaaagcaaaagggcaagaaagggcaaacaagaagcccagccgcggcagaaacggu

SEQ ID NO: 11520 - RNA, 4187 nt, Mus musculus
accguuucugccgcggcugggcuucuuguuugcccuuucuugcccuuuugcuuuuuccaagcacuugccuuuggggggugugggagggaagagagagaaggugacaggaagugcacuuagcauccugcugagcucccucggugaaaccuggaaucucagguuggaguucagcucccagacacugagcugugagagaguguguauuacagaaccguggucaaaucccaccucauguucccuccagguccaggccaacacauucucugccuugauagcacagugccagagacaacgaagguucccagguuggcugcuguccaucacuaagguuccgaaccuguuugggugugggucugagagaggccauaaaggaagagggagugagccuggaaaagccaagagucaaguguggguccaggucaggguggucugggguucgaaaaaagacugagcauucauacaauauuuaucucuccacccagggugagagccaaaaccuaaaauggcacuagacagagagagagagagagagagagagagacagagagagacagagacagagagagagacggagagagagaaagacagagagacagggagaauagaaauuaagguucuguaggaguguugccuuucuaaugucucaguggcuucagacaucuggccucacugccugcaaauaccagcacuggaagguggaaaagaugaagggagcccccaaacuacccacugccccuccucaaccccauaaagauuuuuauuuaauggcucagaaugcauuuccugcaaucccaaacauccccuauccccuccagugcacuguccacccaguccuaccucucagguauucucccuacucggggcaaaccccugcuccucuucugaaagcgguccaaaugagucugaagggaagagaccugcaaaaggcccuuacagaaggaacaugguccagauuccgaagaauagaggcccaaugcaacaugcuuagcaaacucauugucuuuauuucuccaagugugugacuuguguuuguaacucucccuucuuccuguguauuuacaucgccuguucaauagaguccuucgguaagaaucaauaagaaucagucuuguuccagguuggcacaaccuguccuucagcuccgggaguggagauaccuggauaccuacggaggcaucucgaggaccccagccagggaaagugguaaugcugaaguucuacgguuucauaggcagauggcuaaguuaccccagguuccugccagguuucaacgucacgcugugauuuuguucuucuggaacagggcgaguguugcuuccagagaggcccuauuagaacagaaagcaaauccucuaaauaggcggaacaaggcaucaggaggaaaacgaucucuaaaugcacuuuaguaggaacccgguauugugugggauucagcgcccaucaccguuuagccugagaguuauggcacggauugagggugaauagagaggcauaauggagacauguggcguuugcucauuauauucaaguuagcccaacucuacuguggaaacuguucaacuuucucucccccucuagcuugucauagugaaauaauacagacaucggggccuccaaugggaucgccugccacgccauucuauuuccacuacuaacgagggcuucauaagccuuugauacagucugaucuuugaaaccuuuccaaaucuccucaagcuuaugcuaaauccuauuuggaacuuuauuuuuccuugccugcuagcaccuagggcuuaaggaagccauuugaacagugacaugcauacuaacguguaucgcagggcucuuuucugaaaggcaaguggcaccggugcucacacgagcaaaacacaauugcguacacaaaugugaauaaaaucaguuuugcucuacccuucacucuucuucaucgacagguuauuccccacaccggugggaagcugagggaggaggcgaacagagagccucgcuccccagagcaaguuuugaagccuuuaaaaugcaaaauaaaggggcggaugggggguaggaugugagacccggagcuucugaagagaaacccagcuuguucgggcuuaguacccgcagcggcgggcagaagagaccgggugccuggcacccaauuuccaaaaaucaucagcuucguuuacuucagagcccagugcuaacucauugcaagcaaggugcuaacagaaaaugggagcaggaguuuuuaaaacaaaggaaagauucccucauuuuccuucccuguuuucuccucuaagccuuuccacauuaaagggauugucggugguuggcggaggagcggcgcuguggcuaagcgaccauuggcuggccccuuccagugauuugcauaucggcagcuauaaagacggaggcggcgcucgccagcgcagcuccagcccagggaaaggaggcggaggcgccgagugagggugggucugcgcguccuccgagccagcccgagccggagcugcagcuuuucccgcacggggcucgcagagccugggacucacgcuccgaucugcacgccggggaagacucuuuagguuagccuuucggaauagcaguuggggauuggcgauaugaguccugcgaagcgcuggggcagcccuugccuuuuccccuugcagcuauuuagucucugcugggugcucucaguggcccagagcaagacaguccgauacagcacguucgaagaggaugccccuggcacagucaucggaacccuugcagaagaccugcacaugaaagugucuggagacacaagcuuccgccugaugaagcaauucaacagcucucugcuccggguacgcgagggcgacgggcagcugaccgucggggaugcgggccuggaccgugagcgucuguguggcccguccccacagugcgugcuggccuucgauguugucagcuucucgcaggaacaguuccgccuggugcacguggagguggaggugagggauguaaacgaccacgcgccccgcuuuccccgagcccagaucccgguggaggucucagagagcgcuccgguaggcacacgcaucccccuggaggugcccguggacgaggacgugggugccaacgggcugcagaguguacgccuagccgagccucacagccccuuccgcguggagcugcagacgcgcgcggacggugcccagugugcggaccuggugcugcuacaggaguuggaccgcgagagccaggccuccuacagccuggagcugguggcucaggauggcgggcgaccgccgcguuccgccacagcagcccucagcgugcgugugcuagaugccaaugaccacagcccggccuucccacagggugccguggcagagguggaauuggccgaggacgcaccugugggaucgcugcugcucgaccuggacgcugccgaucccgacgaaggucccaacggcgacguuguguucaccuucggcgcccgcaccccucccgaagcccgccaccucuuccggcucgacccgcgcucuggccgccucaccuuggcugggcagguggacuacgagcgccaggacaccuacgagcuggacgugcgggcucaagaccgagguccagggccccggacagccaccugcaagguuaucgugcgcauccgagacgucaacgacaacgcuccugaaauuucuaucacuccucuggccgccccgggggcuccagccaccucgcccuucgccgccgccgccgcugccgccgcacucggaggagcggacgcggccucgucgacuggguccgggacacaggaagccgguaucaccucgcuggugccagagggggcggcgcgcgagagucuaguggcgcuggucagcaccucggacagggacucgggcgccaacgggcaggugcgcugcgcccucuacgggcacgagcacuuuaggcugcagccggccuaugcuggcagcuaccugguggugaccgcugcaucucuggaccgggagcgcaucgcggaguacaaccugacgcugguggccgaagaccguggcacacccccucuucgcaccgucaggcccuacaccgugcgagugggggacgagaacgacaacgcaccgaucuucaccaagccagucuaugaggugucgguccgcgaaaacaacccuccaggcgccuaccuggccacaguggcagcccgcgacccugacgugggucgc

SEQ ID NO: 11521 - RNA, 800 nt, Mus musculus
uugcuuacauccauccucacguccacgaguccugagcugaaaaacagcuugaucgcaaagcgcuuucaccauguccugcaggcagguagcaucuguccgucugaaaguaaucccuauaucugugcccuuggucacucacaaggcaggcagggaagaugaagagugugugaacaagcggcccgucaagaacuguuacagggaaccuguauucacgcucccguuucagcaucucacuggugccuacucucagagacacugaccccuaugcgcauccuugccuguuaguggugacacuuccguucaagcagcucgagaggugguaccugcucuccccacccgcauagaagcucugcccccaaggcuguggggugcucuucucugaguggagagggaagcaccuagucccggagaaaugacagggacgggugggaguuaaggacuggaaagcaagaggcugggggaaaccaucaacucccacucccacgggguauugugagagaaaccaaauuggcccaaaugggaguucuaacucagcaaguguuuccccagcugcuugagugagaggccaggggacggugaaccucaaagcaggccuggacuggugucccagcgacgugcacgcugagaguaucuagucuuuuagaguugcccaccaauuagguggcacuuuucuggcacaaccucuugcggcuccugagagugcagucucgggaggcaaaaacuaacgcaggacagggcagaggcgcggggcagcaaagcucucggcucgcccgucggaaaguggauggaggcggcagcgc

SEQ ID NO: 11522 - RNA, 800 nt, Mus musculus
gcgcugccgccuccauccacuuuccgacgggcgagccgagagcuuugcugccccgcgccucugcccuguccugcguuaguuuuugccucccgagacugcacucucaggagccgcaagagguugugccagaaaagugccaccuaauuggugggcaacucuaaaagacuagauacucucagcgugcacgucgcugggacaccaguccaggccugcuuugagguucaccguccccuggccucucacucaagcagcuggggaaacacuugcugaguuagaacucccauuugggccaauuugguuucucucacaauaccccgugggagugggaguugaugguuucccccagccucuugcuuuccaguccuuaacucccacccgucccugucauuucuccgggacuaggugcuucccucuccacucagagaagagcaccccacagccuugggggcagagcuucuaugcggguggggagagcagguaccaccucucgagcugcuugaacggaagugucaccacuaacaggcaaggaugcgcauaggggucagugucucugagaguaggcaccagugagaugcugaaacgggagcgugaauacagguucccuguaacaguucuugacgggccgcuuguucacacacucuucaucuucccugccugccuugugagugaccaagggcacagauauagggauuacuuucagacggacagaugcuaccugccugcaggacauggugaaagcgcuuugcgaucaagcuguuuuucagcucaggacucguggacgugaggauggauguaagcaa

SEQ ID NO: 11523 - RNA, 803 nt, Mus musculus
cccgcaccugaccuuucuggucccuggagcaaggucggggaacaaggaacaagguccuggugcaggaaaauucauuugcagagcugguaagcccaucuggccugcacggugucgcaccgcuccuucccccacccggcgugggugcccuccucccucugggcugcugggacacgcuagaaucacagugggcgcagcgucaccgugucccagugcgcagccccuccgcggggucacugagaccagaaaagcgaaacuuguugcuuccgauguuggauaaaugauuccgcuccaggaagugucgcggagcuugaaaagcaucacccuaagguacuauuugcuaaaccaggcaacuaaaagggacucccgcuucccggccccccagaucuucccccagagaaucuuuaaguaccuaaaaagcagucugccaaccccagcgcuucuguuccaggaugcccgauagucuaggaugcccagaaagguccugcccgguagacccagucuuuccacuggucacagcuaccacagcgaugcagacggaguggaaaggauuguggagaagucucagaccagagaggcgcgucucugaaccgagcagcugcgcagguccagagggcccugcacccucuuuucguggucacgcagcaaagacauuuacggcgagaacaggcuguauuacacaagguaguucugacaccaaagucuugcaaauuaaaguuaauuuaaaauguuucuaaauguucuuucauuuggcugggcgucagugugugcuccaaucuuaacuuaaacuuacgcccucuuucggc

SEQ ID NO: 11524 - RNA, 803 nt, Mus musculus
gccgaaagagggcguaaguuuaaguuaagauuggagcacacacugacgcccagccaaaugaaagaacauuuagaaacauuuuaaauuaacuuuaauuugcaagacuuuggugucagaacuaccuuguguaauacagccuguucucgccguaaaugucuuugcugcgugaccacgaaaagagggugcagggcccucuggaccugcgcagcugcucgguucagagacgcgccucucuggucugagacuucuccacaauccuuuccacuccgucugcaucgcugugguagcugugaccaguggaaagacugggucuaccgggcaggaccuuucugggcauccuagacuaucgggcauccuggaacagaagcgcugggguuggcagacugcuuuuuagguacuuaaagauucucugggggaagaucuggggggccgggaagcgggagucccuuuuaguugccugguuuagcaaauaguaccuuagggugaugcuuuucaagcuccgcgacacuuccuggagcggaaucauuuauccaacaucggaagcaacaaguuucgcuuuucuggucucagugaccccgcggaggggcugcgcacugggacacggugacgcugcgcccacugugauucuagcgugucccagcagcccagagggaggagggcacccacgccgggugggggaaggagcggugcgacaccgugcaggccagaugggcuuaccagcucugcaaaugaauuuuccugcaccaggaccuuguuccuuguuccccgaccuugcuccagggaccagaaaggucaggugcggg

SEQ ID NO: 11525 - RNA, 3798 nt, Mus musculus
ugggcuggggacugcgcugugcgcgcguguacacacacacacacacacacacacacacacacacacacacacacaccagcuccucugcuaggccuuuuccccuuccucccauaccacaaacguuggggcagcaaccguucagcccgcuccaggucagcgugucccuguugucgaaagcccagagccgugaggacugaagcugacccgauccacggauaaaugaguaaauuggcagcugaaacccgacagggagcugggacagcuccgcggagacucggaccugggggugcagcuggccugcggcagacucggcuucugcacgccaggacaccacggcucguuugguggccgggugggccaguuuucugcaacgaggcuuauugcaggucugucuaccuggugagccggcucucucaaagcgugcggacuugccgcccucccacccccgaggucugagcgcggagaaguuccggugcgggucccagguggccgcccagcggccuagagaagcugcgguuccgagcgcgcucuacugcaccugcccaugcccgcugcagggcucaggccgccgggccccgcagaaccgcgcugcuaccugcaaagauucucggaaucuauccaaccuuuuuuuccagcugcggcggagcucgggcuggguugggcuagaguucuucccaggcugagaagcgcgagguaaacguguuuacagcaacaggcuggcucagggagcuuucggaaagggggguuagaaauuccacgguuuugaaaagcgagagauucaguacucaauacacacgggcccaaaggugcgaagccugcugaugcagaaguugccuccacuuuagugcaagggaacuagaaagcacuggcucaaagcucaggucaccaacggugcguguauguccugggggggucugaauguaaagaaaguucccuccaguucucuaaauugagaaaggcuguucgaaggaaugaggugguuggaaagagggaaccgcaggcauccugggagcugaggcucaagaccaagcgcuaaaaugaaagcacccuauggaacucacucgagaaacgguuuuuuaaacccccaacucuuccuaggcguucuccugcguccaucaaauuuauucugaaguaguuaagcacuacaggauacugaacacuccagucucugucccaggcucacuuccuaauccuugcgaaccuacaauuggugaagauggccugcuaguccugaauuacguuuuaccaaagaaacgaaaauuaauauucaccuugacaaaaauaaaacaaaaggcuuuuaccuuaaugggaucguuuccguagugucugccugccuuccugcuuggucuuugacgauucggcucggcucguagcuuucugcuuacaccuauccaucuccucacauaguugagguuauuguaauuguccuuugagggggcgaccgaaaagcaucuuuuggugaaacacguuugaauuguacaguuccuuuaaaagaucuaugguucugcaagcaccagcuaaaguguccucaagugguuugggacgagggacaguuugcuuaguucuguuccggcggcgcguugcgucugaaaagaaguugcuucaaguggaucuuaucguucccugacauccuuuuccagagggacuguaauacccucucauuuacacgcucacaaaacuaaaccuuuaggagaacuaagaaaccuaacaguacaugucaaauucaaucaauuuuccuggcggcugaacaaugaacucaauuuuugcugagaaugaagauaaugcacguuuugaggcacuggaauaguuuuuuccuaaaauuuaaaaaagauuguucuucacccauuccagaugggcagguuauuguuugccaauggauugcagaugcccacuccuuugccuaaguugguuaacugcuuaugaaauguacauuagcugauuaaagcuuagauauugaaagaaauuucucccggaacauccagaugucucugcacuaauuaugaaauuagucaauugucaccuucauaaacaaacuucguuuugaaaacagggaggaaaccagacuacacacauagucacaauugaccaaaaguaugggcagaacuguuuuacauaggaggaagggcgguauaugcuggaaaacaaaaucuaaaacugauagcuuuggcccuuugaagcagaugaucauauuaaaaguguuaagauguguaaaaugacgcgacagcuaaccgaguaaaaguacgaaaugcccuuuggacuucucugcgggcuugggggagcaaagauccaguagucggacuucuaucggugugaggaaagugucauccaaaaagaggggaugggcguugucuuugugugagguuugaauugagucaccuugggcucugugucuggguuaacugggaaaaccucaagcaaaccugcgccuuuaagacucaguugcuauccaaacacaaguaaacagaguggaccauuagcgggcgccgggcuuggaggcggagccugggcgcugcagccuugcuccucugcaggacgcccgccgcgaggggaggcggggccgcuacuaaagccuuggacuccgggccaggggcagccuggggcgggacgcgggcugggacggagcucagcgcgcucgcagccggagggugauggcccugcagggcugcgggcuccgacuuuacccgcaguccgcggucagaaacuggcccaggcaccgggaucugggcgagcucugagcacucaucccaacacgcucgcucuuuacacaucccgcuuccacggacugccgaagaccaauuaccgcugucgcuuucgcucccccagaucauguucucgguucccgggacaacgcgccgaaaaagaaguucucccaguuuggaccucaugaccuuuccaagcugugcguccugcuguccggaccuagucugaaccgcgcugcccaggcagacaucgguucuggcggugaguguccuuuccagggccaggcuguagccuuccaaaggaagggagggaugugggugcucaaggggcgcccagguucucagucuggagcgcuacaaguucagaaaaugaaaggcagccgugcggacccuagucccgggccucguguucuggccuccuccggucccugcacgcgacucccagcuaauacacucaguuguacuuuugugcgcugucccuuaguuugguuuugguagauuuacgcauucggcaagauuuauaaaggccgaucaucguacuuuguggccagaucccaucaccccgugauauugcuccccugcucuagaaagcgggauccacgcuuccuccuacugcagcuccggcacucagcacggaagggccgggacacacggugcaaucaagccagcgacuccgaaggcgcauuucacaggggaauaguccagucaugggugauuauuuuuuccaaccguguacuggccucuugcuuuuccuccugcuccggucuucgcccagaggccaacaggcaagcuucucaggagcugagacgcuuggguugucgagaaauagcucggaauggagucgcgguuguaggaaggaggcaggacaagguguuuguggaggcagcaacgcuggaucggucuccccaccugugagcagagaacaaaagaguucugacugcuuucgaagcgaaacugggugcagacagcaacuuucucugcuccacaaauuccagucuugaacagaacaagaaaaugaaauggagagggagggagcggagacaaacccaguuuaugcggagggcgccuuaauuuaauuaacucuucgggaaggcagagg

SEQ ID NO: 11526 - RNA, 3798 nt, Mus musculus
ccucugccuucccgaagaguuaauuaaauuaaggcgcccuccgcauaaacuggguuugucuccgcucccucccucuccauuucauuuucuuguucuguucaagacuggaauuuguggagcagagaaaguugcugucugcacccaguuucgcuucgaaagcagucagaacucuuuuguucucugcucacagguggggagaccgauccagcguugcugccuccacaaacaccuuguccugccuccuuccuacaaccgcgacuccauuccgagcuauuucucgacaacccaagcgucucagcuccugagaagcuugccuguuggccucugggcgaagaccggagcaggaggaaaagcaagaggccaguacacgguuggaaaaaauaaucacccaugacuggacuauuccccugugaaaugcgccuucggagucgcuggcuugauugcaccgugugucccggcccuuccgugcugagugccggagcugcaguaggaggaagcguggaucccgcuuucuagagcaggggagcaauaucacggggugaugggaucuggccacaaaguacgaugaucggccuuuauaaaucuugccgaaugcguaaaucuaccaaaaccaaacuaagggacagcgcacaaaaguacaacugaguguauuagcugggagucgcgugcagggaccggaggaggccagaacacgaggcccgggacuaggguccgcacggcugccuuucauuuucugaacuuguagcgcuccagacugagaaccugggcgccccuugagcacccacaucccucccuuccuuuggaaggcuacagccuggcccuggaaaggacacucaccgccagaaccgaugucugccugggcagcgcgguucagacuagguccggacagcaggacgcacagcuuggaaaggucaugagguccaaacugggagaacuucuuuuucggcgcguugucccgggaaccgagaacaugaucugggggagcgaaagcgacagcgguaauuggucuucggcaguccguggaagcgggauguguaaagagcgagcguguugggaugagugcucagagcucgcccagaucccggugccugggccaguuucugaccgcggacugcggguaaagucggagcccgcagcccugcagggccaucacccuccggcugcgagcgcgcugagcuccgucccagcccgcgucccgccccaggcugccccuggcccggaguccaaggcuuuaguagcggccccgccuccccucgcggcgggcguccugcagaggagcaaggcugcagcgcccaggcuccgccuccaagcccggcgcccgcuaaugguccacucuguuuacuuguguuuggauagcaacugagucuuaaaggcgcagguuugcuugagguuuucccaguuaacccagacacagagcccaaggugacucaauucaaaccucacacaaagacaacgcccauccccucuuuuuggaugacacuuuccucacaccgauagaaguccgacuacuggaucuuugcucccccaagcccgcagagaaguccaaagggcauuucguacuuuuacucgguuagcugucgcgucauuuuacacaucuuaacacuuuuaauaugaucaucugcuucaaagggccaaagcuaucaguuuuagauuuuguuuuccagcauauaccgcccuuccuccuauguaaaacaguucugcccauacuuuuggucaauugugacuauguguguagucugguuuccucccuguuuucaaaacgaaguuuguuuaugaaggugacaauugacuaauuucauaauuagugcagagacaucuggauguuccgggagaaauuucuuucaauaucuaagcuuuaaucagcuaauguacauuucauaagcaguuaaccaacuuaggcaaaggagugggcaucugcaauccauuggcaaacaauaaccugcccaucuggaaugggugaagaacaaucuuuuuuaaauuuuaggaaaaaacuauuccagugccucaaaacgugcauuaucuucauucucagcaaaaauugaguucauuguucagccgccaggaaaauugauugaauuugacauguacuguuagguuucuuaguucuccuaaagguuuaguuuugugagcguguaaaugagaggguauuacagucccucuggaaaaggaugucagggaacgauaagauccacuugaagcaacuucuuuucagacgcaacgcgccgccggaacagaacuaagcaaacugucccucgucccaaaccacuugaggacacuuuagcuggugcuugcagaaccauagaucuuuuaaaggaacuguacaauucaaacguguuucaccaaaagaugcuuuucggucgcccccucaaaggacaauuacaauaaccucaacuaugugaggagauggauagguguaagcagaaagcuacgagccgagccgaaucgucaaagaccaagcaggaaggcaggcagacacuacggaaacgaucccauuaagguaaaagccuuuuguuuuauuuuugucaaggugaauauuaauuuucguuucuuugguaaaacguaauucaggacuagcaggccaucuucaccaauuguagguucgcaaggauuaggaagugagccugggacagagacuggaguguucaguauccuguagugcuuaacuacuucagaauaaauuugauggacgcaggagaacgccuaggaagaguuggggguuuaaaaaaccguuucucgagugaguuccauagggugcuuucauuuuagcgcuuggucuugagccucagcucccaggaugccugcgguucccucuuuccaaccaccucauuccuucgaacagccuuucucaauuuagagaacuggagggaacuuucuuuacauucagacccccccaggacauacacgcaccguuggugaccugagcuuugagccagugcuuucuaguucccuugcacuaaaguggaggcaacuucugcaucagcaggcuucgcaccuuugggcccguguguauugaguacugaaucucucgcuuuucaaaaccguggaauuucuaaccccccuuuccgaaagcucccugagccagccuguugcuguaaacacguuuaccucgcgcuucucagccugggaagaacucuagcccaacccagcccgagcuccgccgcagcuggaaaaaaagguuggauagauuccgagaaucuuugcagguagcagcgcgguucugcggggcccggcggccugagcccugcagcgggcaugggcaggugcaguagagcgcgcucggaaccgcagcuucucuaggccgcugggcggccaccugggacccgcaccggaacuucuccgcgcucagaccucgggggugggagggcggcaaguccgcacgcuuugagagagccggcucaccagguagacagaccugcaauaagccucguugcagaaaacuggcccacccggccaccaaacgagccgugguguccuggcgugcagaagccgagucugccgcaggccagcugcacccccagguccgagucuccgcggagcugucccagcucccugucggguuucagcugccaauuuacucauuuauccguggaucgggucagcuucaguccucacggcucugggcuuucgacaacagggacacgcugaccuggagcgggcugaacgguugcugccccaacguuugugguaugggaggaaggggaaaaggccuagcagaggagcugguguguguguguguguguguguguguguguguguguguguguguguacacgcgcgcacagcgcaguccccagccca

SEQ ID NO: 11527 - RNA, 1814 nt, Mus musculus
gaguggaaauaaagaacaaccaaaccuagugccguaauuuaauucccccaaaucaugugaccugcaaagguuuaauacagaaguugugucaaaucugacagcuccagugcuccaguguugacuugacauaaauguggcaaagcuuuccauacccuccuguauuuccaccacgcucauguaugggcuagaucccugucagaacucccacaaauacuuaauucucguagcagcgauuauaaaugacaccuggcuacuucgcacuguuccggaccagaagagaacccacacaaacaagucacuuucauccugcguuguuccccuggcaaccauauuaaacugcaaggauaaagagccuuuguaguagcugcuucuauugaauuacaauguaaauguugaugcuugccuagaaaugucaacgggcgacaggcuuauggaacagaugcaguaguuguuccgcagcgcaggaaucccaggcugcggagagaugcaagaggugcgcccgggccaccuuaagagucuauucaaccgaaucuccuuucuccauuaaagccacgccgcacuucauagauccaguucaggaaaggucgcucgacuaguugaaaacugaaaacgaccugcuaucuucuaugcaucagagcaggagaagaguuuguuguggauaagaaugcuaacaaugcaauuacgcaagagacccggcaauccguuccuuucccacucagcauagcguaacucuaguucccugacucuucugcccgccacacaguuuucgucccgcgagugucaaguggcagguggugaacuggccauuugguuccggguggcuuguugauuucuggguucagcauucugucguccuucgguuugacccacgguaccuagugucuguaguggcgcuccccgcuccgucucucccaucaccucuacccugccccuagucagggaagaaagccaaaaguggguagaagucagcucgcagagucuccagcgugccaccgcuccacucagguaaacuucgcagugagugaccugcacuuggagaagggccuuaccugagcgcgccucugccaauggcagcucaccugagggagcaccgcagccaaucaccgcgcagcucggcccucgggcuuguacccuuuagugaaagaauucagcgccuugcgagaaaguuaccuguggccgcccaaguccgccacuuugcgcucugugucugcccauugcagcgauccgggaggacuccgcgccgccgggccgccuccgagcgcgggccccaugugagggcucccuccccccaucccaccuuuccggcuaggugagggcgcgagcgagcgggcgagcgagaguggugaggggggacgaaagcagaauuaccuguagcucuuguucugccaucucgggcgcucucacacaccuucaccugcacagacuugaaaguccaguuucaccagaggcugaggcuccaggaaaaggggagcgaguucauuggaucaaacaugucacaagagucggacaaguaagugggucgcacgcgccggcggcggcugccgcugccccuuugggcugauggcaacugguuuguuguguuuuuguuuuuuuuguuuuuguuuuuguuuuuuaagucgcuauuguuggauuuugauuuuguauuuuuuuccucucuuuuuacuuuuuucuuuuugguguauccagacccucucggauuauuucuaccccgauucaggggagagacccuacucgaacgugaauguuuaaaacccguuuuggggccuugcaaguaaacguggguuuucuuugcuuccuccccgacgaaugagcuc

SEQ ID NO: 11528 - RNA, 1814 nt, Mus musculus
gagcucauucgucggggaggaagcaaagaaaacccacguuuacuugcaaggccccaaaacggguuuuaaacauucacguucgaguagggucucuccccugaaucgggguagaaauaauccgagagggucuggauacaccaaaaagaaaaaaguaaaaagagaggaaaaaaauacaaaaucaaaauccaacaauagcgacuuaaaaaacaaaaacaaaaacaaaaaaaacaaaaacacaacaaaccaguugccaucagcccaaaggggcagcggcagccgccgccggcgcgugcgacccacuuacuuguccgacucuugugacauguuugauccaaugaacucgcuccccuuuuccuggagccucagccucuggugaaacuggacuuucaagucugugcaggugaaggugugugagagcgcccgagauggcagaacaagagcuacagguaauucugcuuucguccccccucaccacucucgcucgcccgcucgcucgcgcccucaccuagccggaaaggugggauggggggagggagcccucacauggggcccgcgcucggaggcggcccggcggcgcggaguccucccggaucgcugcaaugggcagacacagagcgcaaaguggcggacuugggcggccacagguaacuuucucgcaaggcgcugaauucuuucacuaaaggguacaagcccgagggccgagcugcgcggugauuggcugcggugcucccucaggugagcugccauuggcagaggcgcgcucagguaaggcccuucuccaagugcaggucacucacugcgaaguuuaccugaguggagcgguggcacgcuggagacucugcgagcugacuucuacccacuuuuggcuuucuucccugacuaggggcaggguagaggugaugggagagacggagcggggagcgccacuacagacacuagguaccgugggucaaaccgaaggacgacagaaugcugaacccagaaaucaacaagccacccggaaccaaauggccaguucaccaccugccacuugacacucgcgggacgaaaacuguguggcgggcagaagagucagggaacuagaguuacgcuaugcugagugggaaaggaacggauugccgggucucuugcguaauugcauuguuagcauucuuauccacaacaaacucuucuccugcucugaugcauagaagauagcaggucguuuucaguuuucaacuagucgagcgaccuuuccugaacuggaucuaugaagugcggcguggcuuuaauggagaaaggagauucgguugaauagacucuuaagguggcccgggcgcaccucuugcaucucuccgcagccugggauuccugcgcugcggaacaacuacugcaucuguuccauaagccugucgcccguugacauuucuaggcaagcaucaacauuuacauuguaauucaauagaagcagcuacuacaaaggcucuuuauccuugcaguuuaauaugguugccaggggaacaacgcaggaugaaagugacuuguuuguguggguucucuucugguccggaacagugcgaaguagccaggugucauuuauaaucgcugcuacgagaauuaaguauuugugggaguucugacagggaucuagcccauacaugagcgugguggaaauacaggaggguauggaaagcuuugccacauuuaugucaagucaacacuggagcacuggagcugucagauuugacacaacuucuguauuaaaccuuugcaggucacaugauuugggggaauuaaauuacggcacuagguuugguuguucuuuauuuccacuc

SEQ ID NO: 11529 - RNA, 1066 nt, Mus musculus
cccacgcaacuccuggaaagugacucuggguccccgcaggccggggacggagcugcucggcugcaggccgggaacaggugcccgacgcgggaccccgggggcucaggggagccucccgcaguccccaugagcugaccguggaagguuugcgcuggguggaauucgggguacagggggcacggggugagcgcguugaaggggaaagugcuggaggugaagaagcgcaaaggagucaccacccaggcccacucuuccuagggggaccucgcucaaccccagcagacugauuuucgccuuugcgaaaacaggaaaggcacauccgcagaagucugcgauuguagagagagcuaaaguugaagaacucugucugggucacuuguccucauuuuccccauauagugagauggccaaggggccccuagacccccuuucuucuaaccaccaucaccccuuuccucgcuccaacuugcuuaugccgugccuccucuuacccgguguuuuagacaguauaacccuucaucagcaguucccuagaauugaggcuuccuuagcaaagugauacauccgcgcccgggcagguggauaugucucuugcuaggauggaauuuuccacauuuuuuucuuucuuuguagcauuaguuaccuagcaugacauuugacuuggauuugacuuugugacgaauguuacugauaacacacuuuggguuuguuuuuacagcaguugccccagaauucauuuucaggaaacagcuucuaucaaaaugguacaaagaaugcaaugaggaauuuguacauuuuaucucugauuugagaaucuuuuugaugcggaaaggagcauaagaauaauccaagccaugugguaaaaucggagucuggcaagauggaaagguccccguuucuguuggcgugcauucuucugccccucguaagaggacacagccuuuucaccugugagccaaucaccguucccagauguaugaaaaugacuuacaacaugacguucuucccuaaccugaugggucauuaugaccaggggaucgcugcuguggaaaugggggugagugga

SEQ ID NO: 11530 - RNA, 1066 nt, Mus musculus
uccacucacccccauuuccacagcagcgauccccuggucauaaugacccaucagguuagggaagaacgucauguuguaagucauuuucauacaucugggaacggugauuggcucacaggugaaaaggcuguguccucuuacgaggggcagaagaaugcacgccaacagaaacggggaccuuuccaucuugccagacuccgauuuuaccacauggcuuggauuauucuuaugcuccuuuccgcaucaaaaagauucucaaaucagagauaaaauguacaaauuccucauugcauucuuuguaccauuuugauagaagcuguuuccugaaaaugaauucuggggcaacugcuguaaaaacaaacccaaaguguguuaucaguaacauucgucacaaagucaaauccaagucaaaugucaugcuagguaacuaaugcuacaaagaaagaaaaaaauguggaaaauuccauccuagcaagagacauauccaccugcccgggcgcggauguaucacuuugcuaaggaagccucaauucuagggaacugcugaugaaggguuauacugucuaaaacaccggguaagaggaggcacggcauaagcaaguuggagcgaggaaaggggugauggugguuagaagaaagggggucuaggggccccuuggccaucucacuauauggggaaaaugaggacaagugacccagacagaguucuucaacuuuagcucucucuacaaucgcagacuucugcggaugugccuuuccuguuuucgcaaaggcgaaaaucagucugcugggguugagcgaggucccccuaggaagagugggccuggguggugacuccuuugcgcuucuucaccuccagcacuuuccccuucaacgcgcucaccccgugcccccuguaccccgaauuccacccagcgcaaaccuuccacggucagcucauggggacugcgggaggcuccccugagcccccggggucccgcgucgggcaccuguucccggccugcagccgagcagcuccguccccggccugcggggacccagagucacuuuccaggaguugcguggg

SEQ ID NO: 11531 - RNA, 592 nt, Mus musculus
ccucagucccccuggcucgcccugcagcccucagccuccgcccuccacgcaggggaccggcggcagcugugugagcucacccgggcccagccgaaucgccgacuaccugcugcuaccccuagcugagcgcgagcaugugucccgggcacugugcauccacaccggccgcgagcugcgcugcaagguaagcauccuggggcggagguugcgggucuggaucguccacagaagugccuagguuccggcccaccgggaucacagucccgccagcgcuuggguuuggcagagcagauaagggcguuuaguuggauaaggaggguauuuuggucagcuucguguuuuuggagguugagugcuuuccuguggaguguuuuuuggugaggguuaggcggucuagaggaagugcaggguucaguucuuuuaucucuguucuuuucuuuggcgcucuguauugcuagcgcguggcguuccauuuaaguuuggaauugcaauggguuccagggccaugccauugcccugcucucaucccccuccucccccuguccuggaaggacgcccugcagugugugccuccucgggacuuggagcaacu

SEQ ID NO: 11532 - RNA, 592 nt, Mus musculus
aguugcuccaagucccgaggaggcacacacugcagggcguccuuccaggacagggggaggagggggaugagagcagggcaauggcauggcccuggaacccauugcaauuccaaacuuaaauggaacgccacgcgcuagcaauacagagcgccaaagaaaagaacagagauaaaagaacugaacccugcacuuccucuagaccgccuaacccucaccaaaaaacacuccacaggaaagcacucaaccuccaaaaacacgaagcugaccaaaauacccuccuuauccaacuaaacgcccuuaucugcucugccaaacccaagcgcuggcgggacugugaucccggugggccggaaccuaggcacuucuguggacgauccagacccgcaaccuccgccccaggaugcuuaccuugcagcgcagcucgcggccgguguggaugcacagugcccgggacacaugcucgcgcucagcuagggguagcagcagguagucggcgauucggcugggcccgggugagcucacacagcugccgccgguccccugcguggagggcggaggcugagggcugcagggcgagccagggggacugagg

SEQ ID NO: 11533 - RNA, 811 nt, Mus musculus
ggcagacacuucucacuggaacuuacaaucugcgagccaggacaggacuccccaggcuccggggagggaauuuuugucuauuuggggacaguguucucugccucugcccgcgaucagcucuccugaaaagagcuccucgagcuguuugaaggcuggauuuccuuugggcguuggaaaccccgguaagcacagaucugguggucuuucccuguguucuuucugcgucuugaauguagcggccgguuaggacagucuuucuuccauuccugugcuuuugacacuuuucucaagaguaguugggguaggcugggguagaucugagucgggguagagcgacuugucaagaugacagaggaaaggggaagggaaaaaccgggaugcauuuugaagcgggguucccgagguuacuaugggcugacgcugacccggccgguuggacauucuugcuuugcuacauuaauugauauguguccuuugaggggucaaaccgggaggucgcuucgugguggccaaagaaagcccuuggaauccugaggucuuuggagaagggauuaccuuuugcguuugggagcgagaaggcuccguagcuucugacuuaccagucucugagagggcauuuaaauuucagcuuggugcauuucugacagccugggaccgacacggaggugcgucccgcccgccaauccccggcggcgaucgcaacccgucccugagccuuuuaagaaguugcuauuuuggcuuuaaaaauagugaucguaguaaaauuuaagccugacccccgcggcacuaggacuugauguugggcuagcgc

SEQ ID NO: 11534 - RNA, 811 nt, Mus musculus
gcgcuagcccaacaucaaguccuagugccgcgggggucaggcuuaaauuuuacuacgaucacuauuuuuaaagccaaaauagcaacuucuuaaaaggcucagggacggguugcgaucgccgccggggauuggcgggcgggacgcaccuccgugucggucccaggcugucagaaaugcaccaagcugaaauuuaaaugcccucucagagacugguaagucagaagcuacggagccuucucgcucccaaacgcaaaagguaaucccuucuccaaagaccucaggauuccaagggcuuucuuuggccaccacgaagcgaccucccgguuugaccccucaaaggacacauaucaauuaauguagcaaagcaagaauguccaaccggccgggucagcgucagcccauaguaaccucgggaaccccgcuucaaaaugcaucccgguuuuucccuuccccuuuccucugucaucuugacaagucgcucuaccccgacucagaucuaccccagccuaccccaacuacucuugagaaaagugucaaaagcacaggaauggaagaaagacuguccuaaccggccgcuacauucaagacgcagaaagaacacagggaaagaccaccagaucugugcuuaccgggguuuccaacgcccaaaggaaauccagccuucaaacagcucgaggagcucuuuucaggagagcugaucgcgggcagaggcagagaacacuguccccaaauagacaaaaauucccuccccggagccuggggaguccuguccuggcucgcagauuguaaguuccagugagaagugucugcc

SEQ ID NO: 11535 - RNA, 1966 nt, Mus musculus
ccucguaucucagggaaucagaaaauggguaccuguauggguggcccuggugaagcugggccccagagacccugggaccuguccaauuugagcugggaacauaaggcccaagucaaaggcagagccugacuacacccagcguauucuaggacugagguggguaggagaggccauaggggcccagggauucagcccucugcaucugccuuccacccuggccuaccuaugcguauugggcccugucacugaugggcaccuccagaagguugccacaucucugacggauucaggaaugggccuggcauaucguagguacccaaugaugggucggugagugaugaaggacugacaagagaggacuugggugauaccauuccaucccagccucuggaaccaugacgccugccgggcucugcccugggguaggguauggggaaagaaagucugcguggccggccccgcgcagcaucccugaucuaggggccuaugggauggguagggcaggggauaccugauucucaguaacucuagaggcugcggcagcuucacaugcagugcgcauuauugcucuauagucugcaucggacuaacuaagaggaaggggagcgggcagccccgggaaggguugggaagaagggugggacugcaugcagugaugucacaaaggcggcggccaauggagcggggcccuugggauagggucaccgccgaggcuuuggcauagacgggugaaaguuggcaaccgagugggaguggggccugggccuccaggaaagggccggccucgggggcagaggaagugguccuggacagccuaagccccgggcgucggcgggaaggaugaggguucggcgcccccucccugacccgagugcaauccguucauaaauaaaacguauaaauacagaaagaaagaaacccgacgcguccgcaacccccccccccagggggcuuuacccgcaaagcaaauacagagguguguagagggcaguggcacgccagccugccggcccgggcauccguccuccaacacccgaagccuggggagcgagggagggggcccggggcagggcgggaucggggucugaguaggucggauaaguucaugcgauuccgauaugcgucauuauuauucguuauggaggacagagccccggaagccgggcuggaagaauuaggauuuggcagaggaugcgaggcguggguuggagggaggcucggacugaggcccuagaaagaacccgaggaagaggguugccgccguccgcgccccuccccauccccaaaucgucuagcacucccgggagguuugcaaagccugcggaacagaacgccucuguggcccgccugauauccugcuccuccuccggccagcugcccgaguggagcugacucccuggacgccggacugaaggcuuggccuggaaggcuugggaagggguggggaagaccugagucucugcaacgcgauccaggggcgcagaggagggaggagggcgcuccuuaccucaccucacccccugucuucagagacccaacuaagagaugagguucgguucugggucuggucgacccuauugcugggagaaagccuggggcacccuggaggagaggggaggguuuucggggugggucuccccucaggacccuauugcuugaaggggcuggcaaggcuccuggcgagcggggcgggguggggccggcucccugccccuauugcugugaggaggggcccgcccuccagccccuccgcccggacgccagcggagauuucccugggggcccguauugcugagagccgaccuggcuggcggaggccccgcugcccuaggcuugaaccgggcugagcugcggcggcgcagggguugcggggccgcuagcgccgcccuugaagcaggcugacucguagugcuuguugagauaagacuugagcgcgaagcucuucuugcagcgcuugcacuggaag

SEQ ID NO: 11536 - RNA, 1966 nt, Mus musculus
cuuccagugcaagcgcugcaagaagagcuucgcgcucaagucuuaucucaacaagcacuacgagucagccugcuucaagggcggcgcuagcggccccgcaaccccugcgccgccgcagcucagcccgguucaagccuagggcagcggggccuccgccagccaggucggcucucagcaauacgggcccccagggaaaucuccgcuggcguccgggcggaggggcuggagggcgggccccuccucacagcaauaggggcagggagccggccccaccccgccccgcucgccaggagccuugccagccccuucaagcaauaggguccugaggggagacccaccccgaaaacccuccccucuccuccagggugccccaggcuuucucccagcaauagggucgaccagacccagaaccgaaccucaucucuuaguugggucucugaagacagggggugaggugagguaaggagcgcccuccucccuccucugcgccccuggaucgcguugcagagacucaggucuuccccaccccuucccaagccuuccaggccaagccuucaguccggcguccagggagucagcuccacucgggcagcuggccggaggaggagcaggauaucaggcgggccacagaggcguucuguuccgcaggcuuugcaaaccucccgggagugcuagacgauuuggggauggggaggggcgcggacggcggcaacccucuuccucggguucuuucuagggccucaguccgagccucccuccaacccacgccucgcauccucugccaaauccuaauucuuccagcccggcuuccggggcucuguccuccauaacgaauaauaaugacgcauaucggaaucgcaugaacuuauccgaccuacucagaccccgaucccgcccugccccgggcccccucccucgcuccccaggcuucggguguuggaggacggaugcccgggccggcaggcuggcgugccacugcccucuacacaccucuguauuugcuuugcggguaaagcccccuggggggggggguugcggacgcgucggguuucuuucuuucuguauuuauacguuuuauuuaugaacggauugcacucgggucagggagggggcgccgaacccucauccuucccgccgacgcccggggcuuaggcuguccaggaccacuuccucugcccccgaggccggcccuuuccuggaggcccaggccccacucccacucgguugccaacuuucacccgucuaugccaaagccucggcggugacccuaucccaagggccccgcuccauuggccgccgccuuugugacaucacugcaugcagucccacccuucuucccaacccuucccggggcugcccgcuccccuuccucuuaguuaguccgaugcagacuauagagcaauaaugcgcacugcaugugaagcugccgcagccucuagaguuacugagaaucagguauccccugcccuacccaucccauaggccccuagaucagggaugcugcgcggggccggccacgcagacuuucuuuccccauacccuaccccagggcagagcccggcaggcgucaugguuccagaggcugggauggaaugguaucacccaaguccucucuugucaguccuucaucacucaccgacccaucauuggguaccuacgauaugccaggcccauuccugaauccgucagagauguggcaaccuucuggaggugcccaucagugacagggcccaauacgcauagguaggccaggguggaaggcagaugcagagggcugaaucccugggccccuauggccucuccuacccaccucaguccuagaauacgcuggguguagucaggcucugccuuugacuugggccuuauguucccagcucaaauuggacaggucccagggucucuggggcccagcuucaccagggccacccauacagguacccauuuucugauucccugagauacgagg

SEQ ID NO: 11537 - RNA, 773 nt, Mus musculus
agcucagucugcccuggcuaggaacaccagacccuccccagagcaccugcacuggagcagguccccagcaaccccuacacacacacacacacacacacacacacacacacacacacacacacacacacacacacguuacgcaugcccgggggcaucggaugccugcguuucccaggcaaaaugcucucauugacuuaaguucccugauacuuuuagucccucugacaguccugguacaaagacgcccagugggagaggagccucggagaacugagcccggauuugagcucuugagaaaaacugauucuuuaagggauacacaaaugggacagagagaaccagagaggucaaagagcacaguaaagaucccacaggggucgccaucggcaccggcaaccacauccagcugucugcucuggagcgggccuaggaagggagaggaaaccccuggcggcgggcucaccgguacgguuagcgcggcacgggaaacgguaggugcugagcaccuccuccucguccuguucguccaggacgcggcacuggcgcagauacggcgugagcuuggccggauucagggcgcgcgucagucggugccggacgcccucgauccgcucccacagcgcguccucuucggccuccgaccccgaacccgccccagccuccucgucagccucgcccgcguccgcccggcccugcauggccgcguccuccgagccugcgggcgacaagcacggugggcacggagccgcggucaccgcaccugggcgucgccc

SEQ ID NO: 11538 - RNA, 773 nt, Mus musculus
gggcgacgcccaggugcggugaccgcggcuccgugcccaccgugcuugucgcccgcaggcucggaggacgcggccaugcagggccgggcggacgcgggcgaggcugacgaggaggcuggggcggguucggggucggaggccgaagaggacgcgcugugggagcggaucgagggcguccggcaccgacugacgcgcgcccugaauccggccaagcucacgccguaucugcgccagugccgcguccuggacgaacaggacgaggaggaggugcucagcaccuaccguuucccgugccgcgcuaaccguaccggugagcccgccgccagggguuuccucucccuuccuaggcccgcuccagagcagacagcuggaugugguugccggugccgauggcgaccccugugggaucuuuacugugcucuuugaccucucugguucucucugucccauuuguguaucccuuaaagaaucaguuuuucucaagagcucaaauccgggcucaguucuccgaggcuccucucccacugggcgucuuuguaccaggacugucagagggacuaaaaguaucagggaacuuaagucaaugagagcauuuugccugggaaacgcaggcauccgaugcccccgggcaugcguaacguguguguguguguguguguguguguguguguguguguguguguguguguguguguguagggguugcuggggaccugcuccagugcaggugcucuggggagggucugguguuccuagccagggcagacugagcu

SEQ ID NO: 11539 - RNA, 3083 nt, Mus musculus
guggcggaauaggccuguaaucccagcagucacuggaccaucauggguucuacauauuaaaccuuuauguuagguagggucacacagcaagauccggucacaaaaccagcaacaacaaaaccaaaaggagccagcuucuucccacaagcauucuuucccucaggucuucagcuccaucugacagcuacucggcuggugguccuauccuuucugagccuaguugccagagaaacaagcccgguucaucuucaugacuagcacaucuaaugauaagcacagguugacucaaggugccauagggugacacuagguacccagagcgacagaaugacaccuaugagugcacgucguuaaucacaaacacacacacacacacacacacacacacacacacacacucaugcacccaccugcaaacacaauugcagccuucuggacgucuccugucacagccccaccuccuuccugauacacugcguuaaguggugacuguaacaaaaugacuucaugcucucccuguccugagccaaauuacacaauuauuuggaaagggcucaaaauguucuucguuagaaguuucuggauacaccaauacacaggagcgugcacccucagaacacauguacacuuugacuuaaucucacgggugacacaccgacgcuuacacucccccuagcccacagaggcaaacugcugggcgcuucugaguuucucacugccaccagcucgguuugcucagccuaccccuacaccccacgcccgggaaucccugaccacagcuccacccaugcucugucuccuucuuuuccuucucuguccagccgucgggguuccugggugaggaagugucuccacggagucgcuggcuagaaccacaacuuucauccugccauucagaauagggaagagaagagaccacagcguaggggggacagaggagacggacuucgagaggacagccccaccggcgcgugugggggaggcaauccaggcugcaaacagguuguccccagcgcauugucuccgcgcccccuggcggaugcugguccccgacgggcuccggacgcgcagaagagugaggccggcgcgcgugggaggccaucccaaggggaggggucggcggccagugcagaccuggaggcgggggccaccaggcagggggcgggggugagccccgacgguuagccugucagcucuuugcucagaccggcaagagccacagcuucgcucgccacucauugucuguggcccugaccagugcgcccuggugcuuuuagugccgcccgggcccggaggggcagccucuucucacugcagucagcgccgcaacuauaagaggccuauaagaggcggugccucccgcaguggcugcuucagcccagcagccaggacagcgaaccaugcugccugcggcccgccuccagacuuauuagagccagccugggaacucgcaucacugcccucaccgcuguguccagucccaccgucgcggacagcaaccacagucgucagaaccgcagcacagaaccagcaaggccaggcaggccauggggcucugggcgcugcugcccagcuggguuucuacuacguugcuacuggcacugaccgcucugcccgcagcccuggcugccaacaguaguggccgauggugguaagugagcuaguacgggguccgccacuuguccuggggcaaagagccaggcacgggccuuacccagcucccacgcuguggggaucaccaaccuacagaccccccucgugcauugugacuucacauccagggugcucacaccuagaacuagcucugcugaagugggggcacaucauuggcaugcagaagcccagauacaccaggcucagagaccauucccauuuaauacgaccccguuucugcugagcaacaggucccaaccucgcuguggugggugcucaggugucccuuaggucuugaaccaaaaaaaaaaaaaaaaaaaaaaaaaaaaccagauauuagcuuugaggugagggaguggaauuccuaaguuuuucaaggugggcaaggcugcaggugggguuucuccucgggggcugacuugaagaaaggaagagcuaagguagccaugccuuuucuguccacucacuagacucuggagcucagggccaggcaaggauagggugguacagccuguaugguuaggaugcagguccccuccccuggacugaacccuuaugcaucccgccaggggcaucgugaacauagccuccuccacgaaccuguugacggauuccaagagucugcagcuggugcucgagcccagucugcagcugcugagccgcaagcagcggcgacugauccgacagaacccggggauccugcacagcgugaguggagggcuccagagcgcugugcgagagugcaaauggcaauuccgaaaccgccgcuggaacugccccacugcuccggggccccaccucuucggcaagaucgucaaccgaggugggugcccaggaaagcgacgcuuccgggauuaagggaaaagcagggucaucuccagggcauaggcgggcgaaggcagggaagacaucccaggguuauaugugaucaaacugagaaucgccuggugccggcaguuaccguaggucagcaccagauucuuucuagccuugcguugugagcaugaucuuuaacguugcugagccacuggcccacagaaagggaauuccggaucgugggcgcugggcgacagcuguuuuucccuagccuuccucaaagguaccugggaagcugaucucugagggcuagcuaggguugugcuucgcacccagcaaaguuugcacugccaauacuaguagcgaucuuggcuaugcagauuuguucuacuugggaaucuccccuuggagcugcucugcuaaggcucuggagucucaguaaagcuuagagaggagggcauuccaugcuucgcacacaugacuccaaggauguuggacuguaggguaccaagucuuccaaacagggugcugaguuggccccacgccuucucucaacugaugcggggucgcuucacccacaggcugccgagaaacagcguucaucuucgcaauca

SEQ ID NO: 11540 - RNA, 3083 nt, Mus musculus
ugauugcgaagaugaacgcuguuucucggcagccugugggugaagcgaccccgcaucaguugagagaaggcguggggccaacucagcacccuguuuggaagacuugguacccuacaguccaacauccuuggagucaugugugcgaagcauggaaugcccuccucucuaagcuuuacugagacuccagagccuuagcagagcagcuccaaggggagauucccaaguagaacaaaucugcauagccaagaucgcuacuaguauuggcagugcaaacuuugcugggugcgaagcacaacccuagcuagcccucagagaucagcuucccagguaccuuugaggaaggcuagggaaaaacagcugucgcccagcgcccacgauccggaauucccuuucugugggccaguggcucagcaacguuaaagaucaugcucacaacgcaaggcuagaaagaaucuggugcugaccuacgguaacugccggcaccaggcgauucucaguuugaucacauauaacccugggaugucuucccugccuucgcccgccuaugcccuggagaugacccugcuuuucccuuaaucccggaagcgucgcuuuccugggcacccaccucgguugacgaucuugccgaagagguggggccccggagcaguggggcaguuccagcggcgguuucggaauugccauuugcacucucgcacagcgcucuggagcccuccacucacgcugugcaggauccccggguucugucggaucagucgccgcugcuugcggcucagcagcugcagacugggcucgagcaccagcugcagacucuuggaauccgucaacagguucguggaggaggcuauguucacgaugccccuggcgggaugcauaaggguucaguccaggggaggggaccugcauccuaaccauacaggcuguaccacccuauccuugccuggcccugagcuccagagucuagugaguggacagaaaaggcauggcuaccuuagcucuuccuuucuucaagucagcccccgaggagaaaccccaccugcagccuugcccaccuugaaaaacuuaggaauuccacucccucaccucaaagcuaauaucugguuuuuuuuuuuuuuuuuuuuuuuuuuuugguucaagaccuaagggacaccugagcacccaccacagcgagguugggaccuguugcucagcagaaacggggucguauuaaaugggaauggucucugagccugguguaucugggcuucugcaugccaaugaugugcccccacuucagcagagcuaguucuaggugugagcacccuggaugugaagucacaaugcacgaggggggucuguagguuggugauccccacagcgugggagcuggguaaggcccgugccuggcucuuugccccaggacaaguggcggaccccguacuagcucacuuaccaccaucggccacuacuguuggcagccagggcugcgggcagagcggucagugccaguagcaacguaguagaaacccagcugggcagcagcgcccagagccccauggccugccuggccuugcugguucugugcugcgguucugacgacugugguugcuguccgcgacggugggacuggacacagcggugagggcagugaugcgaguucccaggcuggcucuaauaagucuggaggcgggccgcaggcagcaugguucgcuguccuggcugcugggcugaagcagccacugcgggaggcaccgccucuuauaggccucuuauaguugcggcgcugacugcagugagaagaggcugccccuccgggcccgggcggcacuaaaagcaccagggcgcacuggucagggccacagacaaugaguggcgagcgaagcuguggcucuugccggucugagcaaagagcugacaggcuaaccgucggggcucacccccgcccccugccugguggcccccgccuccaggucugcacuggccgccgaccccuccccuugggauggccucccacgcgcgccggccucacucuucugcgcguccggagcccgucggggaccagcauccgccagggggcgcggagacaaugcgcuggggacaaccuguuugcagccuggauugccucccccacacgcgccgguggggcuguccucucgaaguccgucuccucuguccccccuacgcuguggucucuucucuucccuauucugaauggcaggaugaaaguugugguucuagccagcgacuccguggagacacuuccucacccaggaaccccgacggcuggacagagaaggaaaagaaggagacagagcauggguggagcuguggucagggauucccgggcgugggguguagggguaggcugagcaaaccgagcugguggcagugagaaacucagaagcgcccagcaguuugccucugugggcuagggggaguguaagcgucggugugucacccgugagauuaagucaaaguguacauguguucugagggugcacgcuccuguguauugguguauccagaaacuucuaacgaagaacauuuugagcccuuuccaaauaauuguguaauuuggcucaggacagggagagcaugaagucauuuuguuacagucaccacuuaacgcaguguaucaggaaggagguggggcugugacaggagacguccagaaggcugcaauuguguuugcaggugggugcaugaguguguguguguguguguguguguguguguguguguguuugugauuaacgacgugcacucauaggugucauucugucgcucuggguaccuagugucacccuauggcaccuugagucaaccugugcuuaucauuagaugugcuagucaugaagaugaaccgggcuuguuucucuggcaacuaggcucagaaaggauaggaccaccagccgaguagcugucagauggagcugaagaccugagggaaagaaugcuugugggaagaagcuggcuccuuuugguuuuguuguugcugguuuugugaccggaucuugcugugugacccuaccuaacauaaagguuuaauauguagaacccaugaugguccagugacugcugggauuacaggccuauuccgccac

SEQ ID NO: 11541 - RNA, 771 nt, Mus musculus
gcugcuuaagaaauccacugauauacaaauggggucuggguggccaaggguauuuauauaugugcaugugugugggucacaugaaggugggaagcaggaauaagagcaggugagugaauguguacaaacagguaagugcucgugugagggucaggcuucagggauguguagguguaugugauguguggauggcugaguggcaagguaagacuccggucugaaugugccuguaucuccacacaggcaaaugcuugaaucagucaagugugacugugacucggaguguguguguguguguguguguguguguguacacgugugcaugugccaucagaggaagcagcagcagcaagaagcaggagcuucgauccgaaggagacaacguggggagggggacgcugggggcagacacccuccuuccugcgcgcacacgugcgcgugcacacacacacaccccauagucacacacgcacacacacgcgcacacacacacaagccacagggccucgcaagcagagagcggagccggcuccgggauccgaacgaggcagcucugcugagagcggcgggaggaggcgagccagcggggggagcccucgguuccgcucccgggccgggggccccccgcgcacaccggcccagagacacccucgcagacacucguaggcgcgcacgcgcacccuuuccccuccuccuccccucccgccgccucccggccggacgauggaucccugcagaucccggggcugagagcaccgcgcagcgccagcg

SEQ ID NO: 11542 - RNA, 771 nt, Mus musculus
cgcuggcgcugcgcggugcucucagccccgggaucugcagggauccaucguccggccgggaggcggcgggaggggaggaggaggggaaagggugcgcgugcgcgccuacgagugucugcgagggugucucugggccggugugcgcggggggcccccggcccgggagcggaaccgagggcuccccccgcuggcucgccuccucccgccgcucucagcagagcugccucguucggaucccggagccggcuccgcucucugcuugcgaggcccuguggcuugugugugugugcgcgugugugugcgugugugacuauggggugugugugugugcacgcgcacgugugcgcgcaggaaggagggugucugcccccagcgucccccuccccacguugucuccuucggaucgaagcuccugcuucuugcugcugcugcuuccucugauggcacaugcacacguguacacacacacacacacacacacacacacacuccgagucacagucacacuugacugauucaagcauuugccuguguggagauacaggcacauucagaccggagucuuaccuugccacucagccauccacacaucacauacaccuacacaucccugaagccugacccucacacgagcacuuaccuguuuguacacauucacucaccugcucuuauuccugcuucccaccuucaugugacccacacacaugcacauauauaaauacccuuggccacccagaccccauuuguauaucaguggauuucuuaagcagc

SEQ ID NO: 11543 - RNA, 475 nt, Mus musculus
ucuccacccccauacuaucccuucucgggucaccuuuaucaccgucccccaccccaauauucucacacuaucuacagguuccucaucuuccugcacauacacucaugcuaacuggauuucacgguucaccuucucuguccuccccuuuacuccucccuacuccacaaucccuuuagccagauguacagcucccaaauuccgggcgagauucccaggaacaaagcaagaaaaaaacaucagaacaauuugggaaguaaacagcggcggagaagaagggagggaaaagccggguggacccagguggguggcccuccaguccacccaguuaagggacugccuuuuuccccucccccuucaccuggcuuuuaaggggccgggcccagaccucugcuucuuaaagaggagcccgcagcagcagcugcacuggacucucuggaaggaguguacagggcaaaaacucugaccaugaccuggg

SEQ ID NO: 11544 - RNA, 475 nt, Mus musculus
cccaggucauggucagaguuuuugcccuguacacuccuuccagagaguccagugcagcugcugcugcgggcuccucuuuaagaagcagaggucugggcccggccccuuaaaagccaggugaagggggaggggaaaaaggcagucccuuaacuggguggacuggagggccacccaccuggguccacccggcuuuucccucccuucuucuccgccgcuguuuacuucccaaauuguucugauguuuuuuucuugcuuuguuccugggaaucucgcccggaauuugggagcuguacaucuggcuaaagggauuguggaguagggaggaguaaaggggaggacagagaaggugaaccgugaaauccaguuagcaugaguguaugugcaggaagaugaggaaccuguagauagugugagaauauuggggugggggacggugauaaaggugacccgagaagggauaguauggggguggaga

SEQ ID NO: 11545 - RNA, 6197 nt, Mus musculus
cccugaguauaaaugcaacucgccugcaaaaaaaaaaaaaaaggcaaagaccucagacucuucuuccaagggaccuaugguucgugcuucgaggaugcuuccaccuaaagcaugaaauggggugauggguuuugggguguugugugugcccucauagauggggugguaguguggccggugugugugucaacucuucagucacccaugcacucacauacagcauucuguucuccaugcaaaguugaggucaaaugcacccgauuagaggggaaagaaagggggauaaucaaacagagagggucuguaaccuuguagagcacaguuagcauugcuccuuccuugcugcauuuccccccuuagaauaauagguagucuugaaaguucagcuaguauuuguguguuugucauaguacccagugucuagacuaaacccucccucucucugucuuucccucccaauggcucugagaauaugcuugaaguauuuguacugcuuucugcuuuucucccacccuucccaacacacuauaucucucucaucucagaaauuccauccagaagaacaaaaaaaaaauuaaaaauagagcauagcaaaguaaaaacaacccccccuccaaguuguccugcuccugucugggaguuguguuauuuaaagauauucuguauguuguaucuuuugcauguagcuuccuuaauggagaaaaaaaauccuaauaaauuuccggaaucuuaauccucaaauggauggguuuuuuuuuuguuuuguuuuuaguggcgcuuuuuuuuuuagcggcacccccucccccaaaacacugaguguguggauauguguguguuuuguguuugacucaucuccuacagccuuuccagaaugucucuuggcggguuuaauguaagugagagaccauaacguugauuuaaauauuauccaggugaccacaauaagucaaggucauaaaacaguaaugucaggacggucuuggugcgcgcgagagguggauuuuaugaucugcaaauauaaugugguacugcaguaaaagaugcauuuaaaggugacuggaggagggaaagaggcagagagcaaacugcaaucuugaggagcagacggaucugauugccuucgguacuggggcuggaugcaccccaccacugcuggggggguaccucaggaacccccacccaucuaaacagaggaauaaacuuaacugccggaggggcacgaggaguuaagcccccgcccucgacagcagcuuacagaagcgccagcggcagcaagagaaggaggaggcagcgacaagguaagagaaucgguuucuuguucuucucuuggcggucgacugaggacuagcagcguucccaggugcccggagagcagcgcguagagcacggaggaagguguuuugggcgucuguguuuucugagagacccggauuuuccuuguggccgccagcaguggagggcagcggcuaugagcucccucuccuccccucccugguccacuaccgccgugggguucggugguuaaaggggguaaauuggugguuuuggcuucuuuaucuuugauggcacuuaggggcgucuagagauccacccaucagcuuaggugucucugucugguuguaagguagaaggguuggagcuugaagcuuggguuuucuugcguuuugcuggugugggugugagccuuguccauguucuuggucuucguguucccaagcuguagggauuugccagacaaguggcccgacuguaaguggcuccugagcacaggcgcuguggucuagacacccauguuuguugagaauccuuagacacugagucugggagaagaguagaggagagccagauggauaagacaggggacccagcucaagaguggaagaacgauccagcuccccccagggccagggccagaugcagggggauagcucuacugcaguacuggggguggggcagggauuuggcggcuagagguuccuuuucaccagauuuucccaaugcaacuugcuuauaccagaaacuaacgggagacuaucagacccucaacccacccagccacccaaaguccacucucuaguccucagggagguuguagggcugaagggggaccgggcugaauuucuuccuuccccaagccccuucccuucuucuuuggauagaugcaaagcccuaaacuccggcccugcuugcucagcugaucuguggcuuagguaguuucauguuguugggauugaguuuugaacucggcaacaagaaacugccugaguuacaucagucgguuuucgucgagggccccaauccaccuccccuaacccuuccuucccuugugggacugccccaccacccaucccagaaagggcaaaauaggugcagacugaggaggucaggcugugaguggggccaugggacaaauucuggacagcccugcuuuacaaccaucucccccucagccugucccaaucuuuggaauggagggaaaggguuucuccccccuccucacucccguagcuauugucuccugugcccagcugauaaagacagacaaagaagguccagccaauuccaaggaaaugcaggaguuugaguuuggccuguugggccagcuuaguugaggaacaggguggggcagucaugaaaggacagaaaagcuccuagaaagaggagggaaucucugaagucucucccuguuaccucuaaggagagagcagugcuccuuuggaaagugaggguguugguguucaaagaguuagggaacucugagaacaguagccucuucuucccuccauagcuccaucuccagggaaaggauggauauaggaagugaguacauuaguggagaaacaccaaguccaagucgaaaccuccuucaacacacccuguugagggcaaaagcccagcucuggucugucuugucuguuauccguaggccuuggucuguauauuugccugucugagacugcuaggcauuugccuguccuuguguucuguggaaaugucuggguaaacagacgcugccagcgcccaccguuaccauauuguugagaaggcuguuggcugaugguagggggcggaggggagaagaaugggacagagggagaucugagcaaugagaaacuuuacagaccuccuccacucuguucccuucggcuuucuuaauucuggacuugguuugucaagugaggaucucagaaaagguuuucuggucuucagaggaaaaaauggggggaugaucagggaaaaggggaaacaggcauaggaucuguucucagagacucugaaaaggagaaaccuaaaggaggccagauucuuggggcucuuuuguaauuaugauuaugaaagcagggaauacaaccaugucucuuaacaaauuaucaugaaaaauuuuguauucucaacauggugucuuagaagaaaagaaugugacuuuaaauucaugacaaguguauaggucucuguuucuaucuguccuuucuagguuuuuugaaaucucucucucucucucucucucucucucucucucucucugugugugugugugugugugugugugugugugugugugugugugugugugugugugugugaaauucauuuugacuucuguggauauuggaaaagaagaugugaauagaccccccccuucccagcugaauugucgguccuagcuguucuccaucccuuugugugaagaaaaguauuuaaaucucuauggcucccagggaaaugaggagguuuccagaaagacgggccaguuggugaaggaagauauguauaagggaauccccugguuugggagcccauauagucucuaacuucagagucucugaggcacacagccaguuuggguaaggggagccucaggcuggagcaagguguucaagagcucuuggcuuagagaaauggcccugaugaaccgaaauuuaucaauacagggcuucugugccuugagucacuuugccccuauuuccauuucaaagaugauggauuuaaaggagguggccacagagucaggggucagggcagucuucucccuagaucuggagaaguggagcaaggucucauagggccaaggugaggaccagucugauggucagaguccacccugggggcccugggacuguggaucauggcuaaggcgaugguaauuauuuauucgcuucgcuggaagggaguguucagaaggaacagcgugaaaaggagggaaaaaauuaucucucucaucugaggauauuaagauggauuuuuauuucuuaaaggacccuccccgccgagagcacauaagcguaaacuuaauauaugcuccgcagcccaacucuagaaaucgcaauaaaaguuaaaaccuccccuacugguuuuuuuuaauuaugauauggggaaggggagcaggauuuauagagcugaacucucggcgcguguuugagacuugcgggagaaggaggaaaaggcaagagcucgccaaggagagcccugaucucugagaugucucgccggcagugggggcuuaggcucagcccagcuaauccgcuguggucucucugggaccucaccccagcagucggccuugcuucggcucacuugcuggaagaugcagcccuucuugagaacaggugacgugaaggcggcaaacggggauaggggaaguauaaaugggaagacuagcgcacagagcuuuguguggguccuugcuggggacgagguuagcccaaguguagcucagcggauggcuggacuccgaaggguguccgggcagggcacaagagcagggacaagguggauugugugugaacaucgaccacagacugaguagaguggacuccuggucuguggucagcggcgagccaggcaaccggauguugagucuguaggaaggaccuugaggucuguuggguguuugggcugccgggggcgcggcaaccagggguauugagggaguguguugugcgcggggcgcggcggucagcuugggcgaggcuguaggccccgcacaucucugcggcugaugggcuguguccgggaagacuaaacuagggucgaaccaaugauuagagcaugaaaauaaaugcaguuauguguucccaccuccccguauacgcaguucuuuuuuucuuuucuuucuuucuuuucuuuuuuuuuuccuuucggagauaccuggauaugguccagagcagguuguccgcgggagggccccgcgagcggcagcgugcgagggagggagggagggcgaaggagggagggagggaaggagggcggguggcggcggcugcgguggccagggcuucccucccugggcgggaggcugcugcccugccucuguggccguggggagccaagaagcagguaaaggaggcuuucugaggcgguauugcaccaagcccaagguaccaagucuuccgggccucugcuuaagguucuggcgggagagaagguagggagaucggcgcccaccaggccuggaaaggaggccucgggauguucaaccuguguaugauuucagucucacacucauguuguggucugucugcauugggagacgccgcuugccugucugucugagacuucccaaacccgggcacuccuuccaaaggcucagaaaaauucgucgucggaauguguacuuucauucauuggauucucugaaacucggcagggcuggcuacgacaacccagguugggagggagcauucuuccucuuuucuggauguguaguccuuuggcuccuuggucacaggcugaguuuuccgguucuagguucgcgggucgcccugauguuugaagcuagacagcuccagucgguuagggagggcggggagggacccgcggcuguggcuccuuaauuguacuucgagcccuuauugucucuccuuucgccaccuccgcuuccucagucugggcuccaaagucacugcaaauuuccuugcgauacauacaucacacaaaagaucagguaacaacgcgcucagagccauugaaucagagcacagggcaacccugguucuggggaggcuaccucuccagucacuccccaggcuggaaaaacagacuguguugggggagccggaaauaaccccguuugcugcggagcggcagggcgggggcgccggcgcaaaggcaggccgggcaggccauggcguugagagggccacguucacaggcccuggggguuucacgcuugcggagcuugggggccuggcucuugg

SEQ ID NO: 11546 - RNA, 6197 nt, Mus musculus
ccaagagccaggcccccaagcuccgcaagcgugaaacccccagggccugugaacguggcccucucaacgccauggccugcccggccugccuuugcgccggcgcccccgcccugccgcuccgcagcaaacgggguuauuuccggcucccccaacacagucuguuuuuccagccuggggagugacuggagagguagccuccccagaaccaggguugcccugugcucugauucaauggcucugagcgcguuguuaccugaucuuuugugugauguauguaucgcaaggaaauuugcagugacuuuggagcccagacugaggaagcggagguggcgaaaggagagacaauaagggcucgaaguacaauuaaggagccacagccgcgggucccuccccgcccucccuaaccgacuggagcugucuagcuucaaacaucagggcgacccgcgaaccuagaaccggaaaacucagccugugaccaaggagccaaaggacuacacauccagaaaagaggaagaaugcucccucccaaccuggguugucguagccagcccugccgaguuucagagaauccaaugaaugaaaguacacauuccgacgacgaauuuuucugagccuuuggaaggagugcccggguuugggaagucucagacagacaggcaagcggcgucucccaaugcagacagaccacaacaugagugugagacugaaaucauacacagguugaacaucccgaggccuccuuuccaggccuggugggcgccgaucucccuaccuucucucccgccagaaccuuaagcagaggcccggaagacuugguaccuugggcuuggugcaauaccgccucagaaagccuccuuuaccugcuucuuggcuccccacggccacagaggcagggcagcagccucccgcccagggagggaagcccuggccaccgcagccgccgccacccgcccuccuucccucccucccuccuucgcccucccucccucccucgcacgcugccgcucgcggggcccucccgcggacaaccugcucuggaccauauccagguaucuccgaaaggaaaaaaaaaagaaaagaaagaaagaaaagaaaaaaagaacugcguauacggggaggugggaacacauaacugcauuuauuuucaugcucuaaucauugguucgacccuaguuuagucuucccggacacagcccaucagccgcagagaugugcggggccuacagccucgcccaagcugaccgccgcgccccgcgcacaacacacucccucaauaccccugguugccgcgcccccggcagcccaaacacccaacagaccucaagguccuuccuacagacucaacauccgguugccuggcucgccgcugaccacagaccaggaguccacucuacucagucuguggucgauguucacacacaauccaccuugucccugcucuugugcccugcccggacacccuucggaguccagccauccgcugagcuacacuugggcuaaccucguccccagcaaggacccacacaaagcucugugcgcuagucuucccauuuauacuuccccuauccccguuugccgccuucacgucaccuguucucaagaagggcugcaucuuccagcaagugagccgaagcaaggccgacugcuggggugaggucccagagagaccacagcggauuagcugggcugagccuaagcccccacugccggcgagacaucucagagaucagggcucuccuuggcgagcucuugccuuuuccuccuucucccgcaagucucaaacacgcgccgagaguucagcucuauaaauccugcuccccuuccccauaucauaauuaaaaaaaaccaguaggggagguuuuaacuuuuauugcgauuucuagaguugggcugcggagcauauauuaaguuuacgcuuaugugcucucggcggggaggguccuuuaagaaauaaaaauccaucuuaauauccucagaugagagagauaauuuuuucccuccuuuucacgcuguuccuucugaacacucccuuccagcgaagcgaauaaauaauuaccaucgccuuagccaugauccacagucccagggcccccaggguggacucugaccaucagacugguccucaccuuggcccuaugagaccuugcuccacuucuccagaucuagggagaagacugcccugaccccugacucuguggccaccuccuuuaaauccaucaucuuugaaauggaaauaggggcaaagugacucaaggcacagaagcccuguauugauaaauuucgguucaucagggccauuucucuaagccaagagcucuugaacaccuugcuccagccugaggcuccccuuacccaaacuggcugugugccucagagacucugaaguuagagacuauaugggcucccaaaccaggggauucccuuauacauaucuuccuucaccaacuggcccgucuuucuggaaaccuccucauuucccugggagccauagagauuuaaauacuuuucuucacacaaagggauggagaacagcuaggaccgacaauucagcugggaaggggggggucuauucacaucuucuuuuccaauauccacagaagucaaaaugaauuucacacacacacacacacacacacacacacacacacacacacacacacacacacacacacagagagagagagagagagagagagagagagagagagagauuucaaaaaaccuagaaaggacagauagaaacagagaccuauacacuugucaugaauuuaaagucacauucuuuucuucuaagacaccauguugagaauacaaaauuuuucaugauaauuuguuaagagacaugguuguauucccugcuuucauaaucauaauuacaaaagagccccaagaaucuggccuccuuuagguuucuccuuuucagagucucugagaacagauccuaugccuguuuccccuuuucccugaucauccccccauuuuuuccucugaagaccagaaaaccuuuucugagauccucacuugacaaaccaaguccagaauuaagaaagccgaagggaacagaguggaggaggucuguaaaguuucucauugcucagaucucccucugucccauucuucuccccuccgcccccuaccaucagccaacagccuucucaacaauaugguaacggugggcgcuggcagcgucuguuuacccagacauuuccacagaacacaaggacaggcaaaugccuagcagucucagacaggcaaauauacagaccaaggccuacggauaacagacaagacagaccagagcugggcuuuugcccucaacaggguguguugaaggagguuucgacuuggacuugguguuucuccacuaauguacucacuuccuauauccauccuuucccuggagauggagcuauggagggaagaagaggcuacuguucucagaguucccuaacucuuugaacaccaacacccucacuuuccaaaggagcacugcucucuccuuagagguaacagggagagacuucagagauucccuccucuuucuaggagcuuuucuguccuuucaugacugccccacccuguuccucaacuaagcuggcccaacaggccaaacucaaacuccugcauuuccuuggaauuggcuggaccuucuuugucugucuuuaucagcugggcacaggagacaauagcuacgggagugaggaggggggagaaacccuuucccuccauuccaaagauugggacaggcugagggggagaugguuguaaagcagggcuguccagaauuugucccauggccccacucacagccugaccuccucagucugcaccuauuuugcccuuucugggaugggugguggggcagucccacaagggaaggaaggguuaggggagguggauuggggcccucgacgaaaaccgacugauguaacucaggcaguuucuuguugccgaguucaaaacucaaucccaacaacaugaaacuaccuaagccacagaucagcugagcaagcagggccggaguuuagggcuuugcaucuauccaaagaagaagggaaggggcuuggggaaggaagaaauucagcccggucccccuucagcccuacaaccucccugaggacuagagaguggacuuuggguggcuggguggguugagggucugauagucucccguuaguuucugguauaagcaaguugcauugggaaaaucuggugaaaaggaaccucuagccgccaaaucccugccccacccccaguacugcaguagagcuaucccccugcaucuggcccuggcccuggggggagcuggaucguucuuccacucuugagcuggguccccugucuuauccaucuggcucuccucuacucuucucccagacucagugucuaaggauucucaacaaacaugggugucuagaccacagcgccugugcucaggagccacuuacagucgggccacuugucuggcaaaucccuacagcuugggaacacgaagaccaagaacauggacaaggcucacacccacaccagcaaaacgcaagaaaacccaagcuucaagcuccaacccuucuaccuuacaaccagacagagacaccuaagcugauggguggaucucuagacgccccuaagugccaucaaagauaaagaagccaaaaccaccaauuuacccccuuuaaccaccgaaccccacggcgguaguggaccagggaggggaggagagggagcucauagccgcugcccuccacugcuggcggccacaaggaaaauccgggucucucagaaaacacagacgcccaaaacaccuuccuccgugcucuacgcgcugcucuccgggcaccugggaacgcugcuaguccucagucgaccgccaagagaagaacaagaaaccgauucucuuaccuugucgcugccuccuccuucucuugcugccgcuggcgcuucuguaagcugcugucgagggcgggggcuuaacuccucgugccccuccggcaguuaaguuuauuccucuguuuagauggguggggguuccugagguacccccccagcagugguggggugcauccagccccaguaccgaaggcaaucagauccgucugcuccucaagauugcaguuugcucucugccucuuucccuccuccagucaccuuuaaaugcaucuuuuacugcaguaccacauuauauuugcagaucauaaaauccaccucucgcgcgcaccaagaccguccugacauuacuguuuuaugaccuugacuuauuguggucaccuggauaauauuuaaaucaacguuauggucucucacuuacauuaaacccgccaagagacauucuggaaaggcuguaggagaugagucaaacacaaaacacacacauauccacacacucaguguuuugggggagggggugccgcuaaaaaaaaaagcgccacuaaaaacaaaacaaaaaaaaaacccauccauuugaggauuaagauuccggaaauuuauuaggauuuuuuuucuccauuaaggaagcuacaugcaaaagauacaacauacagaauaucuuuaaauaacacaacucccagacaggagcaggacaacuuggaggggggguuguuuuuacuuugcuaugcucuauuuuuaauuuuuuuuuuguucuucuggauggaauuucugagaugagagagauauaguguguugggaagggugggagaaaagcagaaagcaguacaaauacuucaagcauauucucagagccauugggagggaaagacagagagagggaggguuuagucuagacacuggguacuaugacaaacacacaaauacuagcugaacuuucaagacuaccuauuauucuaaggggggaaaugcagcaaggaaggagcaaugcuaacugugcucuacaagguuacagacccucucuguuugauuaucccccuuucuuuccccucuaaucgggugcauuugaccucaacuuugcauggagaacagaaugcuguaugugagugcaugggugacugaagaguugacacacacaccggccacacuaccaccccaucuaugagggcacacacaacaccccaaaacccaucaccccauuucaugcuuuagguggaagcauccucgaagcacgaaccauaggucccuuggaagaagagucugaggucuuugccuuuuuuuuuuuuuuugcaggcgaguugcauuuauacucaggg

SEQ ID NO: 11547 - RNA, 1588 nt, Mus musculus
guaaauggggaucaggaauauauauaacaaggaaagaaucuucagauaugagagagagagagagagagagagagagagagagagagagagagagagagagagagagagagagaauucugaguguugcauagaauggggggguugcugacuagguaaagaggugggggcagguguaagcugcagggucaaagaaagggggagaggaagaaggagaaacagcaggggagggguacagucccuuggaugagaggaagugucugggggauccccgggaggagacuucaggaaaucuuuuccucuagcucuauaaggggccagggccuaauuauaccccucugaagccuucccucccugcucucagcuacucccauaaaccugaaauuggaggguugucuccugcagagcuguccuggggcuggcuggaggaggggggcacuggaguccaacauaugagggagccuuucuccaaggccagcagcucugugaggagaggggaagauuuuccccauccugauaacuucacccuaauaauucgccucagcaggguugaauucugagccggagauggguacuggaaagaagugaggguucagggacucucaggacuuggucgugucugugaggaugggagggggcagaggaggagggagguggggaggagagggaccuugcuauaaaaauaaaaaacaagagagggaagcguuuaugggccuaugaaaugguugggaauuuggacuuuuuaugaggauauucucgaauuacuacucuugaagcuaaggaccagacugugggagcuuugguagcuuaaauuuuacuacaguuuuaggugcuggaagcugaacagggaggggauauagggagggggcuggaugcaaaagagaaaggaggagaugccuaaagcaaaauguguccaaauucagguucaauuauugaguuuggggagcuugacuaaaccuagggugggaugacagagguccugagcuggaagggaacuuuacugacccuugcccguguuugucccuccaggcaaccccguggccaacuggauccacgcccguuccacaaggaagaagcgcugccccuacaccaaguaccagacgcuggaacuggagaaggaguuucucuucaauauguauuuaaccagggaccgucgguacgagguggcccguguucucaaucucacugagcggcaggucaaaaucugguuucagaaccggaggaugaagaugaaaaagaugaauaaagagaaaaccgacaaggaacaauccuaagcccugccccagccugcugccucggcacagccaagggaaacacaaaaacccccacaaaaaaugccccaacccaggcgggagaaagcacgaaaagaaaaggaaagaacaagauagagaaaagcccaccgucuuaaaaagaaaagaaaaaaaaggaaggggaaaaaugcaaacucuugcgaugugggaggguuaaguguugagaaauugguguuuagaguuaguucuauccaucgaggaggaggcaggagagaaacugcguucucuuccccagcgcaacugaaauaaaugacacacacaaaugugaauuuuuuuccuuc

SEQ ID NO: 11548 - RNA, 1588 nt, Mus musculus
gaaggaaaaaaauucacauuugugugugucauuuauuucaguugcgcuggggaagagaacgcaguuucucuccugccuccuccucgauggauagaacuaacucuaaacaccaauuucucaacacuuaacccucccacaucgcaagaguuugcauuuuuccccuuccuuuuuuuucuuuucuuuuuaagacggugggcuuuucucuaucuuguucuuuccuuuucuuuucgugcuuucucccgccuggguuggggcauuuuuuguggggguuuuuguguuucccuuggcugugccgaggcagcaggcuggggcagggcuuaggauuguuccuugucgguuuucucuuuauucaucuuuuucaucuucauccuccgguucugaaaccagauuuugaccugccgcucagugagauugagaacacgggccaccucguaccgacggucccugguuaaauacauauugaagagaaacuccuucuccaguuccagcgucugguacuugguguaggggcagcgcuucuuccuuguggaacgggcguggauccaguuggccacgggguugccuggagggacaaacacgggcaagggucaguaaaguucccuuccagcucaggaccucugucaucccacccuagguuuagucaagcuccccaaacucaauaauugaaccugaauuuggacacauuuugcuuuaggcaucuccuccuuucucuuuugcauccagcccccucccuauauccccucccuguucagcuuccagcaccuaaaacuguaguaaaauuuaagcuaccaaagcucccacagucugguccuuagcuucaagaguaguaauucgagaauauccucauaaaaaguccaaauucccaaccauuucauaggcccauaaacgcuucccucucuuguuuuuuauuuuuauagcaaggucccucuccuccccaccucccuccuccucugcccccucccauccucacagacacgaccaaguccugagagucccugaacccucacuucuuuccaguacccaucuccggcucagaauucaacccugcugaggcgaauuauuagggugaaguuaucaggauggggaaaaucuuccccucuccucacagagcugcuggccuuggagaaaggcucccucauauguuggacuccagugccccccuccuccagccagccccaggacagcucugcaggagacaacccuccaauuucagguuuaugggaguagcugagagcagggagggaaggcuucagagggguauaauuaggcccuggccccuuauagagcuagaggaaaagauuuccugaagucuccucccggggaucccccagacacuuccucucauccaagggacuguaccccuccccugcuguuucuccuucuuccucucccccuuucuuugacccugcagcuuacaccugcccccaccucuuuaccuagucagcaacccccccauucuaugcaacacucagaauucucucucucucucucucucucucucucucucucucucucucucucucucucucucucucucucauaucugaagauucuuuccuuguuauauauauuccugauccccauuuac

SEQ ID NO: 11549 - RNA, 1195 nt, Mus musculus
cgggaaggucuaugccuuggacgagacguggcacccggaccugggggagccuuuuggggugaugcgcugcgugcugugcgccugugaagcggugaguggauaacgcagcugccugcccuacucuagaggguagcggaacgcugguguccuaaguaguagacucggagaugcucaggggaaggcugguccgcaaaucggaggaaaccgcuuucaagucugcgguguugacaguuauugaucgcccacaaugugacuggcuuuuagccaacuuccccccucccguuacaguauugcuagauaaaugacauuauuaguucuacuuugcagacagggacgccgaggcucagagaaguuaagaaacuuuggacgggccauguaacuuguaaauagcagaauugacugucugcagcccuggggucugaugguuucauucccuuaauuuuccuauguucucugccaucagccucagugggcucgccgugggagggguccuggcagggucagcugcaagaacaucaaaccucagugccccacccuggccugcaggcagccgcgccagcugccaggacacugcugccagaccugcccgcagggugaggcccgcugugcccggaguuaggaggguggaaggcucuacacuagguccuguacgacuugcaucgcggaggaggacugguccuccugguaccuuucugaagccagccgucuuauuccuuaccccggaugcagagcgcagcaaucuagauccacagcccgcuggccuggucuucgaguauccaagggauccagagcaucgcaguuacagugaucgaggggaacccggcguuggggagcggacccgugcugauggccacacagguaggcugggguggaggugggccugaugaaguuugagucccgcggcaaggcuugacagugcucaggccaucuucucuucucgaagacuuuguggcgcugcugacaggaccgaggucgcaggcgguagcucgugcucgagucucuuugcugcgcucaaguuuacgcuucucugucuccuaccagcggugagaccgggaaaagggcaaggacuaggaguaguaaagggggcaauaaagaggagccuguaggcuauagauccagucucacuggaccucucuucacaggcuggaccgucccagcaggguucguuucacagaucccacaggcaacauccugu

SEQ ID NO: 11550 - RNA, 1195 nt, Mus musculus
acaggauguugccugugggaucugugaaacgaacccugcugggacgguccagccugugaagagagguccagugagacuggaucuauagccuacaggcuccucuuuauugcccccuuuacuacuccuaguccuugcccuuuucccggucucaccgcugguaggagacagagaagcguaaacuugagcgcagcaaagagacucgagcacgagcuaccgccugcgaccucgguccugucagcagcgccacaaagucuucgagaagagaagauggccugagcacugucaagccuugccgcgggacucaaacuucaucaggcccaccuccaccccagccuaccuguguggccaucagcacggguccgcuccccaacgccggguuccccucgaucacuguaacugcgaugcucuggaucccuuggauacucgaagaccaggccagcgggcuguggaucuagauugcugcgcucugcauccgggguaaggaauaagacggcuggcuucagaaagguaccaggaggaccaguccuccuccgcgaugcaagucguacaggaccuaguguagagccuuccacccuccuaacuccgggcacagcgggccucacccugcgggcaggucuggcagcaguguccuggcagcuggcgcggcugccugcaggccaggguggggcacugagguuugauguucuugcagcugacccugccaggaccccucccacggcgagcccacugaggcugauggcagagaacauaggaaaauuaagggaaugaaaccaucagaccccagggcugcagacagucaauucugcuauuuacaaguuacauggcccguccaaaguuucuuaacuucucugagccucggcgucccugucugcaaaguagaacuaauaaugucauuuaucuagcaauacuguaacgggaggggggaaguuggcuaaaagccagucacauugugggcgaucaauaacugucaacaccgcagacuugaaagcgguuuccuccgauuugcggaccagccuuccccugagcaucuccgagucuacuacuuaggacaccagcguuccgcuacccucuagaguagggcaggcagcugcguuauccacucaccgcuucacaggcgcacagcacgcagcgcaucaccccaaaaggcucccccagguccgggugccacgucucguccaaggcauagaccuucccg

SEQ ID NO: 11551 - RNA, 527 nt, Mus musculus
augcacuuaagaaagauguaagugagcaaugcuuuuuuuuauuuuuaauuacgaauggaauggcauuucccaggcacaaagaacuaagcucuuagccugcugcauguggaucuuaccccgccagcacuacguucccacuggcgggagagaggccgccgggcccugggaugugggacaugcgggcggggaccuucagaacucggaggcagcugacaaggaggacugacuuucaucccuuguuuuuucugcgcagagcucccggcauuccaagcuagagaaggcagacauucuggaaaugacugugaagcaccuccggaaccugcagcgggcgcagaugaccgguaaggaccgcgcgugcguccccucucugcgggugucccucucggcccgcggugauuucuuccagacuuccgcccgcgguugugagaggcauucagcuacauuuuacugccuuggcucacuccgcguucccacggucugggucuuauuuauagccacagcucccaaguuguuacugcuccggaaau

SEQ ID NO: 11552 - RNA, 527 nt, Mus musculus
auuuccggagcaguaacaacuugggagcuguggcuauaaauaagacccagaccgugggaacgcggagugagccaaggcaguaaaauguagcugaaugccucucacaaccgcgggcggaagucuggaagaaaucaccgcgggccgagagggacacccgcagagaggggacgcacgcgcgguccuuaccggucaucugcgcccgcugcagguuccggaggugcuucacagucauuuccagaaugucugccuucucuagcuuggaaugccgggagcucugcgcagaaaaaacaagggaugaaagucaguccuccuugucagcugccuccgaguucugaagguccccgcccgcaugucccacaucccagggcccggcggccucucucccgccagugggaacguagugcuggcgggguaagauccacaugcagcaggcuaagagcuuaguucuuugugccugggaaaugccauuccauucguaauuaaaaauaaaaaaaagcauugcucacuuacaucuuucuuaagugcau

SEQ ID NO: 11553 - RNA, 280 nt, Mus musculus
cuccuuguucuccgcagagccgccgccugucuugcucugccaucucucagagccaucacccggugaguaguucgcacgcucggcggugggcgcucagaggaaguuucccuacgguggcaggucgcccuucuauucuugcaggaucggaaguuuggcgggaacccggaucccagguucaggccucucaaggguggagcggaauagagggguaaagaguuucaccuguuuguacuuuuugaaaugauuguuguaacuaguauuuacugagaugcgguucuga

SEQ ID NO: 11554 - RNA, 280 nt, Mus musculus
ucagaaccgcaucucaguaaauacuaguuacaacaaucauuucaaaaaguacaaacaggugaaacucuuuaccccucuauuccgcuccacccuugagaggccugaaccugggauccggguucccgccaaacuuccgauccugcaagaauagaagggcgaccugccaccguagggaaacuuccucugagcgcccaccgccgagcgugcgaacuacucaccgggugauggcucugagagauggcagagcaagacaggcggcggcucugcggagaacaaggag

SEQ ID NO: 11555 - RNA, 818 nt, Mus musculus
cggggcccuagcagcaccucuaggcccucgggggcagacgcgcagcucggggaaaggaacggcgguggcgcaccaacuaccagggcuccgccaccgcgcccuggacggcgagggcggggugucgcggcuuuuguucccggggaccuucucagacucagggagaaacuggaggugcacugaagaguccuggacguccagguugagggacggugccggguggccgcacuuuccgaucccucccaucacuuggaacuuacacaaaagggagacacgaaaaugcacaaaguuugcaaaaggaaggcggcggugcgcgaccccgcaccgacucgggagagggucgcugcgcaggcagccgccgcccgcggccgccaggagcaaagcccagcuucgcagucaagacaggcgggggugggaagggagugugagccaggcgcuccccagcauccagagcugcccccauuccaacccaggaccccaaggaaggggaagggcggcgauuuccucgcagggcacugaauccugagacgcuacgcuuucgguuuuccacacgugucccuucccccucgaacugggugucucucgcaucccggaguccagcucucaacgcagggaggagucagggucugcguucaggcucguccccucgccuuccagcccuaggcuggcacggauauggggaccccagcgcccuaacccauucccucuucaucgcucgggcagcgcguccccgggcaggguugggccagagccgccgaagcgcagggcgcccgcaggcgggggcggcgaggagcggucuacccgugacagccccccacguc

SEQ ID NO: 11556 - RNA, 818 nt, Mus musculus
gacguggggggcugucacggguagaccgcuccucgccgcccccgccugcgggcgcccugcgcuucggcggcucuggcccaacccugcccggggacgcgcugcccgagcgaugaagagggaauggguuagggcgcugggguccccauauccgugccagccuagggcuggaaggcgaggggacgagccugaacgcagacccugacuccucccugcguugagagcuggacuccgggaugcgagagacacccaguucgagggggaagggacacguguggaaaaccgaaagcguagcgucucaggauucagugcccugcgaggaaaucgccgcccuuccccuuccuugggguccuggguuggaaugggggcagcucuggaugcuggggagcgccuggcucacacucccuucccacccccgccugucuugacugcgaagcugggcuuugcuccuggcggccgcgggcggcggcugccugcgcagcgacccucucccgagucggugcggggucgcgcaccgccgccuuccuuuugcaaacuuugugcauuuucgugucucccuuuuguguaaguuccaagugaugggagggaucggaaagugcggccacccggcaccgucccucaaccuggacguccaggacucuucagugcaccuccaguuucucccugagucugagaagguccccgggaacaaaagccgcgacaccccgcccucgccguccagggcgcgguggcggagcccugguaguuggugcgccaccgccguuccuuuccccgagcugcgcgucugcccccgagggccuagaggugcugcuagggccccg

SEQ ID NO: 11557 - RNA, 1646 nt, Mus musculus
ucucaaaccaggguugccaauuuggaaaauggccuuuuucgggcugcugagacucagcggucagagaaaucguaaaguaggauaugaauaccagcuccuagggacaagucggaaaagagggagaaaucuagaaaagggcaaaaagaaauuugaaugauuaaaaagaacuaacuggcugguagggacugaacacggcagagucaggcgaauguguagcagggaggaucaguccaggcuaacauuccucagcgcuggggaguccaaccucugccgggagagggagugcgagcaacgaggccgagguaggaggcgcguggaggcggggcgagccaagcaaagaccucccaagcagguucugcagaggggcccaacggagccaccagccaucggggucagcuuuucaaaugggggaaggggacagacggaaggccacagaaaugagaucaccacugccguugcccaggcuccugaacgcacauccaggucaccauggcuccucuacuccgcccuccuuugagcgcuacgugcucacacggacugacguuacaaaacucagcgcgaaacuacaaccuaguuaaagugaacucauacauucacuaaaggcauuaaagggauggagagagauucuucaguguaaggagucggguuauuggcuucgcggaggaaacgcuuagcccuuaucuacaggaccuccgauucuuucucucuuucucaaauuauuaacuauucgggcaaauaaguguucuagcagaguauggucacacuuuuuuugggggggggagcgggaaggucacgacccagaacuucaauucacugcaagucugagucauucgcauuuagaggcgaucuggagugugaccccaagucacgccucguaaagacugagagaugggggucacucuuauaccugauggcuuucccgcguccugaggcguggggucccgcacaggccacugguuccggguguucuggcucucgggucgcgagucgcugguuggcagggucucgucguccaugacgccgcacuuggcgccgccacugccccgccgccuucgccucaggauguggaacugcggccgugcggaugacuccuccucgggcacggcaggggccaggcgcucgguggccacuccaggcgcuggcugaaugaagaacuccucuccuuguagguagaaggcaccacgcacaccuucacagaggcugagggcugcggcagagccgggaucaccguucaccgugccagaguagaagcagugagccagguccccggugggguccagauguugugccucggacccgggacugcgccccacagucugcagggugaagccaggcgccaagaaaccgcuguccggcugcaacuucagauguagcugcuggccaaaggcguccagacgaaggcguguggugguggaaucguggcccggggcgcgcuccagcgagggcaggaccagcuccucaucuuccuccguggggcgcccgugugcgccccgcgcacauagcagcauuguuauggaagcgaggagcagcaacagcaugugugcggacagagagccccgagaucucgcugcccgcuggacgucccccaugucggagcagggcuucugcuugcgugaccccaaagggacuuuuggcugcauggcacc

SEQ ID NO: 11558 - RNA, 1646 nt, Mus musculus
ggugccaugcagccaaaagucccuuuggggucacgcaagcagaagcccugcuccgacaugggggacguccagcgggcagcgagaucucggggcucucuguccgcacacaugcuguugcugcuccucgcuuccauaacaaugcugcuaugugcgcggggcgcacacgggcgccccacggaggaagaugaggagcugguccugcccucgcuggagcgcgccccgggccacgauuccaccaccacacgccuucgucuggacgccuuuggccagcagcuacaucugaaguugcagccggacagcgguuucuuggcgccuggcuucacccugcagacuguggggcgcagucccggguccgaggcacaacaucuggaccccaccggggaccuggcucacugcuucuacucuggcacggugaacggugaucccggcucugccgcagcccucagccucugugaaggugugcguggugccuucuaccuacaaggagaggaguucuucauucagccagcgccuggaguggccaccgagcgccuggccccugccgugcccgaggaggagucauccgcacggccgcaguuccacauccugaggcgaaggcggcggggcaguggcggcgccaagugcggcgucauggacgacgagacccugccaaccagcgacucgcgacccgagagccagaacacccggaaccaguggccugugcgggaccccacgccucaggacgcgggaaagccaucagguauaagagugacccccaucucucagucuuuacgaggcgugacuuggggucacacuccagaucgccucuaaaugcgaaugacucagacuugcagugaauugaaguucugggucgugaccuucccgcucccccccccaaaaaaagugugaccauacucugcuagaacacuuauuugcccgaauaguuaauaauuugagaaagagagaaagaaucggagguccuguagauaagggcuaagcguuuccuccgcgaagccaauaacccgacuccuuacacugaagaaucucucuccaucccuuuaaugccuuuagugaauguaugaguucacuuuaacuagguuguaguuucgcgcugaguuuuguaacgucaguccgugugagcacguagcgcucaaaggagggcggaguagaggagccauggugaccuggaugugcguucaggagccugggcaacggcaguggugaucucauuucuguggccuuccgucuguccccuucccccauuugaaaagcugaccccgauggcugguggcuccguugggccccucugcagaaccugcuugggaggucuuugcuuggcucgccccgccuccacgcgccuccuaccucggccucguugcucgcacucccucucccggcagagguuggacuccccagcgcugaggaauguuagccuggacugauccucccugcuacacauucgccugacucugccguguucagucccuaccagccaguuaguucuuuuuaaucauucaaauuucuuuuugcccuuuucuagauuucucccucuuuuccgacuugucccuaggagcugguauucauauccuacuuuacgauuucucugaccgcugagucucagcagcccgaaaaaggccauuuuccaaauuggcaacccugguuugaga

SEQ ID NO: 11559 - RNA, 5134 nt, Mus musculus
aggacagagaugcauuucaguggccaggaucauuaagagcagguggcugggaccugggaaaguagcucacgucucuccaagacuuaguuuucucuuuguaaaaugggagcgaugcuucucuuuagggccagcuagagaguaacugaaagagccagucaaaaccggcugaacgcgugcgggggagggggcgggguguuggggggcgcagcucagauaaccuugaagcaaucaccagcucugccauucuaaaggcucacucacaccccacaauucggaguacagaaaugaccuguuuauugaauacaccaauagauccuugcccacagaugcacuguuuuacuguuacuaguccuugcacaauugcuugagaaggccuuuggaaacauucaccgcgcgcaugcacgccaccugccagccaggcaggcagacguacaaaacccuggcgagguccggcuggggcuucacgcugaguuuugccaagcuccgccggguucugacuccuggagugucuuaccgcacacgguugagcuccaaagcugccauucuacaguccuucuggcuuccggaccuccaguccucacccccacucuccggugccagaagccuugccugccaccgccaccccgggaggauucugcgcaaggacaccgcucuucuuggcagccaggcagaaucgcugccugaaugcuaguaggaaggaaggaaggaaggaaggaaggaaggaagggaaaggaagggggagagccaggaccaaauagggaaccagggaaucggugggaggucugcgcccuggagccccgcgagagucgccccagccgguuuggcacuggcuccuccugggccgccaggcugcggagcaaaggccggcccuuacacgcacccggccuuuugugcaaaggcaacacaaaggagagggaaaaacacgucuuccguuuugaaggaggaggccaacagcucaggacgccuaggcaagccaggaacucccggagcccggccugccgauuagccuaggcaagugaacucuccauucccagggaaggcauauugguccagcugcguguguugguuggaaacgcgucucuagggcccacccaggacacacaggcaggagcuagauccugacaccggcgaaaaguaucucucggaccaagaaggacaagcgggggcuaaccccgacuaguuuccgauggggugggaggaguaaaggagacgcacggaauuguguccagccucugacuugccucagagccagagaccaagggacacagauggcccucaggcggcaagcagcucucagacgaagagaaggcagcugagaggagaaggagacaguugggagcugcccgucaaagcuuccgacuuagagagugaggaccaccagaugccuggaacugcugggacaagcuaguuagcuaaccaggcugcuacgcuagccacagggcuaggggaaguggaaaggcugggggugggggugggggacgcagagccagcuagcgcugcgcucuugccuuccggcuccuuuuccaggcucgccgcuguagaaagguuuccccaacuuucguccgggucuccaacuccagcuacuggaccaaguguacagaaugucaggcaguucucccgcagacuuccggacgcagaagagacaaaccaguagaacgcaacaaaagaaggaaccugggcgcucggaugcuccgggcagucacacuagccuggguggcugcaaccuaucucccgcauauuguaccgccugagguuuguuagggacuuuggagauccacaucccagcugguggccccacagagcucacccccacguacgcccucucugcgguuugccaacgaaggcccaagagugguccucacaugcccaagcuccuaauccccaccacaagccccgugugacagauucugcuaauugaacgguuaugggucauccucauaaccguugggcgacauuaucaccacgcuucaauucuucauguuuuaaauacauauuuaacggauggcugcagagccagcugggaaacacgcgggucggaaaacaaugcuucagaaggcacgagaugaggggcaaacgcgccagcccacugacacucgaggguggaccccaggggggggggcgggggagaacuuagcacgaaaugaggagcaaucgccugaguuuucaugccuguucugacuuugcuacaagaagaccaauuacuguuugucugcuugcuuguuaaaacuacauaugcgaauucaaauaccaagcaaugagaaguaacgagaaaagaccguuaaaacuccgugagaaggaauuggcgcuuauguuugggggguggaggagagguagcacccgagaucuguaaaaaauaaauaucccaacaaacaaacaaaacgcauuugagcuggaaauguccggaugugagaaacaguuggggguggggauacaaccuacugcccccaugcuugggcacugccaauugcucgcauccauccacgguaggcagggucaccuguaugggccuggccguauuuucuccuggaggcuugcugaaaucaauuccuagguuuucacuuccauaaaaugggugaguguauaguuaucucuagacuuccccaggcaauucacccagauccaguuucucagcuuuguaugugugugugugugugugugugugugugugugugugugagagagagagagagagagagagagagagagagagagagagagaggcugcuaccuauaaaagacgucccaaggcagcuaggaguguguuucaaguaucaacucccauccacagcggagagccuccgauaauucuuugcaaauaauguugccucuacuccaaggcuugggcaccaagauguuggaaguucaguggcuggguuucccugaaaaugaaugagguggaagucguuaaccaucgaugcguuggcgcuuugacuguauugaaaauagcucuccggagcuucuacacaaucuaaacuuuauaaugaauugcgauuucuucccagagugcuaagaaccuuucucugcuuccuugcccgccccgugcucuccaaggccaugcccccaccugggggcgcuaccgccuguccccaaagcugcagcaacugccacuaaguagaaaggagcuaagggagugggggccuucugcgccgcuaguguuuucuuaugcaaccacaaauggucacaguuugaugaaaaucacucgauaggucggcagcgggaaacaggaggaggcgggagggcuagcaaaaacuccagguguggcaagcaaccucgguguucauucucagccauagaacugguuggccaucggacgaguuugcagauuccccgucucacuccguacccuggccugacgcuacagugacaauauuuauauugaaaguugcaggcguucccucucugccaggguccccagacuucuuuagcagccccgcuagcccacccgcuucuucagcucgcccuuuccucucccugcccaggucccuccucccaucccuccucgcgaaucucucuaccgcgggcgcccauuggcugugugcugagaggaggcgugugccgggcccggcggguuucauugagcggaauuagccgggugacaucagcuucgcagccccucgggccggcccagcucauuggcgccucugccccuccaggaaaagcacauuguucccgccccccgcccggaccaccgccaccgccgucgcugcugccuccacccagcuauaaaaaccagcggaaccccgaaagguguggaugcuuauuacagaccgagccaacaccagcgcccagagccagguucuccuccgcagcgagcaccucaaaucuaauucacaguaaguguccccgccccuuaacugcuccagccuaaaccccgaagaccgacuucuccaaaguggcuaggauuuaggaugcacccuacagugcuggccuacuggccgagaucccgccccaauagguacuaaugacugccugggugucuacacucaccgcagcaucccaggcuccaauaacuccuguugcgaguccgcaagcuagccgcgcggucguagaaccagcgcuuagaaagugaauccaaugcgggcugccagugcguguguucacgcuugccggcguuugcugcguguguagauggcguuaaaggcagaugcgucugagcaccagauagaaaauacuucucuauucagaucuccgguccagagaaaaguccucauuuauuccaggccggacugaagaaauaaaaccucuagaaugucccucauugagggccacccagaagucccugaaauaaaguaaccgguggaugaguggggaggagagagauuaggauaacuugcaugccccgggcugcuagaaggccagacugccgcggcguagaugccaaccaccuuugcggguuccuggagcugccgugcaggcggggacggcgauugucucacuucuuucuccacacccugugugucugucugucugucucuguguaugugugugucugugucuguguaucugucugguucucuccucaaguucggaagguugaaaaaagaaggaucauucgagagcuuagaucaucccuggggccauggacucggacgccagccuggugucuagucgcccaucguccccagaacccgaugaucuuuuucugcccgcccggagcaaggggggaagcagcagcggcuucacaggagggacuguguccucguccacgccgagcgacugcccgccagagcugagcuccgagcuacgaggggccaugggcgcgucaggcgcgcaucccggggacaaacugggcggcgguggcuucaagucaucuuccuccagcaccuccucguccacguccucggcggccacgucuuccaccaagaaagacaagaagcagaugacugagcccgagcugcagcagcugcgccugaagaucaacagccgcgaacgcaagcgcaugcacgaccucaacaucgccauggacggccugcgggaggucaugccuuacgcgcacgggccgucggugcgcaagcucuccaagaucgccacgcugcugcuggcgcgaaacuacauccucaugcucaccaacucgcuggaggagaugaagcgacuggugagcgagaucuacgggggucaccacgccggcuuccac

SEQ ID NO: 11560 - RNA, 5134 nt, Mus musculus
guggaagccggcguggugacccccguagaucucgcucaccagucgcuucaucuccuccagcgaguuggugagcaugaggauguaguuucgcgccagcagcagcguggcgaucuuggagagcuugcgcaccgacggcccgugcgcguaaggcaugaccucccgcaggccguccauggcgauguugaggucgugcaugcgcuugcguucgcggcuguugaucuucaggcgcagcugcugcagcucgggcucagucaucugcuucuugucuuucuugguggaagacguggccgccgaggacguggacgaggaggugcuggaggaagaugacuugaagccaccgccgcccaguuuguccccgggaugcgcgccugacgcgcccauggccccucguagcucggagcucagcucuggcgggcagucgcucggcguggacgaggacacagucccuccugugaagccgcugcugcuuccccccuugcuccgggcgggcagaaaaagaucaucggguucuggggacgaugggcgacuagacaccaggcuggcguccgaguccauggccccagggaugaucuaagcucucgaaugauccuucuuuuuucaaccuuccgaacuugaggagagaaccagacagauacacagacacagacacacacauacacagagacagacagacagacacacaggguguggagaaagaagugagacaaucgccguccccgccugcacggcagcuccaggaacccgcaaaggugguuggcaucuacgccgcggcagucuggccuucuagcagcccggggcaugcaaguuauccuaaucucucuccuccccacucauccaccgguuacuuuauuucagggacuucuggguggcccucaaugagggacauucuagagguuuuauuucuucaguccggccuggaauaaaugaggacuuuucucuggaccggagaucugaauagagaaguauuuucuaucuggugcucagacgcaucugccuuuaacgccaucuacacacgcagcaaacgccggcaagcgugaacacacgcacuggcagcccgcauuggauucacuuucuaagcgcugguucuacgaccgcgcggcuagcuugcggacucgcaacaggaguuauuggagccugggaugcugcggugaguguagacacccaggcagucauuaguaccuauuggggcgggaucucggccaguaggccagcacuguagggugcauccuaaauccuagccacuuuggagaagucggucuucgggguuuaggcuggagcaguuaaggggcggggacacuuacugugaauuagauuugaggugcucgcugcggaggagaaccuggcucugggcgcugguguuggcucggucuguaauaagcauccacaccuuucgggguuccgcugguuuuuauagcuggguggaggcagcagcgacggcgguggcggugguccgggcggggggcgggaacaaugugcuuuuccuggaggggcagaggcgccaaugagcugggccggcccgaggggcugcgaagcugaugucacccggcuaauuccgcucaaugaaacccgccgggcccggcacacgccuccucucagcacacagccaaugggcgcccgcgguagagagauucgcgaggagggaugggaggagggaccugggcagggagaggaaagggcgagcugaagaagcgggugggcuagcggggcugcuaaagaagucuggggacccuggcagagagggaacgccugcaacuuucaauauaaauauugucacuguagcgucaggccaggguacggagugagacggggaaucugcaaacucguccgauggccaaccaguucuauggcugagaaugaacaccgagguugcuugccacaccuggaguuuuugcuagcccucccgccuccuccuguuucccgcugccgaccuaucgagugauuuucaucaaacugugaccauuugugguugcauaagaaaacacuagcggcgcagaaggcccccacucccuuagcuccuuucuacuuaguggcaguugcugcagcuuuggggacaggcgguagcgcccccaggugggggcauggccuuggagagcacggggcgggcaaggaagcagagaaagguucuuagcacucugggaagaaaucgcaauucauuauaaaguuuagauuguguagaagcuccggagagcuauuuucaauacagucaaagcgccaacgcaucgaugguuaacgacuuccaccucauucauuuucagggaaacccagccacugaacuuccaacaucuuggugcccaagccuuggaguagaggcaacauuauuugcaaagaauuaucggaggcucuccgcuguggaugggaguugauacuugaaacacacuccuagcugccuugggacgucuuuuauagguagcagccucucucucucucucucucucucucucucucucucucucucucucacacacacacacacacacacacacacacacacacacauacaaagcugagaaacuggaucugggugaauugccuggggaagucuagagauaacuauacacucacccauuuuauggaagugaaaaccuaggaauugauuucagcaagccuccaggagaaaauacggccaggcccauacaggugacccugccuaccguggauggaugcgagcaauuggcagugcccaagcaugggggcaguagguuguauccccacccccaacuguuucucacauccggacauuuccagcucaaaugcguuuuguuuguuuguugggauauuuauuuuuuacagaucucgggugcuaccucuccuccaccccccaaacauaagcgccaauuccuucucacggaguuuuaacggucuuuucucguuacuucucauugcuugguauuugaauucgcauauguaguuuuaacaagcaagcagacaaacaguaauuggucuucuuguagcaaagucagaacaggcaugaaaacucaggcgauugcuccucauuucgugcuaaguucucccccgccccccccccugggguccacccucgagugucagugggcuggcgcguuugccccucaucucgugccuucugaagcauuguuuuccgacccgcguguuucccagcuggcucugcagccauccguuaaauauguauuuaaaacaugaagaauugaagcguggugauaaugucgcccaacgguuaugaggaugacccauaaccguucaauuagcagaaucugucacacggggcuugugguggggauuaggagcuugggcaugugaggaccacucuugggccuucguuggcaaaccgcagagagggcguacgugggggugagcucuguggggccaccagcugggauguggaucuccaaagucccuaacaaaccucaggcgguacaauaugcgggagauagguugcagccacccaggcuagugugacugcccggagcauccgagcgcccagguuccuucuuuuguugcguucuacugguuugucucuucugcguccggaagucugcgggagaacugccugacauucuguacacuugguccaguagcuggaguuggagacccggacgaaaguuggggaaaccuuucuacagcggcgagccuggaaaaggagccggaaggcaagagcgcagcgcuagcuggcucugcgucccccacccccacccccagccuuuccacuuccccuagcccuguggcuagcguagcagccugguuagcuaacuagcuugucccagcaguuccaggcaucuggugguccucacucucuaagucggaagcuuugacgggcagcucccaacugucuccuucuccucucagcugccuucucuucgucugagagcugcuugccgccugagggccaucugugucccuuggucucuggcucugaggcaagucagaggcuggacacaauuccgugcgucuccuuuacuccucccaccccaucggaaacuagucgggguuagcccccgcuuguccuucuugguccgagagauacuuuucgccggugucaggaucuagcuccugccuguguguccugggugggcccuagagacgcguuuccaaccaacacacgcagcuggaccaauaugccuucccugggaauggagaguucacuugccuaggcuaaucggcaggccgggcuccgggaguuccuggcuugccuaggcguccugagcuguuggccuccuccuucaaaacggaagacguguuuuucccucuccuuuguguugccuuugcacaaaaggccgggugcguguaagggccggccuuugcuccgcagccuggcggcccaggaggagccagugccaaaccggcuggggcgacucucgcggggcuccagggcgcagaccucccaccgauucccugguucccuauuugguccuggcucucccccuuccuuucccuuccuuccuuccuuccuuccuuccuuccuuccuacuagcauucaggcagcgauucugccuggcugccaagaagagcgguguccuugcgcagaauccucccgggguggcgguggcaggcaaggcuucuggcaccggagagugggggugaggacuggagguccggaagccagaaggacuguagaauggcagcuuuggagcucaaccgugugcgguaagacacuccaggagucagaacccggcggagcuuggcaaaacucagcgugaagccccagccggaccucgccaggguuuuguacgucugccugccuggcuggcagguggcgugcaugcgcgcggugaauguuuccaaaggccuucucaagcaauugugcaaggacuaguaacaguaaaacagugcaucugugggcaaggaucuauugguguauucaauaaacaggucauuucuguacuccgaauuguggggugugagugagccuuuagaauggcagagcuggugauugcuucaagguuaucugagcugcgccccccaacaccccgcccccucccccgcacgcguucagccgguuuugacuggcucuuucaguuacucucuagcuggcccuaaagagaagcaucgcucccauuuuacaaagagaaaacuaagucuuggagagacgugagcuacuuucccaggucccagccaccugcucuuaaugauccuggccacugaaaugcaucucuguccu

SEQ ID NO: 11561 - RNA, 1618 nt, Mus musculus
gccaccuaucuccucauccucauccucauccucuuccaccgcaucccuucuccccaagccugcgcgcgagaaggccgaagcuccgcucgcugaaccucggggaccugcgccagaguccgggggcgcccgggccgacgccaaagaggaacagcagcagcagcagcugcggcgcaagaucaacagccgcgagcggaagcgcaugcaggaccugaacuuggccauggacgcgcugcgcgaaguuauccuacccuacucggcagcgcacugccagggcgcgccgggccgcaagcucuccaagauugccacgcugcugcucgcccgcaacuacauccugcugcuggguagcucgcugcaggagcugcgccgcgcgcucggcgacggugcgggacccgccgccccgcgccugcuccucgcuggccugccucuucuggcugccgcgccgggcucugugcugcuggcacccggugccgugggaccccccgaaacgcugcgccccaccaaguaccugucucuagcgcucgacgagccaccgugcggccaguucucucucccagcugguggcgcggguagcccuggccucugcuccugugcggugugcaaguucccgcaucugguccccgccggccugggcuuggcagcggugcaggcccaguucuccaagugagggcuggcugggcccggggcggagcgcgaccucagccaaucuucccgcgcccccgcguccuggaucuaggcagagcuggccccagaaaggaggacauuuccagacuucucucccagacgacagacuguagggcgccuucuuccccgcccccacucccuggcaauuaaaauaacccaagcggguguuccaaggagcgauguaguugcuugggauucuagaugaaucccaccuguuuagagccagaagucuucgcauccccaccacaacucacccacuggcaggggugacaacccccaccaccgcgggcuauucucguauccgugagcaucgcggagucggggaggacgguagccggccggugcgguauaaggggguugcccugggugcagcgaaaggcugcccccagcuugguuuccuggcaugcuuccgcucccuggccuaagagcugcuccccaacagugucuacccagaggggcguccuuuccuuguccagggccugagcgcacaggcucccuugcucucuccagccaaaccaugcggaucuaggaggucuagaaagcccaggccaccgguacaaacaucaaggguguuacggaugggccgcucuggaaagcccaggguuuccgagcuggauguuacgcgggugcgcucgguuaccgcgcucggugguuggggaugcgaaguggagagguuccucuccacucccaguucuguuuuucaggcucgcccagguguuuuguugcaguuuaugcuccuuaaaaccuaaaacccuuacuuagucuccacuucccuaaagguagcuuaaccaacguuugagcuugcuugaaaacaaaauuccaaccacguuccaugccaucgguguucggacuuacuaaaauagguagcaaggcacgucguagcgcaggcuuauaaaauucggucauuaacguucucauuaaaguaagcggaguuggg

SEQ ID NO: 11562 - RNA, 1618 nt, Mus musculus
cccaacuccgcuuacuuuaaugagaacguuaaugaccgaauuuuauaagccugcgcuacgacgugccuugcuaccuauuuuaguaaguccgaacaccgauggcauggaacgugguuggaauuuuguuuucaagcaagcucaaacguugguuaagcuaccuuuagggaaguggagacuaaguaaggguuuuagguuuuaaggagcauaaacugcaacaaaacaccugggcgagccugaaaaacagaacugggaguggagaggaaccucuccacuucgcauccccaaccaccgagcgcgguaaccgagcgcacccgcguaacauccagcucggaaacccugggcuuuccagagcggcccauccguaacacccuugauguuuguaccgguggccugggcuuucuagaccuccuagauccgcaugguuuggcuggagagagcaagggagccugugcgcucaggcccuggacaaggaaaggacgccccucuggguagacacuguuggggagcagcucuuaggccagggagcggaagcaugccaggaaaccaagcugggggcagccuuucgcugcacccagggcaacccccuuauaccgcaccggccggcuaccguccuccccgacuccgcgaugcucacggauacgagaauagcccgcggugguggggguugucaccccugccagugggugaguugugguggggaugcgaagacuucuggcucuaaacaggugggauucaucuagaaucccaagcaacuacaucgcuccuuggaacacccgcuuggguuauuuuaauugccagggagugggggcggggaagaaggcgcccuacagucugucgucugggagagaagucuggaaauguccuccuuucuggggccagcucugccuagauccaggacgcgggggcgcgggaagauuggcugaggucgcgcuccgccccgggcccagccagcccucacuuggagaacugggccugcaccgcugccaagcccaggccggcggggaccagaugcgggaacuugcacaccgcacaggagcagaggccagggcuacccgcgccaccagcugggagagagaacuggccgcacgguggcucgucgagcgcuagagacagguacuugguggggcgcagcguuucggggggucccacggcaccgggugccagcagcacagagcccggcgcggcagccagaagaggcaggccagcgaggagcaggcgcggggcggcgggucccgcaccgucgccgagcgcgcggcgcagcuccugcagcgagcuacccagcagcaggauguaguugcgggcgagcagcagcguggcaaucuuggagagcuugcggcccggcgcgcccuggcagugcgcugccgaguaggguaggauaacuucgcgcagcgcguccauggccaaguucagguccugcaugcgcuuccgcucgcggcuguugaucuugcgccgcagcugcugcugcugcuguuccucuuuggcgucggcccgggcgcccccggacucuggcgcagguccccgagguucagcgagcggagcuucggccuucucgcgcgcaggcuuggggagaagggaugcgguggaagaggaugaggaugaggaugaggagauagguggc

SEQ ID NO: 11563 - RNA, 2527 nt, Mus musculus
acacaaaccgguaagaguaccggaggucugugcggccgcuacugugaagguccugagaccauucuucucccacagugaggugccucuguguggucaggcggcugaugagucuuucuggguuuucugagagagaagaugcucagguugguaaugauaacaccuagacgcuaggaaccgagagagugguauggaugcugucaagccaaggacccuucuucucugaacuccaggugcagagugaagguaagaggccugggcugaguggguaaacuguguaucaauggggagaaugcauaguuuaggggcuuggagucuuaccuguugcgaggucaucgggagagucuguauggagggcuucaaugaucagagagaagguacccuagggaaaggggagaagaugcuugauaaccggaaguguggaggaggaggaaggggaggaggaggaguugggagacuaggagugggaggaggaggagcuggaggaggaggagaggcauuaaagagaaccaaguacagaggcucucagaucucuguguugugccaaugaaggucaacuccuaucacuuuccuuaauuagaagaauuuuaaagaguguccccccccacacacacaccguguguggguuugguuuuuuaaaaacauguuaauacaggaaauuguauuuuaaaaaggggggagaguacuugauggagcaagguggggugcaggaagaggagagggcagcugucauuuguuuucuggggguggaaccucgaggauggagagcagccccagcacugguagcaacccaaccaaggccuaagagcuaggggacaagaacucucccaacuuuggggguaggggagggaagcauucgaccuuucagguaaguaggaggugugugagaaaugcccagggcuugcaaaagccucugggguuccacacccccuccucaacugccagucaguucccaguaagaagucaagaccucaggcgugucuuugugggauuccccaacccuuaucaguggcccuugccuucuucccacugccaaccaccaaccagccaccccuaccccuccagacccagccgagugcgcgcaggugcccacucacuggccaggugaagccgaaggggaaucggaugggguugcugaaggcggggucgaugccugcgccaucaggcaggcugaaggagucgacacccagcacuggcgugacagcacugccguaggugcaggguggcuccggugacacgcuggccugguagugcuugaggcauacgcgaaagaagguccugcaggcgcaaggcgggccagagcccccgcggcagcaguugcgguuccccagcagccccuucuuguugacgaacuccugcagcuucagcucaaauacgccggagcuccagaccugcgcggggaaggggcgugaggucgcgccggcggcggagggacccgggggcgcgcgggcccuugcuaggacgcagaggccgagcgcaccucagcgcccauccggagcugcccgcugccgggcagcucucggggucgucgcugccggagucacuuggggauggacagcugaucggcugguccgacuccccucccuccaccgcgcagcagccccgcccggcccccuaccuggcacagcagggcagagaccacggcaagggcuagcgcgcuccgacggcccaugguaccgcuggacgcccuugcucuccuagaguauccucuuuucuuucuucuucaaagacccagggaugccaggaaagucuauaugacccgaggaguacuggcggaaaggcgucucucggcuccaggugugcuaucagggccaggucgcuucaggagggugcggugccuucagcuagguccccggcaagagcucuacgaggcacugagaaaggacaacuuucgguuuccucuucgucuggcuuucaguccacggagaggugagugucuccugcuuucugguuuugucuuaagcuucuucgcggagggaaagaggagaaaggagauaagacacagagggaagagagcccagauguucagcuuaauucccaagagagcuugcaguggcuuccuucgcaggccuauuaggaagcggcggucuggaaaucccaccggugaggcgauaauccggggccccgaggggcgcggugggaacggugguggcaaggacugcggcgcgcgcccugguuucccggcccggcgucacucggcagccgcugccgcucccagaguguucuagaccgguaucucuugcacuaucgccaagccucgcgucuuccucaagaauucagccaaugccaugcgagaacacacaccgaggaccggaggccgaagcgugggaggcuccgugccgcaccggugcucucccgugaccugcccuggucagacaggguaaccgcgggugcacgccggaggaucuggcccgggcuggcgccugccacccuuaaauccugccggccgcucgcauaacuaaugagaugcaaaugagcagccccccaaucuggcgagagcugucacaaaggagccacuuuuccaaacccu

SEQ ID NO: 11564 - RNA, 2527 nt, Mus musculus
aggguuuggaaaaguggcuccuuugugacagcucucgccagauuggggggcugcucauuugcaucucauuaguuaugcgagcggccggcaggauuuaaggguggcaggcgccagcccgggccagauccuccggcgugcacccgcgguuacccugucugaccagggcaggucacgggagagcaccggugcggcacggagccucccacgcuucggccuccgguccucgguguguguucucgcauggcauuggcugaauucuugaggaagacgcgaggcuuggcgauagugcaagagauaccggucuagaacacucugggagcggcagcggcugccgagugacgccgggccgggaaaccagggcgcgcgccgcaguccuugccaccaccguucccaccgcgccccucggggccccggauuaucgccucaccggugggauuuccagaccgccgcuuccuaauaggccugcgaaggaagccacugcaagcucucuugggaauuaagcugaacaucugggcucucuucccucugugucuuaucuccuuucuccucuuucccuccgcgaagaagcuuaagacaaaaccagaaagcaggagacacucaccucuccguggacugaaagccagacgaagaggaaaccgaaaguuguccuuucucagugccucguagagcucuugccggggaccuagcugaaggcaccgcacccuccugaagcgaccuggcccugauagcacaccuggagccgagagacgccuuuccgccaguacuccucgggucauauagacuuuccuggcaucccugggucuuugaagaagaaagaaaagaggauacucuaggagagcaagggcguccagcgguaccaugggccgucggagcgcgcuagcccuugccguggucucugcccugcugugccagguagggggccgggcggggcugcugcgcgguggagggaggggagucggaccagccgaucagcuguccauccccaagugacuccggcagcgacgaccccgagagcugcccggcagcgggcagcuccggaugggcgcugaggugcgcucggccucugcguccuagcaagggcccgcgcgcccccgggucccuccgccgccggcgcgaccucacgccccuuccccgcgcaggucuggagcuccggcguauuugagcugaagcugcaggaguucgucaacaagaaggggcugcuggggaaccgcaacugcugccgcgggggcucuggcccgccuugcgccugcaggaccuucuuucgcguaugccucaagcacuaccaggccagcgugucaccggagccacccugcaccuacggcagugcugucacgccagugcugggugucgacuccuucagccugccugauggcgcaggcaucgaccccgccuucagcaaccccauccgauuccccuucggcuucaccuggccagugagugggcaccugcgcgcacucggcugggucuggagggguagggguggcugguuggugguuggcagugggaagaaggcaagggccacugauaaggguuggggaaucccacaaagacacgccugaggucuugacuucuuacugggaacugacuggcaguugaggaggggguguggaaccccagaggcuuuugcaagcccugggcauuucucacacaccuccuacuuaccugaaaggucgaaugcuucccuccccuacccccaaaguugggagaguucuuguccccuagcucuuaggccuugguuggguugcuaccagugcuggggcugcucuccauccucgagguuccacccccagaaaacaaaugacagcugcccucuccucuuccugcaccccaccuugcuccaucaaguacucuccccccuuuuuaaaauacaauuuccuguauuaacauguuuuuaaaaaaccaaacccacacacgguguguguguggggggggacacucuuuaaaauucuucuaauuaaggaaagugauaggaguugaccuucauuggcacaacacagagaucugagagccucuguacuugguucucuuuaaugccucuccuccuccuccagcuccuccuccucccacuccuagucucccaacuccuccuccuccccuuccuccuccuccacacuuccgguuaucaagcaucuucuccccuuucccuaggguaccuucucucugaucauugaagcccuccauacagacucucccgaugaccucgcaacagguaagacuccaagccccuaaacuaugcauucuccccauugauacacaguuuacccacucagcccaggccucuuaccuucacucugcaccuggaguucagagaagaaggguccuuggcuugacagcauccauaccacucucucgguuccuagcgucuagguguuaucauuaccaaccugagcaucuucucucucagaaaacccagaaagacucaucagccgccugaccacacagaggcaccucacugugggagaagaauggucucaggaccuucacaguagcggccgcacagaccuccgguacucuuaccgguuugugu

SEQ ID NO: 11565 - RNA, 836 nt, Mus musculus
acauguuugaaagacuccccccaccucaccccccaacacauaaccuuuacacaaccgucaccuuauuagguuuuuacacauccaucagacacuagaacuuuuguuuucuuuuuuuucuuuuuuuuuuuuuaagggaaaugaguuuauugggagggcccaggacacacguaucacaaugaauuaccuaaacggcuccccugguuacaagcuccagagaaaaguaaauggagauauagucucugacuuagcaccuagcuuuguguugagcaugccaugagcuguauauucccaucuuuagaggggccucuuuacuccacccccaccaccuaggcagcuucauuagaaucccgaggugugauucuuggagcuaguguuccuuugauuguagcacagccccuaggguguaccugacagguguccucacuguagguguugcuguccuguuggugagaaugagcccuguccuggcagaguagcuugaucauuuaggccaguaucuggagcaagauguauauaaugcacagaaagagaggaaaaccuucgcaugcccagagaaacacugcuaacaagaaucuagcaguuacugggcagaaucaucuguguugggccaucuggcaacugaaauuacagcuccuuuucugaugacccagccugccuacugcuacccugucucccaaacacuuucaaaguuucagaaucaacaggaauuucugcacuucacgucgucaucgccaacucacagacaaucaaagaguuaaccaaaaagccauguguauaauacucaaggcugaggugagaaaggcaggguuagaucccacuuuuuaaaaaaccuguuu

SEQ ID NO: 11566 - RNA, 836 nt, Mus musculus
aaacagguuuuuuaaaaagugggaucuaacccugccuuucucaccucagccuugaguauuauacacauggcuuuuugguuaacucuuugauugucugugaguuggcgaugacgacgugaagugcagaaauuccuguugauucugaaacuuugaaaguguuugggagacaggguagcaguaggcaggcugggucaucagaaaaggagcuguaauuucaguugccagauggcccaacacagaugauucugcccaguaacugcuagauucuuguuagcaguguuucucugggcaugcgaagguuuuccucucuuucugugcauuauauacaucuugcuccagauacuggccuaaaugaucaagcuacucugccaggacagggcucauucucaccaacaggacagcaacaccuacagugaggacaccugucagguacacccuaggggcugugcuacaaucaaaggaacacuagcuccaagaaucacaccucgggauucuaaugaagcugccuaggugguggggguggaguaaagaggccccucuaaagaugggaauauacagcucauggcaugcucaacacaaagcuaggugcuaagucagagacuauaucuccauuuacuuuucucuggagcuuguaaccaggggagccguuuagguaauucauugugauacguguguccugggcccucccaauaaacucauuucccuuaaaaaaaaaaaaagaaaaaaaagaaaacaaaaguucuagugucugauggauguguaaaaaccuaauaaggugacgguuguguaaagguuauguguuggggggugagguggggggagucuuucaaacaugu

SEQ ID NO: 11567 - RNA, 750 nt, Mus musculus
gcuggggcacgaagucacuccuuuccucagccugagugucaagaguccccacacucaccgccacagcuugccuagggucuugcugagcucugcguuauggagaugcggguacugguccgccagcuugcggcgcgccgccugugcccacaccaugaaggcauucaugggccgcuucacguguggcuuggccuugagcgugccgccaccgccgccgcgcacaggcauaggcaccagacuccagucauaacccuuaagcaccugcgacacggcaucacggaugcaggcugggaagcguucgucugcugccucagcaguauccccucggccgccgccccccgcgcggcccaggcccucugaucccgcgggcgacgguggcgcgucggaguccgaauccuccacgugugacauggagcuagcggugccagacgggcugcagggaggcugggcgcgggccucacucauguccagcaucggggccacgcgcggaggggcacucaguggggauggacgcaggggucgcgcccggucacucuguggaaggacacucuagaauccaagguugccacgcaggacccaaucuuuguccucaccgcaggggcccagcagcagcuccuccgccgcaguagcucagucucaguucugggacccgcaacaaguuucuuuaagccguggucgaaaccccgccccucccgguccggguuggcagguccuccccaggcggagcuuguaugccccgccccgaauccaaag

SEQ ID NO: 11568 - RNA, 750 nt, Mus musculus
cuuuggauucggggcggggcauacaagcuccgccuggggaggaccugccaacccggaccgggaggggcgggguuucgaccacggcuuaaagaaacuuguugcgggucccagaacugagacugagcuacugcggcggaggagcugcugcugggccccugcggugaggacaaagauuggguccugcguggcaaccuuggauucuagaguguccuuccacagagugaccgggcgcgaccccugcguccauccccacugagugccccuccgcgcguggccccgaugcuggacaugagugaggcccgcgcccagccucccugcagcccgucuggcaccgcuagcuccaugucacacguggaggauucggacuccgacgcgccaccgucgcccgcgggaucagagggccugggccgcgcggggggcggcggccgaggggauacugcugaggcagcagacgaacgcuucccagccugcauccgugaugccgugucgcaggugcuuaaggguuaugacuggagucuggugccuaugccugugcgcggcggcgguggcggcacgcucaaggccaagccacacgugaagcggcccaugaaugccuucauggugugggcacaggcggcgcgccgcaagcuggcggaccaguacccgcaucuccauaacgcagagcucagcaagacccuaggcaagcuguggcggugaguguggggacucuugacacucaggcugaggaaaggagugacuucgugccccagc

SEQ ID NO: 11569 - RNA, 1121 nt, Mus musculus
ccggacacccagcuccgcuuaagcuaaucgccgagugcacgggcucgcucgguucgauguuggcgcaauugcgcaucugggaaaugccuaaguggcuuggacaaaacaaaacaagagaaaucucgggcgcccuaucccagaccucuuccccggauaguuagcguucucuuaacagucugggauuuagcuuuagcuuuucuggcugcaaagaaaauaaagucaugaggaugcucggagugaauuacauuaggaauacuccgguuugucccucggguggucagcugauguuggcauggcuucuggacuucccaguacccggaggaggacagaggccucuacaccagcccugcgggauuccgguugguagcaauaaguucuaauccuccuccaguccuucuccaauguuccuggaccuucucucugcucccagggaaaaccuaggaacguccucuaacucgcagaaaccauugggccucucuggcuuuacucagcacaggaucugggccugggacuucccugcuccuucugugagcuggccaggagccccucucccuacucugagauauuugguauucggccaccuucggaagccugcucuucacuucucagugucuuuauucguuccguauuucccaacaguucccagaaaggaauuucugccugauccugccuggagauuguacuagaaaaacaaagccaaccccagcuccugggauccgcagcaucgcaucucaaaaucacaacccgguccccagacuccucucuuuuggcacaaaggaggcaaggcccagaaaggcagggugggcuacacaaggcccaggauacacggggcuaagcuuucgguuuagcaguucucagugucucaaaguacccccaaaucuggaagagauuuuaacucuccaguacgaagauuuguucuaacgcggauuguuagauagcuuaacuuuguaacagauccaagaacaaggcccuaaccuacugggguuuuguaggccgaaaacaacauuuuaaucuucucucucucucucucucucucucucacucucacucucucacucucucccucucucucucucccuucuuuuuuccugacccucuaaauucggcguucccucuaaacu

SEQ ID NO: 11570 - RNA, 1121 nt, Mus musculus
aguuuagagggaacgccgaauuuagagggucaggaaaaaagaagggagagagagagagggagagagugagagagugagagugagagagagagagagagagagagagaagauuaaaauguuguuuucggccuacaaaaccccaguagguuagggccuuguucuuggaucuguuacaaaguuaagcuaucuaacaauccgcguuagaacaaaucuucguacuggagaguuaaaaucucuuccagauuuggggguacuuugagacacugagaacugcuaaaccgaaagcuuagccccguguauccugggccuuguguagcccacccugccuuucugggccuugccuccuuugugccaaaagagaggagucuggggaccggguugugauuuugagaugcgaugcugcggaucccaggagcugggguuggcuuuguuuuucuaguacaaucuccaggcaggaucaggcagaaauuccuuucugggaacuguugggaaauacggaacgaauaaagacacugagaagugaagagcaggcuuccgaagguggccgaauaccaaauaucucagaguagggagaggggcuccuggccagcucacagaaggagcagggaagucccaggcccagauccugugcugaguaaagccagagaggcccaaugguuucugcgaguuagaggacguuccuagguuuucccugggagcagagagaagguccaggaacauuggagaaggacuggaggaggauuagaacuuauugcuaccaaccggaaucccgcagggcugguguagaggccucuguccuccuccggguacugggaaguccagaagccaugccaacaucagcugaccacccgagggacaaaccggaguauuccuaauguaauucacuccgagcauccucaugacuuuauuuucuuugcagccagaaaagcuaaagcuaaaucccagacuguuaagagaacgcuaacuauccggggaagaggucugggauagggcgcccgagauuucucuuguuuuguuuuguccaagccacuuaggcauuucccagaugcgcaauugcgccaacaucgaaccgagcgagcccgugcacucggcgauuagcuuaagcggagcuggguguccgg

SEQ ID NO: 11571 - RNA, 2182 nt, Mus musculus
aacccggccuuaucuuaccugagaucucaguuucgaggaauuggggguuggggggcgacgcagcgcgaaaccucaaacccugcgcccagaggcacuccuuuuuucaaaggaggaaaagaaggacugacccagcccucccggaggcuuuaccugguaaagaggaugagcagccacagcagcgcgguggaaaggguguccuggcuggcuccgaagauguccguaauaguggcaggcacauccuccaaguccagcccggaggaaucgucgccaggggccccagacgcuuucuuuucggcagagaggaugaaggcguccgucaugucucgaggagcagccccgggcaccaggcuuucgcggugccucaggaacuuguccagaacgaaguugcugaaguugcgguugagcugcucgaacuugcggaagguggugcgcaccggguugggaaauagcugcagccagggcagcacauccaccaggcugcccgcacccacugugcgcccgaacuccucauuguggcugagcagcucuaggaacuccgcaucgucgugguuguaccgacagccgaagcacacagcgcucaugacguuggccaccgccacaaugaccggcugcguuggaucgaggaaggcgccgcccgcacagcgccgcaccagcacugccaccaauucucgagccucugccagcgcguggcccucgagaagaccgcgacugcgcggguggcgcguggagaaagcacgcaucgugcuauaggccgagcgucgcugcgucuuccagugcucagaguagugaccgaacgccagacugcggccaccagacaccacacggaaagaggcgaagggcggccgguccgcgaagaugcugcccugcugcaccagggccugguggauggcacucucuccauucagcaccaccacgggacagcugcccagacggaucuggaaaacgucgccauagcgccuugcaaggcgagcgaaguacaagugcgacgccuggccaacagccgccgcguuuccgaucaguggccaaggaaagggaccugggggcgaggaccacgguuuccguugccacugucgcagcagccacuggccuaagugcacggcggccaggacggagaagaguagcagaagaguggucugcuggguagacagcgagcucagcugcuguggacugucugcacuaaggcugguggccaugcuggggacacaaaggcaaaccgugaaacucaggugugcaaaggaaaaaaagagugcccuccgucccgcgucucggccccagcauggggcuuuacccugggauugaguagagaggaggcagugcauaauucagguaaaggcuagcuuucugggcaagaugcuuaaaacuauguuuccuacccaacucagccuccagcagagaccuaucggcuuccaaauccccagcugccuaacgguucccagaauuccgacacaaugccgguggguggcagacacugaggcagguuucuuuuaaaguaccuaauacccccaccccugaccuucaagaacugcccugaagagaccucaggaaaguggcuccgcggacagacugaccugcgaugaagcgugguuuccagcgguguagagcagcgggaucugggagaagcucuggagccucugcccagauucuggcaaggcuucaaccugagaguccccagggaccccgagaccuagacaccugaggcccgcugcuuuagcaccuacucuugacucaaucagagccuaaacuuagauuaggauggaggacagggacaaaagugucucaaguuugcaccugggaccccgcaaagucagggcuuucucacggaguugggguugcaguugagaagggucgggggugggaguugauaaaguggaguuaaaucccagcccgcuggcaguuuucaagcuggcgucgcagaggugucugcaacgcaccccagaggcgaugcgccaucccucuacuccgggguuuuaaggacuggguagagacuggaggaagcgggaccuuaggggguggggcgugaggggcgggacgcacugcgaaaauccacagaucugugaguugggucucacauccgugcuuagugacccagggugguccagugggaaauccgcgccucuggcugggacccuccugaaacaauagcuggcagcuuuguuaggauccgccuuguaaaguuuuccuu

SEQ ID NO: 11572 - RNA, 2182 nt, Mus musculus
aaggaaaacuuuacaaggcggauccuaacaaagcugccagcuauuguuucaggagggucccagccagaggcgcggauuucccacuggaccacccugggucacuaagcacggaugugagacccaacucacagaucuguggauuuucgcagugcgucccgccccucacgccccacccccuaaggucccgcuuccuccagucucuacccaguccuuaaaaccccggaguagagggauggcgcaucgccucuggggugcguugcagacaccucugcgacgccagcuugaaaacugccagcgggcugggauuuaacuccacuuuaucaacucccacccccgacccuucucaacugcaaccccaacuccgugagaaagcccugacuuugcggggucccaggugcaaacuugagacacuuuugucccuguccuccauccuaaucuaaguuuaggcucugauugagucaagaguaggugcuaaagcagcgggccucaggugucuaggucucggggucccuggggacucucagguugaagccuugccagaaucugggcagaggcuccagagcuucucccagaucccgcugcucuacaccgcuggaaaccacgcuucaucgcaggucagucuguccgcggagccacuuuccugaggucucuucagggcaguucuugaaggucagggguggggguauuagguacuuuaaaagaaaccugccucagugucugccacccaccggcauugugucggaauucugggaaccguuaggcagcuggggauuuggaagccgauaggucucugcuggaggcugaguuggguaggaaacauaguuuuaagcaucuugcccagaaagcuagccuuuaccugaauuaugcacugccuccucucuacucaaucccaggguaaagccccaugcuggggccgagacgcgggacggagggcacucuuuuuuuccuuugcacaccugaguuucacgguuugccuuuguguccccagcauggccaccagccuuagugcagacaguccacagcagcugagcucgcugucuacccagcagaccacucuucugcuacucuucuccguccuggccgccgugcacuuaggccaguggcugcugcgacaguggcaacggaaaccgugguccucgcccccaggucccuuuccuuggccacugaucggaaacgcggcggcuguuggccaggcgucgcacuuguacuucgcucgccuugcaaggcgcuauggcgacguuuuccagauccgucugggcagcugucccgugguggugcugaauggagagagugccauccaccaggcccuggugcagcagggcagcaucuucgcggaccggccgcccuucgccucuuuccguguggugucugguggccgcagucuggcguucggucacuacucugagcacuggaagacgcagcgacgcucggccuauagcacgaugcgugcuuucuccacgcgccacccgcgcagucgcggucuucucgagggccacgcgcuggcagaggcucgagaauugguggcagugcuggugcggcgcugugcgggcggcgccuuccucgauccaacgcagccggucauuguggcgguggccaacgucaugagcgcugugugcuucggcugucgguacaaccacgacgaugcggaguuccuagagcugcucagccacaaugaggaguucgggcgcacagugggugcgggcagccugguggaugugcugcccuggcugcagcuauuucccaacccggugcgcaccaccuuccgcaaguucgagcagcucaaccgcaacuucagcaacuucguucuggacaaguuccugaggcaccgcgaaagccuggugcccggggcugcuccucgagacaugacggacgccuucauccucucugccgaaaagaaagcgucuggggccccuggcgacgauuccuccgggcuggacuuggaggaugugccugccacuauuacggacaucuucggagccagccaggacacccuuuccaccgcgcugcuguggcugcucauccucuuuaccagguaaagccuccgggagggcugggucaguccuucuuuuccuccuuugaaaaaaggagugccucugggcgcaggguuugagguuucgcgcugcgucgccccccaacccccaauuccucgaaacugagaucucagguaagauaaggccggguu

SEQ ID NO: 11573 - RNA, 1482 nt, Mus musculus
acugcuagcugcagaggcgcuaccgcaguucaggcuucccaacagguuagcuagccuaggauccacccgguauuucgcaggaagggggggggggcguugagauagcuagaggaggggaagccuuccuggaggacagagggagggagagaaagagagacaggagcuagagcgcgcgcgcggagcccuuugaaaggacuuacacuuccuaaugaauauuuauccgccgcugcuacacgcucccggcuucucuuaccuuucugcagguaagaucuucccuguuccccuacccuggugugugugugugugugugugugugugugugauccggaauucccaccccuccccacacucgggcgcggguggucagucuuuggccgacggggugaggugagggguaagguggcuucucugugugcgaugggucccgcacgaccaacacaggguggggggcacuaccuguguaggacgagagggagagagagagagagagagagagagagagagagagagagagagagagagagagagagagagaauugagauugugcgcccccgagcgcgcgucugcucuaugcgcgcauuagggacauuuuuggacuuuucucucggacgccccggaucucuugccuuugccuuucuuugguuccccucccuccucuuuuggccuccucuaccuccucccccaccucaccacuacccucgguugcagaaccacuccccacuccucugcccggcuuugugccacuggcgcgcaucccuccaagcagucucucgcgucucccacaaagaggauggagagcucuuuuuccucugugaccccuacaccaagaccucugauccaggggucccucgaccccuuuccugcagguucaaaucuugagguucugcugcgcgcugucuccuuccccccucuugggacgcagaggcucagugccagaagcugagaguaaucauuggugauuggaacuccgggguaccgggugaggcgucacaagggaucuacuaaccuggaaccccaagccagaaagcccccaugguagggugcaaguacccugccaccccgcccccaacacccgagccaccguuggcgggaggagcccagagaacucggacccgccuagggggaaagagggaggggaaagggaaggggucggggaggagcuguugauuuacacggaauucuuuaaacagacuuacccagccaccuguugagaaucagucuggggucggccagcuccggaucugcucgagguggacacacaaaagcaaaagccaagcugggaaaguaaauuucuuuggcuaugccagacgcggcaagcuaggcuaacaaccuugcgcuaggguagcaaggcuguaagauccaagaggggguugucgcaagaagacccacuacuccagcguccgccccuaucccacgccuccucagccuagaggccaggacucagggcuccugaacucggcgcucaggacucagcacccuca

SEQ ID NO: 11574 - RNA, 1482 nt, Mus musculus
ugagggugcugaguccugagcgccgaguucaggagcccugaguccuggccucuaggcugaggaggcgugggauaggggcggacgcuggaguagugggucuucuugcgacaacccccucuuggaucuuacagccuugcuacccuagcgcaagguuguuagccuagcuugccgcgucuggcauagccaaagaaauuuacuuucccagcuuggcuuuugcuuuuguguguccaccucgagcagauccggagcuggccgaccccagacugauucucaacagguggcuggguaagucuguuuaaagaauuccguguaaaucaacagcuccuccccgaccccuucccuuuccccucccucuuucccccuaggcggguccgaguucucugggcuccucccgccaacgguggcucggguguugggggcgggguggcaggguacuugcacccuaccaugggggcuuucuggcuugggguuccagguuaguagaucccuugugacgccucacccgguaccccggaguuccaaucaccaaugauuacucucagcuucuggcacugagccucugcgucccaagaggggggaaggagacagcgcgcagcagaaccucaagauuugaaccugcaggaaaggggucgagggaccccuggaucagaggucuugguguaggggucacagaggaaaaagagcucuccauccucuuugugggagacgcgagagacugcuuggagggaugcgcgccaguggcacaaagccgggcagaggaguggggagugguucugcaaccgaggguaguggugaggugggggaggagguagaggaggccaaaagaggagggaggggaaccaaagaaaggcaaaggcaagagauccggggcguccgagagaaaaguccaaaaaugucccuaaugcgcgcauagagcagacgcgcgcucgggggcgcacaaucucaauucucucucucucucucucucucucucucucucucucucucucucucucucucucucucucucccucucguccuacacagguagugccccccacccuguguuggucgugcgggacccaucgcacacagagaagccaccuuaccccucaccucaccccgucggccaaagacugaccacccgcgcccgaguguggggaggggugggaauuccggaucacacacacacacacacacacacacacacaccaggguaggggaacagggaagaucuuaccugcagaaagguaagagaagccgggagcguguagcagcggcggauaaauauucauuaggaaguguaaguccuuucaaagggcuccgcgcgcgcgcucuagcuccugucucucuuucucucccucccucuguccuccaggaaggcuuccccuccucuagcuaucucaacgcccccccccccuuccugcgaaauaccggguggauccuaggcuagcuaaccuguugggaagccugaacugcgguagcgccucugcagcuagcagu

SEQ ID NO: 11575 - RNA, 2122 nt, Mus musculus
gcaacuuccgcgaccuguaccacauccuggagaaccacaaguucacuaaggagucucacggcaagcugcaagccauguggcucgaggcgcacuaccaggaggccgagaagcugcgcggccgcccgcucggcccgguggacaaguaccgcgugcgcaagaaguucccucugccgcgcaccaucugggauggcgagcagaagacccauugcuucaaggagcggacucggagccugcugcgggagugguaccugcaggaucccuaccccaaccccagcaagaaacgcgaacuggcgcaggccaccggccucacccccacacaaguaggcaacugguuuaagaaccggcgacagcgcgaccgcgcagcggcggccaagaacaggucaguggcggggaccgcggccaggccaccacaggcuccgggcuagaaaaauggaaacggguggaaacucaggcugucggggaaugguagaggcggcugauccaguucuggagauaccggugcucucuggacaguuagagaaaaguuucugguugcccuggaacagggaacaacuggcuguggguuuauauacugcuuugcucaagaagggcuuuuuuuaucagagccagcgcugugugagcaugccccugguguccucaacccuccgugccugucccuaggggccuuaaaccccucgcgggucucuucagcccuggcaccagcuagaagacuggaaggaaaggaaaauacuacuugcuaucugauuauuucugugcaccgcaaaagggggggggcuugguuuagaggcguccauaggagucaaagaggggaaaggaggccaggguuccugccacaaagagaaggccgguggccuccaucccuugagcuggcacuggacaggagaggcaggccuggagugaagaggccuggaguguuaguguguucauggguuugaggggguggugguaggagugagagcuucaagucucccuaucgccucaguucaggagcauccacuuguuuugguccacuuauucgggaagcaaaaucgcaggugcagucauggcaggcaaguugguuacagacucacaaaguuguuugguucugguggaucuuuaaagcucaauugugagaaaguaaaaagaaaaaggagaggacggagagacgauuaguccaaagggaaaggagaggaaagaagggggguugagcagaagcucugguacaggccugggagcaggggcaacggcugcugacaguugcugguggcuggagacuuagagugugugccgguuuagguggcccaggccugaauccacgucccucucaucucugccuguggaggccacauuucgucagauggggggagcgcccaugaccagugaaaggcuuccaagaagggagacacuagguucagacaacugcuucgucacccagaaaagagacacagccuguccuucccuccugucuucucuuucuacccuuuucucccccccccccccccaucuuuuagcuuccaacuucccucuuuucucuuccccguguccugcgcccucugcguagagauccagaaaggaaagcgaugggugcucugaggagaaccccuacaguucuggggugugugcuugggaaggccguggccugagcuucuguggaauaucugguucuccggguucaguuauuugagccucggaggcugcagaagaaagcgaagcucuuccccacugucugcuggucccggcucaggguccuuugcugccugcccaggucucugcaggaggcugguuugggagucugcccuucaucugaggccuuccuuccaucuggaacgcuucccugggcugggaaaccgggagcucggacuugaguuaggaagucucugcgguacucagggggcagcugggagccuguaagaacacagagccccguugaaggcuguggcuaggggcacgccacgcgggaggccgcuguuguaggggagugcggguccagucgggccaggcuccccgcgguaugagcgaggggagcaggguggcgggccaccgagucagggcgggcauggcucucuuguuccccgcaggcuccagcaucaggccaucgggccgagcgggaugcgcucgcuggccgagcccggcugccccacgc

SEQ ID NO: 11576 - RNA, 2122 nt, Mus musculus
gcguggggcagccgggcucggccagcgagcgcaucccgcucggcccgauggccugaugcuggagccugcggggaacaagagagccaugcccgcccugacucgguggcccgccacccugcuccccucgcucauaccgcggggagccuggcccgacuggacccgcacuccccuacaacagcggccucccgcguggcgugccccuagccacagccuucaacggggcucuguguucuuacaggcucccagcugcccccugaguaccgcagagacuuccuaacucaaguccgagcucccgguuucccagcccagggaagcguuccagauggaaggaaggccucagaugaagggcagacucccaaaccagccuccugcagagaccugggcaggcagcaaaggacccugagccgggaccagcagacaguggggaagagcuucgcuuucuucugcagccuccgaggcucaaauaacugaacccggagaaccagauauuccacagaagcucaggccacggccuucccaagcacacaccccagaacuguagggguucuccucagagcacccaucgcuuuccuuucuggaucucuacgcagagggcgcaggacacggggaagagaaaagagggaaguuggaagcuaaaagaugggggggggggggggagaaaaggguagaaagagaagacaggagggaaggacaggcugugucucuuuucugggugacgaagcaguugucugaaccuagugucucccuucuuggaagccuuucacuggucaugggcgcuccccccaucugacgaaauguggccuccacaggcagagaugagagggacguggauucaggccugggccaccuaaaccggcacacacucuaagucuccagccaccagcaacugucagcagccguugccccugcucccaggccuguaccagagcuucugcucaaccccccuucuuuccucuccuuucccuuuggacuaaucgucucuccguccucuccuuuuucuuuuuacuuucucacaauugagcuuuaaagauccaccagaaccaaacaacuuugugagucuguaaccaacuugccugccaugacugcaccugcgauuuugcuucccgaauaaguggaccaaaacaaguggaugcuccugaacugaggcgauagggagacuugaagcucucacuccuaccaccacccccucaaacccaugaacacacuaacacuccaggccucuucacuccaggccugccucuccuguccagugccagcucaagggauggaggccaccggccuucucuuuguggcaggaacccuggccuccuuuccccucuuugacuccuauggacgccucuaaaccaagcccccccccuuuugcggugcacagaaauaaucagauagcaaguaguauuuuccuuuccuuccagucuucuagcuggugccagggcugaagagacccgcgagggguuuaaggccccuagggacaggcacggaggguugaggacaccaggggcaugcucacacagcgcuggcucugauaaaaaaagcccuucuugagcaaagcaguauauaaacccacagccaguuguucccuguuccagggcaaccagaaacuuuucucuaacuguccagagagcaccgguaucuccagaacuggaucagccgccucuaccauuccccgacagccugaguuuccacccguuuccauuuuucuagcccggagccugugguggccuggccgcgguccccgccacugaccuguucuuggccgccgcugcgcggucgcgcugucgccgguucuuaaaccaguugccuacuugugugggggugaggccgguggccugcgccaguucgcguuucuugcugggguugggguagggauccugcagguaccacucccgcagcaggcuccgaguccgcuccuugaagcaaugggucuucugcucgccaucccagauggugcgcggcagagggaacuucuugcgcacgcgguacuuguccaccgggccgagcgggcggccgcgcagcuucucggccuccugguagugcgccucgagccacauggcuugcagcuugccgugagacuccuuagugaacuugugguucuccaggaugugguacaggucgcggaaguugc

SEQ ID NO: 11577 - RNA, 1622 nt, Mus musculus
auuccuaacggccauucuuucagauuucuugggguggggggugggggaaugagcaagacaucaucgccauucaaagucaaacuuggggauuucaaauacccagguccagucugcagcuugcucuucugccccuacuguucgauacccugacccuggauccuucaaacgguguucaacacauccacaucaccuaacccaggugucuuguuuugcuguuccccaaggagaaauccguucccauaauccguuucucuccgaucucgauccccuaguuuccuuguccagauuuaagcccaaagcggguuacagacaguuacaggggugucuguagcuuagguuaguuuggaaagucuuagauuccgauagaaaagaaagcucccagucuuucggcagaucccaguuuaccucgcacacccgacuugcccaucaaagagagcagaaccuaaggagagcgaggucuucaagggucuggcaaguucaggaaaggcaggcuggauugccuucucuuccucagcagacauuucccccggaggccuuacaucuuuggguccuuucuacgcgggauaacucccaacucucuugugcccagcucuuaugcccagacaaggaauaggucuaccuugcauagauauugcagucauuacccagauaauacuagggagauuccaaccccugcccugaccccuaaaaaucucuuugaccuggaggugacguccuaaacccccugauccccgacgcccuugguuguucgaagaucaggcccuaagccuacgcuuaccucgcagggaauucaggcccacagcccugcccucucugaaacucgccguuuuuccaguuuaguccacaagcgacugaggaauuaguuacugaacuuacgcaccgcuuugcccgcuuuagacaaauuccgggucgcucagccuccagaaaagaccuaagcgcuguuuugagccagccugagcugcggccgagcuugguacccgggguccgggugcgauuuaguccuguccaggagcuccccauccucccgcacccguuucucccaggaccagggaagccggcgcagaugcucacuuacucguaccuuuccuuggccucggccgcccugucgcgcugccgccgguucuugaaccaguugcugacuugcgugguggugaggccgguggccucggccagcucgcgcuucucucguggcgacggguagggguugugagcguaccacucgcgcagcacgcugcggcucuucuccuugaagcaguagcuggucuccucgccgucccagauggagcggggcagcgggaacuugcgccgcacgcgguacuugcccacggcgcccagcggccggccgcgcagcuucuccgccucgauguagugcgccuugagccacaacugcugcagcuuggcgugguugugcggcgagaacugguggcucuccaggauuuuguagagcucgcggaaguugccccgguggaaggccaccacggccuuggccuugagcacgcuuucauucuuguggaggugcucgcaggcgggcagcgaccacaggaagcgacccagccgcucgauguugccgcccugcugcagcaccucgcacacgcacgccacuugcuccugcgugaagccga

SEQ ID NO: 11578 - RNA, 1622 nt, Mus musculus
ucggcuucacgcaggagcaaguggcgugcgugugcgaggugcugcagcagggcggcaacaucgagcggcugggucgcuuccuguggucgcugcccgccugcgagcaccuccacaagaaugaaagcgugcucaaggccaaggccgugguggccuuccaccggggcaacuuccgcgagcucuacaaaauccuggagagccaccaguucucgccgcacaaccacgccaagcugcagcaguuguggcucaaggcgcacuacaucgaggcggagaagcugcgcggccggccgcugggcgccgugggcaaguaccgcgugcggcgcaaguucccgcugccccgcuccaucugggacggcgaggagaccagcuacugcuucaaggagaagagccgcagcgugcugcgcgagugguacgcucacaaccccuacccgucgccacgagagaagcgcgagcuggccgaggccaccggccucaccaccacgcaagucagcaacugguucaagaaccggcggcagcgcgacagggcggccgaggccaaggaaagguacgaguaagugagcaucugcgccggcuucccugguccugggagaaacgggugcgggaggauggggagcuccuggacaggacuaaaucgcacccggaccccggguaccaagcucggccgcagcucaggcuggcucaaaacagcgcuuaggucuuuucuggaggcugagcgacccggaauuugucuaaagcgggcaaagcggugcguaaguucaguaacuaauuccucagucgcuuguggacuaaacuggaaaaacggcgaguuucagagagggcagggcugugggccugaauucccugcgagguaagcguaggcuuagggccugaucuucgaacaaccaagggcgucggggaucaggggguuuaggacgucaccuccaggucaaagagauuuuuaggggucagggcagggguuggaaucucccuaguauuaucuggguaaugacugcaauaucuaugcaagguagaccuauuccuugucugggcauaagagcugggcacaagagaguugggaguuaucccgcguagaaaggacccaaagauguaaggccuccgggggaaaugucugcugaggaagagaaggcaauccagccugccuuuccugaacuugccagacccuugaagaccucgcucuccuuagguucugcucucuuugaugggcaagucgggugugcgagguaaacugggaucugccgaaagacugggagcuuucuuuucuaucggaaucuaagacuuuccaaacuaaccuaagcuacagacaccccuguaacugucuguaacccgcuuugggcuuaaaucuggacaaggaaacuaggggaucgagaucggagagaaacggauuaugggaacggauuucuccuuggggaacagcaaaacaagacaccuggguuaggugauguggauguguugaacaccguuugaaggauccagggucaggguaucgaacaguaggggcagaagagcaagcugcagacuggaccuggguauuugaaauccccaaguuugacuuugaauggcgaugaugucuugcucauucccccaccccccaccccaagaaaucugaaagaauggccguuaggaau

SEQ ID NO: 11579 - RNA, 1074 nt, Mus musculus
uccugauuagcuggagguuagagcuucuugcaccuggggaccccuuuggugucgcugggcuggccugcaaaguccaggcuuguggaggucaaggccaggcaaacgucacuugcacugcagagguugagaugccugcagguagaggugaggcaaggcgagcucaggugccugugcaaccacagucaggugugcagaagacagugcgaggagacucggaucuacaugugccccaggguuagagccuaaagucauacggagcaagaagaaagaauggcuaccaccuucucuaaaaugugauuuguaaucuaccaaagugcgcaguuggacggaagaaacgucaagaaauugugacagcucagagagucacggagguggagcaucaagccuccugcucggguggcugggcuccgcuguucuugguaccggcuaugucuuuuaagagcuaaagaagacuuaaacacgaaaaauaccugaaagaauuaguaucauuuguacuuuucucccuuaacgauagccacacagccaagagccccaccuaagaaucugccuuuuuauguggucuagaaguggcuaaaauauacaauaaagccauuuccaguacuaaucucacccucgauucuucaaaguuaucaucuacuuagcaacaagaaacucagcaaggcacaauuuaaacaaggaaggagacuggcuuuucauuuuugugcuccacgcguaugugcaccauaguuugaucgaccgacuuuugugcuguucccggguuucuguuaugugauguuucuuggcgguacugcauugcugccuucugcgcugcgcuugugcaguaggaugagggcaggcucugauucacagaugccaccucagcggcuuaaaccccaaggacaaaucugacaauuucaaccaccgauuuucagcgggcaaguuucacaacagaggcggguacaguugacaauccauaggaagaaagaguucauucccuuucgcggucucuguguaaagaugcucgguaggcauuggggugcaaccucgccuucugaccucagcuacccuucccuaggacgaaguagcaauagcaaa

SEQ ID NO: 11580 - RNA, 1074 nt, Mus musculus
uuugcuauugcuacuucguccuagggaaggguagcugaggucagaaggcgagguugcaccccaaugccuaccgagcaucuuuacacagagaccgcgaaagggaaugaacucuuucuuccuauggauugucaacuguacccgccucuguugugaaacuugcccgcugaaaaucggugguugaaauugucagauuuguccuugggguuuaagccgcugagguggcaucugugaaucagagccugcccucauccuacugcacaagcgcagcgcagaaggcagcaaugcaguaccgccaagaaacaucacauaacagaaacccgggaacagcacaaaagucggucgaucaaacuauggugcacauacgcguggagcacaaaaaugaaaagccagucuccuuccuuguuuaaauugugccuugcugaguuucuuguugcuaaguagaugauaacuuugaagaaucgagggugagauuaguacuggaaauggcuuuauuguauauuuuagccacuucuagaccacauaaaaaggcagauucuuagguggggcucuuggcuguguggcuaucguuaagggagaaaaguacaaaugauacuaauucuuucagguauuuuucguguuuaagucuucuuuagcucuuaaaagacauagccgguaccaagaacagcggagcccagccacccgagcaggaggcuugaugcuccaccuccgugacucucugagcugucacaauuucuugacguuucuuccguccaacugcgcacuuugguagauuacaaaucacauuuuagagaaggugguagccauucuuucuucuugcuccguaugacuuuaggcucuaacccuggggcacauguagauccgagucuccucgcacugucuucugcacaccugacugugguugcacaggcaccugagcucgccuugccucaccucuaccugcaggcaucucaaccucugcagugcaagugacguuugccuggccuugaccuccacaagccuggacuuugcaggccagcccagcgacaccaaagggguccccaggugcaagaagcucuaaccuccagcuaaucagga

SEQ ID NO: 11581 - RNA, 1368 nt, Mus musculus
aaagguagggcggcagccgucuuuggggcucacggaaggucggcggagguguagcccgggcgcccgggucgcccucggacucgaggaacgcugcgccgcacagcgggagcccucgaggcuggguuugggaagugcucaggcgcucuccuuuucgucggucuccucaguccuuuagaaaucccaaaucguuguuuacggauuucaguuuccaacuuuguaauugaaaaaacaugcggaggagauuuaggcaucaucauucuuccgagugaguuugucgagcuugccacucucccggguccucugcccucgcccgaugacccuuccgcggucccagacgucacacugccacaggccggcuguuuucccgggacucgggauguccucggugcgcgcgcggcacaucuggcaacgauuaggugcccgcggaguucagcuggcuaggaaagugcguuuggcaucucucuccaucggauccacugacuggaaaauaacugcuccuuucccuacgcccgcccagggaauaguuguccccacgugugcccagagaaugccacaaaucuuacugauauugguccccuaggugauguccucugcaggcggguuuauuggagugucagauuuuaucuugcuuuuuaaaagaaucuggagaccacggccuggggguggggagcaaucuucagucuaguggaaacaugcggauuugucagcagaaccuugauuuaugugggagauaaauaauuacagucggaccaucggagauggggugcgucguuaaaaaauagacgggaguaguguuuacuuaaggcugaaguugcugguuugggacugggguaaaacguuucauucccugcgcgguccugggcugaaugcgaaaugacuucugaguuuccagccacaccagacuacgugaugugaucuguuaggcugaggggggcgcccuaggagcuccaggaauuuggaaaguaucuuugcuccgugagguucgugcugaacuacguggagaucccgguccuguggaagcaaucgccuuccaaaggcgcugccgugucuucacuggagggaacugcaaggaacgugacuguaagccaggugcuaagaggcuugucccaaggaaaggauacucagaacaggccacaacuuuaugaguugagacuuuuuguuuguuuguuuguuuuuuguuuuuucgagacaggguuucucuguguagccuggcuguccuggaacccacucuguagaccaggcgccugccuuugccucacaagugcugggauuaaugcaugagccaccacugccccgcugacuugagacuuuuaaaacgcugugauaugcuuucuugcucugccucuguuucuauugccuugccccuua

SEQ ID NO: 11582 - RNA, 1368 nt, Mus musculus
uaaggggcaaggcaauagaaacagaggcagagcaagaaagcauaucacagcguuuuaaaagucucaagucagcggggcagugguggcucaugcauuaaucccagcacuugugaggcaaaggcaggcgccuggucuacagaguggguuccaggacagccaggcuacacagagaaacccugucucgaaaaaacaaaaaacaaacaaacaaacaaaaagucucaacucauaaaguuguggccuguucugaguauccuuuccuugggacaagccucuuagcaccuggcuuacagucacguuccuugcaguucccuccagugaagacacggcagcgccuuuggaaggcgauugcuuccacaggaccgggaucuccacguaguucagcacgaaccucacggagcaaagauacuuuccaaauuccuggagcuccuagggcgccccccucagccuaacagaucacaucacguagucugguguggcuggaaacucagaagucauuucgcauucagcccaggaccgcgcagggaaugaaacguuuuaccccagucccaaaccagcaacuucagccuuaaguaaacacuacucccgucuauuuuuuaacgacgcaccccaucuccgaugguccgacuguaauuauuuaucucccacauaaaucaagguucugcugacaaauccgcauguuuccacuagacugaagauugcuccccacccccaggccguggucuccagauucuuuuaaaaagcaagauaaaaucugacacuccaauaaacccgccugcagaggacaucaccuaggggaccaauaucaguaagauuuguggcauucucugggcacacguggggacaacuauucccugggcgggcguagggaaaggagcaguuauuuuccagucaguggauccgauggagagagaugccaaacgcacuuuccuagccagcugaacuccgcgggcaccuaaucguugccagaugugccgcgcgcgcaccgaggacaucccgagucccgggaaaacagccggccuguggcagugugacgucugggaccgcggaagggucaucgggcgagggcagaggacccgggagaguggcaagcucgacaaacucacucggaagaaugaugaugccuaaaucuccuccgcauguuuuuucaauuacaaaguuggaaacugaaauccguaaacaacgauuugggauuucuaaaggacugaggagaccgacgaaaaggagagcgccugagcacuucccaaacccagccucgagggcucccgcugugcggcgcagcguuccucgaguccgagggcgacccgggcgcccgggcuacaccuccgccgaccuuccgugagccccaaagacggcugccgcccuaccuuu

SEQ ID NO: 11583 - RNA, 800 nt, Mus musculus
acuuuccgcccuccgagggguguccaguauuucuccacugcuuucaagcugucgccuggucucccaccgcgcauuggcccagggggcuggcugaugcauuagaggcagcagcgagccuggcacuugcaggguugggacucuggcucgcgcgcugucggggcagccagccuuugugaccugagcacagcccacugcacccuugccagguccuuguguggcgcucuccuuuguauauaccccgacacucccggugcuuuuguuauuuaaagacaguguaguguauugucgcucugaagaggaacuuaaaacguuucagcccaaacucucaucacccaucucugccucauccuucuaaaaucaagaugaguucugaugccuuucaagagagccgauuuauuaagaauuaucuaguaagaagaaaauagagggauuuaaaaaauacgggagaauggaaggggaaucacguguguugcguuaauuuuuguuugcuuuugaaaauuaagcucuaagcccuguugugaaagaagccuugggaacucaaagcauccagguguucugcuucagaaagcaagcuggcuuaccugagagccugccuggccaucaaaugccuaguagcuguccucaacauguuuaagggcggcuaccacagaguuucuucaggcccguaguuuagauugaaaugagcggcucccagugugaugggauguagcugugauggagaaagaguguguuggugaggaaugcuuaggcuuuaaagaauggugguugccaccaagcccacucacugcacucccaccgca

SEQ ID NO: 11584 - RNA, 800 nt, Mus musculus
ugcggugggagugcagugagugggcuugguggcaaccaccauucuuuaaagccuaagcauuccucaccaacacacucuuucuccaucacagcuacaucccaucacacugggagccgcucauuucaaucuaaacuacgggccugaagaaacucugugguagccgcccuuaaacauguugaggacagcuacuaggcauuugauggccaggcaggcucucagguaagccagcuugcuuucugaagcagaacaccuggaugcuuugaguucccaaggcuucuuucacaacagggcuuagagcuuaauuuucaaaagcaaacaaaaauuaacgcaacacacgugauuccccuuccauucucccguauuuuuuaaaucccucuauuuucuucuuacuagauaauucuuaauaaaucggcucucuugaaaggcaucagaacucaucuugauuuuagaaggaugaggcagagaugggugaugagaguuugggcugaaacguuuuaaguuccucuucagagcgacaauacacuacacugucuuuaaauaacaaaagcaccgggagugucgggguauauacaaaggagagcgccacacaaggaccuggcaagggugcagugggcugugcucaggucacaaaggcuggcugccccgacagcgcgcgagccagagucccaacccugcaagugccaggcucgcugcugccucuaaugcaucagccagcccccugggccaaugcgcggugggagaccaggcgacagcuugaaagcaguggagaaauacuggacaccccucggagggcggaaagu

SEQ ID NO: 11585 - RNA, 2060 nt, Mus musculus
aacacgucucugcaguucuuuucuugaggagagaggaguucuagggagauggagauaguuuaagaaugaauuccucauuuagcacugagccugaccuauggcagauacuuaguaaagaucuuaguaaagagugaguggccuggacucgugguucaggaugacuucaacugggcauggaggcacaucccuuuaaccagagcauuuggagguagaggcaggccgaucuugaucuuuaugaguuugaggccagccaaggauacauagccagacugucucaaaaacaaaacaaaacaaacaaaaccacaacaaaacccaaacaaaaacaaaaccaacaaacacauuguuauuuuaaaaaauauuuauuugugagcacagauggacaacuuucaggagugaguuuuccccuuccguguggauccugaggguuaaaaucaggggucaaguuugcuggcuuuuacccacugaaccaucuugacugccuuucuuuccuuacaucguggauuaagauuuuaauaaauuuaaagcagaggauucguugacgaggacccucagaaaccaggaggaugcaaauguuccuuaaacaaagaggcgaucuccuaggagcaaagccagaguuccugacaaggccacugcuugggaugauggagcuccggcggugacuacgccagaguuaaacuucuccgagugggauucagaguccaaaaagggauuuccuuuaagugacagguuccccacuuggggcagcucaucugggcuaggguuccuauccagccuguuguaacugagauccagcacgcugagcuuggcuggcagcccuuuagguaccugcuucagcccagugaaagacagauugagcgaguuuagcugacugggccagucacaacucggagcgccugcagcaucccgcagugaauugugacuaaggucuaguccuugcagcuguacccuugcugcggccagcgcagagcacacgccgcugggcgucuccauccccgcguuacgcagcgcuaaaacuuggagggucgggaacuugaggggacagagggcugagaucaguccucucucgcccaauucaggauugucagacaggucuaagguggagagggcagggaagacgcggaccuguucgcaggaaaaguugagcgagugugcuugggcaauacucaguaccuugaguccaggcuuuagccacugcugcaguucugcgagccaggcaucccuuguugcccacgacacguugcggagguucaagauguugagaucggguccgguggcuuccagaagcgguggcggcgcggugccgguuaccucgagauuuucaagagucaguuccuggaggccggaaaucccgagcacacgcagggcuccgaauagaauccgacuaggaauccgcgcggcccgcaccguaagccgcuuuaaggacagagacuugauaauaucagugaacugccccagaucugcuuccguguccacacgcuuuagaagguauuccaggcugcggccgccgccguacaauuccacaucugccgcccccaaacaauugaaagcgcuggaccaaucuggcuucggaucugagaaguugcaggaacaacuuuccucgucuagcucgcagggcucugguggggcgggagaggcgugcaccagaagcaacagcaacaagccaagcacacgcuccugaggagaaaguaggggucagggagacuccugccagacccugagauuccucagguuggcuccaguuccaccccaagacugucugacucaccauggucgguagauucugaaaguuugagcagcccagauaggcuccgagaaaggcuucaguuucuuuccuuuacagcggugguguucucuggcuuccagguuccacgggcuuguucgaccaauuuggcagccccuguaaauuuauguaauccuggggugucacccugucccuuccucugugaauucuaauugcgucuccacuucucuuccuccuaacagcccuacucacuucuaguaaauauugcaacgaaguguuuuuuaggaagggacgaaaaacaggaagaauucagaguggc

SEQ ID NO: 11586 - RNA, 2060 nt, Mus musculus
gccacucugaauucuuccuguuuuucgucccuuccuaaaaaacacuucguugcaauauuuacuagaagugaguagggcuguuaggaggaagagaaguggagacgcaauuagaauucacagaggaagggacagggugacaccccaggauuacauaaauuuacaggggcugccaaauuggucgaacaagcccguggaaccuggaagccagagaacaccaccgcuguaaaggaaagaaacugaagccuuucucggagccuaucugggcugcucaaacuuucagaaucuaccgaccauggugagucagacagucuugggguggaacuggagccaaccugaggaaucucagggucuggcaggagucucccugaccccuacuuucuccucaggagcgugugcuuggcuuguugcuguugcuucuggugcacgccucucccgccccaccagagcccugcgagcuagacgaggaaaguuguuccugcaacuucucagauccgaagccagauugguccagcgcuuucaauuguuugggggcggcagauguggaauuguacggcggcggccgcagccuggaauaccuucuaaagcguguggacacggaagcagaucuggggcaguucacugauauuaucaagucucuguccuuaaagcggcuuacggugcgggccgcgcggauuccuagucggauucuauucggagcccugcgugugcucgggauuuccggccuccaggaacugacucuugaaaaucucgagguaaccggcaccgcgccgccaccgcuucuggaagccaccggacccgaucucaacaucuugaaccuccgcaacgugucgugggcaacaagggaugccuggcucgcagaacugcagcaguggcuaaagccuggacucaagguacugaguauugcccaagcacacucgcucaacuuuuccugcgaacagguccgcgucuucccugcccucuccaccuuagaccugucugacaauccugaauugggcgagagaggacugaucucagcccucuguccccucaaguucccgacccuccaaguuuuagcgcugcguaacgcggggauggagacgcccagcggcgugugcucugcgcuggccgcagcaaggguacagcugcaaggacuagaccuuagucacaauucacugcgggaugcugcaggcgcuccgaguugugacuggcccagucagcuaaacucgcucaaucugucuuucacugggcugaagcagguaccuaaagggcugccagccaagcucagcgugcuggaucucaguuacaacaggcuggauaggaacccuagcccagaugagcugccccaaguggggaaccugucacuuaaaggaaaucccuuuuuggacucugaaucccacucggagaaguuuaacucuggcguagucaccgccggagcuccaucaucccaagcaguggccuugucaggaacucuggcuuugcuccuaggagaucgccucuuuguuuaaggaacauuugcauccuccugguuucugaggguccucgucaacgaauccucugcuuuaaauuuauuaaaaucuuaauccacgauguaaggaaagaaaggcagucaagaugguucaguggguaaaagccagcaaacuugaccccugauuuuaacccucaggauccacacggaaggggaaaacucacuccugaaaguuguccaucugugcucacaaauaaauauuuuuuaaaauaacaauguguuuguugguuuuguuuuuguuuggguuuuguugugguuuuguuuguuuuguuuuguuuuugagacagucuggcuauguauccuuggcuggccucaaacucauaaagaucaagaucggccugccucuaccuccaaaugcucugguuaaagggaugugccuccaugcccaguugaagucauccugaaccacgaguccaggccacucacucuuuacuaagaucuuuacuaaguaucugccauaggucaggcucagugcuaaaugaggaauucauucuuaaacuaucuccaucucccuagaacuccucucuccucaagaaaagaacugcagagacguguu

SEQ ID NO: 11587 - RNA, 2332 nt, Mus musculus
agaccuacaggggaccugagccagcaaugggagggagcagcgcgcggaggaagcgccccggccgcccgcagguacuguuuauccugcugcugccuuuguucugucccgcgcugggccagccgguccgcuacuccaucccugaggagcuggaccgcgggucggugguggggaagcucgccaaggaccuggggcucaguguccuggaagugucggcucggaagcugcgggucagcgcugagaagcugcacuucagcguggauucggagagcggggacuuacuggugaaggaccgcauagaucgcgagcaaauaugcaaagggaggagaaagugugagcugcaguuggaagcugugcuagaaaacccuuuaaauauuuuucaugucguuguggagauugaggauguuaaugaucacgcuccucaauuuccaaaagacgaaauaaaccuagagauaagugaauccgacagcccaggggcgagaacaauucuggagucagcaaaagaucuugacauugguaugaauucucuaaguaaauaccaguuaaguccuaacgacuacuuuuuauuguuggugaaagacaauccugaugguaguaaauacccagaauuagaauugcaaaagaugcuggaccgagaagcagagagcacacaccaccugaugcugacugcuguagaugguggggacccgccccguacugguacuacucagcuccgaauccgagugguggacgccaaugauaaccgcccaguguucagccaagacguguacagaguccgccuuccagaagacuugccuccaggaaccacaguccuaaggcuaaaggcaauggaucaagacgagggcaucaaugcagaauuuacauauuccuuccuagguguggcuaacaaagcccaguucucucuggaucccauaacaggagauauuguaacucgccagucguuggauuuugaagaaguagagcaauauacgauugauguggaggcaaaggaccgaggaucucuuucuucacaguguaaaguaauuauagagguucuagaugagaacgacaaccgcccagaaauaaucaucacuucucucucugaucagauuucggaggauucuccuuccggaacuguuguggcccucuucaagguacgggaucgagauucuggggaaaacgcagaagucaugugcaguuuaagcggaaacaauccauuuaagauucauucuucuuccaacaauuacuacaaguuaguaacagauagcauccuagaccgggaacagaccccaggguacaacguuacuaucacagccacugauaggggcaagccgccccuuuccuccagcacaaccaucacucugaacgucgcugaugucaacgacaaugcaccuguuuuccaacagcaggccuaccugauaaacguagcagaaaacaaccagcccgguaccuccauaacccaagucaaagcaugggauccagaugugggauccaauggccucgucuccuacuccaucauagccagcgaccuagaaccaaaagcgcugucguccuucguguccgugaaccaggacaguggaguaguguacgcgcagcgugccuuugaccaugagcagauucgcuccuuccagcugacuuuacaagcgcgagaccaggggucgccugcgcucagcgccaacgugagcaugcgcgugcugguggacgaccgcaacgacaacgcgccacgcgugcuguaucccacgcuggagcccgauggcucugcacucuucgacaugguaccccgugccgcugagccuggauaccuggucaccaaagugguggcuguggaugcagacucaggacacaaugccuggcugucuuaccacgugcugcaggccagcgaucccggucucuucagccuggggcugcgcacgggcgaggugcgcacagcgcgugccuugagcgacaaggaugcagcucgucagcgccuucuggucgcugugcgugaugguggacagccaccucugucugccacugcuacacugcuccuaguuuuugcagacagccuacaagaagcguugccagaccucgucgaucaucccauccccuccgacccucagagugagcuucaguuuuaccuggugguggcuuuggccuugaucucagugcuuuuccuucucgcaguaauuuucgccauugcuuugcgccugcgacagucuuccagcccuucauccacugguugcuuugggucgguucuugguuccaaaucuagaccaguacuuccacccaacuacagcgagggaacauugcccuaugccuauaaucugugcgugccgggagaucaacuuaaaccagaauuuaauuacuucucauccgu

SEQ ID NO: 11588 - RNA, 2332 nt, Mus musculus
acggaugagaaguaauuaaauucugguuuaaguugaucucccggcacgcacagauuauaggcauagggcaauguucccucgcuguaguuggguggaaguacuggucuagauuuggaaccaagaaccgacccaaagcaaccaguggaugaagggcuggaagacugucgcaggcgcaaagcaauggcgaaaauuacugcgagaaggaaaagcacugagaucaaggccaaagccaccaccagguaaaacugaagcucacucugagggucggaggggaugggaugaucgacgaggucuggcaacgcuucuuguaggcugucugcaaaaacuaggagcaguguagcaguggcagacagagguggcuguccaccaucacgcacagcgaccagaaggcgcugacgagcugcauccuugucgcucaaggcacgcgcugugcgcaccucgcccgugcgcagccccaggcugaagagaccgggaucgcuggccugcagcacgugguaagacagccaggcauuguguccugagucugcauccacagccaccacuuuggugaccagguauccaggcucagcggcacgggguaccaugucgaagagugcagagccaucgggcuccagcgugggauacagcacgcguggcgcguugucguugcggucguccaccagcacgcgcaugcucacguuggcgcugagcgcaggcgaccccuggucucgcgcuuguaaagucagcuggaaggagcgaaucugcucauggucaaaggcacgcugcgcguacacuacuccacuguccugguucacggacacgaaggacgacagcgcuuuugguucuaggucgcuggcuaugauggaguaggagacgaggccauuggaucccacaucuggaucccaugcuuugacuuggguuauggagguaccgggcugguuguuuucugcuacguuuaucagguaggccugcuguuggaaaacaggugcauugucguugacaucagcgacguucagagugaugguugugcuggaggaaaggggcggcuugccccuaucaguggcugugauaguaacguuguacccuggggucuguucccggucuaggaugcuaucuguuacuaacuuguaguaauuguuggaagaagaaugaaucuuaaauggauuguuuccgcuuaaacugcacaugacuucugcguuuuccccagaaucucgaucccguaccuugaagagggccacaacaguuccggaaggagaauccuccgaaaucugaucagagagagaagugaugauuauuucugggcgguugucguucucaucuagaaccucuauaauuacuuuacacugugaagaaagagauccucgguccuuugccuccacaucaaucguauauugcucuacuucuucaaaauccaacgacuggcgaguuacaauaucuccuguuaugggauccagagagaacugggcuuuguuagccacaccuaggaaggaauauguaaauucugcauugaugcccucgucuugauccauugccuuuagccuuaggacugugguuccuggaggcaagucuucuggaaggcggacucuguacacgucuuggcugaacacugggcgguuaucauuggcguccaccacucggauucggagcugaguaguaccaguacggggcggguccccaccaucuacagcagucagcaucagguggugugugcucucugcuucucgguccagcaucuuuugcaauucuaauucuggguauuuacuaccaucaggauugucuuucaccaacaauaaaaaguagucguuaggacuuaacugguauuuacuuagagaauucauaccaaugucaagaucuuuugcugacuccagaauuguucucgccccugggcugucggauucacuuaucucuagguuuauuucgucuuuuggaaauugaggagcgugaucauuaacauccucaaucuccacaacgacaugaaaaauauuuaaaggguuuucuagcacagcuuccaacugcagcucacacuuucuccucccuuugcauauuugcucgcgaucuaugcgguccuucaccaguaaguccccgcucuccgaauccacgcugaagugcagcuucucagcgcugacccgcagcuuccgagccgacacuuccaggacacugagccccagguccuuggcgagcuuccccaccaccgacccgcgguccagcuccucagggauggaguagcggaccggcuggcccagcgcgggacagaacaaaggcagcagcaggauaaacaguaccugcgggcggccggggcgcuuccuccgcgcgcugcucccucccauugcuggcucagguccccuguaggucu

SEQ ID NO: 11589 - RNA, 797 nt, Mus musculus
accaggauaguggcgugguguucgcgcagcgcgccuucgaccacgaacagcugcgcuccuuccagcugacacugcaggcgcgcgaccagggaaagcccucgcucagcgccaacgugagcaugcgggugcuggugggugaccgcaacgacaacgcgccacgcgugcuguaucccacacucgagcccgacggcucugcgcucuucgacauggugccgcgugcugccgagcccggauaccuggucaccaaagugguggcgguggaugcagacucuggacacaaugccuggcuaucuuaccacgugcugcaggccagcgaucccgggcucuucagccugggacugcgcacaggcgaggugcgcacagcgcgugcccugggagacagggacucagcgcggcagcgccuucuggucgcugugcgugaugguggacaaccaccgcucucggcuacagccacgcugcaccucaucuucgcugacagccugcaggagguccugccagaccucagagaugaaccuuugcugucugacucccaaagugagcuucaguuuuaccuggugguggccuuggccuuggucucagugcucuuucuuuucguugugauccuggccauuguccuucgccuucgacagucccaugguccugcugucucagacuauuuucagucgggccucugcuguaagacgagaccagagguuucucucaacuaaggcgaggggacucuuccuuauuccuacaaucucuauguugccuccaauugucaaaagacaauuucucaauuucuuaccuugacuccagaa

SEQ ID NO: 11590 - RNA, 797 nt, Mus musculus
uucuggagucaagguaagaaauugagaaauugucuuuugacaauuggaggcaacauagagauuguaggaauaaggaagaguccccucgccuuaguugagagaaaccucuggucucgucuuacagcagaggcccgacugaaaauagucugagacagcaggaccaugggacugucgaaggcgaaggacaauggccaggaucacaacgaaaagaaagagcacugagaccaaggccaaggccaccaccagguaaaacugaagcucacuuugggagucagacagcaaagguucaucucugaggucuggcaggaccuccugcaggcugucagcgaagaugaggugcagcguggcuguagccgagagcggugguuguccaccaucacgcacagcgaccagaaggcgcugccgcgcugagucccugucucccagggcacgcgcugugcgcaccucgccugugcgcagucccaggcugaagagcccgggaucgcuggccugcagcacgugguaagauagccaggcauuguguccagagucugcauccaccgccaccacuuuggugaccagguauccgggcucggcagcacgcggcaccaugucgaagagcgcagagccgucgggcucgagugugggauacagcacgcguggcgcguugucguugcggucacccaccagcacccgcaugcucacguuggcgcugagcgagggcuuucccuggucgcgcgccugcagugucagcuggaaggagcgcagcuguucguggucgaaggcgcgcugcgcgaacaccacgccacuauccuggu

SEQ ID NO: 11591 - RNA, 550 nt, Mus musculus
aauuaacucucucuccaagucagcaugcccaggaggucaugucccacuucccagcccuugucccacuuccuaccccuugucugcgcugaauagcagucaaaacuaggaucaaaaccuaagaccgggcuguggaaauccauaccuggccaggcaguuuucuuccgcagcgcaucucagguuguacauagacaucuucuggacguacguggaagccuggauguaguaggggucgggcaccagguccgggagaccuaaagauaagacaagcugaugaccucugacuccuaaaccuguuugucaccuuucgcccaccaagucugcaggguggggcugaguguguggaagaacagggaaagucgggguuaggaaggaaagggaaaaggaaacugcuggugccaggagcgcgguuuccaucagauuccagagcuggcgggacaggcugggguuggggguuggggagggggggcguuguugagucugcgggaccggaucccgccgccgcgcccaggccgccacgucuagacagcacugaccggcggccaggguggcc

SEQ ID NO: 11592 - RNA, 550 nt, Mus musculus
ggccacccuggccgccggucagugcugucuagacguggcggccugggcgcggcggcgggauccggucccgcagacucaacaacgcccccccuccccaacccccaaccccagccugucccgccagcucuggaaucugauggaaaccgcgcuccuggcaccagcaguuuccuuuucccuuuccuuccuaaccccgacuuucccuguucuuccacacacucagccccacccugcagacuuggugggcgaaaggugacaaacagguuuaggagucagaggucaucagcuugucuuaucuuuaggucucccggaccuggugcccgaccccuacuacauccaggcuuccacguacguccagaagaugucuauguacaaccugagaugcgcugcggaagaaaacugccuggccagguauggauuuccacagcccggucuuagguuuugauccuaguuuugacugcuauucagcgcagacaagggguaggaagugggacaagggcugggaagugggacaugaccuccugggcaugcugacuuggagagagaguuaauu

SEQ ID NO: 11593 - RNA, 624 nt, Mus musculus
gggugcuggcagcugcgcugcugcuccgcgcacacccgagcguccucuccgagcgcugcacggaugagaagagccggcgcauccuggcugcgcugguaggucccgccgccgcauugcccagugucgcgcguccaggucggguuccagacaccuucuccggguccucggaguccacgucaccugcgaugcugcaacaucguagcggccacuccauccugggauaugggaaugggguggggguacccgccaaagggagauuagguuccuaugcgcguaugauauacccaggcaaagagcucucaguucgcuaugggcgaucgggacaucccuccuuuuucuccagaauauagucuugcgucccgggacagcauucaugccagaaaguuugcagggccauuccuggucagugaugcuuacauccaguucuaguggccagguuuggaggauauacaucuuucuuacgcuaucucgccccuuaagccaccauccuucggugaucccaugggacugccggaacaccccaaccugaucaaaccccauuguuugauuguugcuugggcuccuccuccugaugaccuaaagacaaggccuuuggcuguucggguccagaggaaccgaggcaga

SEQ ID NO: 11594 - RNA, 624 nt, Mus musculus
ucugccucgguuccucuggacccgaacagccaaaggccuugucuuuaggucaucaggaggaggagcccaagcaacaaucaaacaaugggguuugaucagguugggguguuccggcagucccaugggaucaccgaaggaugguggcuuaaggggcgagauagcguaagaaagauguauauccuccaaaccuggccacuagaacuggauguaagcaucacugaccaggaauggcccugcaaacuuucuggcaugaaugcugucccgggacgcaagacuauauucuggagaaaaaggagggaugucccgaucgcccauagcgaacugagagcucuuugccuggguauaucauacgcgcauaggaaccuaaucucccuuuggcggguacccccaccccauucccauaucccaggauggaguggccgcuacgauguugcagcaucgcaggugacguggacuccgaggacccggagaaggugucuggaacccgaccuggacgcgcgacacugggcaaugcggcggcgggaccuaccagcgcagccaggaugcgccggcucuucucauccgugcagcgcucggagaggacgcucgggugugcgcggagcagcagcgcagcugccagcaccc

SEQ ID NO: 11595 - RNA, 1268 nt, Mus musculus
ucuccuacauguacauugaguugaauuucccuuuccucuuguggccaggugaaccuggacugucaguuguggacuuggagaugccuccugcaaguuaauccgcucucauucauaucuaucagaucuggacagcuccuccccaggugucugcccauucuuuccuguucauuccaucuauaucccaggucuuuucaggacagucccuuuaaaauaccgauugaaucaccaaagaaguuuugucuuuccucucaccuccuggcguaggucuauucuguuaucucccaaguuagaccaaauaucucucaagaagaaaguaagauuccauaaacuuugccugcacagacuuuucugcaaccgugggcgagagaguacaccaaugcacacuugccuacacacugggacaaauacacauguccaggaaaacagcggcugaggcagccaaacugugggcaacuauuaagggcauguuaaagucccugcuguagccaaaggggaugcgcugcgcugaugaggcaucaaaggagaauuucgaaucgggcuuggagaaagaagaccuaaaaauggugaaucuaaacacacagagaaagacaccuuuuacaccugcugucagcacucggcaguucuccccagagucacacacuuuugagagaaaucguuguagguuacaccaaauguaauaaaucucuaugacucauauaucuuuggaacugacaaucccuguguucuacuggacuucuagcuguggucaccaugagcccagcgcacuugagaauagggaccuaggcgcuccagagcccucaccucggugugcagaguaccucaggcaggugccaagcucuggucgguucaagcaacaagcggacuaucugggcaaggcagguugcccugguacccgcgcgggucaccucuccccgcccccauccccagcagcccuccuggucgcagaagcagagaagaaggagaaagccgaguuaaccacucaccccuagcuuccugcugcggauuuucacguagcccugcuugacuaugucguuaaaguuggaggccauggccagagcggucggguuccucugcugggcgauccgcuucucggagucgacaaccgcuguccgccgcccgguccacgcaggucucgcauccagccggccgccgccagcagucgcgccgccgcugauuucuccccaggcuccugcuggcgcggacccggggucgauagcugggccgccacacacggagacaagggauccgggcccggaacugcucagcag

SEQ ID NO: 11596 - RNA, 1268 nt, Mus musculus
cugcugagcaguuccgggcccggaucccuugucuccguguguggcggcccagcuaucgaccccggguccgcgccagcaggagccuggggagaaaucagcggcggcgcgacugcuggcggcggccggcuggaugcgagaccugcguggaccgggcggcggacagcgguugucgacuccgagaagcggaucgcccagcagaggaacccgaccgcucuggccauggccuccaacuuuaacgacauagucaagcagggcuacgugaaaauccgcagcaggaagcuaggggugagugguuaacucggcuuucuccuucuucucugcuucugcgaccaggagggcugcuggggaugggggcggggagaggugacccgcgcggguaccagggcaaccugccuugcccagauaguccgcuuguugcuugaaccgaccagagcuuggcaccugccugagguacucugcacaccgaggugagggcucuggagcgccuaggucccuauucucaagugcgcugggcucauggugaccacagcuagaaguccaguagaacacagggauugucaguuccaaagauauaugagucauagagauuuauuacauuugguguaaccuacaacgauuucucucaaaagugugugacucuggggagaacugccgagugcugacagcagguguaaaaggugucuuucucuguguguuuagauucaccauuuuuaggucuucuuucuccaagcccgauucgaaauucuccuuugaugccucaucagcgcagcgcauccccuuuggcuacagcagggacuuuaacaugcccuuaauaguugcccacaguuuggcugccucagccgcuguuuuccuggacauguguauuugucccaguguguaggcaagugugcauugguguacucucucgcccacgguugcagaaaagucugugcaggcaaaguuuauggaaucuuacuuucuucuugagagauauuuggucuaacuugggagauaacagaauagaccuacgccaggaggugagaggaaagacaaaacuucuuuggugauucaaucgguauuuuaaagggacuguccugaaaagaccugggauauagauggaaugaacaggaaagaaugggcagacaccuggggaggagcuguccagaucugauagauaugaaugagagcggauuaacuugcaggaggcaucuccaaguccacaacugacaguccagguucaccuggccacaagaggaaagggaaauucaacucaauguacauguaggaga

SEQ ID NO: 11597 - RNA, 1438 nt, Mus musculus
uaaguugacgugcaggcugucaaggcguccucccuaaauaaacuagguacacuggcuuccuggaguaccuuacggcucuaagaaccaucuuuugcuuaguguccuccacgagcugaaccgaggugggacugucucaaaggcaagcaagguacauuggguuuauuucccagcagcuccuggaccgucaggcaggaguccagggaaauucggugguccugaaucuggacccucauuucaauaccaccaaaguuauggggccaaguuuucucuuacaauguagcccaaguuucagcggaaacuccagcucugcuccuuuccauucccuggcccuccccuccaaaguggcaucgcuccagugcuccucuccugccucaugaaagcccggguuuucuggauuuacgacacgagagccggaggucgccugagcggugacacaccccacugcguccccuguagcgcggcgcgggcaggagaucccgggccugagagcggcaaagccucgguuuggaguccccuucccccacccacgcuccuucagcgccgggggucgaaucgcgacgagaaucugcguccccacgcucgacugaccggcgccgaccgcugguccgugcgccccgcccucccggcgccgggagcccgaggcgccucaccuggcacguagaucucgccgcgcucuucguccgggagcucgcuccaguuccucuugcacguggagacgcauggcuucuucaccaggaacgcgcgaggcaucuucaguuccuccuggcccggcgcgguucgcucugguaagucgaguucguguggucgucccaccuuuucuuccaccggaucgggguugaggcgcgggaauagggacaguucaaggaaagagucgccgaggcguguccacguucuuaggacagaguguaccagggaccacgcguggcguuuccaacuacgccgaaggucgccgguguccacagagagggugcagccaggugcaccgggaucgcagaagcgcuaagccagcguccuuuagcucgacuggcguccccgcggcugcucgcgaagucuucaagugcgagcuggacggacggguucacgcuuuauuggcucgcggcgguguguguugguggcucgggcgggggugggguagggguguugaucugaucuaauuagcuuggaguggccgagagagcgauggcgcaugcguugggaaauaacggugacaacccaccuauuuguuaccugucgaaccgguuuccauuccgcugcgggugagguggccucgcggcccgggcgggguggcacgacgggggcaggguuagggggcgugcuccgguccccacacccagaagcacccggcccgccccggaccuccccugcccagcgugcucacguuugcaaacuagaguuucggagggagcgggcacggaaagggaggggagggcaacguuau

SEQ ID NO: 11598 - RNA, 1438 nt, Mus musculus
auaacguugcccuccccucccuuuccgugcccgcucccuccgaaacucuaguuugcaaacgugagcacgcugggcaggggagguccggggcgggccgggugcuucuggguguggggaccggagcacgcccccuaacccugcccccgucgugccaccccgcccgggccgcgaggccaccucacccgcagcggaauggaaaccgguucgacagguaacaaauagguggguugucaccguuauuucccaacgcaugcgccaucgcucucucggccacuccaagcuaauuagaucagaucaacaccccuaccccacccccgcccgagccaccaacacacaccgccgcgagccaauaaagcgugaacccguccguccagcucgcacuugaagacuucgcgagcagccgcggggacgccagucgagcuaaaggacgcuggcuuagcgcuucugcgaucccggugcaccuggcugcacccucucuguggacaccggcgaccuucggcguaguuggaaacgccacgcguggucccugguacacucuguccuaagaacguggacacgccucggcgacucuuuccuugaacugucccuauucccgcgccucaaccccgauccgguggaagaaaaggugggacgaccacacgaacucgacuuaccagagcgaaccgcgccgggccaggaggaacugaagaugccucgcgcguuccuggugaagaagccaugcgucuccacgugcaagaggaacuggagcgagcucccggacgaagagcgcggcgagaucuacgugccaggugaggcgccucgggcucccggcgccgggagggcggggcgcacggaccagcggucggcgccggucagucgagcguggggacgcagauucucgucgcgauucgacccccggcgcugaaggagcgugggugggggaaggggacuccaaaccgaggcuuugccgcucucaggcccgggaucuccugcccgcgccgcgcuacaggggacgcaguggggugugucaccgcucaggcgaccuccggcucucgugucguaaauccagaaaacccgggcuuucaugaggcaggagaggagcacuggagcgaugccacuuuggaggggagggccagggaauggaaaggagcagagcuggaguuuccgcugaaacuugggcuacauuguaagagaaaacuuggccccauaacuuuggugguauugaaaugaggguccagauucaggaccaccgaauuucccuggacuccugccugacgguccaggagcugcugggaaauaaacccaauguaccuugcuugccuuugagacagucccaccucgguucagcucguggaggacacuaagcaaaagaugguucuuagagccguaagguacuccaggaagccaguguaccuaguuuauuuagggaggacgccuugacagccugcacgucaacuua

SEQ ID NO: 11599 - RNA, 3899 nt, Mus musculus
cugucacucuguugggcuucucccggauuaggucguccagguccugcuccagaaaagaggugaacccuacuuccucuuugccuaaaauuaguuuucacugaccacguuugcuccucucucccauaacuuaccgacuuuuauuacaauagaaacucuuaccugaaaaugggcuuucauuaauuaaucugauuuacaagauaguauaaacacagacaccaggaaguuacauuuauucagaccagugcagcauuuagcucaaugccaaguuugcugaccuuccuggagcacccucucggucugggaccauugucucagucucucgacaggcgccuucucaccggucgcgggguccccuaagaaugcaccaacaccgaguguagggagcuccccuugcugucagcccugccggcugcggugggcuccaagagaggggcugugggugaggcggcggccgcgcacacgguggagggagcaggcagcugcugcgacgccguggggacagacaacgccggcggcagcguggucacgggugguagcgcaggcgugggcuugaugggcaccgguacagcuggcaggcucugguuugccgaguggcacagagccuugacuggcaccccgaaugccccauacuccgggccuaccgggaccccagcugcggcggcagcagcggcagccgcggcuaccgaauccaucacgccaacaugaggccacacggagccgacaacauugcugagcuggcccggcacgggguagcccaaguggugcaugaccgacgccaaaggcaacccuccagccugcagcacgcccuuguagucccgcccgaugauguucucuauggcgaacggauguuugaagccugugguggacgcggcggcugcagcggcggcggcggcggccgagcccagcccguagggugggaacugagacagacgccccacgcugcccaccgcugcggccgccgccgcugcugcggccgccgccacggccgccgccuccugcaucuugccgggaugggacgucugcggaggcugcgacugcggcuguggcugcugcgcgggcugcgacgggagguguggaggcugcggagccggagccggcugcugguggaaauagggcaccaugugcggcggcggcggcgggggcggcugcggcggguggugaugguggugauggugugcggcgugguggugauggugguggugguggugugcgugguggggaugguggggaugcaggugaccuccuggccccgugccgggcgcgcccuugcugcuuccugaguguaggugagcguggucugcgcguagcaccuugaagcgcuugcggcgccgcaggaagcugccguucucgaacaugucaccgcagucaggguguagcgcccagaagcugcccuuaccggguugguccggccuccgagggaucuugaugaaacagucguugaaggagagguuguggcgcaggcuguucugccagcgcugcgugugcucgcgguaguaggggaagcgcuccaugaugaacuuguagaugucgcucagaggcagcaucuucucagccgaaugcuggauggccauggcggucagugagauguaagaguagggcggcuuuuggucgcuguaggaacucuucccuggccguggcaucuucccaggcucuuccacuuccguccggcccacagugggccuuaacgccucucggaaagccggauaccaggcuuaaguguccccacuaauucucucuccaccugcgcagccugauccccagcuuucuugguccccagaccccuuuugccuugguccuccuccuucggggagcugccccggguccccgcaauuggcuuuuugagccaauacaguuuuauggcgcucacaacuucuggucuugacugucgugggcaggcccucacaguagccagagagacucgccagcuuuaccuugcuuuucuccgucucguccuccucuuggaugacuagacuugagcucuggagcgaaaggcuguggaaugaguuucuuuuuggucucuuuucccuuuaucgguacaaaggcagcucagaucaaaccaacuggauaaugaagacuggcuuuuuaagcucgaguccacacuagcugucccgaggccacuggugaccgaucuuucgacccuggaagcugaccugguacugggucuguccgcgcuggaguucaaaucuuacaaaaagggguagacaggguaagaagagagagagggagcgcgcacuuuccuauccgcuacuguacguacguacccucuuuuuucaggagaucugcaggcaagcugaaaauggaagaggcaccgagcucuagguggugguuccaagaaaaaaguuuggugcugucuacagcagcggcgcccaccgucaggcucuauggaggggacggugucagaacucccggagcuagccgcaggcugcagggggcgucugcguagacaggcuaggacccggcucgcccgguccgaacagccgucugagcugcagcugcagccgcucugccccgcggguuuugagaagacgcgcugcuguggcagcgacgcgcucuccuggcugcguuuuguaaugguccccgagacgccgagaccccugcagcuugcgcuucgagacuaucacaugaccgaggcugagggacuccgccgccgccgccuccacagccucuucuuuugcugaagaaggggcaagaaggcacaauuucucgucuccgccccuucuccauuuccacuggucaccccgacccuucgcuuucacuucccgcuugccagcccaggcuucagccgucugaccacugagaaggggucacugucuaguugugggggucugcuguuccacagcaagggggcacggcacugcuuucucacccgucaggucuugcauagcucucucccuuuaucauucagucuuuucacccacucucccuuaguuucccgguggccuagccauuuaggucuccaguuuggagcaccuuugucuccagcuccuuuucucuuggagaaacagagacgcccagaggguuguaaguggaaaccaauagaaagaagagcuggggccuacagaucggcccauuuuuuggcagguucagcgaggcacgaauugcucuuugcaccccagaaccuugauuuagggggcagaaagauaauaggcagggaauuaggaggcaagaagcuuggcggguggagaaacuccaacacgucuuccugaaaggggcggacagacggcgugaggucucuuugggguggcgauauuagaggcaggggaaagaaugaggaguugggagucgaggggcuccguuaccuaacugugcagcacucuccucaccaagggaggaauaccauuaaaaucacucuggaagccuuggugugaccuguaagggagcaggggcugagccagggguaaagguccccuaccaccccccacccccacuuggaugaagcacucauccuggaaauggcaaugcguauucaaagaacuuaaaaucucauucugguuggcuacguuugaccccaagcuggcagggaaagaagcauuuagaaacaaccauauucucuauucccgucucgggaucucacuuucaguauuuuuccuguaguuggaaaauuucagaguucuuuccaguucccucacuugagagcaguuaaaggcagcaggugccucagauuuuaauuucuucucugcuaagcauaaguccuaaaucuuggcucaguggcuagaaaggcuacguacggguccaaggaaaucaggauuuugguaagugguaaaaugggcgcggguguguggguccuuacuugguuucuagguagagacccuggagugaggcaagcaggaaagauucguuuucuuuuucuccuuuuuagccggcagggaaccuucuggcuccugcuguuuggccaguuu

SEQ ID NO: 11600 - RNA, 3899 nt, Mus musculus
aaacuggccaaacagcaggagccagaagguucccugccggcuaaaaaggagaaaaagaaaacgaaucuuuccugcuugccucacuccagggucucuaccuagaaaccaaguaaggacccacacacccgcgcccauuuuaccacuuaccaaaauccugauuuccuuggacccguacguagccuuucuagccacugagccaagauuuaggacuuaugcuuagcagagaagaaauuaaaaucugaggcaccugcugccuuuaacugcucucaagugagggaacuggaaagaacucugaaauuuuccaacuacaggaaaaauacugaaagugagaucccgagacgggaauagagaauaugguuguuucuaaaugcuucuuucccugccagcuuggggucaaacguagccaaccagaaugagauuuuaaguucuuugaauacgcauugccauuuccaggaugagugcuucauccaaguggggguggggggugguaggggaccuuuaccccuggcucagccccugcucccuuacaggucacaccaaggcuuccagagugauuuuaaugguauuccucccuuggugaggagagugcugcacaguuagguaacggagccccucgacucccaacuccucauucuuuccccugccucuaauaucgccaccccaaagagaccucacgccgucuguccgccccuuucaggaagacguguuggaguuucuccacccgccaagcuucuugccuccuaauucccugccuauuaucuuucugcccccuaaaucaagguucuggggugcaaagagcaauucgugccucgcugaaccugccaaaaaaugggccgaucuguaggccccagcucuucuuucuauugguuuccacuuacaacccucugggcgucucuguuucuccaagagaaaaggagcuggagacaaaggugcuccaaacuggagaccuaaauggcuaggccaccgggaaacuaagggagagugggugaaaagacugaaugauaaagggagagagcuaugcaagaccugacgggugagaaagcagugccgugcccccuugcuguggaacagcagacccccacaacuagacagugaccccuucucaguggucagacggcugaagccugggcuggcaagcgggaagugaaagcgaagggucggggugaccaguggaaauggagaaggggcggagacgagaaauugugccuucuugccccuucuucagcaaaagaagaggcuguggaggcggcggcggcggagucccucagccucggucaugugauagucucgaagcgcaagcugcaggggucucggcgucucggggaccauuacaaaacgcagccaggagagcgcgucgcugccacagcagcgcgucuucucaaaacccgcggggcagagcggcugcagcugcagcucagacggcuguucggaccgggcgagccggguccuagccugucuacgcagacgcccccugcagccugcggcuagcuccgggaguucugacaccguccccuccauagagccugacggugggcgccgcugcuguagacagcaccaaacuuuuuucuuggaaccaccaccuagagcucggugccucuuccauuuucagcuugccugcagaucuccugaaaaaagaggguacguacguacaguagcggauaggaaagugcgcgcucccucucucucuucuuacccugucuaccccuuuuuguaagauuugaacuccagcgcggacagacccaguaccaggucagcuuccagggucgaaagaucggucaccaguggccucgggacagcuaguguggacucgagcuuaaaaagccagucuucauuauccaguugguuugaucugagcugccuuuguaccgauaaagggaaaagagaccaaaaagaaacucauuccacagccuuucgcuccagagcucaagucuagucauccaagaggaggacgagacggagaaaagcaagguaaagcuggcgagucucucuggcuacugugagggccugcccacgacagucaagaccagaaguugugagcgccauaaaacuguauuggcucaaaaagccaauugcggggacccggggcagcuccccgaaggaggaggaccaaggcaaaaggggucuggggaccaagaaagcuggggaucaggcugcgcagguggagagagaauuaguggggacacuuaagccugguauccggcuuuccgagaggcguuaaggcccacugugggccggacggaaguggaagagccugggaagaugccacggccagggaagaguuccuacagcgaccaaaagccgcccuacucuuacaucucacugaccgccauggccauccagcauucggcugagaagaugcugccucugagcgacaucuacaaguucaucauggagcgcuuccccuacuaccgcgagcacacgcagcgcuggcagaacagccugcgccacaaccucuccuucaacgacuguuucaucaagaucccucggaggccggaccaacccgguaagggcagcuucugggcgcuacacccugacugcggugacauguucgagaacggcagcuuccugcggcgccgcaagcgcuucaaggugcuacgcgcagaccacgcucaccuacacucaggaagcagcaagggcgcgcccggcacggggccaggaggucaccugcauccccaccauccccaccacgcacaccaccaccaccaccaucaccaccacgccgcacaccaucaccaccaucaccacccgccgcagccgcccccgccgccgccgccgcacauggugcccuauuuccaccagcagccggcuccggcuccgcagccuccacaccucccgucgcagcccgcgcagcagccacagccgcagucgcagccuccgcagacgucccaucccggcaagaugcaggaggcggcggccguggcggcggccgcagcagcggcggcggccgcagcggugggcagcguggggcgucugucucaguucccacccuacgggcugggcucggccgccgccgccgccgcugcagccgccgcguccaccacaggcuucaaacauccguucgccauagagaacaucaucgggcgggacuacaagggcgugcugcaggcuggaggguugccuuuggcgucggucaugcaccacuugggcuaccccgugccgggccagcucagcaauguugucggcuccguguggccucauguuggcgugauggauucgguagccgcggcugccgcugcugccgccgcagcuggggucccgguaggcccggaguauggggcauucggggugccagucaaggcucugugccacucggcaaaccagagccugccagcuguaccggugcccaucaagcccacgccugcgcuaccacccgugaccacgcugccgccggcguugucuguccccacggcgucgcagcagcugccugcucccuccaccgugugcgcggccgccgccucacccacagccccucucuuggagcccaccgcagccggcagggcugacagcaaggggagcucccuacacucgguguuggugcauucuuaggggaccccgcgaccggugagaaggcgccugucgagagacugagacaauggucccagaccgagagggugcuccaggaaggucagcaaacuuggcauugagcuaaaugcugcacuggucugaauaaauguaacuuccuggugucuguguuuauacuaucuuguaaaucagauuaauuaaugaaagcccauuuucagguaagaguuucuauuguaauaaaagucgguaaguuaugggagagaggagcaaacguggucagugaaaacuaauuuuaggcaaagaggaaguaggguucaccucuuuucuggagcaggaccuggacgaccuaauccgggagaagcccaacagagugacag

SEQ ID NO: 11601 - RNA, 558 nt, Mus musculus
guugacaacaguuguaauagccuuagaggaaagagagacuggcaaagccacgcagaguccaccuuaagaaaaaaacgucuggcuccccuuucagaacgaccucucccccuuucucaagugccccaaggcucccugaagauaauuguuugauggaaggguccacuuucaggucuuguuguuagaucacagagggaggcaaggaaagauaaacuuucaagugcucaaacacaagccagugacgaugugucaggagaacccuugcaugagcacgcguuugcagguggcgccaccuuagcuuugacagaaccagagcauuucauuugauuccuggguccucaaaggcaaggugguucuaauuuaaaaaggaguccaagacucaccauuuuugcaguaguucccggggcagcacauagcgugccucaugcagcgcuuccugcgcuuucggcaagccagacagaucuguacaccuccgacgccggcugccccgcggcuggggcuggagcaguacucgucagagccgcacuccucaucuucagcgcaaggguagggcugugggaa

SEQ ID NO: 11602 - RNA, 558 nt, Mus musculus
uucccacagcccuacccuugcgcugaagaugaggagugcggcucugacgaguacugcuccagccccagccgcggggcagccggcgucggagguguacagaucugucuggcuugccgaaagcgcaggaagcgcugcaugaggcacgcuaugugcugccccgggaacuacugcaaaaauggugagucuuggacuccuuuuuaaauuagaaccaccuugccuuugaggacccaggaaucaaaugaaaugcucugguucugucaaagcuaagguggcgccaccugcaaacgcgugcucaugcaaggguucuccugacacaucgucacuggcuuguguuugagcacuugaaaguuuaucuuuccuugccucccucugugaucuaacaacaagaccugaaaguggacccuuccaucaaacaauuaucuucagggagccuuggggcacuugagaaagggggagaggucguucugaaaggggagccagacguuuuuuucuuaagguggacucugcguggcuuugccagucucucuuuccucuaaggcuauuacaacuguugucaac

SEQ ID NO: 11603 - RNA, 1306 nt, Mus musculus
cgcagagugcccagcauuuugucccagugugugaaguaaggagcaaaauugcaguuaaacugagagugaugcaugucguggugagccacgcccccguaccagccaaagggcacaagucugugaguggaccacgggaagucauagcccgagugguccuccaccgacagccagauguuaaucacgugaaagguaaagauggugagugggugacaccgaagcaccgcgacguucagcacgucgaagaaggucagcgaaagcagcucccagaagcucauguauugggucgccagcgcgaaggaggacgaguucuggugaugcaccuuguggaaggugcgguacagccagggcaccuuauggugcagcaggugccacgcgaagaucucggugucgaagagcagcaggcagaucaggacgugacuuaggagcuggacgagcucaggggccuccugggggaggagcgccgggcugcgcacccagugcagcagcgucaccgggaacacgaacaccaggugcugguagagugucagccccaggcaaggcagaagcugcuuuacggaaggcgagaaguccggguggaucuuguagcgucgcaggauggggacccagggauacaggacguccagcaccacgaacgguaggcagaagcccacguaagugaugauagaaaaggugacugggaagaugggugagcgcgugaacgccucccuuguccuuauggugucccagaggggcugcaggagcagcuggcuggaacagcccaggucuuggagcuccgaaccguuguagcagcccaugcugagacuaugucccacaauuguggucuccccagccccgccgacuuuucuuaagacuguggccacuccccccagugacgucacccuuccgucuccuucccaccucccuuucccugcuaaagaauuuugcuuaaauaacccgaauuuuguuccugucuauguccugguuuauagcugcaucaaaucuccccuucacgcaagcagcggcccuuaaagcccuuucccagacguaaagaacuguuugcuugccuuucagcugauguacuaaugacacaggagagagcgauucugccuugggacaguucacccgccaucaccgcuaaaaacuaaugaguucuucgcucucagaaggcgcuguuucucaaccaaagcagaauucccuggguuuuaaaauaucuguuuuugacuguuuaaagacuuauucuacaccuugggggacucugagugugcguaccucacgccacagugcugguacuggguccguugcagacagggauugaguccuguaggag

SEQ ID NO: 11604 - RNA, 1306 nt, Mus musculus
cuccuacaggacucaaucccugucugcaacggacccaguaccagcacuguggcgugagguacgcacacucagagucccccaagguguagaauaagucuuuaaacagucaaaaacagauauuuuaaaacccagggaauucugcuuugguugagaaacagcgccuucugagagcgaagaacucauuaguuuuuagcggugauggcgggugaacugucccaaggcagaaucgcucucuccugugucauuaguacaucagcugaaaggcaagcaaacaguucuuuacgucugggaaagggcuuuaagggccgcugcuugcgugaaggggagauuugaugcagcuauaaaccaggacauagacaggaacaaaauucggguuauuuaagcaaaauucuuuagcagggaaagggaggugggaaggagacggaagggugacgucacuggggggaguggccacagucuuaagaaaagucggcggggcuggggagaccacaauugugggacauagucucagcaugggcugcuacaacgguucggagcuccaagaccugggcuguuccagccagcugcuccugcagccccucugggacaccauaaggacaagggaggcguucacgcgcucacccaucuucccagucaccuuuucuaucaucacuuacgugggcuucugccuaccguucguggugcuggacguccuguaucccuggguccccauccugcgacgcuacaagauccacccggacuucucgccuuccguaaagcagcuucugccuugccuggggcugacacucuaccagcaccugguguucguguucccggugacgcugcugcacugggugcgcagcccggcgcuccucccccaggaggccccugagcucguccagcuccuaagucacguccugaucugccugcugcucuucgacaccgagaucuucgcguggcaccugcugcaccauaaggugcccuggcuguaccgcaccuuccacaaggugcaucaccagaacucguccuccuucgcgcuggcgacccaauacaugagcuucugggagcugcuuucgcugaccuucuucgacgugcugaacgucgcggugcuucggugucacccacucaccaucuuuaccuuucacgugauuaacaucuggcugucgguggaggaccacucgggcuaugacuucccgugguccacucacagacuugugcccuuuggcugguacgggggcguggcucaccacgacaugcaucacucucaguuuaacugcaauuuugcuccuuacuucacacacugggacaaaaugcugggcacucugcg

SEQ ID NO: 11605 - RNA, 1090 nt, Mus musculus
aaugcaaagauuuuuauaauugaacugucccagagguaugacgauucucagucauuugucugggcuguuucagcucagacagcugguagcuacauucuuacaauguuagucuccuggguuagaagaaaacaggaacagaaagccaacaaacucauaaguaauuuucgaucucauggguacuacuaaugcgugccaaccuccucuuaaaauucccucaacaacgugcccauuuuuuauucuuacuuuucccaacuaagaaauggggggcugggaggaagcaguccaagaacuuacagcucaccagugaaggcgccaaggagauucugcaaucuucuggcuucaggauuaauuaaucacaggccccuggagguuuauuuggcgcuccuggggugaggcgcccggggcgggguaggcuccagccauuucccugugcuuaacgaucaacacggcccccucacuucgcaggguuaccagauccccaaaggcuggagcgugauguauagcauccgagacacgcaugagacagccgcaguguaccguagcccgcccgagggcuucgauccggagcgcuuuggcguggagaguggagacgcgcggggcuccgguggccgcuuucauuacaucccguucggcggcggcgcgcgcagcugccuggggcaggagcuagcgcaggcggugcugcaacugcucgcagucgagcuggugcgcaccgcgcgcugggagcuggccacaccugccuuccccguaaugcagacggugcccaucgugcacccgguggacgggcugcugcucuuuuuccacccucuuccgacuucgggugcgggagauggguuacccuucugauucguugcuucucuagccuuggcucgcccaguagcugaugcguacacaccggccaaucuucagagcccuagguccucaucgcgcguauauucaucgagucacagguuuaacaaaugcuuaccggacagcucugcuagacugaaaguuguagaaugagccacagacaccgcaguggagaagagcugggcuuggggaaagagagcagguggcaugccccacaccgcaggcacaucccaagaucuaaaag

SEQ ID NO: 11606 - RNA, 1090 nt, Mus musculus
cuuuuagaucuugggaugugccugcgguguggggcaugccaccugcucucuuuccccaagcccagcucuucuccacugcggugucuguggcucauucuacaacuuucagucuagcagagcuguccgguaagcauuuguuaaaccugugacucgaugaauauacgcgcgaugaggaccuagggcucugaagauuggccgguguguacgcaucagcuacugggcgagccaaggcuagagaagcaacgaaucagaaggguaacccaucucccgcacccgaagucggaagaggguggaaaaagagcagcagcccguccaccgggugcacgaugggcaccgucugcauuacggggaaggcagguguggccagcucccagcgcgcggugcgcaccagcucgacugcgagcaguugcagcaccgccugcgcuagcuccugccccaggcagcugcgcgcgccgccgccgaacgggauguaaugaaagcggccaccggagccccgcgcgucuccacucuccacgccaaagcgcuccggaucgaagcccucgggcgggcuacgguacacugcggcugucucaugcgugucucggaugcuauacaucacgcuccagccuuuggggaucugguaacccugcgaagugagggggccguguugaucguuaagcacagggaaauggcuggagccuaccccgccccgggcgccucaccccaggagcgccaaauaaaccuccaggggccugugauuaauuaauccugaagccagaagauugcagaaucuccuuggcgccuucacuggugagcuguaaguucuuggacugcuuccucccagccccccauuucuuaguugggaaaaguaagaauaaaaaaugggcacguuguugagggaauuuuaagaggagguuggcacgcauuaguaguacccaugagaucgaaaauuacuuaugaguuuguuggcuuucuguuccuguuuucuucuaacccaggagacuaacauuguaagaauguagcuaccagcugucugagcugaaacagcccagacaaaugacugagaaucgucauaccucugggacaguucaauuauaaaaaucuuugcauu

SEQ ID NO: 11607 - RNA, 1624 nt, Mus musculus
uaccaugggcuucccauucuuuggggaaacauugcagauggugcuucagguaagggagcucgggaagggaccugacgcuucccccggaguccgccucagcucugggccugggcugaaggugggauaaguguccucgcgagggaggcgaccacggcuuggaagaggggcuagacggagaccagaugcuccccggcgcccccucaugcggguugcgggucucucuccuccaccucccucucagcggaggaaguuucugcagaugaagcgcaggaaauacggcuucaucuacaagacgcaucuguuugggcggcccacggugcgggugaugggcgcggauaaugugcggcgcaucuugcugggagagcaccgguuggugucggugcacuggcccgcgucggugcgcaccauccugggcgcuggcugccucuccaaccugcacgauuccucgcacaagcagcgaaagaaggugagggugagcuggcaacuccuuggcuggcagggagaccucauccuauggcuugguucaggcaaauagaugcggggcgagggcuaguccuaugugguggggaccaggacccucucuaucugagauccacuuuagcuuuucugcuagcacguggguuaguccuggggggacugaaauucuugaaaggguacucggaaaggcgaaggggggggggcugagggaaaguagaggauuguaacacucucugcuccuggggggugcucaggugauuaugcaggccuucagccgcgaggcacuccagugcuacgugcccgugaucgcugaggaagucagcaguugucuggagcaguggcuaagcugcggcgagcgcggccuccuggucuaccccgaggugaagcgccucauguuccgcaucgccaugcgcauccugcugggcugcgagccggguccagcgggcggcggggaggacgagcagcagcucguggaggcuuucgaggagaugacccgcaaucucuucucucuucccauugacgugcccuuuagcggccuguaccggguaagggcgguuugcggagucggaguaggggaacgcaagcucgggcauccgcucaccgccacgcucucuccgcgcucagggcgugaaggcgcggaaccuuauacacgcgcgcaucgaggagaacauucgcgccaagauccgccggcuucaggcuacagagccggauggggguugcaaggacgcgcugcagcuccugauugagcacucgugggagaggggagagaggcuggauaugcaggugagaagcaauuucaaaaggugccaagggccggggagugccucugacuuuccagacacacuuucugggggucuccaaagcccugucaaggccccagcuacuuccaagugggcggcgaugcuaggucuagagcuuuucaaccugugggucgugaccccuucacggagccaaacaacccuuucagaagggucgccuaagagcaucugcauauccgauauuuacaucaagaaacauaacaguagcaaaauuaccguuaugaaguagcaacaaagauaauuuuaucguugggggucaccacaacacgaggaaccguauuaaaggguggcauuggucuagagagcuguggaaggggguggcugagcaa

SEQ ID NO: 11608 - RNA, 1624 nt, Mus musculus
uugcucagccacccccuuccacagcucucuagaccaaugccacccuuuaauacgguuccucguguuguggugacccccaacgauaaaauuaucuuuguugcuacuucauaacgguaauuuugcuacuguuauguuucuugauguaaauaucggauaugcagaugcucuuaggcgacccuucugaaaggguuguuuggcuccgugaaggggucacgacccacagguugaaaagcucuagaccuagcaucgccgcccacuuggaaguagcuggggccuugacagggcuuuggagacccccagaaagugugucuggaaagucagaggcacuccccggcccuuggcaccuuuugaaauugcuucucaccugcauauccagccucucuccccucucccacgagugcucaaucaggagcugcagcgcguccuugcaacccccauccggcucuguagccugaagccggcggaucuuggcgcgaauguucuccucgaugcgcgcguguauaagguuccgcgccuucacgcccugagcgcggagagagcguggcggugagcggaugcccgagcuugcguuccccuacuccgacuccgcaaaccgcccuuacccgguacaggccgcuaaagggcacgucaaugggaagagagaagagauugcgggucaucuccucgaaagccuccacgagcugcugcucguccuccccgccgcccgcuggacccggcucgcagcccagcaggaugcgcauggcgaugcggaacaugaggcgcuucaccucgggguagaccaggaggccgcgcucgccgcagcuuagccacugcuccagacaacugcugacuuccucagcgaucacgggcacguagcacuggagugccucgcggcugaaggccugcauaaucaccugagcaccccccaggagcagagaguguuacaauccucuacuuucccucagccccccccccuucgccuuuccgaguacccuuucaagaauuucaguccccccaggacuaacccacgugcuagcagaaaagcuaaaguggaucucagauagagaggguccugguccccaccacauaggacuagcccucgccccgcaucuauuugccugaaccaagccauaggaugaggucucccugccagccaaggaguugccagcucacccucaccuucuuucgcugcuugugcgaggaaucgugcagguuggagaggcagccagcgcccaggauggugcgcaccgacgcgggccagugcaccgacaccaaccggugcucucccagcaagaugcgccgcacauuauccgcgcccaucacccgcaccgugggccgcccaaacagaugcgucuuguagaugaagccguauuuccugcgcuucaucugcagaaacuuccuccgcugagagggagguggaggagagagacccgcaacccgcaugagggggcgccggggagcaucuggucuccgucuagccccucuuccaagccguggucgccucccucgcgaggacacuuaucccaccuucagcccaggcccagagcugaggcggacuccgggggaagcgucaggucccuucccgagcucccuuaccugaagcaccaucugcaauguuuccccaaagaaugggaagcccauggua

SEQ ID NO: 11609 - RNA, 798 nt, Mus musculus
guugggaguucucaaaauccugccuugcauaugaguauuuaaggaaaggagacuauugcuuccagaacacugccuggcugggaguccaccgggaggggccugggcugugacccagcucagacacauaguucccuccucuuggauaucggucucuagcucugccgauguuccagauuguccuacugucucagagauuccacuccaagagacagaguggagugguaaugugugagacagcgugaaguaagucacaguggaugaucagggaaaugguacccgauaagcccaaaggcccuuccgaacuuggauuagguauuuuaggcugagaauccagucgcuucuaaucccacauccccuaaauucagacagggcugaggguucugccucucgaagcccuucccaacggugccgcugaacagaaacgcagugauuuggccauguaugccccacuacucacuuccucgcuggagaaaggaggcuacaccccaguacuucaucuugaacuuggcaggaucuucagugucugugaaagugcccaccaugucugcacacacuucccaguugcugcaaaagccaagagaauccugagccaagccaggaaagggcuucuaccucauccaagguacucuuuucccaucccagugaggguugggcucccagggagccaaaggcaaggugggaggcacuuuggaacgccgcacacagcccaccagaggccacugaccucagaagacggacucgucccuuggcuguggcgcucauaugacccuucucguccacagaaaacucagcgaugau

SEQ ID NO: 11610 - RNA, 798 nt, Mus musculus
aucaucgcugaguuuucuguggacgagaagggucauaugagcgccacagccaagggacgaguccgucuucugaggucaguggccucuggugggcugugugcggcguuccaaagugccucccaccuugccuuuggcucccugggagcccaacccucacugggaugggaaaagaguaccuuggaugagguagaagcccuuuccuggcuuggcucaggauucucuuggcuuuugcagcaacugggaagugugugcagacauggugggcacuuucacagacacugaagauccugccaaguucaagaugaaguacugggguguagccuccuuucuccagcgaggaagugaguaguggggcauacauggccaaaucacugcguuucuguucagcggcaccguugggaagggcuucgagaggcagaacccucagcccugucugaauuuaggggaugugggauuagaagcgacuggauucucagccuaaaauaccuaauccaaguucggaagggccuuugggcuuaucggguaccauuucccugaucauccacugugacuuacuucacgcugucucacacauuaccacuccacucugucucuuggaguggaaucucugagacaguaggacaaucuggaacaucggcagagcuagagaccgauauccaagaggagggaacuaugugucugagcugggucacagcccaggccccucccgguggacucccagccaggcaguguucuggaagcaauagucuccuuuccuuaaauacucauaugcaaggcaggauuuugagaacucccaac

SEQ ID NO: 11611 - RNA, 1090 nt, Mus musculus
ugggcaaagaagguucagaaaaguaaaguacccaaaagccuaggaauugggaggaggggaaguuaggguuacaggccuugaaacgagggcccucagggcuucccuaaccacccgccucuucucaaaguucccgaggucagggaaggaguagcgcuugucugggugucggcaguucaggucaaagaaacugccuagcgaccccaagcauccuugagaugaggaaaggaauacggcauuuaugagggacgucuccaaggcuuccagggauuccgcagcucggaaaaccgagcgugcugugaguugcacaagguacaggucagaguugggagagaacuagugggaauacccagagcuucaaguuuauaaagguuggaaggaaaaaggagacagugccagggcgcuguguauaggggcuuggcaccuaucggggaguacagaugaggguuuggggagaggaucaguccgaggcgcucugggcgcaaaggcgcuaccuggaggcgcgguggcaggcaggugcccgaacugcaccgcgaugcagaggucguuguccagggggaacuuguggcagugcagcaucucgggccaagggaaaccguaggccuccaugagcggagcgcagccggcgcgcacggcuucgcacagcgagcggcagggguagaugggucgguccaggcagacgggagcgaagagcgagcagaggaagaccugggugucugaguggcagcgcuuggccagcaguggcagccagcugcuugccugcugcuucaccucggccaggcucucgugcuccagcagguugggcagccgcaugcgcuuguagcccaccgugugacagagcggcagaucggcggggaugucgaggcacugcgguggcuuggaguaggagcggccgugcagcggcucggccugccaaccguaguagucguacuccuggccgcguguuggcgccccaugcagcgccccgagcagcaacgccagugcggccguccgugcgcuccaggccacccacauggcuggauguugcggccugccccgacggcucggugcucggcgccccgcugcccggcgugcgccccggcugggauguucc

SEQ ID NO: 11612 - RNA, 1090 nt, Mus musculus
ggaacaucccagccggggcgcacgccgggcagcggggcgccgagcaccgagccgucggggcaggccgcaacauccagccauguggguggccuggagcgcacggacggccgcacuggcguugcugcucggggcgcugcauggggcgccaacacgcggccaggaguacgacuacuacgguuggcaggccgagccgcugcacggccgcuccuacuccaagccaccgcagugccucgacauccccgccgaucugccgcucugucacacggugggcuacaagcgcaugcggcugcccaaccugcuggagcacgagagccuggccgaggugaagcagcaggcaagcagcuggcugccacugcuggccaagcgcugccacucagacacccaggucuuccucugcucgcucuucgcucccgucugccuggaccgacccaucuaccccugccgcucgcugugcgaagccgugcgcgccggcugcgcuccgcucauggaggccuacgguuucccuuggcccgagaugcugcacugccacaaguucccccuggacaacgaccucugcaucgcggugcaguucgggcaccugccugccaccgcgccuccagguagcgccuuugcgcccagagcgccucggacugauccucuccccaaacccucaucuguacuccccgauaggugccaagccccuauacacagcgcccuggcacugucuccuuuuuccuuccaaccuuuauaaacuugaagcucuggguauucccacuaguucucucccaacucugaccuguaccuugugcaacucacagcacgcucgguuuuccgagcugcggaaucccuggaagccuuggagacgucccucauaaaugccguauuccuuuccucaucucaaggaugcuuggggucgcuaggcaguuucuuugaccugaacugccgacacccagacaagcgcuacuccuucccugaccucgggaacuuugagaagaggcgggugguuagggaagcccugagggcccucguuucaaggccuguaacccuaacuuccccuccucccaauuccuaggcuuuuggguacuuuacuuuucugaaccuucuuugccca

SEQ ID NO: 11613 - RNA, 2662 nt, Mus musculus
ugaagccacuucgagggcugcaagggcaaguacggucuggacccugcccucagggacucacaaucuaaagugacaaucgagcggacacuaaguacagcuuuggcacuagaugggagagugacaagugacauuacugagcaaguuccgaggaagaggaccucuaggugaggugaucuggcggaguuuccuuggagguauuuaagcuuuuccucggagaacagcuuuccacuguggaaaugagggugggaaaggcacuccagguggcgaggacagcuagagcaaaggugagguggaauuugacacgucgcucauauuuccacagauacaacacuccucuccuuagaaauccgcagucuggccucucagaacugccccuggucgggaaggugcagccagguggagcgggaaucggugauucggacacccgguuuuuugcagcuuuucccaccgcgacuuggaucucaggacccuauucuagucccugucuauuucugguagcgcagcaacaucccacuggguggacgcagagggcguggcccacauacacaagaaccaauugggaaggaggccaggaugccgaccccgccccuugacgugacgcagggcccccggacagaggcuucacagccccggccccaguccuugcaguggcuguaacaaaacccagacccccaggucccggccaauggaggggauuuagacuggaccgcgucugucaaaagcucgacuccgcaccaccgcggaguccagaagaagagcuggagccaccgcacucccuccccgcccccgccgggauuuauugaguauuuggacuggacaauuaaguggcccugaugauguuaccaagcccggucaccuccaccccuuucucagucaaagacauuuugaaucuggagcagcagcggcacuuccacggagcucacuugcaggcggaauuggagcagcacuuccacucggcacccugcaugcuggccacggcugaagggacgcaguuuuccgaugcaggggaggaggacgaggaagaagagggagagaaacuguccuauuugaacucacuagcugcugccgagggccauggagauucgggucucuguccucagagcuauguccauacaguucuccgagacgcuugcagcgggcccaaggaacaagaagaggagguugugagcgaacggagccaaagugaguagagggggaaggaaacgcguccgcacaccuggggcaauggcucagcgccuauaaacccacaaaccgugccugcauggccacccgccccuuucacauucggcuagggucaugccuaugccagguucaaggacagcucugcaaagcacagguaccugagauggugcuggggcggggauaaaagagaaagagagaacagcucuugcccggagcagggacccggagcaguccccgagggaaggaaaagugauuauugcaauccugguuccuugaguaaugagugacgggggcccagagccugggucguaacuuguccguuguguguguguucucucgcacacccaucuucucaaaaaaaaaggggggggucaguuuucugccauuuuucugucuuucuucuaacgugaggugaauucagcgaggccagggcagucaccccggcugucccgaaaaggcagugcaagaauguuguguuugggccauccuuucgggcaagacuuugagagacaccagcuuacuucggagcuugcaguucuuacguucgaacugcaaggaggagaggugguggccaaugugugggagcucgauccauaucagaugacggcagcaagucacacccaggaggugaaggccucugaaaaaaaauaucguaaugcucgcuuuguuucuuauacugcaggcggaguggaaugguuaaaguuccugaauuaguucugagugggauucuggccauucagcagaucagagguggggcaggcaggagaaucagauaauugaauaagcccauaaggaaaugucugaaagggaaacaggaucaaauaaucucuucuccgaguggagauuugaucuggcugagaccaaaaucuuuucucuaacaauucuccaggccuaacacagacaugaaacugucuaaaucgguccauccaacuguuuuuccucuguaagguaacauacagauacugucacagacgcguucucaguaguuuugaaaauuaaaaaaaaaaucaauucuugagcugcacauacgccuuucacuuagauauuuccaaagagaaacaauuuuugcaaucaacccaugcauccaggccuccaguccccaauaccaacucguuccacaccuucaggggaguggaaggcaaacgaguuugcagauacgggguccuguuccgcggucgccugaaaauuguuauuagccccuggaccggcacauuuaaucuauuuucucgcugaugcucaaauuuaauaaaugcgagcuaauuacucucaccgaauacgccuucucccgguggaggugcuccgccugacgcgggggggauggggggggcggaauugggcuccagaaacuaugaacuuuccccaaaacuagcauuuacuacgggaguguuuugugccucuggggcgcaggggugguauccugagaacuagaaaggcuaaugucuugcuucucccuuagaaagcugucaguugaagaagucuc

SEQ ID NO: 11614 - RNA, 2662 nt, Mus musculus
gagacuucuucaacugacagcuuucuaagggagaagcaagacauuagccuuucuaguucucaggauaccaccccugcgccccagaggcacaaaacacucccguaguaaaugcuaguuuuggggaaaguucauaguuucuggagcccaauuccgccccccccaucccccccgcgucaggcggagcaccuccaccgggagaaggcguauucggugagaguaauuagcucgcauuuauuaaauuugagcaucagcgagaaaauagauuaaaugugccgguccaggggcuaauaacaauuuucaggcgaccgcggaacaggaccccguaucugcaaacucguuugccuuccacuccccugaagguguggaacgaguugguauuggggacuggaggccuggaugcauggguugauugcaaaaauuguuucucuuuggaaauaucuaagugaaaggcguaugugcagcucaagaauugauuuuuuuuuuaauuuucaaaacuacugagaacgcgucugugacaguaucuguauguuaccuuacagaggaaaaacaguuggauggaccgauuuagacaguuucaugucuguguuaggccuggagaauuguuagagaaaagauuuuggucucagccagaucaaaucuccacucggagaagagauuauuugauccuguuucccuuucagacauuuccuuaugggcuuauucaauuaucugauucuccugccugccccaccucugaucugcugaauggccagaaucccacucagaacuaauucaggaacuuuaaccauuccacuccgccugcaguauaagaaacaaagcgagcauuacgauauuuuuuuucagaggccuucaccuccugggugugacuugcugccgucaucugauauggaucgagcucccacacauuggccaccaccucuccuccuugcaguucgaacguaagaacugcaagcuccgaaguaagcuggugucucucaaagucuugcccgaaaggauggcccaaacacaacauucuugcacugccuuuucgggacagccggggugacugcccuggccucgcugaauucaccucacguuagaagaaagacagaaaaauggcagaaaacugaccccccccuuuuuuuuugagaagaugggugugcgagagaacacacacacaacggacaaguuacgacccaggcucugggcccccgucacucauuacucaaggaaccaggauugcaauaaucacuuuuccuucccucggggacugcuccgggucccugcuccgggcaagagcuguucucucuuucucuuuuauccccgccccagcaccaucucagguaccugugcuuugcagagcuguccuugaaccuggcauaggcaugacccuagccgaaugugaaaggggcggguggccaugcaggcacgguuuguggguuuauaggcgcugagccauugccccaggugugcggacgcguuuccuucccccucuacucacuuuggcuccguucgcucacaaccuccucuucuuguuccuugggcccgcugcaagcgucucggagaacuguauggacauagcucugaggacagagacccgaaucuccauggcccucggcagcagcuagugaguucaaauaggacaguuucucucccucuucuuccucguccuccuccccugcaucggaaaacugcgucccuucagccguggccagcaugcagggugccgaguggaagugcugcuccaauuccgccugcaagugagcuccguggaagugccgcugcugcuccagauucaaaaugucuuugacugagaaagggguggaggugaccgggcuugguaacaucaucagggccacuuaauuguccaguccaaauacucaauaaaucccggcgggggcggggagggagugcgguggcuccagcucuucuucuggacuccgcgguggugcggagucgagcuuuugacagacgcgguccagucuaaauccccuccauuggccgggaccugggggucuggguuuuguuacagccacugcaaggacuggggccggggcugugaagccucuguccgggggcccugcgucacgucaaggggcggggucggcauccuggccuccuucccaauugguucuuguguaugugggccacgcccucugcguccacccagugggauguugcugcgcuaccagaaauagacagggacuagaauaggguccugagauccaagucgcggugggaaaagcugcaaaaaaccggguguccgaaucaccgauucccgcuccaccuggcugcaccuucccgaccaggggcaguucugagaggccagacugcggauuucuaaggagaggaguguuguaucuguggaaauaugagcgacgugucaaauuccaccucaccuuugcucuagcuguccucgccaccuggagugccuuucccacccucauuuccacaguggaaagcuguucuccgaggaaaagcuuaaauaccuccaaggaaacuccgccagaucaccucaccuagagguccucuuccucggaacuugcucaguaaugucacuugucacucucccaucuagugccaaagcuguacuuaguguccgcucgauugucacuuuagauugugagucccugagggcaggguccagaccguacuugcccuugcagcccucgaaguggcuuca

SEQ ID NO: 11615 - RNA, 1097 nt, Mus musculus
uuguagaaaucaaucaguucucagccccugccccaguagcucccuguacucagcagcccugcgggaagccgccagccgacucaguccccugggguauccacaguggagcccggagucuaacuugcaggccgagucucccugugcaauugacccuucugaucaguuagcaguucugucccuuuuucaaacugggcgaacugggggauuucucuacuuucuuuuucccacucuccuuuugugggcccuggcgacauauccucuuucaagaacuccccuuaaauuugggccucuccucugaacccucugccuccaccugcagccggguagaggugugugaagauuguaagggagacuccuggauucauucauuugcggagcagggaagagagggcaccuguuggccucguccuccccagggucccuuccccacuauucucuccagcugaccccaaggcaccuuuucgucuuaacuccuucccuucucagguggagagcccgcaggccuuucuggcugaugcagcuggggcuggcaaggggcggcgagguccaagcuaccucuccucuccaggguccgggaaugcaccuuaccgaaggggucuccgucuucugccauggcguugaugcgcuuguuggccaggaccugcacgugcuucccgcuggugcggcuguagagcugguagguccggaugaggcggcggcugagcugauccgucaccaggcucugcucccucacaugcuguguaaaauuaggugaggacugaacaguuaccuuuaggaaauugaaaaauacacagcacgccauuauaacgcuacuccgcccaggggccccgaguugguccccauugcccuuguacccgccucccgccgcgccaggcagccagcggggacugggggcauccccacaacaugccggcucaggccaccaacccccucggggaagucgcgcagacccagcccaggauggauggaugaacccgggaaugagggagucuggacccaccuguugggaaacacccuggggcucccggccagcucggagcagggaagugggcucccugcccagcgcaggccccccgcccgggccuuccuagaggagc

SEQ ID NO: 11616 - RNA, 1097 nt, Mus musculus
gcuccucuaggaaggcccgggcggggggccugcgcugggcagggagcccacuucccugcuccgagcuggccgggagccccaggguguuucccaacagguggguccagacucccucauucccggguucauccauccauccugggcugggucugcgcgacuuccccgaggggguugguggccugagccggcauguuguggggaugcccccaguccccgcuggcugccuggcgcggcgggaggcggguacaagggcaauggggaccaacucggggccccugggcggaguagcguuauaauggcgugcuguguauuuuucaauuuccuaaagguaacuguucaguccucaccuaauuuuacacagcaugugagggagcagagccuggugacggaucagcucagccgccgccucauccggaccuaccagcucuacagccgcaccagcgggaagcacgugcagguccuggccaacaagcgcaucaacgccauggcagaagacggagaccccuucgguaaggugcauucccggacccuggagaggagagguagcuuggaccucgccgccccuugccagccccagcugcaucagccagaaaggccugcgggcucuccaccugagaagggaaggaguuaagacgaaaaggugccuuggggucagcuggagagaauaguggggaagggacccuggggaggacgaggccaacaggugcccucucuucccugcuccgcaaaugaaugaauccaggagucucccuuacaaucuucacacaccucuacccggcugcagguggaggcagaggguucagaggagaggcccaaauuuaaggggaguucuugaaagaggauaugucgccagggcccacaaaaggagagugggaaaaagaaaguagagaaaucccccaguucgcccaguuugaaaaagggacagaacugcuaacugaucagaagggucaauugcacagggagacucggccugcaaguuagacuccgggcuccacuguggauaccccaggggacugagucggcuggcggcuucccgcagggcugcugaguacagggagcuacuggggcaggggcugagaacugauugauuucuacaa

SEQ ID NO: 11617 - RNA, 636 nt, Mus musculus
guuauauaagaaacuacagggcugagagauagcucaguaagaaccuaaguucauuccacccucagaauccguauuuuaaaagccaggcauggcagccagcacuguggaugcagacaggcagacuagccuacgaggcaagcucuaggccagugaccacaaaagacaggugggcaaccccuaaggaacuacacuuucgaguugucuucugaccuaaugcacaugcauuagaacacauauauggcacaugcacauacaaaauacaaagccuugaacaaguuuaaaaaaacuuaugaaaaauuaaacuuugcagaauugauuugaacaaacaguuguuucaugaauagacucuggcccagucaaaguucagaguguuccaucagugagcaagcaaucuuuguaaauuaaaaaaagguaaaaagaaacauauaauacugugguuggucauaucuuaguauuuaccuuauaaaaacauggugugaucagcugucauacugacuggcuaaaagucaacuacuaugacugacuaagacucagcaacacguuauaagaauacuaacauacucuuaagugaagcugcaguucaagcuauuuaguuuuucaaaggaaggaguugguuguaggccaaacuuaaugcac

SEQ ID NO: 11618 - RNA, 636 nt, Mus musculus
gugcauuaaguuuggccuacaaccaacuccuuccuuugaaaaacuaaauagcuugaacugcagcuucacuuaagaguauguuaguauucuuauaacguguugcugagucuuagucagucauaguaguugacuuuuagccagucaguaugacagcugaucacaccauguuuuuauaagguaaauacuaagauaugaccaaccacaguauuauauguuucuuuuuaccuuuuuuuaauuuacaaagauugcuugcucacugauggaacacucugaacuuugacugggccagagucuauucaugaaacaacuguuuguucaaaucaauucugcaaaguuuaauuuuucauaaguuuuuuuaaacuuguucaaggcuuuguauuuuguaugugcaugugccauauauguguucuaaugcaugugcauuaggucagaagacaacucgaaaguguaguuccuuagggguugcccaccugucuuuuguggucacuggccuagagcuugccucguaggcuagucugccugucugcauccacagugcuggcugccaugccuggcuuuuaaaauacggauucugaggguggaaugaacuuagguucuuacugagcuaucucucagcccuguaguuucuuauauaac

SEQ ID NO: 11619 - RNA, 1289 nt, Mus musculus
guggccacguacagagagccucauagccgcgggugcaggagacaaaaaccagggagaaaggggaaaggggaaaagcgggaagggaagcaaccaagcuccagcucaaagacccaugccacaaaugacacucuaaagucacuagggcccaagucuuuggggcuaccaggaggguacagggcggcuaagccaagccucuuaggacuauuuuucuugggggugccugaaacaggaugaggaaacaagggacccucagauugcagaagggaagugcuaggcgcgcgagugugcccaggcucuguugagucuucugugcucuggccucucugccaaacucucccucagguagaggacucccuuagguccuggcgguccacuuuaggggugggcaugacacugaggcagggaacgacaguuuacuuauacauguccaguccaagaaggaaagucuuuacuacuuaaguuuugagucuggaguagggaaagaaagggagucuuucuucuguaugcuggauaucuuuagggacggcgcuguuuaccagggagguaugagaacgguguugaaguuaauagcaggguguccagggugacaagaacugugccuaaguguaaagagaugaaguauaagagugauuaugauuuucaaaugaugccgcugacccagacaggcacucagagagaagggggaacgggaauggauuucaaggagcuaacaugagguugcaucuggguggggagucaauagucuuucauugcaccgcguucgcaacuuucuuguauauuugcaaaacgucacaauaacacaaagcuggaaaaaccaggcaugguagcacauggaccaguagaguccagcacucggaggaggcaggagaaacagaaguuuaagggcguccuuggcuacauagcaaguucgaggacagucugagcuuugugaaagacucaaaaaaaaaaaaaaaucugggagaaaucccuuauaaaauagagccuggauguuaaaaaauaaauaaauaaacucagcgucucucuucccaccuuucuuggguugcagacaucuuugagagagugggauguaaacucagauaggauuuggacgggaaggguuucgcuggccugcagcagcuuacacacccgggcuccaaaagagaccacaggggcagguggagugcuggguacaaggcgcuaugugggagcuacuuagcgcguucacuccgugacucugaaggagaggcuguugccuuagcagcucuuggcuaaaccucuacuccagccaccucuugucuagucugggacuu

SEQ ID NO: 11620 - RNA, 1289 nt, Mus musculus
aagucccagacuagacaagagguggcuggaguagagguuuagccaagagcugcuaaggcaacagccucuccuucagagucacggagugaacgcgcuaaguagcucccacauagcgccuuguacccagcacuccaccugccccuguggucucuuuuggagcccggguguguaagcugcugcaggccagcgaaacccuucccguccaaauccuaucugaguuuacaucccacucucucaaagaugucugcaacccaagaaaggugggaagagagacgcugaguuuauuuauuuauuuuuuaacauccaggcucuauuuuauaagggauuucucccagauuuuuuuuuuuuuuugagucuuucacaaagcucagacuguccucgaacuugcuauguagccaaggacgcccuuaaacuucuguuucuccugccuccuccgagugcuggacucuacugguccaugugcuaccaugccugguuuuuccagcuuuguguuauugugacguuuugcaaauauacaagaaaguugcgaacgcggugcaaugaaagacuauugacuccccacccagaugcaaccucauguuagcuccuugaaauccauucccguucccccuucucucugagugccugucugggucagcggcaucauuugaaaaucauaaucacucuuauacuucaucucuuuacacuuaggcacaguucuugucacccuggacacccugcuauuaacuucaacaccguucucauaccucccugguaaacagcgccgucccuaaagauauccagcauacagaagaaagacucccuuucuuucccuacuccagacucaaaacuuaaguaguaaagacuuuccuucuuggacuggacauguauaaguaaacugucguucccugccucagugucaugcccaccccuaaaguggaccgccaggaccuaagggaguccucuaccugagggagaguuuggcagagaggccagagcacagaagacucaacagagccugggcacacucgcgcgccuagcacuucccuucugcaaucugagggucccuuguuuccucauccuguuucaggcacccccaagaaaaauaguccuaagaggcuuggcuuagccgcccuguacccuccugguagccccaaagacuugggcccuagugacuuuagagugucauuuguggcaugggucuuugagcuggagcuugguugcuucccuucccgcuuuuccccuuuccccuuucucccugguuuuugucuccugcacccgcggcuaugaggcucucuguacguggccac

SEQ ID NO: 11621 - RNA, 74 nt, Mus musculus
cacucaggaugauauuuucaaguucaucccucacucaggaugauauuuucaaguucauccauuugccugcgaau

SEQ ID NO: 11622 - RNA, 74 nt, Mus musculus
auucgcaggcaaauggaugaacuugaaaauaucauccugagugagggaugaacuugaaaauaucauccugagug

SEQ ID NO: 11623 - RNA, 44 nt, Mus musculus
aguaguuuacagaccuguauaaccaucacuauaaccuaacuugg

SEQ ID NO: 11624 - RNA, 44 nt, Mus musculus
ccaaguuagguuauagugaugguuauacaggucuguaaacuacu

SEQ ID NO: 11625 - RNA, 2330 nt, Mus musculus
aagaaugcuauggggauuuugacucaguagguuuugcaacuaaccaugauuauauugcuuuguaucuguaucucuuuaauugguuccucuuaucucugugugcauuugucuuucauaccauauccaggcccagugcuugugggggcaagaaaagaaugauggauuucccaggaacuggaguuacacacagcuguaagaugccaugugggugcuaggaauuaaacuugcauccuucuagaagaaaagccaguacucuuaaccugugagccaucucucuaaaccuagaccucuaaucuaaagguaacgaaaacaaaacaaaacaaaacaaaacaaaacaaaacaaauaguauagaaguaguacuuaccaguaccggaauuuggaacccaauguaaaauaaugugcaaaaaaauuuuuuugagguggaaguggucuauccaggcggaagaauguaugauguucuacacacgcuuuccacaaaguuuuacaugcucuauaauucaccauauuaaaucccaguaauguuucucuagauucaugcuguaugaaaugacaaaauucagagaaaacagaaaaaugucaggauaugauaguacuuuugacagauaaguuauaccagccuuguaaaugcuaaucuccuuuaaugacuuuauuaacaaaggcuaagugaaauaaauaaaaagauuuauaaaaugugaacuucuguaauuauacaacauuuacauacuuguauucucuaucauauuagaaauaacuuuaaauuuuuuacuauuuucaaguaaauauuuacaaauuuuauuagcuauaauucugcuucaauauauaguccuggaccacaaauuaaauuuguguagauccacaauuuguaauucugccuugauuaaaagaaagaauauucaacaccccaagcguuauuauaaaaaucacauuagaaauggauuagcauuagaagagacugaugcuauaguuuuucuuuuggcaugaaccacauuauaccaaagcacauaucuccugaguaucucauauauauacacauacauacauauauacacauacauacauauauauacauauuuaugugugugcacguaauauguucauauuauauauguaauguguaauauaugcacaauaguuuacauacuuuacuguuuauagauacuugauauuucccaaguuagagauagaagagcaauguuguguaugcacauucuuagauuuuauguacauauguacacauuucuguugcuagauaauuauauguauagcuaaaguaguuaguacuuccugucaaugauaguguguguuccauacacucaccauauucagugauuuucugguuuugauuuguguccauuuuuguauugagauggcauuuuauauugugcuuuaggcuggccuagaacucacuauaauguucaagcuggacuugaacuuauagcaguucccacaccgacaaucauuuggguggugaauuauaagcaugugccaccucaucuauuuguauuuuuucuuauuucaguguuuugcauuuugguuauaacauguaccucaucuugaugacuuaaauaagguucaacaucucuacauguuaauggcaaauuggauauugauuuuauuuuuucaaagcaugaccuucuccagcccaggcuagacuugaauuuguagcaauuucccuaccuuagccuuucaaaugcagggauuagagacuuagagcaccauguguaccuuauuuuagcuucugaagcugguccucacacaauguagccaagguugauuuugaacucacaaccuugccucagccuuggaaauaucuggcuaccaugaagauacugucauuucugaagugguauucaagacauuggauagcauauauauggaaggacuugggguugcauauuacugcauauacagccagugcuacaucacucuuaaugguaucuuuugaugaacauuuaucagucugaaacagucugaaacaaugaaugauuauauuuaagagcuucuucuauguuuuauucaagaaauauuuucaucaugaaaauauuuuccauaauuaaaacaagauaaaauguucagauauaagaauguaguuucaaauuaaaaaguaaagcauagcuuguuguuuacuagaaaguuaaauaguaucacuaacauuuuuauaugcaguuacaguuuacauauugucugauauacaguaaauguuauauaagaugacagaacaccuuacaagaagaguauaauacaguaaguuuuuucaguguguguacacugucuaauauguggccucccuauuaaaccauugcuucaaacacucugcauguacuuuugu

SEQ ID NO: 11626 - RNA, 2330 nt, Mus musculus
acaaaaguacaugcagaguguuugaagcaaugguuuaauagggaggccacauauuagacaguguacacacacugaaaaaacuuacuguauuauacucuucuuguaagguguucugucaucuuauauaacauuuacuguauaucagacaauauguaaacuguaacugcauauaaaaauguuagugauacuauuuaacuuucuaguaaacaacaagcuaugcuuuacuuuuuaauuugaaacuacauucuuauaucugaacauuuuaucuuguuuuaauuauggaaaauauuuucaugaugaaaauauuucuugaauaaaacauagaagaagcucuuaaauauaaucauucauuguuucagacuguuucagacugauaaauguucaucaaaagauaccauuaagagugauguagcacuggcuguauaugcaguaauaugcaaccccaaguccuuccauauauaugcuauccaaugucuugaauaccacuucagaaaugacaguaucuucaugguagccagauauuuccaaggcugaggcaagguugugaguucaaaaucaaccuuggcuacauugugugaggaccagcuucagaagcuaaaauaagguacacauggugcucuaagucucuaaucccugcauuugaaaggcuaagguagggaaauugcuacaaauucaagucuagccugggcuggagaaggucaugcuuugaaaaaauaaaaucaauauccaauuugccauuaacauguagagauguugaaccuuauuuaagucaucaagaugagguacauguuauaaccaaaaugcaaaacacugaaauaagaaaaaauacaaauagaugagguggcacaugcuuauaauucaccacccaaaugauugucggugugggaacugcuauaaguucaaguccagcuugaacauuauagugaguucuaggccagccuaaagcacaauauaaaaugccaucucaauacaaaaauggacacaaaucaaaaccagaaaaucacugaauauggugaguguauggaacacacacuaucauugacaggaaguacuaacuacuuuagcuauacauauaauuaucuagcaacagaaauguguacauauguacauaaaaucuaagaaugugcauacacaacauugcucuucuaucucuaacuugggaaauaucaaguaucuauaaacaguaaaguauguaaacuauugugcauauauuacacauuacauauauaauaugaacauauuacgugcacacacauaaauauguauauauauguauguauguguauauauguauguauguguauauauaugagauacucaggagauaugugcuuugguauaaugugguucaugccaaaagaaaaacuauagcaucagucucuucuaaugcuaauccauuucuaaugugauuuuuauaauaacgcuugggguguugaauauucuuucuuuuaaucaaggcagaauuacaaauuguggaucuacacaaauuuaauuugugguccaggacuauauauugaagcagaauuauagcuaauaaaauuuguaaauauuuacuugaaaauaguaaaaaauuuaaaguuauuucuaauaugauagagaauacaaguauguaaauguuguauaauuacagaaguucacauuuuauaaaucuuuuuauuuauuucacuuagccuuuguuaauaaagucauuaaaggagauuagcauuuacaaggcugguauaacuuaucugucaaaaguacuaucauauccugacauuuuucuguuuucucugaauuuugucauuucauacagcaugaaucuagagaaacauuacugggauuuaauauggugaauuauagagcauguaaaacuuuguggaaagcguguguagaacaucauacauucuuccgccuggauagaccacuuccaccucaaaaaaauuuuuuugcacauuauuuuacauuggguuccaaauuccgguacugguaaguacuacuucuauacuauuuguuuuguuuuguuuuguuuuguuuuguuuuguuuucguuaccuuuagauuagaggucuagguuuagagagauggcucacagguuaagaguacuggcuuuucuucuagaaggaugcaaguuuaauuccuagcacccacauggcaucuuacagcuguguguaacuccaguuccugggaaauccaucauucuuuucuugcccccacaagcacugggccuggauaugguaugaaagacaaaugcacacagagauaagaggaaccaauuaaagagauacagauacaaagcaauauaaucaugguuaguugcaaaaccuacugagucaaaauccccauagcauucuu

SEQ ID NO: 11627 - RNA, 333 nt, Mus musculus
gucaacugagccuagggauuaucugguguuccagccccuuugagacucugguuugcugcccccccccccauagagaagcuguaaagcaaacccucugggcuaagaauggguccaccaugaucccuuaggacgcagagaggggcuggaggaagcagcuuccacugaccacagcaugucaucagccuucuguccauuucuccagucaaucccuggucaaaaaauacuugggggaaaaaauguuucccuaacacucacagaccuuuuuuuuuucuugucaaucauuucccaaacaguauaguuuaaugacaauuuauauaacauuacauuguguua

SEQ ID NO: 11628 - RNA, 333 nt, Mus musculus
uaacacaauguaauguuauauaaauugucauuaaacuauacuguuugggaaaugauugacaagaaaaaaaaaaggucugugaguguuagggaaacauuuuuucccccaaguauuuuuugaccagggauugacuggagaaauggacagaaggcugaugacaugcuguggucaguggaagcugcuuccuccagccccucucugcguccuaagggaucaugguggacccauucuuagcccagaggguuugcuuuacagcuucucuaugggggggggggcagcaaaccagagucucaaaggggcuggaacaccagauaaucccuaggcucaguugac

SEQ ID NO: 11629 - RNA, 117 nt, Mus musculus
cugcacucauggagacagacagggacguucaaaggguguaggucaggcuggaccacuuaauaagacccugucucagaagacagaagcaacaagagaaaucauaaaaguauucguccu

SEQ ID NO: 11630 - RNA, 117 nt, Mus musculus
aggacgaauacuuuuaugauuucucuuguugcuucugucuucugagacagggucuuauuaagugguccagccugaccuacacccuuugaacgucccugucugucuccaugagugcag

SEQ ID NO: 11631 - RNA, 67 nt, Mus musculus
ugacugguccaggccuugcaccauaguaaaaugacagccaggaucagccuuuaugaauaagacucga

SEQ ID NO: 11632 - RNA, 67 nt, Mus musculus
ucgagucuuauucauaaaggcugauccuggcugucauuuuacuauggugcaaggccuggaccaguca

SEQ ID NO: 11633 - RNA, 105 nt, Mus musculus
guugccagucccuggccaacacaguuuucagaaggccagcuuccccuuguguuguucacucauggcccaaacuaaacuaagaagugugauuguucggagcuucug

SEQ ID NO: 11634 - RNA, 105 nt, Mus musculus
cagaagcuccgaacaaucacacuucuuaguuuaguuugggccaugagugaacaacacaaggggaagcuggccuucugaaaacuguguuggccagggacuggcaac

SEQ ID NO: 11635 - RNA, 173 nt, Mus musculus
aagauucagauaccaaaugugaacuuggcaagcccacccuuccuaagucgagucaaaugcacaccgcugucuuugccaggguugugcuuccaaaagcagucauugccacccucugcagaccguuggcugccuuuguuucagaagcuguguggucccuggaagaacuuagagcu

SEQ ID NO: 11636 - RNA, 173 nt, Mus musculus
agcucuaaguucuuccagggaccacacagcuucugaaacaaaggcagccaacggucugcagaggguggcaaugacugcuuuuggaagcacaacccuggcaaagacagcggugugcauuugacucgacuuaggaagggugggcuugccaaguucacauuugguaucugaaucuu

SEQ ID NO: 11637 - RNA, 75 nt, Mus musculus
ugcuuacgaguacaugcaguacucagagaggccagaaggcggcgcuggauuuccugcuugugagcugcacguggg

SEQ ID NO: 11638 - RNA, 75 nt, Mus musculus
cccacgugcagcucacaagcaggaaauccagcgccgccuucuggccucucugaguacugcauguacucguaagca

SEQ ID NO: 11639 - RNA, 726 nt, Mus musculus
cacguggcagcucacaguugucuguaccuccaguuccaugagaaucuaacacccuccucuggcuuccauaggcacuguguguaaaccauguauguacauuuacauacauacacauuuauauauguucauuuacauguauguaaucaggcaaagcacucagauaaaauaaaaaaucaaguaaauuuuaaaaaguccucuaacaucuacacagaugcccuccccauccuguguacauacacaauuauaaugcuuuuuuuuuccauuuuuuauuagguauuuagcucauuuacauuuccaaugcuauaccaaaagucccccauacccacccacccccacuccccuacccacccacucccccuuuuuggcccuggcguuccccuguacuggggcauauaaaguuugcaaguccaaugggccucucuuuccagugauggccgacuaggccaucuuuugauacauaugcagcuagagucaagagcuccaggguacugguuaguucauaauguuguuccaccuauaggguugcagaucccuuuagcuccuuggguacuuucucuagcuccuccauugggagcccugugauccauccauuagcugacugugagcauccacuuauguguuugcuaggccccggcauagucucacaagagacagcuacaucuggguccuuucaauaaaaucuugcuaguguaugcaauggugucagcguuuggaugcugauuaugg

SEQ ID NO: 11640 - RNA, 726 nt, Mus musculus
ccauaaucagcauccaaacgcugacaccauugcauacacuagcaagauuuuauugaaaggacccagauguagcugucucuugugagacuaugccggggccuagcaaacacauaaguggaugcucacagucagcuaauggauggaucacagggcucccaauggaggagcuagagaaaguacccaaggagcuaaagggaucugcaacccuauagguggaacaacauuaugaacuaaccaguacccuggagcucuugacucuagcugcauauguaucaaaagauggccuagucggccaucacuggaaagagaggcccauuggacuugcaaacuuuauaugccccaguacaggggaacgccagggccaaaaagggggaguggguggguaggggaguggggguggguggguaugggggacuuuugguauagcauuggaaauguaaaugagcuaaauaccuaauaaaaaauggaaaaaaaaagcauuauaauuguguauguacacaggauggggagggcaucuguguagauguuagaggacuuuuuaaaauuuacuugauuuuuuauuuuaucugagugcuuugccugauuacauacauguaaaugaacauauauaaauguguauguauguaaauguacauacaugguuuacacacagugccuauggaagccagaggaggguguuagauucucauggaacuggagguacagacaacugugagcugccacgug

SEQ ID NO: 11641 - RNA, 1045 nt, Mus musculus
ggagugccuuccacaucuguggaauuacugcaccaagcaguuuuuguacagaaacugucuuuguguugagaugcaaauaauaaaaugacaacugucuaggaaagagagguagaaggucaaagcaggauauuugucagaaucuggacacaggccuaaguggcuuauguauagacaggcaagggaagagacugagaaaguagaaugggcugugucacccaaaugaccuaaguuauaauccuaagagugguuacauuuguccuuucagaacauacacugcaguugcuucuguacggacaccuacuggggggaaccaguguaccugcugugcuccaggagggaagauaaggauugccuaugcuaggauaagacaggcuauggauuuggaaaguaaaggggagcaugucuuuuccuugggcaugaauaauuugauauuucucccugaaauacaggacacaaggaaaugccagauagcaucagcaaacaguaacugaagccaugggcaugaauacauuaggcuguagaaugaaaagaaauggaauccuagaaucaagcccucaggaauccaacaucuaaggaaacaaaggagacaaaguaggagaguuaccagguagaagagaggaaacagaggcgugauuucagcuuccagggagggcaguuucaagagagagagugaguggucaagggugucaaagaaggaaaguucuggguaaaaguucacaguacuucacaaaccaguggucaaucccuccagcaagacuguaccaacucccaaacagcaccaacuggggacuaagcguucaaggaccugagcccacaggaaacauuucucuuugaaaccaccacacaaacggaauaguuuacacaugcaggaaaggucuauauagaauaacccuuacauuugugugaaguagucacuaagaagugaaggaacuaucacucauuacugcuuagauaugauaagggcugagaaaacuuagcuaugaggucucaucuuuaucuaguagcaguuguucacucagaauaaauguuuaaucaaugguucugg

SEQ ID NO: 11642 - RNA, 1045 nt, Mus musculus
ccagaaccauugauuaaacauuuauucugagugaacaacugcuacuagauaaagaugagaccucauagcuaaguuuucucagcccuuaucauaucuaagcaguaaugagugauaguuccuucacuucuuagugacuacuucacacaaauguaaggguuauucuauauagaccuuuccugcauguguaaacuauuccguuuguguggugguuucaaagagaaauguuuccugugggcucagguccuugaacgcuuaguccccaguuggugcuguuugggaguugguacagucuugcuggagggauugaccacugguuugugaaguacugugaacuuuuacccagaacuuuccuucuuugacacccuugaccacucacucucucucuugaaacugcccucccuggaagcugaaaucacgccucuguuuccucucuucuaccugguaacucuccuacuuugucuccuuuguuuccuuagauguuggauuccugagggcuugauucuaggauuccauuucuuuucauucuacagccuaauguauucaugcccauggcuucaguuacuguuugcugaugcuaucuggcauuuccuuguguccuguauuucagggagaaauaucaaauuauucaugcccaaggaaaagacaugcuccccuuuacuuuccaaauccauagccugucuuauccuagcauaggcaauccuuaucuucccuccuggagcacagcagguacacugguuccccccaguagguguccguacagaagcaacugcaguguauguucugaaaggacaaauguaaccacucuuaggauuauaacuuaggucauuugggugacacagcccauucuacuuucucagucucuucccuugccugucuauacauaagccacuuaggccuguguccagauucugacaaauauccugcuuugaccuucuaccucucuuuccuagacaguugucauuuuauuauuugcaucucaacacaaagacaguuucuguacaaaaacugcuuggugcaguaauuccacagauguggaaggcacucc

SEQ ID NO: 11643 - RNA, 477 nt, Mus musculus
augguccagucaggcccgauuucucgggaagggaaagaaagcaagaaaauuaacuacagcuuuucuaccucugguaaacuuacuaacuucuucugcuuuauuuuaaaagguuuuuauuaguguuuguggguggccagaaguggguaucagauccucugacgcugccugauacggacacugggaaccaaacuugggucaucugaagggcagcaacuguuaacugucaagcaaacucuacagcuucucauuuaguauuuaaaucucauauuuuuauuggcugaggcaagugaggcuuaauagaaagaagagaaauggaguauaaguucaaauccucaugcacacaguacucccuuuacccaggcaacucaaaaacuccuaauagaaguuacccuaaauuuuuauucagaauauuacaagacuuccauguuacucccaacaacuaccacacuucuccuacgucugacaggagaugaacaa

SEQ ID NO: 11644 - RNA, 477 nt, Mus musculus
uuguucaucuccugucagacguaggagaagugugguaguuguugggaguaacauggaagucuuguaauauucugaauaaaaauuuaggguaacuucuauuaggaguuuuugaguugccuggguaaagggaguacugugugcaugaggauuugaacuuauacuccauuucucuucuuucuauuaagccucacuugccucagccaauaaaaauaugagauuuaaauacuaaaugagaagcuguagaguuugcuugacaguuaacaguugcugcccuucagaugacccaaguuugguucccaguguccguaucaggcagcgucagaggaucugauacccacuucuggccacccacaaacacuaauaaaaaccuuuuaaaauaaagcagaagaaguuaguaaguuuaccagagguagaaaagcuguaguuaauuuucuugcuuucuuucccuucccgagaaaucgggccugacuggaccau

SEQ ID NO: 11645 - RNA, 732 nt, Mus musculus
auuuugaaguuggcaguagcugguuuaaaaaccagacagugaaauguaugucccuuuucaguguuuuucugucugugugaacagugugacaggcuuccugucauggcuucuuagaaaauaguuuaaugcuauuacugaggugguuuggauuuuagauucuuuuuuagcuauagaucaaauuuagcuaccucccauguuccuguaccaucuccuuaauggacacagaaucuacuccugguuuuguguauugacucagcucaguaacaguauagaauaguuggcaagaguuagagccaagcuuucuauguagcucaggccugccuugaacucagucuuucugccucaucauugcuuuugcgauuauaaaugagcauaccccaugcccaacuaagguugaggcuuugcggaaagaaguacugucuggaacaggaauugagggguggguaggaaaucuaggaccaaagaaaaggucuuucacuucuaggcaauauucuacucccaaccccagcucuggugcuggauuaguuggguuuucuuagguuuguuuguuuguuuguuuaauuuaaaugucacuuguuuuuacagacauccaccucugcaucuucuguacaguauaguauaaaauauaagugcauauucacuuacaugugaauauuuauuugugcguguuuaguggguggcuacuguuguuauuacuuuuuacauuuaauuucagugagacacugaucuuuu

SEQ ID NO: 11646 - RNA, 732 nt, Mus musculus
aaaagaucagugucucacugaaauuaaauguaaaaaguaauaacaacaguagccacccacuaaacacgcacaaauaaauauucacauguaagugaauaugcacuuauauuuuauacuauacuguacagaagaugcagagguggaugucuguaaaaacaagugacauuuaaauuaaacaaacaaacaaacaaaccuaagaaaacccaacuaauccagcaccagagcugggguugggaguagaauauugccuagaagugaaagaccuuuucuuugguccuagauuuccuacccaccccucaauuccuguuccagacaguacuucuuuccgcaaagccucaaccuuaguugggcaugggguaugcucauuuauaaucgcaaaagcaaugaugaggcagaaagacugaguucaaggcaggccugagcuacauagaaagcuuggcucuaacucuugccaacuauucuauacuguuacugagcugagucaauacacaaaaccaggaguagauucuguguccauuaaggagaugguacaggaacaugggagguagcuaaauuugaucuauagcuaaaaaagaaucuaaaauccaaaccaccucaguaauagcauuaaacuauuuucuaagaagccaugacaggaagccugucacacuguucacacagacagaaaaacacugaaaagggacauacauuucacugucugguuuuuaaaccagcuacugccaacuucaaaau

SEQ ID NO: 11647 - RNA, 1583 nt, Mus musculus
ugaccacaccuacuauaccacagagcagaaagagagguuaauuugacccuuaacuagacagggaccagaucguauucaagcuuacauguugcuucuuacauugugacuguaauucuucucuauggaucugcuggcaggacuauugauuagacacaggaggcagauggauuguacccaguuggggucauauuucauaccccguuuauaacauauuacuauuuuacacguuacaggguuucagucugaagaguuuugguguguguguuguuuuuguuuguuuguuuguuuguuuuuuguagacucuggguaaaaaaaauauuauaugcagauaccugggggagagaauauuuuugugauuuugaauuugcuuuuaagugaaaauacaugugugucuguguguguguuguauaugugugcguuucaguguugguacaccugggugcauauggaggccaaaaguuggcaucaggugccuucccuaaccucucuccaucuuacuaguugaaauaagaucucucacaggaucuggaguucacuguaggcuggcuauccaaaggagucccagggagcugcaugucucugccuccuuggugcugggguuacagauguuucaaugccaccuggcuuucugugugcaugcugggaauccgaacucagcuccucgcugguguggugaccacuuuacuacccgagccaugucccagcccuugcuuucacuuuuaagcuacucauuucaaccacacucugucuucucacucccggaauggcgccgaccuuggacaggacauuauagauggaucucagauuuuguguaaguguuccaagaagcacgggugagcuagauacagcacaggugauuucaaagaagaucugacaugggaauugcaagaggaugugguggguuguguuugcuguggguuuuuuuccucucccuugcaguccuuucacuuucuggggaugcugcuaagagcagagacaguaaacugcacugguaaaaucugacagauuacuucagaacugggggcaaauagagggagccacccuacagucuccuuuugacguucuauucuaauuucauguuugucucauuuuacaacucuccccaucaccuccugccuccaaguuuuucuauacuuggaaggagugcuuuuccagaaagcauggguuuaggcgauguguuuagagagguagcagagaggucugagaguuguuaggggguaaagacagauccaggguuauaugaacugucucuaaguucacugcagaaaguuugccuaaaggggcuuuguugcuuauuucugaagaaggaggaggaggaggaagaggaagaagaagaggaggaggaggaggaggaggaggaggaggaggaggaggaggaggacaguuggagagauggcucagugguuaagagcacuaacugcucuuccagagguccagaguucaacuagcaaccacauggugucucauaaccauccaauggagucugaugcccucuucugguguguuugaagacagcuacaguguacucauauacauaaaauaaauagauuauuuuuuuuucgagacaggguuucucuguauag

SEQ ID NO: 11648 - RNA, 1583 nt, Mus musculus
cuauacagagaaacccugucucgaaaaaaaaauaaucuauuuauuuuauguauaugaguacacuguagcugucuucaaacacaccagaagagggcaucagacuccauuggaugguuaugagacaccaugugguugcuaguugaacucuggaccucuggaagagcaguuagugcucuuaaccacugagccaucucuccaacuguccuccuccuccuccuccuccuccuccuccuccuccuccuccuccucuucuucuuccucuuccuccuccuccuccuucuucagaaauaagcaacaaagccccuuuaggcaaacuuucugcagugaacuuagagacaguucauauaacccuggaucugucuuuacccccuaacaacucucagaccucucugcuaccucucuaaacacaucgccuaaacccaugcuuucuggaaaagcacuccuuccaaguauagaaaaacuuggaggcaggaggugauggggagaguuguaaaaugagacaaacaugaaauuagaauagaacgucaaaaggagacuguaggguggcucccucuauuugcccccaguucugaaguaaucugucagauuuuaccagugcaguuuacugucucugcucuuagcagcauccccagaaagugaaaggacugcaagggagaggaaaaaaacccacagcaaacacaacccaccacauccucuugcaauucccaugucagaucuucuuugaaaucaccugugcuguaucuagcucacccgugcuucuuggaacacuuacacaaaaucugagauccaucuauaauguccuguccaaggucggcgccauuccgggagugagaagacagagugugguugaaaugaguagcuuaaaagugaaagcaagggcugggacauggcucggguaguaaaguggucaccacaccagcgaggagcugaguucggauucccagcaugcacacagaaagccagguggcauugaaacaucuguaaccccagcaccaaggaggcagagacaugcagcucccugggacuccuuuggauagccagccuacagugaacuccagauccugugagagaucuuauuucaacuaguaagauggagagagguuagggaaggcaccugaugccaacuuuuggccuccauaugcacccagguguaccaacacugaaacgcacacauauacaacacacacacagacacacauguauuuucacuuaaaagcaaauucaaaaucacaaaaauauucucucccccagguaucugcauauaauauuuuuuuuacccagagucuacaaaaaacaaacaaacaaacaaacaaaaacaacacacacaccaaaacucuucagacugaaacccuguaacguguaaaauaguaauauguuauaaacgggguaugaaauaugaccccaacuggguacaauccaucugccuccugugucuaaucaauaguccugccagcagauccauagagaagaauuacagucacaauguaagaagcaacauguaagcuugaauacgaucuggucccugucuaguuaagggucaaauuaaccucucuuucugcucugugguauaguaggugugguca

SEQ ID NO: 11649 - RNA, 1545 nt, Mus musculus
uuuucuucuguaaaauagggacuuccccucuucucuuccauauuguaucucccucccauucugccauggucacaggcccuauucagguagcuuaaauaauguucccuacacacagagagguggggguggguggguaagggaggaagggagaguuuauggauccaaguauaauacugcuagaaauaacuggucagucacuaaaaacuucacucagacugacuucagacacuauguauaggcaccauuguuucuggaugacugucaauggcuacguuauaaucuaauccaaagaaagcugggugacaggcccacaccauguuuauuuauugcauggguuaugaccuuucaacaaaucacuuccuccagguagauuacagccccccucacuauaacacuguaucuugauccuuuguuguagcacaugaaaguuagaauccuugggcucuagaaaaguugccuuaggaaauaaacaacacugccuuugguaauuaauuuaagugaaugucacuucauccauagguuaaaauuuuuaaauuuuauuuauaaaaagcacaggaguuucucucugaaacagaaagcuauuuauaaaucacauggcuccuguggguugguaauacucauauucccaucacaaguugaauccucaucccugaguaacucacauaacuucuuugugguaccaccuccauguuggcuaaaugaguauauuucuagcuaguuuuccacauuguugaauacccauaaggugcucaccaaaggacuguauuagaaacucauaaaaaucagacuuuauggcuauacucacuauuguauggcauguacuuuuucuguuuaaauguauuuuuuuuugaugcugggauuaaauccuggguaccuuacacauguuaugcgcaugcucugccacugugccacacccccagccccaugauguaugcuuugauuuaccaucaauaucaguccuuguaacaugaugaagucacucuugguguuaauguuccggguccauguggggaaaucagugaagagaaguaacuaagcaacaacuuucacaucugccugucucgcccaugucggguuuucccauuauaacuugccuuguuuaagaguccaaguucugagaggggcacgagaaggcuuugcaccuccauuuguucccugucuuguugcugugaacaaugaccugacaaaggcaaggugaggaggcaaggcuuuaauucagucuguaguuuuacaaugccauccgcuauggcggagaaguuaagacaggcagagcauacagcugcugguccugcuccaucuguaguuggggagcagagaggugacagcuggagcucagcauacucucuccuuugagucauuccaugacuacagcccaaagcauggugccauccacaguuaggggcucaguuucccuuccucaguuaauccagucuagaaccaccucccaagaagcacgcuuguccccuaggugacucuagaucuagauugguagugaauauuaaccaucacagugcguaugcucuucauacugcuuaugacucuuaa

SEQ ID NO: 11650 - RNA, 1545 nt, Mus musculus
uuaagagucauaagcaguaugaagagcauacgcacugugaugguuaauauucacuaccaaucuagaucuagagucaccuaggggacaagcgugcuucuugggaggugguucuagacuggauuaacugaggaagggaaacugagccccuaacuguggauggcaccaugcuuugggcuguagucauggaaugacucaaaggagagaguaugcugagcuccagcugucaccucucugcuccccaacuacagauggagcaggaccagcagcuguaugcucugccugucuuaacuucuccgccauagcggauggcauuguaaaacuacagacugaauuaaagccuugccuccucaccuugccuuugucaggucauuguucacagcaacaagacagggaacaaauggaggugcaaagccuucucgugccccucucagaacuuggacucuuaaacaaggcaaguuauaaugggaaaacccgacaugggcgagacaggcagaugugaaaguuguugcuuaguuacuucucuucacugauuuccccacauggacccggaacauuaacaccaagagugacuucaucauguuacaaggacugauauugaugguaaaucaaagcauacaucauggggcuggggguguggcacaguggcagagcaugcgcauaacauguguaagguacccaggauuuaaucccagcaucaaaaaaaaauacauuuaaacagaaaaaguacaugccauacaauagugaguauagccauaaagucugauuuuuaugaguuucuaauacaguccuuuggugagcaccuuauggguauucaacaauguggaaaacuagcuagaaauauacucauuuagccaacauggaggugguaccacaaagaaguuaugugaguuacucagggaugaggauucaacuugugaugggaauaugaguauuaccaacccacaggagccaugugauuuauaaauagcuuucuguuucagagagaaacuccugugcuuuuuauaaauaaaauuuaaaaauuuuaaccuauggaugaagugacauucacuuaaauuaauuaccaaaggcaguguuguuuauuuccuaaggcaacuuuucuagagcccaaggauucuaacuuucaugugcuacaacaaaggaucaagauacaguguuauagugaggggggcuguaaucuaccuggaggaagugauuuguugaaaggucauaacccaugcaauaaauaaacauggugugggccugucacccagcuuucuuuggauuagauuauaacguagccauugacagucauccagaaacaauggugccuauacauagugucugaagucagucugagugaaguuuuuagugacugaccaguuauuucuagcaguauuauacuuggauccauaaacucucccuuccucccuuacccacccacccccaccucucuguguguagggaacauuauuuaagcuaccugaauagggccugugaccauggcagaaugggagggagauacaauauggaagagaagaggggaagucccuauuuuacagaagaaaa

SEQ ID NO: 11651 - RNA, 102 nt, Mus musculus
ugacuuuuacagcauaaagcuguaaaaacauuuuauaagagggacaggccauuuagggucugggaaaugcucauugaaugacaaagcuuaguccagauaagu

SEQ ID NO: 11652 - RNA, 102 nt, Mus musculus
acuuaucuggacuaagcuuugucauucaaugagcauuucccagacccuaaauggccugucccucuuauaaaauguuuuuacagcuuuaugcuguaaaaguca

SEQ ID NO: 11653 - RNA, 1621 nt, Mus musculus
uguccagcucauagucugaaacaguaacauacggguccaucccuagucuuccgcuuagauuuuguauuauuaucuguauugaaaagauguacuuuuuacaaauuuuaacaaaccuguauguuugguucuuucaaaacacuagguuuuauucccaccuauaaaacagagggauugagguggaacgcggauucucacgcucucguuugcauaugugugcgccacccugggaucuuguuaaugcugcaggucugaguucaggagguccgugaggucagcuuucccacucugcucuaaagugaagcuugugguacugaagugaggccugcauuuggggcaauggcggguuguguguuuccuuuuauuucuguaaggaacuucuucagaggccccaacaacuccuguucccauuaugcacugccuaaguuguucaaggagcuuagagcgucacuucucaucaugccuucccuguucuccccagaaaagguucggcuugggcucuguuuuuaaaaacuucuuuauagugaguggaccuucgggcgaacagauagacgccacugucaaguuuucauaaaagccacaggcuuggaaagggauuaauucugaaccagugagauaggucaguggguaacgaaauuugucauacaagccuggcagugugagcuugaucccuggaauucacguaagggcagaaggaaaggaagucccuccacgagcuuauccucugcccugugugugcgugauacucccuggccccucgcccuccacgcaucacgcacacagagauaacgaguggaaagaaauaaaagaaaggacugaaggaacaaacacauaaaaauauauaauauucacuuuaggugaagaucagacucaggcuuuuuuuuuucagcuuucucuccagccacaguucuugugaugugcugucugucugucugucugucugucugucugucucucucucucucuguguauucauguguacauguuugugggaugccaagagacaaccuuagauauaauuccucacaaacucuuuaaaaaaaacuuuaaaauucauuacauuuuuuagagauggagucucccucucucccccaagaugcaaagaagcaggcuauuuggcugggauaacaauuaaacaaauaucacacacacacacacacacacacacacacagagagagagagagagauaugcgugaguguguguguguaucauagguccuagggauuaaacucaggaccuuaugacugcaacacaggcguuuuacugaccgaggcaucuccucagucucccugugaugcuuuuuaauugucuuaaauauuuugugaacacucuacuaaugagaaauauucacuguauuuccuuccagcauccugcaccgcuagauggccagagaaaaggcugagaugaggcacuuuaaacucaucaggagaugucaagauaacucaaguacacagccucggcaacagaguaaagugcuacauuuguuccuacuuauccgucccaugguacucaaguucaaaucccagaguaagggacgcgcaagccuccugagcaggcacacccccuagucuucaaguuucuugucugucggaguucuggucuccuugacugucaaggagau

SEQ ID NO: 11654 - RNA, 1621 nt, Mus musculus
aucuccuugacagucaaggagaccagaacuccgacagacaagaaacuugaagacuagggggugugccugcucaggaggcuugcgcgucccuuacucugggauuugaacuugaguaccaugggacggauaaguaggaacaaauguagcacuuuacucuguugccgaggcuguguacuugaguuaucuugacaucuccugaugaguuuaaagugccucaucucagccuuuucucuggccaucuagcggugcaggaugcuggaaggaaauacagugaauauuucucauuaguagaguguucacaaaauauuuaagacaauuaaaaagcaucacagggagacugaggagaugccucggucaguaaaacgccuguguugcagucauaagguccugaguuuaaucccuaggaccuaugauacacacacacacucacgcauaucucucucucucucucugugugugugugugugugugugugugugugauauuuguuuaauuguuaucccagccaaauagccugcuucuuugcaucuugggggagagagggagacuccaucucuaaaaaauguaaugaauuuuaaaguuuuuuuuaaagaguuugugaggaauuauaucuaagguugucucuuggcaucccacaaacauguacacaugaauacacagagagagagagagacagacagacagacagacagacagacagacagcacaucacaagaacuguggcuggagagaaagcugaaaaaaaaaagccugagucugaucuucaccuaaagugaauauuauauauuuuuauguguuuguuccuucaguccuuucuuuuauuucuuuccacucguuaucucugugugcgugaugcguggagggcgaggggccagggaguaucacgcacacacagggcagaggauaagcucguggagggacuuccuuuccuucugcccuuacgugaauuccagggaucaagcucacacugccaggcuuguaugacaaauuucguuacccacugaccuaucucacugguucagaauuaaucccuuuccaagccuguggcuuuuaugaaaacuugacaguggcgucuaucuguucgcccgaagguccacucacuauaaagaaguuuuuaaaaacagagcccaagccgaaccuuuucuggggagaacagggaaggcaugaugagaagugacgcucuaagcuccuugaacaacuuaggcagugcauaaugggaacaggaguuguuggggccucugaagaaguuccuuacagaaauaaaaggaaacacacaacccgccauugccccaaaugcaggccucacuucaguaccacaagcuucacuuuagagcagagugggaaagcugaccucacggaccuccugaacucagaccugcagcauuaacaagaucccaggguggcgcacacauaugcaaacgagagcgugagaauccgcguuccaccucaaucccucuguuuuauaggugggaauaaaaccuaguguuuugaaagaaccaaacauacagguuuguuaaaauuuguaaaaaguacaucuuuucaauacagauaauaauacaaaaucuaagcggaagacuagggauggacccguauguuacuguuucagacuaugagcuggaca

SEQ ID NO: 11655 - RNA, 1259 nt, Mus musculus
cgcuaugaacugggaugcuaagcuaaaagaagcccuuccuccagcuagcugcuuuuuaucgggguauuuuaucacagcgguagaaaugaaauuaggauacaccucaaguaagugaugugaacauauacccagguggcuuucucccaugagcaauuacaaguuucuuucccaauguugcagcaggugaccuucuacauuaagauacaucagaagacaggucaaaaguagagaguccccaauaaacacgaugauaauggagugaaaaaugcuacccgugggccaaguaaagucauggcguuggggaggagagccuacaccuuggaaugguuuguuucuguuuagucggccuggcccagcaaacacucaauuaacaaugugcuaucuuaagaugucacuaucaaggcugcuuugugauggagcugcuacugagccagcaggauccuuucaacaggcucccaagaccaaggcucaagauaaaguaacagagauacuguugagagugacucacaguggggcaggaaccacagcucacaggaacccaguuaugcaggaaccugaagcagggugguucugaguucuaggucauucugaguugaaagccauucugagcaucuuagugagauugaucucaagauaaaaaaguaaggcucguucgguuggucugucggguaaguggcuuaguggauuagaugccugcccuaccaugugggaagaccuggguuccaucucuugcauuacaccacacacauuuaucccuagcagugggcagcugagccaggcagagcucugagucugaagcuagcccgguuuacacaaagagacucugucucaaaaacaaaacaaaacaaaacaaaacaaaacaguaaaaagugaaauaaaggggacgggggauauacuucagugguagaaagcuuacaaaagcugcuugcuucaauuucagaauaguaguauauaauaauaaugauaauaauaauaauaauaacaauaacaacaagcuauugugucaaccuguauuguucuuuguagccgaaagagaagaaagccgcccugagaaagaccugcgacugcugacuguuacuuccacaccuucuucuauccugagaaucucagaggccucugcuucaucuggauugcauacuguugcugacauucgguugauaaggcggcauucuuaggaaagguaccagcgucccauuacugucaccucccgcaggugggauucacccuuucuucuccaaugacacaacacaagucaagcc

SEQ ID NO: 11656 - RNA, 1259 nt, Mus musculus
ggcuugacuuguguugugucauuggagaagaaagggugaaucccaccugcgggaggugacaguaaugggacgcugguaccuuuccuaagaaugccgccuuaucaaccgaaugucagcaacaguaugcaauccagaugaagcagaggccucugagauucucaggauagaagaagguguggaaguaacagucagcagucgcaggucuuucucagggcggcuuucuucucuuucggcuacaaagaacaauacagguugacacaauagcuuguuguuauuguuauuauuauuauuauuaucauuauuauuauauacuacuauucugaaauugaagcaagcagcuuuuguaagcuuucuaccacugaaguauaucccccguccccuuuauuucacuuuuuacuguuuuguuuuguuuuguuuuguuuuguuuuugagacagagucucuuuguguaaaccgggcuagcuucagacucagagcucugccuggcucagcugcccacugcuagggauaaaugugugugguguaaugcaagagauggaacccaggucuucccacaugguagggcaggcaucuaauccacuaagccacuuacccgacagaccaaccgaacgagccuuacuuuuuuaucuugagaucaaucucacuaagaugcucagaauggcuuucaacucagaaugaccuagaacucagaaccacccugcuucagguuccugcauaacuggguuccugugagcugugguuccugccccacugugagucacucucaacaguaucucuguuacuuuaucuugagccuuggucuugggagccuguugaaaggauccugcuggcucaguagcagcuccaucacaaagcagccuugauagugacaucuuaagauagcacauuguuaauugaguguuugcugggccaggccgacuaaacagaaacaaaccauuccaagguguaggcucuccuccccaacgccaugacuuuacuuggcccacggguagcauuuuucacuccauuaucaucguguuuauuggggacucucuacuuuugaccugucuucugauguaucuuaauguagaaggucaccugcugcaacauugggaaagaaacuuguaauugcucaugggagaaagccaccuggguauauguucacaucacuuacuugagguguauccuaauuucauuucuaccgcugugauaaaauaccccgauaaaaagcagcuagcuggaggaagggcuucuuuuagcuuagcaucccaguucauagcg

SEQ ID NO: 11657 - RNA, 2841 nt, Mus musculus
gcauuucaguugcuugccuaccgugcaggaaacuuuagguucaagccccaacaaaacagaugugcugauccacaucuguaagccuagcauuuguaaaguucuggaggcgggggauaguguugacuauauaauauaauaagcgcgcaucuuggguuguguaagacccgggcucaaaaaacaaauacaacaacaacaaaacaaacaagcaagcaagcaaacaaauaaaaacaagaaggaaggaagggacaaagggaagggaagaacacaggagugauaugugguuucucaugugucuucugaacaaagugcuuuguaguauagccgguuuaagcuuaucuccgaguagcguacaaauaagugagauucagaauaugguuacuuuauuuggcuuugacaauuaccaggguggaaucaccucuaauuacucuuuuaauuacuggccuggcuaccucccaagggcuguaucccagauacuugcuguuucuccuggccaugugcucaugguuccucuccccuaauggcggcuuccuccuccucucuuccauguucuuccuccuucuuucccggucucuccuccuccaaucaggucacuccaaacccaccuaccucuaaucccucugaugauuggcuauagccaauuuuguuuaaccaauaguuuuaaaccaaugagaacaagguuugcacaacggaauguuacaaccguaagaagccauuuguagcgcuagaucuucccguauuaaaauuuuagcaucagaauaccuagcaauagaguaaaccucaacauugcuuaauccagcugguaaaauuaacacuuuaugcucauauguuugaacaaauaccauccaacuuuuauauaauucuucuuuucaaaaaaaccagccaagauagccccaggucaucuguggccacggcuccuaccacacuuugucccagguuucaauuccggagccuucucccauauaaaaugccuuguuacuuucucugcuuucucuuuuccauuuugugagcuccacguggcaccuugugggauugcuuacaguugauuuccccuuaauggaauuuaaguagacacaggacaaugucuaggacauugggagucuucaguaaguguucgugacugaguaggugugagugugugcuguugcuggcuguuugagguacugggaccugagcccugggccuggugcaugcuaagugacuauugcagggucacaacuggagccuugucuuuaguuuucaggucuucgagaguuuucagaucuaacuauaaauacugaccuccucaauaaacuggcuuaggaaacuuuggaagaguucuuucaagacaugaacacaagguuggcaccuccaagaacuuaacaugauaaucacaaauauuaaaaaaaacaaaacaaaacaaaaaaaacaaaacccucuuaaauggcugauaaaauaguacucccucaaagaacuaguuuaaaugauucauuuugaaaauuggaaacaauuuuacuuuucaaagaacaucugaguacuuuauacaccuaacacuuaaaaggaugcaugauuugauaggauuauuucagcucuguaugcacagaguuguuggcucacuaucuuacauuaaacccagucagacccacgucuucccuuacuacugaugccuguauuugccaauguucuuucuauuacaaacaaacaaacaaacaaacaauaacaaaaagacuaauuuuaaauuuuucuaaggcaagucaguauuugcuuccaguagauggcacugcagagcaagccuuuauagauguaguaauuugucccuuugaucaugaaaaucauuauuuauucuguuaugaggucauauaaagagcuuacacggugacaccaaacacauaagggacuuuguacuguguucugucacugacaucucaucuguacaccuuagcugggcacuugccaauauaguggacucccuguugcugaagugacccaccauguaugaaaccacuuuuugauauuggauuuuaccugcuuguuuuaauuugguuggcuuauuuuauauguucagugggacugcauacauuuucacggugucaaauuugaccucauucagguuuguuaacacacacaggggaaggauaguucuagaaccagaaacaauaucccugaccuguaugugcacacacacacacacacacacacacacacacacacacacacacaguguuucagguacagggacuuaguuggaucucagauuguguaucaaaugucaacaauguuucuuaaaaccauuuaaaaggaaugucauacaugauauuggcugguaguuauuaaaugcuaucauauauaaaaacauaccuagaagagugucugggguaaauuagguauaaaauauccaccuuggagcuggggauauggcuuaguugguagugugcuugccuaagaugcaaaagacccuggguuugaucacaaggaccucauuaaaaucagauguggugcuguuugccagcacugaucauccuuugguauauaagugagcuuaagguuagcccaggcuauaagaaauccuaucucaaaguaaaagccccucuuuuuuucuccucagagaguagaggaauacaaagggccagaagcagaaagcgagcaucuauaucuuuccacuuaauaguacuuaccaaauaaucuuaguaaucuuucuggauuccagcucucaaaauggcuggaccugagccuucaggacagggaacaaguuuuccaagagaaaacauugugaaguaugauguaugcgucacugucauccuccgguguucaagccaauagcugugaaaauccuaagugaucuuuguccgaaggauuuucagacug

SEQ ID NO: 11658 - RNA, 2841 nt, Mus musculus
cagucugaaaauccuucggacaaagaucacuuaggauuuucacagcuauuggcuugaacaccggaggaugacagugacgcauacaucauacuucacaauguuuucucuuggaaaacuuguucccuguccugaaggcucagguccagccauuuugagagcuggaauccagaaagauuacuaagauuauuugguaaguacuauuaaguggaaagauauagaugcucgcuuucugcuucuggcccuuuguauuccucuacucucugaggagaaaaaaagaggggcuuuuacuuugagauaggauuucuuauagccugggcuaaccuuaagcucacuuauauaccaaaggaugaucagugcuggcaaacagcaccacaucugauuuuaaugagguccuugugaucaaacccagggucuuuugcaucuuaggcaagcacacuaccaacuaagccauauccccagcuccaagguggauauuuuauaccuaauuuaccccagacacucuucuagguauguuuuuauauaugauagcauuuaauaacuaccagccaauaucauguaugacauuccuuuuaaaugguuuuaagaaacauuguugacauuugauacacaaucugagauccaacuaagucccuguaccugaaacacugugugugugugugugugugugugugugugugugugugugugugcacauacaggucagggauauuguuucugguucuagaacuauccuuccccuguguguguuaacaaaccugaaugaggucaaauuugacaccgugaaaauguaugcagucccacugaacauauaaaauaagccaaccaaauuaaaacaagcagguaaaauccaauaucaaaaagugguuucauacauggugggucacuucagcaacagggaguccacuauauuggcaagugcccagcuaagguguacagaugagaugucagugacagaacacaguacaaagucccuuauguguuuggugucaccguguaagcucuuuauaugaccucauaacagaauaaauaaugauuuucaugaucaaagggacaaauuacuacaucuauaaaggcuugcucugcagugccaucuacuggaagcaaauacugacuugccuuagaaaaauuuaaaauuagucuuuuuguuauuguuuguuuguuuguuuguuuguaauagaaagaacauuggcaaauacaggcaucaguaguaagggaagacgugggucugacuggguuuaauguaagauagugagccaacaacucugugcauacagagcugaaauaauccuaucaaaucaugcauccuuuuaaguguuagguguauaaaguacucagauguucuuugaaaaguaaaauuguuuccaauuuucaaaaugaaucauuuaaacuaguucuuugagggaguacuauuuuaucagccauuuaagaggguuuuguuuuuuuuguuuuguuuuguuuuuuuuaauauuugugauuaucauguuaaguucuuggaggugccaaccuuguguucaugucuugaaagaacucuuccaaaguuuccuaagccaguuuauugaggaggucaguauuuauaguuagaucugaaaacucucgaagaccugaaaacuaaagacaaggcuccaguugugacccugcaauagucacuuagcaugcaccaggcccagggcucaggucccaguaccucaaacagccagcaacagcacacacucacaccuacucagucacgaacacuuacugaagacucccaauguccuagacauuguccugugucuacuuaaauuccauuaaggggaaaucaacuguaagcaaucccacaaggugccacguggagcucacaaaauggaaaagagaaagcagagaaaguaacaaggcauuuuauaugggagaaggcuccggaauugaaaccugggacaaagugugguaggagccguggccacagaugaccuggggcuaucuuggcugguuuuuuugaaaagaagaauuauauaaaaguuggaugguauuuguucaaacauaugagcauaaaguguuaauuuuaccagcuggauuaagcaauguugagguuuacucuauugcuagguauucugaugcuaaaauuuuaauacgggaagaucuagcgcuacaaauggcuucuuacgguuguaacauuccguugugcaaaccuuguucucauugguuuaaaacuauugguuaaacaaaauuggcuauagccaaucaucagagggauuagagguagguggguuuggagugaccugauuggaggaggagagaccgggaaagaaggaggaagaacauggaagagaggaggaggaagccgccauuaggggagaggaaccaugagcacauggccaggagaaacagcaaguaucugggauacagcccuugggagguagccaggccaguaauuaaaagaguaauuagaggugauuccacccugguaauugucaaagccaaauaaaguaaccauauucugaaucucacuuauuuguacgcuacucggagauaagcuuaaaccggcuauacuacaaagcacuuuguucagaagacacaugagaaaccacauaucacuccuguguucuucccuucccuuugucccuuccuuccuucuuguuuuuauuuguuugcuugcuugcuuguuuguuuuguuguuguuguauuuguuuuuugagcccgggucuuacacaacccaagaugcgcgcuuauuauauuauauagucaacacuaucccccgccuccagaacuuuacaaaugcuaggcuuacagauguggaucagcacaucuguuuuguuggggcuugaaccuaaaguuuccugcacgguaggcaagcaacugaaaugc

SEQ ID NO: 11659 - RNA, 1019 nt, Mus musculus
auagauagucagucacacagauagacagacagacagacuaaaaaugaaaugaaaacaagaaaagaauaguaaaaaaauaaagguaaaaggaaaaaauaaacauuaaacagcacagaugugcaaugucugaagauaauaaaguugguaaacuagaaaaaaaaacaagguagaaagaagucaugauaaguaucaggaaacaaagacagggucacuagagacugcagauacauuuaccugaaggauaaacaucaauaaacuuuaugcuaauaacaacuuaaaaugaacucuauaaaagccacaaauuaucaaaacugacacaaaauuuaaaaaucuaaauaacuuaauguauauaaaaguuuucacaacuacauauacaucacacacacacacacacacacacacacacauaucuccaggcccagauagcuucaccagccagcccuaagguuucagaaugaaaugaaacaaaucauagucaaauuacuacacagaacagaaaaagaaaaacaucccuuaucucuuuuugagucugcaucauccuaauaucaaaacaagaaaaagaaaugcaugagaagaaaaaaagcugcagacaguucuguggguccugagggucagggacaaacaauauaccuuauucuaccacuucuacuccacauuccacaagagaagagaaacgcacucuuuaauuuaacuggcuuucuauugaacaagcaacuggaaaugaaacuaagaaacaucacuuacagcacaacucaauacacugaaauuaaauuucccuggggauaauuaguggacaaaaguauggcaaugaacugugauccuuacaggguaacaacauagccauggccccacugaucuagaucccuacaagugcuuuuuguagaaaccaacaaguugauucuaaaauucaugagaacaugcaaccuacgagagcuaaaacaacucuuuaauuuuaaaaaauucaguucaaagacauguauuguuuaaauuuaagucauuauuacagaguacuguguaua

SEQ ID NO: 11660 - RNA, 1019 nt, Mus musculus
uauacacaguacucuguaauaaugacuuaaauuuaaacaauacaugucuuugaacugaauuuuuuaaaauuaaagaguuguuuuagcucucguagguugcauguucucaugaauuuuagaaucaacuuguugguuucuacaaaaagcacuuguagggaucuagaucaguggggccauggcuauguuguuacccuguaaggaucacaguucauugccauacuuuuguccacuaauuauccccagggaaauuuaauuucaguguauugaguugugcuguaagugauguuucuuaguuucauuuccaguugcuuguucaauagaaagccaguuaaauuaaagagugcguuucucuucucuuguggaauguggaguagaagugguagaauaagguauauuguuugucccugacccucaggacccacagaacugucugcagcuuuuuuucuucucaugcauuucuuuuucuuguuuugauauuaggaugaugcagacucaaaaagagauaagggauguuuuucuuuuucuguucuguguaguaauuugacuaugauuuguuucauuucauucugaaaccuuagggcuggcuggugaagcuaucugggccuggagauaugugugugugugugugugugugugugugugauguauauguaguugugaaaacuuuuauauacauuaaguuauuuagauuuuuaaauuuugugucaguuuugauaauuuguggcuuuuauagaguucauuuuaaguuguuauuagcauaaaguuuauugauguuuauccuucagguaaauguaucugcagucucuagugacccugucuuuguuuccugauacuuaucaugacuucuuucuaccuuguuuuuuuuucuaguuuaccaacuuuauuaucuucagacauugcacaucugugcuguuuaauguuuauuuuuuccuuuuaccuuuauuuuuuuacuauucuuuucuuguuuucauuucauuuuuagucugucugucugucuaucugugugacugacuaucuau

SEQ ID NO: 11661 - RNA, 640 nt, Mus musculus
aaacacaucuuuagguuccugucaauuugggguuuuuuuuuaaaagauuuauuuacuuuauguaugaguacucuaucuacauguacaucugcacaccugaagagggcaucagaucauguuaugcaugguuguaggccaccauguggcugcuacaaaucaaacucaggaccucuggaagagcagacaguguucuuaaccaccgaaucaucucuccagguccucaugccaauuuauuuucaccaagguuucucagcaaaucuuaccuauguccuugauaucuuuuuaccuuuauaaaauuuauaguccuacagggacuauaaaaauccggagaacauacccacagaaaguuauauuagccaaacauguuuucuuccagccuaauagccacaaauucaaagcauuaaauacauuugcaagagacuauauggcuccuucauagcacucagccaacugcaaauacugcuuguggccaagaacaauacugcuuuggcacguggaaagaguaauacaaagccaauugagaaaucucuaugcacuacugaaacacaagugaaaggaauggaauauuauuauauaccuguguuuaacagauaaugaugaaaagagacagcucagcaguuaaaaacugccuccuuuucag

SEQ ID NO: 11662 - RNA, 640 nt, Mus musculus
cugaaaaggaggcaguuuuuaacugcugagcugucucuuuucaucauuaucuguuaaacacagguauauaauaauauuccauuccuuucacuuguguuucaguagugcauagagauuucucaauuggcuuuguauuacucuuuccacgugccaaagcaguauuguucuuggccacaagcaguauuugcaguuggcugagugcuaugaaggagccauauagucucuugcaaauguauuuaaugcuuugaauuuguggcuauuaggcuggaagaaaacauguuuggcuaauauaacuuucuguggguauguucuccggauuuuuauagucccuguaggacuauaaauuuuauaaagguaaaaagauaucaaggacauagguaagauuugcugagaaaccuuggugaaaauaaauuggcaugaggaccuggagagaugauucggugguuaagaacacugucugcucuuccagagguccugaguuugauuuguagcagccacaugguggccuacaaccaugcauaacaugaucugaugcccucuucaggugugcagauguacauguagauagaguacucauacauaaaguaaauaaaucuuuuaaaaaaaaaccccaaauugacaggaaccuaaagauguguuu

SEQ ID NO: 11663 - RNA, 432 nt, Mus musculus
acuucagaaguguucauuauucuuuccugccccagcauacagaugguuaccaaaggagacaaauuucuucacaaauauaaaauaagccagaguuagcaaauguucacugaugggagaccugcuguaagcaccaaacuccacgccaaugcauuuguaacaaauggaacaguggugggcuguaacacugagacuagcugaauauuacucccaaaucauggauggugucacaaugaagcuucuagguccuccucugaaacaugcuaacauguacuuuuguugucuuuguucuuguuuuuugaaacaggguuucucuguguagcccuggcuguccugacacucacucugcagaccaggcuggccuugaacucagaaauccgccugccucugccucccaagugcugggauuaaaggcgugcgccaccacugcucugc

SEQ ID NO: 11664 - RNA, 432 nt, Mus musculus
gcagagcagugguggcgcacgccuuuaaucccagcacuugggaggcagaggcaggcggauuucugaguucaaggccagccuggucugcagagugagugucaggacagccagggcuacacagagaaacccuguuucaaaaaacaagaacaaagacaacaaaaguacauguuagcauguuucagaggaggaccuagaagcuucauugugacaccauccaugauuugggaguaauauucagcuagucucaguguuacagcccaccacuguuccauuuguuacaaaugcauuggcguggaguuuggugcuuacagcaggucucccaucagugaacauuugcuaacucuggcuuauuuuauauuugugaagaaauuugucuccuuugguaaccaucuguaugcuggggcaggaaagaauaaugaacacuucugaagu

SEQ ID NO: 11665 - RNA, 528 nt, Mus musculus
aaaggauuacuagggacuggagagauggcuaaaccagugguuaagagcacucacugcucuuacacagaagcuggaucuguucauggaaccuauauggcaacucacaacugucuguaaucugaugcucucuucuggacucugaaggcaucgaguacauguaugguacacagaaauacauacaggcaaaacacccauauacauaaaaagcagauuaaaaaucuacuauagaguugugugagacacuggucacacuggguuuugagaacggaagguuacaacguggggauggucuaaguccagauaaaguagacacugcacugcaacaagagcagccaccucugaucacacacuuucugcgugcucagaaaccuccuuccaaaacuuguaccgccucgucuggacgcacagcaauccaccaagugggcaaccaucacucuggaguaaggaaauggaagcacaaggaacuuuaguacuuuugccagcaaacacccaacccaucgugacagugagagccacagcaggcacagu

SEQ ID NO: 11666 - RNA, 528 nt, Mus musculus
acugugccugcuguggcucucacugucacgauggguuggguguuugcuggcaaaaguacuaaaguuccuugugcuuccauuuccuuacuccagagugaugguugcccacuugguggauugcugugcguccagacgaggcgguacaaguuuuggaaggagguuucugagcacgcagaaagugugugaucagagguggcugcucuuguugcagugcagugucuacuuuaucuggacuuagaccauccccacguuguaaccuuccguucucaaaacccagugugaccagugucucacacaacucuauaguagauuuuuaaucugcuuuuuauguauauggguguuuugccuguauguauuucuguguaccauacauguacucgaugccuucagaguccagaagagagcaucagauuacagacaguugugaguugccauauagguuccaugaacagauccagcuucuguguaagagcagugagugcucuuaaccacugguuuagccaucucuccagucccuaguaauccuuu

SEQ ID NO: 11667 - RNA, 1223 nt, Mus musculus
aaaaucaaugaggugauguauaaauuuaauugauuaucauaauucugugcucaaaagucagcaaugaaaaauaaaaccaggaaaauaaaucuacagcccuaaaauguauacauguuuuuuaaaaaagagagugcaguuccagaccugcaaaugguauuggggauugucuacuacuucagucuuauugccuccacaaaacccacacugacuguacaaggcccaagucagacgcacacacccaucccaaaggagggaggcgggaugggguuacagugagggcuauacuuuggcuguagacuauaacacacaugcaaacaugggaggagcaggcuugagaaauguauacagaccccuuggaggaaaggcauugaggucaggaggcacugagcaacaagacagguccaguccugcccuuccccacuaccaucaggaaggcggcucugggguaauuacucuuuuugguuuuuggagacagguucucucuccauagcccuggcuguccuggaacucacucuguagaccaggcuggccucaaacucagaaaucuaccugccuccgccucccgagugcugggauuaaaggcuugcgccaccacaccuggccaauauuuucauuguuaaucauagguaucugagguuauaccucaaaguacugaaacaacaaaggcacauuucuuucauaugauuuaugaccaaauaccgagcacagaaaaauuauuuagcuccacuccuauaacaauacuuagacauuacugaauauaagaaguaaguauugcauccuaaggauauuagcacacacucuucucaagauaaaaacaucuuuuaggaagaguaggggauguuaccagacauugagccuuaggccuggugcacacuaggcaagugcucucacuauucccaagcuagacuuucagccuuaauucugguuuuuaaaggagaauagggccauaucuugaaauguucacaaagaacucugaucuggaugcuggccgcuuggugcagaccuggaaccccagcguucaggaggaggaggccaugugacugugagcuugaggucauccugggcuucacagagcguucaaggcuaaacugcuaccacagugagucuguuuaaaaagcaaaagucaaacguuugcaaucagggaggcaguaaaagcuaaugaauccgucaaucuaauugcugacuggguguauuuucuucacgacucgagcuguuucccucac

SEQ ID NO: 11668 - RNA, 1223 nt, Mus musculus
gugagggaaacagcucgagucgugaagaaaauacacccagucagcaauuagauugacggauucauuagcuuuuacugccucccugauugcaaacguuugacuuuugcuuuuuaaacagacucacugugguagcaguuuagccuugaacgcucugugaagcccaggaugaccucaagcucacagucacauggccuccuccuccugaacgcugggguuccaggucugcaccaagcggccagcauccagaucagaguucuuugugaacauuucaagauauggcccuauucuccuuuaaaaaccagaauuaaggcugaaagucuagcuugggaauagugagagcacuugccuagugugcaccaggccuaaggcucaaugucugguaacauccccuacucuuccuaaaagauguuuuuaucuugagaagagugugugcuaauauccuuaggaugcaauacuuacuucuuauauucaguaaugucuaaguauuguuauaggaguggagcuaaauaauuuuucugugcucgguauuuggucauaaaucauaugaaagaaaugugccuuuguuguuucaguacuuugagguauaaccucagauaccuaugauuaacaaugaaaauauuggccaggugugguggcgcaagccuuuaaucccagcacucgggaggcggaggcagguagauuucugaguuugaggccagccuggucuacagagugaguuccaggacagccagggcuauggagagagaaccugucuccaaaaaccaaaaagaguaauuaccccagagccgccuuccugaugguaguggggaagggcaggacuggaccugucuuguugcucagugccuccugaccucaaugccuuuccuccaaggggucuguauacauuucucaagccugcuccucccauguuugcauguguguuauagucuacagccaaaguauagcccucacuguaaccccaucccgccucccuccuuugggaugggugugugcgucugacuugggccuuguacagucaguguggguuuuguggaggcaauaagacugaaguaguagacaauccccaauaccauuugcaggucuggaacugcacucucuuuuuuaaaaaacauguauacauuuuagggcuguagauuuauuuuccugguuuuauuuuucauugcugacuuuugagcacagaauuaugauaaucaauuaaauuuauacaucaccucauugauuuu

SEQ ID NO: 11669 - RNA, 102 nt, Mus musculus
ggaacuagaguuauagacaauugugaacugucauuugugugcugaggucugaacccagguccuuuggaacaccagcaaaugcucuuaacuguuaaggaauca

SEQ ID NO: 11670 - RNA, 102 nt, Mus musculus
ugauuccuuaacaguuaagagcauuugcugguguuccaaaggaccuggguucagaccucagcacacaaaugacaguucacaauugucuauaacucuaguucc

SEQ ID NO: 11671 - RNA, 235 nt, Mus musculus
agagaacuaaccucugccccuucugcuuuucccacaggacaccaccagcugggcauggaggggccccggcgugugagugcuagggucacagggguuaggguggggagucggguccaccagagcauuucugauccagucucuaaucaaagaggugaaugaccuacaguguaggacugagagaacuccagcggagauugcccucugaccuccccacauuacuuggcaguguuucuag

SEQ ID NO: 11672 - RNA, 235 nt, Mus musculus
cuagaaacacugccaaguaauguggggaggucagagggcaaucuccgcuggaguucucucaguccuacacuguaggucauucaccucuuugauuagagacuggaucagaaaugcucugguggacccgacuccccacccuaaccccugugacccuagcacucacacgccggggccccuccaugcccagcuggugguguccugugggaaaagcagaaggggcagagguuaguucucu

SEQ ID NO: 11673 - RNA, 1306 nt, Mus musculus
ccuuggaacguucggccccuuagcgaugcggccuguugagagcacuggcaucagugugcucacaguaucccaggagacgccugccuuugcaguucagagucuggauagaauuguuuccagcugugggucggugggccagaaaaaaucucagagcccaaguuccuuccugcauaaaguggagaguugcuuacuauauacaaggucuacuuuagcaucacauaucgaccuugucaagauguccuacguguccuaaauucaucuuuucaugguaaauuauaacaccacaagacuaguuucccugcuacaaugaucagccuuugaauuauuuauaaauaguacuggcugaaaaaaauccuucuuccacucauaaagauuuuaacaauccccaagguaucucuugcagguuugaaaaagagaaggaacuaaaaugcuuauuuuuauacuuaaaggaaaauaaaauuuugccuucagacccaacucgugaauguguaaccauuguuuagagguaaccaacacaguaucugaaaaucagccaaucagagacagccucucuucaggggcuuccaaaucagccaguuaucaacagcuucugaaacccagcuaaucauugacagcagcccaaucagcagcgcaaugaccaggcuuccgaaugaaagagccuuucuuagcugcuuuguucuguagaccacuguuaacagccaggagacuguaaauugcuaaacagucaauuuauugaaacaccucgagcuuuuacgcacccagucauuauauacaucuccagcucuguuaaucagcuuugagaauacaucuuuucucuacaagcaaaugugauauucaccuucuuccuuccuccuccauuugguauguuuuauguagccuaggcugaccuugaaccccugaacuugaacccuugaacucuugcuucaaccuccuaaauucugagauuacaggccugcaucaucauguccagauggaaggcuacuacaauuuguagcacagaacaaaauugugugccuuugguugcuuggccaaugucgugguaugcagauaucacaucuuuuguauucauuuaucaguuaaugaauauagaagcuuuuuuccacacuuucugugccuuagcuuaaugccaauaugaccaaauaccgaaaguuuuuguguagacauguuuuuaauucuccuguauauguaguauacuccuagaaguguacugcuugauuauacugaaagucuguguuuaauaauuugaggcaucuuuuuguuuuccaaaaaagcugcaccauuuauauucacauuaccuaggugagag

SEQ ID NO: 11674 - RNA, 1306 nt, Mus musculus
cucucaccuagguaaugugaauauaaauggugcagcuuuuuuggaaaacaaaaagaugccucaaauuauuaaacacagacuuucaguauaaucaagcaguacacuucuaggaguauacuacauauacaggagaauuaaaaacaugucuacacaaaaacuuucgguauuuggucauauuggcauuaagcuaaggcacagaaaguguggaaaaaagcuucuauauucauuaacugauaaaugaauacaaaagaugugauaucugcauaccacgacauuggccaagcaaccaaaggcacacaauuuuguucugugcuacaaauuguaguagccuuccaucuggacaugaugaugcaggccuguaaucucagaauuuaggagguugaagcaagaguucaaggguucaaguucagggguucaaggucagccuaggcuacauaaaacauaccaaauggaggaggaaggaagaaggugaauaucacauuugcuuguagagaaaagauguauucucaaagcugauuaacagagcuggagauguauauaaugacugggugcguaaaagcucgagguguuucaauaaauugacuguuuagcaauuuacagucuccuggcuguuaacaguggucuacagaacaaagcagcuaagaaaggcucuuucauucggaagccuggucauugcgcugcugauugggcugcugucaaugauuagcuggguuucagaagcuguugauaacuggcugauuuggaagccccugaagagaggcugucucugauuggcugauuuucagauacuguguugguuaccucuaaacaaugguuacacauucacgaguugggucugaaggcaaaauuuuauuuuccuuuaaguauaaaaauaagcauuuuaguuccuucucuuuuucaaaccugcaagagauaccuuggggauuguuaaaaucuuuaugaguggaagaaggauuuuuuucagccaguacuauuuauaaauaauucaaaggcugaucauuguagcagggaaacuagucuugugguguuauaauuuaccaugaaaagaugaauuuaggacacguaggacaucuugacaaggucgauaugugaugcuaaaguagaccuuguauauaguaagcaacucuccacuuuaugcaggaaggaacuugggcucugagauuuuuucuggcccaccgacccacagcuggaaacaauucuauccagacucugaacugcaaaggcaggcgucuccugggauacugugagcacacugaugccagugcucucaacaggccgcaucgcuaaggggccgaacguuccaagg

SEQ ID NO: 11675 - RNA, 85 nt, Mus musculus
cagcucucagucaaggccaagguuauggcuuagcaguguggucacgaggugaguggcaauggccaggagcacagcaguaugcagg

SEQ ID NO: 11676 - RNA, 85 nt, Mus musculus
ccugcauacugcugugcuccuggccauugccacucaccucgugaccacacugcuaagccauaaccuuggccuugacugagagcug

SEQ ID NO: 11677 - RNA, 61 nt, Mus musculus
gaagcccaaaucugcagaaggaguaugugugguaucuagguaaccacaugcugacaaccca

SEQ ID NO: 11678 - RNA, 61 nt, Mus musculus
uggguugucagcaugugguuaccuagauaccacacauacuccuucugcagauuugggcuuc

SEQ ID NO: 11679 - RNA, 67 nt, Mus musculus
aaaaaauaaauaaauaaacaaacauacaaagacucaaaguuuucugccuauguuuucauacgagagg

SEQ ID NO: 11680 - RNA, 67 nt, Mus musculus
ccucucguaugaaaacauaggcagaaaacuuugagucuuuguauguuuguuuauuuauuuauuuuuu

SEQ ID NO: 11681 - RNA, 95 nt, Mus musculus
gcaaacagaacaguggcauuaucggaguucccccaguucugagugaaagggccagggggagggauggauguuccccucucgguccuacucuggac

SEQ ID NO: 11682 - RNA, 95 nt, Mus musculus
guccagaguaggaccgagaggggaacauccaucccucccccuggcccuuucacucagaacugggggaacuccgauaaugccacuguucuguuugc

SEQ ID NO: 11683 - RNA, 789 nt, Mus musculus
gagaagacuauggcucuggaggaaauggcacaguugguaaauaggagugccagaacuugaacccaacccucguuuccacagccucacugggcucugacacuucaggcuccccacgaccccucccuguacucaccagcuuuguaguguccauggcagugagcaccgcacgguucagagacuccagcgcagccagcacgggccgguagacacccagguguguggagaaguagucugcaggcagaagagguccaggggcacuagccuaaaccaucucuccagcccagaauuccucagcugcuccagccuucccaucccaagaggccagccccauaaagcaucccucaccacacccacccgcccaggggcugggacacaagacuacucaccacacaguuucucugucucuaaauugcugugggggaaagagaaaacaucuuugagacucuuagcaccugggccuggagaaccagacagaugccugguugugccacagcaagccagcuccuacugagccucacauagcauggcugcuggggaggggucacaggcccuucagagggucagucuaaguccuugaaaccuugaaugcugaccuagucuaggauuuacacuaaggagaugggacgggaagggaaaggaaggaaaaggagaggacagggguagcuguacauguucaugguguguguccccaagugaagaagcagggaaggagcauacacgugaaccagaugugggcaugugggaagcaagagaguauggacuccugcaucugcauccacaggcagaggc

SEQ ID NO: 11684 - RNA, 789 nt, Mus musculus
gccucugccuguggaugcagaugcaggaguccauacucucuugcuucccacaugcccacaucugguucacguguaugcuccuucccugcuucuucacuuggggacacacaccaugaacauguacagcuaccccuguccucuccuuuuccuuccuuucccuucccgucccaucuccuuaguguaaauccuagacuaggucagcauucaagguuucaaggacuuagacugacccucugaagggccugugaccccuccccagcagccaugcuaugugaggcucaguaggagcuggcuugcuguggcacaaccaggcaucugucugguucuccaggcccaggugcuaagagucucaaagauguuuucucuuucccccacagcaauuuagagacagagaaacuguguggugaguagucuugugucccagccccugggcggguggguguggugagggaugcuuuauggggcuggccucuugggaugggaaggcuggagcagcugaggaauucugggcuggagagaugguuuaggcuagugccccuggaccucuucugccugcagacuacuucuccacacaccugggugucuaccggcccgugcuggcugcgcuggagucucugaaccgugcggugcucacugccauggacacuacaaagcuggugaguacagggaggggucguggggagccugaagugucagagcccagugaggcuguggaaacgaggguuggguucaaguucuggcacuccuauuuaccaacugugccauuuccuccagagccauagucuucuc

SEQ ID NO: 11685 - RNA, 59 nt, Mus musculus
cccauuucuuccaguccuguggauucugcugacuaaaugcagcgcuuugaauucccuca

SEQ ID NO: 11686 - RNA, 59 nt, Mus musculus
ugagggaauucaaagcgcugcauuuagucagcagaauccacaggacuggaagaaauggg

SEQ ID NO: 11687 - RNA, 168 nt, Mus musculus
ccucugacucacuggggggggggcugguucuagggacccccugagcacacagauccuuauccuuauguccuuucauuaagucauguaguauuucacgugaccuacacacaucuccuggaauacuuccaaccaccucaagauuaucuacaguaucuaauguagauggua

SEQ ID NO: 11688 - RNA, 168 nt, Mus musculus
uaccaucuacauuagauacuguagauaaucuugaggugguuggaaguauuccaggagauguguguaggucacgugaaauacuacaugacuuaaugaaaggacauaaggauaaggaucugugugcucagggggucccuagaaccagccccccccccagugagucagagg

SEQ ID NO: 11689 - RNA, 4402 nt, Mus musculus
uuucugcugugaugugagauccaacagacagagccacugaugcuuauaguugaguauaucagaaaagugacuuuggaauccauuucuucucuauguaacuugagacaucugucuccaggcaagagaguauuuuaggaaccuggugaccugcugaaaagacuugacgaucucugucugucuguccguugguuaccuagcaaacacagaaguggaugcucacagucagcuaauggauggaucacagggcucccaauggaggagcuagagaaaguacccaaggagcuaaagggaucugcaacccuauagguggaacaacaauaugaacuaaccaguacccuggagcucuugacucuagcugcauauguaucaaaagauggccuagucggccaucacuggaaagagaggcccauuggacacgcaaacuuuauaugccccaguacaggggaacgccagggccaaaaagggggaguggguggguaggggaguggggguggguggguaugggggacuuuugguauagcauuggaaauguaaaugagcuaaauaccuaauaaaaaauggaaaaaaaaaagccaaaaaaaaaaaaaaaagaguaaaugcuuaaggcaucuggccuaauggcagcgaaggagcaaugcauaaggaaaggaaacagauugugagaugcagguugucaagguguccaguaaagacuuguccguccagucugagugaugauacacccugcucucccugcauccuacuguugauuauuuacguaucagggucucccuagguagcccuugcuggccugaagcucucuaugaagacuaugcuguuuuugaacccacagagaucugccugccucugagacucaagugcuuggauuaaagguguguaucgucaugcccagcuuuaaaucucauuucuccuuacuugcuuauuuaacguccggugcugagcuguggacaucacaguuuauuaagaccaagaagagcagaauggagaaaauuugaaugacucaaaugcugggagggaaaagcuucaagaaaacgaaggccccacuaugaagcugugggaaggaggaagucccugggggcucuaaacacacgacacagucgugcuuuauagcagacaauuuucucuaaacaaaaguggauuuauuuuaucucacagcaugaagauuuuagagucauagaaacagauuuuuucuggcacaggggauguuuacccacaagaaaugggcuccucagaaaggaauccagacuucugaaggucacuuuugauuggauuaaaucaacaaggccugaccaggcuaaugguuucugaugguuccuagaacccugaggcaggaggcuuguuagugauggugguagcuagggaaguguuuagauauacagaagaguuguaaaccgagugaauagcguuucugugugcccuucauucagcuuuccccacagacauugugcuuugccuugccucaagcaggguccugacuaguauucucccaguacuaccaaugaccccacacaucuauucuuaauagucauucaauacagcuaaauugaauuauucauuuccccucauuucuucaaaugguuuaaaaaaauaaccuuuauuuuaaauuagauaugcaugcauauaaaugaguguaggugcccacagaggccagaagagggcaucagaucccuggcagcuggaguuauaggcuguugugagccacuugacaugguguaggaaacugaacuuggguucucugaagaucugugcucuuauccacugagccaucucuccaaccccacaugucuucuuucuuugaaacaucuuacauuuuauucaaauaccugcucagaccucuacagucuauuccaacuaaaauaagauuuucuucaccccugacuguuuucuugguuguucuuuuucccccccccccagaguacuagcucaaaggugauuuguuguuguuaaaaauguaaggcuucacacaugagcuggaccuacagccccuccacccacccaaacacauauguaacagaugcauauucagguccuccaacaacuggaguggcgcugucccugacucuguugccugccuguggauccuguuccccuaacuggguugcuuuaucuggccucagagggagaggaugugccuaguccugcagugacuugaggugccagggaggguugguucucaggagggaccuccugcuucucagaagaggaggggaggggagagagggagaagggagggcggugaucgggauguaaaguaaauaaauacaucaaugggaaaaaaagugaggcuuagccccauguuaaggugcacaccuuuaaucccagcacucuggaggcaaaggcagguggaucccuaaugaguucaaggccagccuggucuauauaguauguuccuggauagccaggacaacacugucuuaaaacaaacaaauaaaauuuuauuugucuacuacuaauaguuauuuguuuggggacaauggcuuugucuucuuguugcugauuuuuaugcuuagaauaugauacuugggagauuuuuuugcaagauacuuguuaaaacagcgauugaaugcagacauggucaccuguagaagguaccauucgucaccuucagaagccuucacguguuuuuacacuuauaauuuacauaugugcacacaaacugugauucccauuuggucagauagcuguauuuuaaaaugucuuuggaugauguuaggaaaugauuucucauuuuaauaucauuauaacauuguagucgcuaauccuagggaguaguuuuggaaugaaacaauaaagcauuuuauugaaacacaguuucauguugcuggagacugaucuuaaacuuuugauccuccugccuccaccuccuaggugugggaccuauggacaugugccaccguggauggcuugaaaaggacaacgucuauggaacaguuugagcuggcagaaaugugguaacacguucaagagagcuauacugccaucacuaauuagcacuguggaaaagugaaagagucauacagcccugucuaugucaugggaaucacaggaggcaccagcuaauuagggacucagagccuugcaagugguuuaagaucgugcaaaguacuguguguuggcccuccucagcaggacaggucugauucuuaaagccucauuucuucuuagaagauucggggauaggugugaggccaguaucuaucuacuaauacauuuacuuaucuaccuguaaccagcagaaaguccuggacccacaaaacaauucuuugugcauaaaggcaaauaaaaucgcacaagauuuuaugaaagugucucuggguagaucugucaguuagggcucugugcucucauccagauguggagggcccuugcaaacaacagggcugccggaggaacaguauaaaugaggcaaggagaaaauccagcucagugugacuccauagaggaauugauucaaaccucuagagucugugugcugauuugaaugaaaauggucccauagauaccucaggaauggcacuauugggggugaggucuuauuggaguagguguggccuuguuagaggacaugugucacuggagguggguuuugggguauaaagaucucaagcuaggcccagccucucucucucucuuccugcugccuuugguucuagauguaaaacucucagcuccuucuccagcagcuuaucugccuuugugccaccaugcuuccugccaugauaauaauggacuaaaccucugaacuggaagccagccucaauuagauguuuuccuuuauaagaguugccauggucauggugucucuucacagcaacaaaacccuaacuacgacagucugacacaagguagauuauuuuagacauaauuuaguuuguuuucaagacagggucucacuauauaguucuguuugucuuaaaccucacuuugcaaaccagaauggucuuaaacuaacagagauuugccugcuucugucucccaaaugcugagauuaaaggcauguaccaccacaccugacauuaggcauauguaaguacaguacaauguggcaaaaaguuuccugguaacaauuaacucaaucuuuugugcacaauaaagcuuaaaguacgacuacaucaaaacucuuuucuaaaguacaauugacuucuuccacaaagaugaguucuauagcuucaggcuuaggggaggaucuugugugguuucugucauacagacauaguccagaggucaccaggcuauaaaguauguguggcaucucccguaaagaugaguucuauugauggagaaacaaugcuaaagauaaaggucuagagaggaggucugggcuaaacauaagagucugagggagucaggucuugccugacccugcagauagcacaggucacuaggcuaucaacaacuuuca

SEQ ID NO: 11690 - RNA, 4402 nt, Mus musculus
ugaaaguuguugauagccuagugaccugugcuaucugcagggucaggcaagaccugacucccucagacucuuauguuuagcccagaccuccucucuagaccuuuaucuuuagcauuguuucuccaucaauagaacucaucuuuacgggagaugccacacauacuuuauagccuggugaccucuggacuaugucuguaugacagaaaccacacaagauccuccccuaagccugaagcuauagaacucaucuuuguggaagaagucaauuguacuuuagaaaagaguuuugauguagucguacuuuaagcuuuauugugcacaaaagauugaguuaauuguuaccaggaaacuuuuugccacauuguacuguacuuacauaugccuaaugucagguguggugguacaugccuuuaaucucagcauuugggagacagaagcaggcaaaucucuguuaguuuaagaccauucugguuugcaaagugagguuuaagacaaacagaacuauauagugagacccugucuugaaaacaaacuaaauuaugucuaaaauaaucuaccuugugucagacugucguaguuaggguuuuguugcugugaagagacaccaugaccauggcaacucuuauaaaggaaaacaucuaauugaggcuggcuuccaguucagagguuuaguccauuauuaucauggcaggaagcaugguggcacaaaggcagauaagcugcuggagaaggagcugagaguuuuacaucuagaaccaaaggcagcaggaagagagagagagaggcugggccuagcuugagaucuuuauaccccaaaacccaccuccagugacacauguccucuaacaaggccacaccuacuccaauaagaccucacccccaauagugccauuccugagguaucuaugggaccauuuucauucaaaucagcacacagacucuagagguuugaaucaauuccucuauggagucacacugagcuggauuuucuccuugccucauuuauacuguuccuccggcagcccuguuguuugcaagggcccuccacaucuggaugagagcacagagcccuaacugacagaucuacccagagacacuuucauaaaaucuugugcgauuuuauuugccuuuaugcacaaagaauuguuuuguggguccaggacuuucugcugguuacagguagauaaguaaauguauuaguagauagauacuggccucacaccuauccccgaaucuucuaagaagaaaugaggcuuuaagaaucagaccuguccugcugaggagggccaacacacaguacuuugcacgaucuuaaaccacuugcaaggcucugagucccuaauuagcuggugccuccugugauucccaugacauagacagggcuguaugacucuuucacuuuuccacagugcuaauuagugauggcaguauagcucucuugaacguguuaccacauuucugccagcucaaacuguuccauagacguuguccuuuucaagccauccacgguggcacauguccauaggucccacaccuaggagguggaggcaggaggaucaaaaguuuaagaucagucuccagcaacaugaaacuguguuucaauaaaaugcuuuauuguuucauuccaaaacuacucccuaggauuagcgacuacaauguuauaaugauauuaaaaugagaaaucauuuccuaacaucauccaaagacauuuuaaaauacagcuaucugaccaaaugggaaucacaguuugugugcacauauguaaauuauaaguguaaaaacacgugaaggcuucugaaggugacgaaugguaccuucuacaggugaccaugucugcauucaaucgcuguuuuaacaaguaucuugcaaaaaaaucucccaaguaucauauucuaagcauaaaaaucagcaacaagaagacaaagccauuguccccaaacaaauaacuauuaguaguagacaaauaaaauuuuauuuguuuguuuuaagacaguguuguccuggcuauccaggaacauacuauauagaccaggcuggccuugaacucauuagggauccaccugccuuugccuccagagugcugggauuaaaggugugcaccuuaacauggggcuaagccucacuuuuuuucccauugauguauuuauuuacuuuacaucccgaucaccgcccucccuucucccucucuccccuccccuccucuucugagaagcaggaggucccuccugagaaccaacccucccuggcaccucaagucacugcaggacuaggcacauccucucccucugaggccagauaaagcaacccaguuaggggaacaggauccacaggcaggcaacagagucagggacagcgccacuccaguuguuggaggaccugaauaugcaucuguuacauauguguuuggguggguggaggggcuguagguccagcucaugugugaagccuuacauuuuuaacaacaacaaaucaccuuugagcuaguacucugggggggggggaaaaagaacaaccaagaaaacagucaggggugaagaaaaucuuauuuuaguuggaauagacuguagaggucugagcagguauuugaauaaaauguaagauguuucaaagaaagaagacaugugggguuggagagauggcucaguggauaagagcacagaucuucagagaacccaaguucaguuuccuacaccaugucaaguggcucacaacagccuauaacuccagcugccagggaucugaugcccucuucuggccucugugggcaccuacacucauuuauaugcaugcauaucuaauuuaaaauaaagguuauuuuuuuaaaccauuugaagaaaugaggggaaaugaauaauucaauuuagcuguauugaaugacuauuaagaauagauguguggggucauugguaguacugggagaauacuagucaggacccugcuugaggcaaggcaaagcacaaugucuguggggaaagcugaaugaagggcacacagaaacgcuauucacucgguuuacaacucuucuguauaucuaaacacuucccuagcuaccaccaucacuaacaagccuccugccucaggguucuaggaaccaucagaaaccauuagccuggucaggccuuguugauuuaauccaaucaaaagugaccuucagaagucuggauuccuuucugaggagcccauuucuuguggguaaacauccccugugccagaaaaaaucuguuucuaugacucuaaaaucuucaugcugugagauaaaauaaauccacuuuuguuuagagaaaauugucugcuauaaagcacgacugugucguguguuuagagcccccagggacuuccuccuucccacagcuucauaguggggccuucguuuucuugaagcuuuucccucccagcauuugagucauucaaauuuucuccauucugcucuucuuggucuuaauaaacugugauguccacagcucagcaccggacguuaaauaagcaaguaaggagaaaugagauuuaaagcugggcaugacgauacacaccuuuaauccaagcacuugagucucagaggcaggcagaucucuguggguucaaaaacagcauagucuucauagagagcuucaggccagcaagggcuaccuagggagacccugauacguaaauaaucaacaguaggaugcagggagagcaggguguaucaucacucagacuggacggacaagucuuuacuggacaccuugacaaccugcaucucacaaucuguuuccuuuccuuaugcauugcuccuucgcugccauuaggccagaugccuuaagcauuuacucuuuuuuuuuuuuuuuuggcuuuuuuuuuuccauuuuuuauuagguauuuagcucauuuacauuuccaaugcuauaccaaaagucccccauacccacccacccccacuccccuacccacccacucccccuuuuuggcccuggcguuccccuguacuggggcauauaaaguuugcguguccaaugggccucucuuuccagugauggccgacuaggccaucuuuugauacauaugcagcuagagucaagagcuccaggguacugguuaguucauauuguuguuccaccuauaggguugcagaucccuuuagcuccuuggguacuuucucuagcuccuccauugggagcccugugauccauccauuagcugacugugagcauccacuucuguguuugcuagguaaccaacggacagacagacagagaucgucaagucuuuucagcaggucaccagguuccuaaaauacucucuugccuggagacagaugucucaaguuacauagagaagaaauggauuccaaagucacuuuucugauauacucaacuauaagcaucaguggcucugucuguuggaucucacaucacagcagaaa

SEQ ID NO: 11691 - RNA, 2947 nt, Mus musculus
cuugcucuuccagaggauccagguugaauuuccagcacccacagggcccuuacacggaucuguaacucuagguucaggggaucugaugcccucuccuggccucuucuggcauugcaggcacgcggugcacagacauucaugcaggcaaaacacauauacaccugacauaaaaauaaauaaaaauaauaacgaaaagaguucuaaagaaaaaagaacuuaagaggcagaaauacccaaagcuucuuuugcuuuuuuugcagcuugggcuuaauuauaacccucagagaaauuuaaaaaaaacuuuccuuugccuuuggagacaacaguugacaaaacagaucaaaaaguuucugaauuacuauaaaaagacccacaaagacacaccugaagcguggcagugcuuuucagcaguauaacucggucuguguagcagaucacaaaugccuacgcaggcaggcaggucaaugacugacaugagcaagugaagccauuccagcaaggcgagcugcuguggcuaagugcggugcacugucaacaauucuccugcagccccagugugcuucauuacaauaaugagaaacuaggaacauuuuaugcauuguaaugaccaaaaaauguguuucauaugccuuccagugauaauuuuguuuauuauucucaaauauaucuauguuuagucauuaauucucacuuuuacgcuggucucaaacugaaaaugcuuagagaggauuccuaguugcaaguuuugccaugcaaaauacaaauuaaaucuuaaauaagaaccccagaaaucucuccucacaccuccaucucugcuacugaugucaccucuuguggguauuaggguucuuaaauuaacagcauguuagagcaagggaaagccuaggguaguugucaagaucugaagacuuaguuuagauucguuaggccacacaagauuugguuaauuuauauaaacuccaagaucugugugugugugcacacgugcaggugcacauguauguauauguguauggaggucagaggucaacccuccccucccucaggagccauccaccuugucuuuugagacagucuguuacugggucccgggucucaccaauuggcuagguuggcugaaccagcgagccccucccgucuccgccuccccagagcugguguaugcaaacacacagcacugcgugguguuuucuacacgggugcugggguuaagugcacgcaugggaagagcucugucaacugagcaguuucccagagcucaggaugauuucauucaugcgcagagugaagacucugggccugaagccagacuacuuacucauuuaucuagcacacacauuuguggcaucuacucgcacuagcuggucauuaucagaggcgugaggugcgggguggggcaggucugcauccccguucaugggucuuucaccaauucugucugccucagccuuccuuucucuugucagcugccccccggcaccccagucaaaacugggugccuccagggccuucuggucucucuggucuccccacccucagugauggagcaucuuugccaucuccuuucaucauuucuucuuccagaccugaugcuuccuguggcuccuguaacaacucuuaggcaguugucaagcucuuccgugaccucucuugguucucacgucugauuuuaucucgcucgaauccuaccuaauguaguuuuucuuugucaaacauacuccauucucucuugcugaggccuccuccacgcuucuuuccucccaccccuaccuaauccuguaggccuccaacaaagccacaugcucucaaggaggagaacccacaggccacauccuccuccccucaguuauauucuggggcuuuuugcauguguacuggugaauuuuuuauuuuuauuucauuuuauuuuauuuuauuuuauuuuauuuuauuuuauuuuuuugucaacuugaaacaagcuggagugaccuauaaagagggaaccucaauugagaggauaccucuaucacauuggccuaugggcaagucccauaacugaugugggaaagccuaacucacuguaggcagugccacccuagcagguggucccggguuauauaagagagcaaggugugugugugugugugugugugugugugugugugugagagagagagagagagagagagggagagagagagagagagagagccaauaagcagcucucuuccauguccuccgcuucggugcuucaguuccaguuuucgcucuggcccggcuucccucaaugagggagugugaucugggcauugagauggaaacgaauccucuccuccucagguugcuucuggucguuguguuuaucacagcaauagaaagcagaauaguggggcauuuggcuacagcauaucaugucuucccuucauaaaaauaugucucacuguguagcccugcuuggccaggaacucacuauauagaccagccaagccuugaacucacagagauccaccugccucucacguaccuucgugccuggcccgaauuugggagcuuuuaauacaaauauccugugccagcccuggucacaaucauaagcaccagagugaaauuugagacugaauucccaggucugaauucucagcaaggcccccguuuuucuggcugugugaccacagauaauguacuuacccucucugaauguccaucucauauuuucaaaccuggggcauuacuauuggauggcugaguuacucacuauucaguaugaguacauauuguuacaguuuagaugagcagggugcuuaaaauagacugugcuauguagugagagcucaggaaguauuagccugaguuauuucauaggaggucuguguaaauuaaauccaagcccuaggcguagugccuggccuggaacaagcauucaguaauauuagccagugcuguuaucuuauuuaacauaugagaggcc

SEQ ID NO: 11692 - RNA, 2947 nt, Mus musculus
ggccucucauauguuaaauaagauaacagcacuggcuaauauuacugaaugcuuguuccaggccaggcacuacgccuagggcuuggauuuaauuuacacagaccuccuaugaaauaacucaggcuaauacuuccugagcucucacuacauagcacagucuauuuuaagcacccugcucaucuaaacuguaacaauauguacucauacugaauagugaguaacucagccauccaauaguaaugccccagguuugaaaauaugagauggacauucagagaggguaaguacauuaucuguggucacacagccagaaaaacgggggccuugcugagaauucagaccugggaauucagucucaaauuucacucuggugcuuaugauugugaccagggcuggcacaggauauuuguauuaaaagcucccaaauucgggccaggcacgaagguacgugagaggcagguggaucucugugaguucaaggcuuggcuggucuauauagugaguuccuggccaagcagggcuacacagugagacauauuuuuaugaagggaagacaugauaugcuguagccaaaugccccacuauucugcuuucuauugcugugauaaacacaacgaccagaagcaaccugaggaggagaggauucguuuccaucucaaugcccagaucacacucccucauugagggaagccgggccagagcgaaaacuggaacugaagcaccgaagcggaggacauggaagagagcugcuuauuggcucucucucucucucucucucccucucucucucucucucucucucacacacacacacacacacacacacacacacacacaccuugcucucuuauauaacccgggaccaccugcuaggguggcacugccuacagugaguuaggcuuucccacaucaguuaugggacuugcccauaggccaaugugauagagguauccucucaauugagguucccucuuuauaggucacuccagcuuguuucaaguugacaaaaaaauaaaauaaaauaaaauaaaauaaaauaaaauaaaaugaaauaaaaauaaaaaauucaccaguacacaugcaaaaagccccagaauauaacugaggggaggaggauguggccuguggguucuccuccuugagagcauguggcuuuguuggaggccuacaggauuagguaggggugggaggaaagaagcguggaggaggccucagcaagagagaauggaguauguuugacaaagaaaaacuacauuagguaggauucgagcgagauaaaaucagacgugagaaccaagagaggucacggaagagcuugacaacugccuaagaguuguuacaggagccacaggaagcaucaggucuggaagaagaaaugaugaaaggagauggcaaagaugcuccaucacugaggguggggagaccagagagaccagaaggcccuggaggcacccaguuuugacuggggugccggggggcagcugacaagagaaaggaaggcugaggcagacagaauuggugaaagacccaugaacggggaugcagaccugccccaccccgcaccucacgccucugauaaugaccagcuagugcgaguagaugccacaaaugugugugcuagauaaaugaguaaguagucuggcuucaggcccagagucuucacucugcgcaugaaugaaaucauccugagcucugggaaacugcucaguugacagagcucuucccaugcgugcacuuaaccccagcacccguguagaaaacaccacgcagugcuguguguuugcauacaccagcucuggggaggcggagacgggaggggcucgcugguucagccaaccuagccaauuggugagacccgggacccaguaacagacugucucaaaagacaagguggauggcuccugagggaggggaggguugaccucugaccuccauacacauauacauacaugugcaccugcacgugugcacacacacacagaucuuggaguuuauauaaauuaaccaaaucuuguguggccuaacgaaucuaaacuaagucuucagaucuugacaacuacccuaggcuuucccuugcucuaacaugcuguuaauuuaagaacccuaauacccacaagaggugacaucaguagcagagauggaggugugaggagagauuucugggguucuuauuuaagauuuaauuuguauuuugcauggcaaaacuugcaacuaggaauccucucuaagcauuuucaguuugagaccagcguaaaagugagaauuaaugacuaaacauagauauauuugagaauaauaaacaaaauuaucacuggaaggcauaugaaacacauuuuuuggucauuacaaugcauaaaauguuccuaguuucucauuauuguaaugaagcacacuggggcugcaggagaauuguugacagugcaccgcacuuagccacagcagcucgccuugcuggaauggcuucacuugcucaugucagucauugaccugccugccugcguaggcauuugugaucugcuacacagaccgaguuauacugcugaaaagcacugccacgcuucaggugugucuuugugggucuuuuuauaguaauucagaaacuuuuugaucuguuuugucaacuguugucuccaaaggcaaaggaaaguuuuuuuuaaauuucucugaggguuauaauuaagcccaagcugcaaaaaaagcaaaagaagcuuuggguauuucugccucuuaaguucuuuuuucuuuagaacucuuuucguuauuauuuuuauuuauuuuuaugucagguguauauguguuuugccugcaugaaugucugugcaccgcgugccugcaaugccagaagaggccaggagagggcaucagauccccugaaccuagaguuacagauccguguaagggcccugugggugcuggaaauucaaccuggauccucuggaagagcaag

SEQ ID NO: 11693 - RNA, 284 nt, Mus musculus
ggcuguuuccuauuccaaguuuaaaagaacucacaccucaaccagaggcugggccuuauuuccuuacagugcccaugcuauggggcugcaaucuaucccuagagguagcagcagcuaugacaggugaggcaaggcccagccagagcucccugucacugcugcucugucuccucccagccccuagcugccaugcagagucuagggaacagagcugaaagcacccucuacaugccaggcaauccuccauggagacaggaacauggaagacaccagcuuccaugagc

SEQ ID NO: 11694 - RNA, 284 nt, Mus musculus
gcucauggaagcuggugucuuccauguuccugucuccauggaggauugccuggcauguagagggugcuuucagcucuguucccuagacucugcauggcagcuaggggcugggaggagacagagcagcagugacagggagcucuggcugggccuugccucaccugucauagcugcugcuaccucuagggauagauugcagccccauagcaugggcacuguaaggaaauaaggcccagccucugguugaggugugaguucuuuuaaacuuggaauaggaaacagcc

SEQ ID NO: 11695 - RNA, 457 nt, Mus musculus
ccauaugaugugucuuggauggagcugacuuaaacagcagcuccaagacacaucauagguguucauccaaaagcagccaucuacagacaaaaacauggauguuagcagccuacaacaggcuucuaaaauagacaaaaaccaaucaauguagacauacucuaaaucccagccucugggccagcuucucaauagcaaauacauugagagaaaccugaaacauguacaaugaacagagacaggugccaggagaaacuccgagaaggcacagcauuaagacgcaucagagugauggacccagagcugccacuguagcagugaugcagacuuaguuuugugugccaugagucuaacuaugaaccuaacuaacaaguuuccuuaccuaaugaagaaguaaaaaccacucaggccuggugaauguuaagcaaguacucuaccaugaagccaaacacgcauucua

SEQ ID NO: 11696 - RNA, 457 nt, Mus musculus
uagaaugcguguuuggcuucaugguagaguacuugcuuaacauucaccaggccugagugguuuuuacuucuucauuagguaaggaaacuuguuaguuagguucauaguuagacucauggcacacaaaacuaagucugcaucacugcuacaguggcagcucuggguccaucacucugaugcgucuuaaugcugugccuucucggaguuucuccuggcaccugucucuguucauuguacauguuucagguuucucucaauguauuugcuauugagaagcuggcccagaggcugggauuuagaguaugucuacauugauugguuuuugucuauuuuagaagccuguuguaggcugcuaacauccauguuuuugucuguagauggcugcuuuuggaugaacaccuaugaugugucuuggagcugcuguuuaagucagcuccauccaagacacaucauaugg

SEQ ID NO: 11697 - RNA, 146 nt, Mus musculus
caggaacucuaguaguuccuuuuuuaucuuuccugagugagcucuggcuugcucuaugguucaaguaucauguugagauacuaccuuuaaccuaguguucacaggucacgggugauuccuugaguguaauauaagaacuaacuugu

SEQ ID NO: 11698 - RNA, 146 nt, Mus musculus
acaaguuaguucuuauauuacacucaaggaaucacccgugaccugugaacacuagguuaaagguaguaucucaacaugauacuugaaccauagagcaagccagagcucacucaggaaagauaaaaaaggaacuacuagaguuccug

SEQ ID NO: 11699 - RNA, 1396 nt, Mus musculus
gaggauggaagggacaugccucaagugucugacaaugucugcccagacaauuggcugacugcaacuacacaggcacaaacaaccacuaagccaaacugaaaaacugaaaaacucaaaagacugaaguggccauucacagcaagagagaaagccaacaguuuaagucuacacaaauugcuaccacgaugggcuagagagauggcuuagagcgucaguauugcucuugcagaggaucugguucacacccgugacuccaaccccaggggacccagacaucucuggguucuguggacaccugcacacacauguacauacuucccccaaccuacauauauccagcacuaggccgacagaggcaggcagaucucugaguucaaagcuagccugaucuacagagugaguucuaggacagccaggguuacacagagaaacugucucaaaaaucgaaaacgaaacagacuuaagcaugaaaacucaccacagaaagcaacucagaguugcuaaaagggucuguuuucaaucaaagguuguagauauagaaagaaacagugugguagaaacuuaguuuuguaaaaguagagguuggauugagcaaagacuuuaaagcagauuauaccuacaucauaucuauguaucuauaucuaucugaauguaagauugugguucagcagaaacgauaggaaaguuggugaggaagcagcagucagugcuugccuagguuuugccuucagcaccacaaaccacaaaacaaaagcagaaauggaaacuacaagaaccaaucugccacacaaugaaacauggagucagagaugagcucgagcggcugugccauuugaaggaacuacaauaaacagguaagagaaaggggaggagaggggaggggaggagaggggaggggaggagaggagggaggggaggggaggggaggagggaggggaggggaggggagaggagagacagaaccccagugacuccagaaacaacaaaacaccucagaaauacaauaccccaaacccuguuuaucugaugaagaugcaggcaacacagcaaaccccaggaagaguaaacaggagagaccugugugucaacauagcacaguccaugugauagaagccaaaucucaagaaaaagccccacauaggucaugaguggcugcacgccugaguucaauguucagggcccgcucgggggagggagagaacuguucccuguaaguugucuucugaccuccguacaugcucugucaugugugcauccacacacaggaacaauucaauacauuacacagggcaggcagaaaagguagggacaugcagagaaugauuaaacuacgacagaucugauaaagagggagaguaaccucagagcuugaaacccagaaagcuuggauuauauu

SEQ ID NO: 11700 - RNA, 1396 nt, Mus musculus
aauauaauccaagcuuucuggguuucaagcucugagguuacucucccucuuuaucagaucugucguaguuuaaucauucucugcaugucccuaccuuuucugccugcccuguguaauguauugaauuguuccuguguguggaugcacacaugacagagcauguacggaggucagaagacaacuuacagggaacaguucucucccucccccgagcgggcccugaacauugaacucaggcgugcagccacucaugaccuauguggggcuuuuucuugagauuuggcuucuaucacauggacugugcuauguugacacacaggucucuccuguuuacucuuccugggguuugcuguguugccugcaucuucaucagauaaacaggguuugggguauuguauuucugagguguuuuguuguuucuggagucacugggguucugucucuccucuccccuccccuccccucccuccuccccuccccuccccucccuccucuccuccccuccccucuccuccccuccccucuccuccccuuucucuuaccuguuuauuguaguuccuucaaauggcacagccgcucgagcucaucucugacuccauguuucauuguguggcagauugguucuuguaguuuccauuucugcuuuuguuuugugguuuguggugcugaaggcaaaaccuaggcaagcacugacugcugcuuccucaccaacuuuccuaucguuucugcugaaccacaaucuuacauucagauagauauagauacauagauaugauguagguauaaucugcuuuaaagucuuugcucaauccaaccucuacuuuuacaaaacuaaguuucuaccacacuguuucuuucuauaucuacaaccuuugauugaaaacagacccuuuuagcaacucugaguugcuuucuguggugaguuuucaugcuuaagucuguuucguuuucgauuuuugagacaguuucucuguguaacccuggcuguccuagaacucacucuguagaucaggcuagcuuugaacucagagaucugccugccucugucggccuagugcuggauauauguagguugggggaaguauguacaugugugugcagguguccacagaacccagagaugucuggguccccugggguuggagucacgggugugaaccagauccucugcaagagcaauacugacgcucuaagccaucucucuagcccaucgugguagcaauuuguguagacuuaaacuguuggcuuucucucuugcugugaauggccacuucagucuuuugaguuuuucaguuuuucaguuuggcuuagugguuguuugugccuguguaguugcagucagccaauugucugggcagacauugucagacacuugaggcaugucccuuccauccuc

SEQ ID NO: 11701 - RNA, 163 nt, Mus musculus
auucauaacaggaucaaaauuacaucuacgaaguggcaaugaaaagaacuuuacgguuggguguaccacagcgugaggaacuguauuaaagagucgcagaauuagcaaaguugaggaccacuaacccacagaggcacuugcucagccguguucauugcugucc

SEQ ID NO: 11702 - RNA, 163 nt, Mus musculus
ggacagcaaugaacacggcugagcaagugccucuguggguuagugguccucaacuuugcuaauucugcgacucuuuaauacaguuccucacgcugugguacacccaaccguaaaguucuuuucauugccacuucguagauguaauuuugauccuguuaugaau

SEQ ID NO: 11703 - RNA, 3513 nt, Mus musculus
gaaggcagcaaaauuuugcagccugauaauaagaauagauguaaaugucugucugcaggucuuacuucacucucggucacaguggagagcagaggcagcacuugaacuuuccccuuugguggguaucugcuucagucuaacuuguuaagacugacccacucaaggccaagccuagucaugcaacugccugacuucccagugguguaguuagcacaaggaagaaacguuuaugcauauauacacagaguaaccaaugcucuugcuuacugcucuuucguaccaauucuucuuaaagauucacguggcucugauuagaucaaaaaucugcuuuuuuugaacaagcaacauuuuggggccgaggauacugucgcaauaaaagucaagucucauuccuuugguuacugucauccugacaucagaauuuagagaacaugguuguuuagaaugucaaauuuuauaaacauagguuggaaauuauaacauaaauguaugauguacagacuguuuaagguuucugaguaacaaauagauguuuccuugaauuauuuugacauaauuuaccaugaguuuuuuuuuuucucuugcugauauuucuggauuccuuguacagacaauaaaaaagaaaagccuuucuuuuaugucagagcucauuauuuaacucauagagcacugguguuuucuggaauacuaauauuuucuagaugcagaaggaauacuaacagaggcaugucucuguuuuaaucauaucaaaaggauucaugaaaguuugagucucuuuauaaggucuauauaaagaggacagcauucauagacaucacaaguguucaugguuuaauuugaagaaucuuuauacaaaucuaccauauaugugcaggggauggggagugucgcucaggacaacuggaagauguuuccgagguaacaaugaaagcacuguggugaagaccaggcuacuaccuacaguguuugcaaagggcuggaaggcacagcugucggguuguuauaauaugccuacauuaaaugcucgcuaugaaauucaccugggggaauacagauacaaaaggacccagacaaguuagaugccaugaguacagcaacuuugggaagugcagaauaggaagggaaggaaggagacccacccacggccuacauuaagggucaucugaaauucagaacuccuuggaaugaagaggcaggaugagagaaggacagagagcaaguaaagacugacagguauggaagacgggugcauagcacuccuaagaaccuguguucugauggucacgauaagccuaccgggaaagugacaggacucugaaucaagaacguguuugcaagaaggagccaaagguagcuguaugaaagagaaacagagcugcagccuguguggcuggcgacaagcuccacuuuggauauccuuaagaaaccuaugugcccguggaggucauuaaaaacucggcuauaaaaacacagauuaugguguuuaccaaaaacuccuggacuuggaaaaaggaaaccggaguauuagcauuguuuuuccuacuauccuuuucccuucagcaaggccuuccauuuaaaccccaugauucccauacuaacuuagcaauagugaguggcaaugauaacaugagcuaugugugagugcuagguggcugcagcugaagacauugaggaaguugagcaguuugucaaagauacacaaguagaaacagaaacucugucucuagaaccuaaguccuuuugugcuguuaaauacaauaccccuacuuuacauuuacaugaaauucaacaucuuuaacgauagcacaaauuacaggugacauaacacuugaaagagagcaaauuauaaaaggaguggguaauauuaaauuaacaugaacagacaaaagcuauuuuauaccaaaaguaauuauacucauaugucuuagauucaugacaauuuguugauugcugacaaauggaaagaaacaaaauugauaacugcuuuuuaaaagugagucagagaaauuacuagaauuuuuaaaacuauaagcuguccugagauguucuggaccuuaggugauauuguuuugaaaucuaaggaaugcuuggggguuuuguuuguuuuuguuuguuuuaauuuuaaagagucuucucccuaacuuauaaagccauugaaaggaugguauauaucuauugcuuaauuauaugugaggauuuucuugaaauacuaaccuuauuacauuuuauacaguauaauauuuuuuaaaaaagagcuaauuugaacaagcgguacuggauuuacgguuaauuuuuucauuauauuuucugaauugucgugcugggaaaaauucuaaguaggcauuaucuucuacagagcagacaaacagauagcuugggguuuugacaggaaaaaaaugaaaaaggcaacuucucaagcuccugcccucauggccaccaggugggggcagcugcuauauauggaguggucaggaacaguaaaguccuuuaggacuuugauucugagagacaucagaccugcagcucugagcuuuagacuuaaaauaacauuuauugacaaaaacaauguuucacucuaaugcagaugagaagcaaauaugacagagaaauauaaccacaguauaugaaaguguucuccuaguuuucugcagacuacaucauguauaauuauccuggccaguuagaauuuaccggcacuaacuggagaaagaaaacagauuuccuucacuuacugucuaucuaaauuaugaccaagggaaauaucuuuccucauuaauuaaucauuucuucuauccauuauacacucuccuaccauagguaaauaauauuauaaaacaaaccuuuacugaccagaaaaaaaucuauagaaugacuugcuuauuuuucuauagcguauaaguaaaugaaaaucuuauuacccuaaauaauuaugagauugaacagagacuggcuugcugacagguaccauuuagugaauugcuauuucaaugcccuuaaacagucaccuaaguuaauucaauuuucauacuguuuaaauuuuuuuugucuuuaaaaucacucuucaaagaaagaaaaaguggcucacagccugucucugugggaugacgcaguaucucugacacaaucucugcuuuaucucuuauuucauugcacuauuuagaaguauucuaaaaccauggcaggguucugaacaaaagccacaaaagcaucuuuaaggaaggucaacuaauauuguucagccuggggaaaauaauaucaagaaacaauuccuaauuagcaaaaacaauuuuuguaauaugauguauucuaagguuaccguacuguuuuauaaacuacaucuauauugauuuuaaaauauaaauuauaagucuuuuuuaaaugguguuugucauaacagaggaugggaagugcccuggccuggccuucauucauacacucauuucguaaagcacagacuugaauaauuuucaaccaaacaggacugcagcaaucaauucucauccaauuuauugg

SEQ ID NO: 11704 - RNA, 3513 nt, Mus musculus
ccaauaaauuggaugagaauugauugcugcaguccuguuugguugaaaauuauucaagucugugcuuuacgaaaugaguguaugaaugaaggccaggccagggcacuucccauccucuguuaugacaaacaccauuuaaaaaagacuuauaauuuauauuuuaaaaucaauauagauguaguuuauaaaacaguacgguaaccuuagaauacaucauauuacaaaaauuguuuuugcuaauuaggaauuguuucuugauauuauuuuccccaggcugaacaauauuaguugaccuuccuuaaagaugcuuuuguggcuuuuguucagaacccugccaugguuuuagaauacuucuaaauagugcaaugaaauaagagauaaagcagagauugugucagagauacugcgucaucccacagagacaggcugugagccacuuuuucuuucuuugaagagugauuuuaaagacaaaaaaaauuuaaacaguaugaaaauugaauuaacuuaggugacuguuuaagggcauugaaauagcaauucacuaaaugguaccugucagcaagccagucucuguucaaucucauaauuauuuaggguaauaagauuuucauuuacuuauacgcuauagaaaaauaagcaagucauucuauagauuuuuuucuggucaguaaagguuuguuuuauaauauuauuuaccuaugguaggagaguguauaauggauagaagaaaugauuaauuaaugaggaaagauauuucccuuggucauaauuuagauagacaguaagugaaggaaaucuguuuucuuucuccaguuagugccgguaaauucuaacuggccaggauaauuauacaugauguagucugcagaaaacuaggagaacacuuucauauacugugguuauauuucucugucauauuugcuucucaucugcauuagagugaaacauuguuuuugucaauaaauguuauuuuaagucuaaagcucagagcugcaggucugaugucucucagaaucaaaguccuaaaggacuuuacuguuccugaccacuccauauauagcagcugcccccaccugguggccaugagggcaggagcuugagaaguugccuuuuucauuuuuuuccugucaaaaccccaagcuaucuguuugucugcucuguagaagauaaugccuacuuagaauuuuucccagcacgacaauucagaaaauauaaugaaaaaauuaaccguaaauccaguaccgcuuguucaaauuagcucuuuuuuaaaaaauauuauacuguauaaaauguaauaagguuaguauuucaagaaaauccucacauauaauuaagcaauagauauauaccauccuuucaauggcuuuauaaguuagggagaagacucuuuaaaauuaaaacaaacaaaaacaaacaaaacccccaagcauuccuuagauuucaaaacaauaucaccuaagguccagaacaucucaggacagcuuauaguuuuaaaaauucuaguaauuucucugacucacuuuuaaaaagcaguuaucaauuuuguuucuuuccauuugucagcaaucaacaaauugucaugaaucuaagacauaugaguauaauuacuuuugguauaaaauagcuuuugucuguucauguuaauuuaauauuacccacuccuuuuauaauuugcucucuuucaaguguuaugucaccuguaauuugugcuaucguuaaagauguugaauuucauguaaauguaaaguagggguauuguauuuaacagcacaaaaggacuuagguucuagagacagaguuucuguuucuacuuguguaucuuugacaaacugcucaacuuccucaaugucuucagcugcagccaccuagcacucacacauagcucauguuaucauugccacucacuauugcuaaguuaguaugggaaucaugggguuuaaauggaaggccuugcugaagggaaaaggauaguaggaaaaacaaugcuaauacuccgguuuccuuuuuccaaguccaggaguuuuugguaaacaccauaaucuguguuuuuauagccgaguuuuuaaugaccuccacgggcacauagguuucuuaaggauauccaaaguggagcuugucgccagccacacaggcugcagcucuguuucucuuucauacagcuaccuuuggcuccuucuugcaaacacguucuugauucagaguccugucacuuucccgguaggcuuaucgugaccaucagaacacagguucuuaggagugcuaugcacccgucuuccauaccugucagucuuuacuugcucucuguccuucucucauccugccucuucauuccaaggaguucugaauuucagaugacccuuaauguaggccgugggugggucuccuuccuucccuuccuauucugcacuucccaaaguugcuguacucauggcaucuaacuugucuggguccuuuuguaucuguauucccccaggugaauuucauagcgagcauuuaauguaggcauauuauaacaacccgacagcugugccuuccagcccuuugcaaacacuguagguaguagccuggucuucaccacagugcuuucauuguuaccucggaaacaucuuccaguuguccugagcgacacuccccauccccugcacauauaugguagauuuguauaaagauucuucaaauuaaaccaugaacacuugugaugucuaugaaugcuguccucuuuauauagaccuuauaaagagacucaaacuuucaugaauccuuuugauaugauuaaaacagagacaugccucuguuaguauuccuucugcaucuagaaaauauuaguauuccagaaaacaccagugcucuaugaguuaaauaaugagcucugacauaaaagaaaggcuuuucuuuuuuauugucuguacaaggaauccagaaauaucagcaagagaaaaaaaaaaacucaugguaaauuaugucaaaauaauucaaggaaacaucuauuuguuacucagaaaccuuaaacagucuguacaucauacauuuauguuauaauuuccaaccuauguuuauaaaauuugacauucuaaacaaccauguucucuaaauucugaugucaggaugacaguaaccaaaggaaugagacuugacuuuuauugcgacaguauccucggccccaaaauguugcuuguucaaaaaaagcagauuuuugaucuaaucagagccacgugaaucuuuaagaagaauugguacgaaagagcaguaagcaagagcauugguuacucuguguauauaugcauaaacguuucuuccuugugcuaacuacaccacugggaagucaggcaguugcaugacuaggcuuggccuugagugggucagucuuaacaaguuagacugaagcagauacccaccaaaggggaaaguucaagugcugccucugcucuccacugugaccgagagugaaguaagaccugcagacagacauuuacaucuauucuuauuaucaggcugcaaaauuuugcugccuuc

SEQ ID NO: 11705 - RNA, 1237 nt, Mus musculus
aaggcaacuuuuaccuauuagaccuggccaucuuucacaugaauacaguggcuuucuucuaaggcuauaaaacaaggcaauccuauaggaucuggauaguuuuaggauaaucaaagcaccaaaauugaagcuccugggugugaaauugcagcuauaaaacagaaggaugcauuuuccaucuguauauuaaacggacuuuucaaguucaggguuguggcgauuaagugcucaagcagaccugaauccugguccugcauuucccaaguucuugcuuuaugacccaagguaccuaaacguucuaagccucagcuuaguucauuaguaaaauggguacugaaaauaagagucaccguuuuagacauggagugaacauaccaaaugaaaaaaguccuuguucccuugccagauaugguggcacaugccuuuaaucccagcacuugggaggcagagguaaguagaucucugaguugggggacagacuggucgauggagcaaguuccaggauagccagggcuacauggagaaacucugucucaauaaauaaaggaaggagggaagggaaggggggggaggggaggggaggggagggguggggagggagggggaggggaggggaggggagggagggggagggaggagagaggggaagagaagggaaggggaaaaaaauuguaugaaugugccuaacaaggcaucucccaggucugugcaucuaugccucuugcuaccugaggaggguuuuuucuugguccugaucuugaugcuaggagacuccacugaguaauugugaggugaguucuaagcacgccugcuuauuuaaagagaaagaaagaaggaaggaaggaaggaaggaaggaaggaaggaaggaaggaaggaaggaaggaaggaaggaaggaaggaaggaagagacagggagagauaugaaaugagaggggaggggaagggagagguggggaggggagagaacaggagaggagauaggagaugggaggagaggagaagacagaagaggagaagaucaaagaggagaggagaggagagaggagaggaggggagagggaaaaaaacuucauaaaaaucugauuuaacauugguucagaggggaaaaaccacagaauuuuaaaaaaucaauacagauuucaacuccuuggucccuuauuacggagauuguaaacuguugcuugaacaauuuuggcucugcucacucuaugacacuauuaacaaugcuggaagaua

SEQ ID NO: 11706 - RNA, 1237 nt, Mus musculus
uaucuuccagcauuguuaauagugucauagagugagcagagccaaaauuguucaagcaacaguuuacaaucuccguaauaagggaccaaggaguugaaaucuguauugauuuuuuaaaauucugugguuuuuccccucugaaccaauguuaaaucagauuuuuaugaaguuuuuuucccucuccccuccucuccucucuccucuccucuccucuuugaucuucuccucuucugucuucuccucuccucccaucuccuaucuccucuccuguucucuccccuccccaccucucccuuccccuccccucucauuucauaucucucccugucucuuccuuccuuccuuccuuccuuccuuccuuccuuccuuccuuccuuccuuccuuccuuccuuccuuccuuccuucuuucuuucucuuuaaauaagcaggcgugcuuagaacucaccucacaauuacucaguggagucuccuagcaucaagaucaggaccaagaaaaaacccuccucagguagcaagaggcauagaugcacagaccugggagaugccuuguuaggcacauucauacaauuuuuuuccccuucccuucucuuccccucucuccucccucccccucccuccccuccccuccccucccccucccuccccaccccuccccuccccuccccuccccccccuucccuucccuccuuccuuuauuuauugagacagaguuucuccauguagcccuggcuauccuggaacuugcuccaucgaccagucugucccccaacucagagaucuacuuaccucugccucccaagugcugggauuaaaggcaugugccaccauaucuggcaagggaacaaggacuuuuuucauuugguauguucacuccaugucuaaaacggugacucuuauuuucaguacccauuuuacuaaugaacuaagcugaggcuuagaacguuuagguaccuugggucauaaagcaagaacuugggaaaugcaggaccaggauucaggucugcuugagcacuuaaucgccacaacccugaacuugaaaaguccguuuaauauacagauggaaaaugcauccuucuguuuuauagcugcaauuucacacccaggagcuucaauuuuggugcuuugauuauccuaaaacuauccagauccuauaggauugccuuguuuuauagccuuagaagaaagccacuguauucaugugaaagauggccaggucuaauagguaaaaguugccuu

SEQ ID NO: 11707 - RNA, 541 nt, Mus musculus
aucacauguguguuauacaguggucaaaucuagcuaauaaacaaguguguuaccucacauaauuaucacguugugaugagaacacaaguguacuguguccuuaguuuucaagaaugaaauaugcugccauugggcauggucacagugccauucagucgacuucuuaaacauaucccuguaaucaugucguuuugacuaacaugucuccaccccggcuccacuucacaccaggccagcucugauaauaacuauuuuacucucuguucgcaucaacuguuuaaauuccacaugugugagaucaugugacauuugucuuucugugucuggcuuauuucacuuaacgucuuccagguucauuuaugaaucccaaaugaugggauuuccuucuuuaaauaguauuccauugugcaugcauaccacauuuucuucaucaaguuuuauucaacagauauguugauucaguaccuuacguacuuaaguaguacuuccauaaauacaggacugaagguguuuauguaacauugauuccauuucguuugaa

SEQ ID NO: 11708 - RNA, 541 nt, Mus musculus
uucaaacgaaauggaaucaauguuacauaaacaccuucaguccuguauuuauggaaguacuacuuaaguacguaagguacugaaucaacauaucuguugaauaaaacuugaugaagaaaaugugguaugcaugcacaauggaauacuauuuaaagaaggaaaucccaucauuugggauucauaaaugaaccuggaagacguuaagugaaauaagccagacacagaaagacaaaugucacaugaucucacacauguggaauuuaaacaguugaugcgaacagagaguaaaauaguuauuaucagagcuggccuggugugaaguggagccgggguggagacauguuagucaaaacgacaugauuacagggauauguuuaagaagucgacugaauggcacugugaccaugcccaauggcagcauauuucauucuugaaaacuaaggacacaguacacuuguguucucaucacaacgugauaauuaugugagguaacacacuuguuuauuagcuagauuugaccacuguauaacacacaugugau

SEQ ID NO: 11709 - RNA, 533 nt, Mus musculus
gcuggcuucccacccaaguagggaaaagcccuuugaagacuuccucccuucacacuauaauuaccuacaguuugccuacuacaacaguaagaccugcuuucucucuucucuccgaugccucaacuaaaguguagccagccaggcaggguugugaccacuccacuucuucagcaugucuagcagcuaugucugugggaggcaacaugcccaaugauuccuggguguuuugucacaagccuguggcccagguagccaauuucuacugcccagaagggaggaacaggggagucuaggaccucuuucuuuugucccuuuuuguucauuuauaaucuaaauuugcaugugaauaagaaugaauagcacaguuaggauguacuacuguugacacuagcucacagggcaggcccagucuuccuccagggguaaagggacgaaaaauauccagaaaaacaaacccucagcaaaucagcaguuguuuacuggguaccuacugggucccagccagaauagcacauccaagaguacauggugug

SEQ ID NO: 11710 - RNA, 533 nt, Mus musculus
cacaccauguacucuuggaugugcuauucuggcugggacccaguagguacccaguaaacaacugcugauuugcugaggguuuguuuuucuggauauuuuucgucccuuuaccccuggaggaagacugggccugcccugugagcuagugucaacaguaguacauccuaacugugcuauucauucuuauucacaugcaaauuuagauuauaaaugaacaaaaagggacaaaagaaagagguccuagacuccccuguuccucccuucugggcaguagaaauuggcuaccugggccacaggcuugugacaaaacacccaggaaucauugggcauguugccucccacagacauagcugcuagacaugcugaagaaguggaguggucacaacccugccuggcuggcuacacuuuaguugaggcaucggagagaagagagaaagcaggucuuacuguuguaguaggcaaacuguagguaauuauagugugaagggaggaagucuucaaagggcuuuucccuacuugggugggaagccagc

SEQ ID NO: 11711 - RNA, 477 nt, Mus musculus
cagacaccucacaacuacaggcagaacgaacguugcccuuugcccuucuagacugaaccgaacagggacaguguguagcaaguuugcccagcgccgcucuguuuucagaaguggauuucuauuuuucuugcuucucuucaugucugagagguagguuaggcagauuacaagaucguuccuguacacaguaugacagugaccauaccaugggcgacacuuuugagcauucacucacgacgagccaaacacuguacugaggguuuagccuuauugguugcucucacuaaucuguugucaaacuuauaagguuaacaguaauugauugaaaaucaaggcugggccaggcagcgguggcauacgccuuuaaucccagcacuugggaggcagaggcaggugaauuucugaguucaaggcccagccuggucuacagagugaguuccaggacagccagggcuacacaaagaaacucugucucga

SEQ ID NO: 11712 - RNA, 477 nt, Mus musculus
ucgagacagaguuucuuuguguagcccuggcuguccuggaacucacucuguagaccaggcugggccuugaacucagaaauucaccugccucugccucccaagugcugggauuaaaggcguaugccaccgcugccuggcccagccuugauuuucaaucaauuacuguuaaccuuauaaguuugacaacagauuagugagagcaaccaauaaggcuaaacccucaguacaguguuuggcucgucgugagugaaugcucaaaagugucgcccaugguauggucacugucauacuguguacaggaacgaucuuguaaucugccuaaccuaccucucagacaugaagagaagcaagaaaaauagaaauccacuucugaaaacagagcggcgcugggcaaacuugcuacacacugucccuguucgguucagucuagaagggcaaagggcaacguucguucugccuguaguugugaggugucug

SEQ ID NO: 11713 - RNA, 181 nt, Mus musculus
gccccaacccaccgccccgccggcccgcucucacccccgugaccagccugcgccgggaccccacuccaucgccgcccgugccacccgcucaccaccccuccgcaguccgccccccgcgccgcgcgaggaguccgcuaagccgagccccgccccguccccaccguucuccuucaagucgccu

SEQ ID NO: 11714 - RNA, 181 nt, Mus musculus
aggcgacuugaaggagaacgguggggacggggcggggcucggcuuagcggacuccucgcgcggcgcggggggcggacugcggagggguggugagcggguggcacgggcggcgauggaguggggucccggcgcaggcuggucacgggggugagagcgggccggcggggcgguggguuggggc

SEQ ID NO: 11715 - RNA, 111 nt, Mus musculus
cagccuuaguuauuuagggacacuuacuuuuuuuuaaugauuuauuuuuauuuuauguacauugcuguuuugcgcgcgcgcgcgugugugugugugugugugugugugugu

SEQ ID NO: 11716 - RNA, 111 nt, Mus musculus
acacacacacacacacacacacacacacgcgcgcgcgcgcaaaacagcaauguacauaaaauaaaaauaaaucauuaaaaaaaaguaagugucccuaaauaacuaaggcug

SEQ ID NO: 11717 - RNA, 601 nt, Mus musculus
gcugcacagucuagcauugugauuggccuuccugcuauugacaauauaccugacaugcuccaacuucaggggggccucugacugaggcaauaaagcagcucuguggauagccugcagcauugccuggcgagcugccuccauuggaacuggggccucggggauugggaacaggaucagagucccgccuucucacccaaagcauagucauuuccugugugccuuugaucagucuucagagugacaaaaugguuguuucugacgcuuguguccaucuugcgaguugucuggggacuaagauuggcuguucucauuuugucugaaguccugagcaagucuggggaauucccggccugugccauuucuacacugcuuuccccacugugcuccuggagucucugccuggagcucugacuaguugugccggggccuucccuccuuguauuaaccuuucuucaggcuccccaucucuuugucucccuccauugccucuugguguugacacuuuauuaauauuucuuuuauuauuucuuggguacuauuaacuuauaagaugagcuugaaauuucacugaggguuuuuuuuuuuaauuuuuagaaauuuc

SEQ ID NO: 11718 - RNA, 601 nt, Mus musculus
gaaauuucuaaaaauuaaaaaaaaaaacccucagugaaauuucaagcucaucuuauaaguuaauaguacccaagaaauaauaaaagaaauauuaauaaagugucaacaccaagaggcaauggagggagacaaagagauggggagccugaagaaagguuaauacaaggagggaaggccccggcacaacuagucagagcuccaggcagagacuccaggagcacaguggggaaagcaguguagaaauggcacaggccgggaauuccccagacuugcucaggacuucagacaaaaugagaacagccaaucuuaguccccagacaacucgcaagauggacacaagcgucagaaacaaccauuuugucacucugaagacugaucaaaggcacacaggaaaugacuaugcuuugggugagaaggcgggacucugauccuguucccaauccccgaggccccaguuccaauggaggcagcucgccaggcaaugcugcaggcuauccacagagcugcuuuauugccucagucagaggccccccugaaguuggagcaugucagguauauugucaauagcaggaaggccaaucacaaugcuagacugugcagc

SEQ ID NO: 11719 - RNA, 47 nt, Mus musculus
uuacaguccuagcccuccuuggguucuucuaaguugaccccuucacc

SEQ ID NO: 11720 - RNA, 47 nt, Mus musculus
ggugaaggggucaacuuagaagaacccaaggagggcuaggacuguaa

SEQ ID NO: 11721 - RNA, 4400 nt, Mus musculus
cuugcagaggcauaggcuccauucucagcauccacaugguggcacucaguaccagggaaucuaaugcccucgucugaccuuccugggcaucugguaauacauguggugcucagucaugcaaguaagcaaaacacucauacacauaaguaaauaaaaacauuuuuuucaaagacuuauuuauuuuuauuuuauguggaugaguguuuuugcaggcucuuaugucuaagccacauuuguccauuagcagaggaggccagaagaggguaucaaauccccucaaacuggaguucgagauaccuguuagccaucauguaggugcugggauuugaacucacacacguuaaaagagcagccauauccugucuucaaaaugaaaaauuaaauaaaugaauaaauaacugacaggaggggcaaagccuauuguuccaaaguuucugugggccuugggcaugcuagguuauggggucugguaagcagagguggaaagguuucuaaaugagcagagccuugcccuuugauauaguugccaacaaccacauuuucuguucugggcacagugccaucaagggucucagccacccucccccaccuuagugagaaaguaucugcuagcgucuagcagggucgaugcaggcaaggaccagagugaaaaggaguucugagccuggcuucccuguggugcacucggacauacaucuuccaaccgucaucaucuuacuccucuugucucugaccccuccuugaccaaaggcaacuacaucucaguuccuuacuauucgggagcuacucaacaauuacacuaagagagcuucugagcugggugggcaugguggcacaagggcaucccuguaaucccagcacuuaggaaggaaagucaggaggcucacacaaguucagggccauccucaguuguguggcugaguuccaggcuauguuacagagaccccugccacaaaaauaaauaaauaaauaaauaaauaaauaaauaaauaaauaaauagauagauagauaaauaaauaaauaaauaaauaaauaaauaaauaaagcgagggagggagggagaggggaggggagaggggaggggagaggggugggggugggggagggggaggggugggggagggggagacugguuuagaacuuugcccugacucugaucuuaauuccuccuggcaaugggcaagcuguuucuuuucugaggaaugcgaaaagagaaugagagauuuguuauggugacaggaagauuccagaucagaggcaaagccccucuaggguacauaccaucuggggauagucccuagaaaaguagauaccugcgcuaauuuaaauguuuaacaggaaugcaggugcagaugaacaaaagguaguuuccauuagguagaaauguuuuuuuuuuccacuuccuguuucuagucucuuuuucaguguuccuguacgaaaccacggaguuucagaagcagaugaaaucuaucagcggccugccccaagcuccgucaacccugccaggcugaauggugcugauuguucgcaaagggcgggcauuucucugcaaacagaaaagccugcucaagaaaugccacucaccgcccuguaucagucucaauauugagucugaaugauuucccgauggcgacuugaccgaaauggaaaaauauuuuuccguugcaauucccccgguacugacugguguuucauccucuuccgguccuugugagacagcaagagcagacagagcuucagcaguguugaucuucagcucugagaacagaagauggguggggugcugcguugccacgcaaccaaaggcaacacagcugcagaucucugccagcugggccagcccauucaaaccgcagggaguuucaaauggcuguguccccuagggacugggcuuagcaagcccagggggaaaagucagcauucaaauggcuucgaugacgaugacgcagaggaagccaagaggacgcugucaaagccuagucaucauugacucgaaguuaguauacuugaacaggaaagaacugccaagaucagacaggcaggacacacacacaccuuucuuuuaaacuuuaaaaguuauucucuuuaaaagaaacguaguugcuuuuuaaaaagcuauacaaaguucuuaauguuucuuuggcaacagaauagaaugaaauuuuacaacuauauaaaauguuuauuuaccgguguguguauagcugacugacaaagcugucuaccacccagcacccuaacugcugaaauaagcuaccucauauuauagcaucuccaaacagaaugagaaggguacagagacuggaacuugucuguagacuaggaggugacuuuauuaucuuuccuauagucaaaaucugcacucucugcuccaugaugccucugaauccacuugaggggcagugauggucccuccucggccacuaccacguacccugccauaugaaagccaacacuucucugccuugguagcuccauggccaccaucuggacaaauugggguuccgaacauuucagcaucuaaccuuucuucagccuaacucgggcuccuuucuccaguaucaccauaagcaauacuaucaaagaaugauuucauuuggucauguuauuaguugggucucagcaggucuucggcagcaucuccuucacugguuaaguaccagcuugugagucuccuguaucuucauccacaagcuuguccuguuucucagguuucucuucuucuaauuuaaguuuauuaugagacacucuguccguuuccuccuuguuaaauuguguguaugcacuugucuuccucagauuucacuggaccaucucauggauaccaaaucuuccucuaccaccuugaugagccccacuuccuccccucagagcagaaggaacacuugggacuagaagccgcuuguauaauuucuuugucacucauuuuguuucccagucuugggauuuugugugcuucagcuuucucccuuccucccuuccucucuuucuucuccucuccccaccccccaaccccaggaauucacucuguaaccacgggagggagaagaguuuggcugcuaugugaugaagggagucugagauacaggcucccaguccucuccucaaaucaccauuaagaaaucacuccucucccagccugauucuucuuccuggggaagcacuaauucggaguggaauaagucagaaaugcuggagcagaaguucuuccacauggaggaacugucaggagugagggggaaucuuuacagauccuaauaauaugcauaaagcaacaugaugcuuggcacacaagaaacaccaaguaaaagcucuuagcugguuauuauucuagcugugguuuauuaaucaugccagagacuuuccuacugcaccgcugugaucucucggacuguaucugcccuuguuggauguucaaccccgggcauguuacuaaacuucucuaagaugcccuccuccuuacgauauauauaauaguacuuacccuguauuagagaggaucacaugauauuuuuuauacagucuuggcaugguaccuggaaccugguaaauauguauugaauagugaccacgguaacaaaagaagcuugcgaguucaaagcaaaauuaauguaaaaaaaggaaaaaaaaaagacaaaauugacuucgagguguguaaaggaaaaguugacuucugucuuaguuaaggcuacuauuacuguaaugaaauaucacaccacccuuggagagaaaaggauuuauugcacuuccacauugcuguucauugaagaaaaucaggacaggaacucaagcagggcaggaaccuggaggcaggagcugaugcagaggccaugaaaaggugcugcuuacuggcuugcuccuuaugacuugcucagccugcuuucuuauagaacccagggccacuaacuaguacaggggcggcaccauccacgaugagcuguaccuaccccaucaaucgcuaauuaagaaaauaccauacaggcuugcuacaggcauaucuuugggaggcauuuucucaacugaggcucccuccucucugauaacgcuagcuuguaucaaguugacauaaaccuaggaaacaguugcucuuccuuagaauaagagugacuaacuccuuuggcucuacauucuagauagcuggagucaaggaaggaagauuggagggaauugcaagcgugccuuugggagcgaagcccuaucugaaaauacuaaacucuaugggccucuucauuacuuuucaagaaaugaagagacauggcaugauguccacuuuaggaagauggcaauguaaugaagcuuucacgagagagagagagagagagagagagagagagagagagagagagagagagagagagagagagagagagagagagagagagaccaagggaugcucaug

SEQ ID NO: 11722 - RNA, 4400 nt, Mus musculus
caugagcaucccuuggucucucucucucucucucucucucucucucucucucucucucucucucucucucucucucucucucucucucucucucucgugaaagcuucauuacauugccaucuuccuaaaguggacaucaugccaugucucuucauuucuugaaaaguaaugaagaggcccauagaguuuaguauuuucagauagggcuucgcucccaaaggcacgcuugcaauucccuccaaucuuccuuccuugacuccagcuaucuagaauguagagccaaaggaguuagucacucuuauucuaaggaagagcaacuguuuccuagguuuaugucaacuugauacaagcuagcguuaucagagaggagggagccucaguugagaaaaugccucccaaagauaugccuguagcaagccuguaugguauuuucuuaauuagcgauugaugggguagguacagcucaucguggauggugccgccccuguacuaguuaguggcccuggguucuauaagaaagcaggcugagcaagucauaaggagcaagccaguaagcagcaccuuuucauggccucugcaucagcuccugccuccagguuccugcccugcuugaguuccuguccugauuuucuucaaugaacagcaauguggaagugcaauaaauccuuuucucuccaaggguggugugauauuucauuacaguaauaguagccuuaacuaagacagaagucaacuuuuccuuuacacaccucgaagucaauuuugucuuuuuuuuuuccuuuuuuuacauuaauuuugcuuugaacucgcaagcuucuuuuguuaccguggucacuauucaauacauauuuaccagguuccagguaccaugccaagacuguauaaaaaauaucaugugauccucucuaauacaggguaaguacuauuauauauaucguaaggaggagggcaucuuagagaaguuuaguaacaugcccgggguugaacauccaacaagggcagauacaguccgagagaucacagcggugcaguaggaaagucucuggcaugauuaauaaaccacagcuagaauaauaaccagcuaagagcuuuuacuugguguuucuugugugccaagcaucauguugcuuuaugcauauuauuaggaucuguaaagauucccccucacuccugacaguuccuccauguggaagaacuucugcuccagcauuucugacuuauuccacuccgaauuagugcuuccccaggaagaagaaucaggcugggagaggagugauuucuuaauggugauuugaggagaggacugggagccuguaucucagacucccuucaucacauagcagccaaacucuucucccucccgugguuacagagugaauuccugggguugggggguggggagaggagaagaaagagaggaagggaggaagggagaaagcugaagcacacaaaaucccaagacugggaaacaaaaugagugacaaagaaauuauacaagcggcuucuagucccaaguguuccuucugcucugaggggaggaaguggggcucaucaaggugguagaggaagauuugguauccaugagaugguccagugaaaucugaggaagacaagugcauacacacaauuuaacaaggaggaaacggacagagugucucauaauaaacuuaaauuagaagaagagaaaccugagaaacaggacaagcuuguggaugaagauacaggagacucacaagcugguacuuaaccagugaaggagaugcugccgaagaccugcugagacccaacuaauaacaugaccaaaugaaaucauucuuugauaguauugcuuauggugauacuggagaaaggagcccgaguuaggcugaagaaagguuagaugcugaaauguucggaaccccaauuuguccagaugguggccauggagcuaccaaggcagagaaguguuggcuuucauauggcaggguacgugguaguggccgaggagggaccaucacugccccucaaguggauucagaggcaucauggagcagagagugcagauuuugacuauaggaaagauaauaaagucaccuccuagucuacagacaaguuccagucucuguacccuucucauucuguuuggagaugcuauaauaugagguagcuuauuucagcaguuagggugcugggugguagacagcuuugucagucagcuauacacacaccgguaaauaaacauuuuauauaguuguaaaauuucauucuauucuguugccaaagaaacauuaagaacuuuguauagcuuuuuaaaaagcaacuacguuucuuuuaaagagaauaacuuuuaaaguuuaaaagaaagguguguguguguccugccugucugaucuuggcaguucuuuccuguucaaguauacuaacuucgagucaaugaugacuaggcuuugacagcguccucuuggcuuccucugcgucaucgucaucgaagccauuugaaugcugacuuuucccccugggcuugcuaagcccagucccuaggggacacagccauuugaaacucccugcgguuugaaugggcuggcccagcuggcagagaucugcagcuguguugccuuugguugcguggcaacgcagcaccccacccaucuucuguucucagagcugaagaucaacacugcugaagcucugucugcucuugcugucucacaaggaccggaagaggaugaaacaccagucaguaccgggggaauugcaacggaaaaauauuuuuccauuucggucaagucgccaucgggaaaucauucagacucaauauugagacugauacagggcggugaguggcauuucuugagcaggcuuuucuguuugcagagaaaugcccgcccuuugcgaacaaucagcaccauucagccuggcaggguugacggagcuuggggcaggccgcugauagauuucaucugcuucugaaacuccgugguuucguacaggaacacugaaaaagagacuagaaacaggaaguggaaaaaaaaaacauuucuaccuaauggaaacuaccuuuuguucaucugcaccugcauuccuguuaaacauuuaaauuagcgcagguaucuacuuuucuagggacuauccccagaugguauguacccuagaggggcuuugccucugaucuggaaucuuccugucaccauaacaaaucucucauucucuuuucgcauuccucagaaaagaaacagcuugcccauugccaggaggaauuaagaucagagucagggcaaaguucuaaaccagucucccccucccccaccccucccccucccccacccccaccccucuccccuccccucuccccuccccucucccucccucccucgcuuuauuuauuuauuuauuuauuuauuuauuuauuuaucuaucuaucuauuuauuuauuuauuuauuuauuuauuuauuuauuuauuuauuuuuguggcaggggucucuguaacauagccuggaacucagccacacaacugaggauggcccugaacuugugugagccuccugacuuuccuuccuaagugcugggauuacagggaugcccuugugccaccaugcccacccagcucagaagcucucuuaguguaauuguugaguagcucccgaauaguaaggaacugagauguaguugccuuuggucaaggaggggucagagacaagaggaguaagaugaugacgguuggaagauguauguccgagugcaccacagggaagccaggcucagaacuccuuuucacucugguccuugccugcaucgacccugcuagacgcuagcagauacuuucucacuaaggugggggaggguggcugagacccuugauggcacugugcccagaacagaaaaugugguuguuggcaacuauaucaaagggcaaggcucugcucauuuagaaaccuuuccaccucugcuuaccagaccccauaaccuagcaugcccaaggcccacagaaacuuuggaacaauaggcuuugccccuccugucaguuauuuauucauuuauuuaauuuuucauuuugaagacaggauauggcugcucuuuuaacgugugugaguucaaaucccagcaccuacaugauggcuaacagguaucucgaacuccaguuugaggggauuugauacccucuucuggccuccucugcuaauggacaaauguggcuuagacauaagagccugcaaaaacacucauccacauaaaauaaaaauaaauaagucuuugaaaaaaauguuuuuauuuacuuauguguaugaguguuuugcuuacuugcaugacugagcaccacauguauuaccagaugcccaggaaggucagacgagggcauuagauucccugguacugagugccaccauguggaugcugagaauggagccuaugccucugcaag

SEQ ID NO: 11723 - RNA, 449 nt, Mus musculus
caggcugcccucaaauacauuacauagccugacaucugacucuucugucucuaucuccagaguauuagaacagcagauguguccaaucugugggaugcuggggaugaagccagcaccuguggaugcuggguaggcagucuaaugcuguacuuuaucaucauuuccuauacaagaucuucaaaggcaaccagagaacggcaggggaggggaccuggagagagggcugcauggagguaauugcaccagaggcuagaggagccaggggcacaagaacaugagacaguucugguacuuaguaauagacacaaagcuugaccaauuaagccaagaaagguggcuaaugacuucugcuuaccucuaccuucugagacucaccuucaguugagugacuuguauuagccauaacugcaagaaagcugggagaugugauucuaaaauuuucagccucu

SEQ ID NO: 11724 - RNA, 449 nt, Mus musculus
agaggcugaaaauuuuagaaucacaucucccagcuuucuugcaguuauggcuaauacaagucacucaacugaaggugagucucagaagguagagguaagcagaagucauuagccaccuuucuuggcuuaauuggucaagcuuugugucuauuacuaaguaccagaacugucucauguucuugugccccuggcuccucuagccucuggugcaauuaccuccaugcagcccucucuccagguccccuccccugccguucucugguugccuuugaagaucuuguauaggaaaugaugauaaaguacagcauuagacugccuacccagcauccacaggugcuggcuucauccccagcaucccacagauuggacacaucugcuguucuaauacucuggagauagagacagaagagucagaugucaggcuauguaauguauuugagggcagccug

SEQ ID NO: 11725 - RNA, 267 nt, Mus musculus
ugaggcaggagauggucugaaguagguccucacagcauggaaggucagcuaaaagggcagaaaagcagcugugacaagggagaccuggcagguucucaaagcucuccuguaaacugggagcuaauuacaagcuugauggggcugagccuaaguucuugcuggagcauccguggccuucagugacucauugugagccucagugugagcuguccucugucagagcacagcuccuaacaguaugaucaucugguguucuggagaugcagu

SEQ ID NO: 11726 - RNA, 267 nt, Mus musculus
acugcaucuccagaacaccagaugaucauacuguuaggagcugugcucugacagaggacagcucacacugaggcucacaaugagucacugaaggccacggaugcuccagcaagaacuuaggcucagccccaucaagcuuguaauuagcucccaguuuacaggagagcuuugagaaccugccaggucucccuugucacagcugcuuuucugcccuuuuagcugaccuuccaugcugugaggaccuacuucagaccaucuccugccuca

SEQ ID NO: 11727 - RNA, 3928 nt, Mus musculus
guacaaggugccuuucacuuaggcguuuucuuugcugcauagugacagagaaagugcaaguaacuuaggugggaacaacuagauuauccaguuaaguucacaccacagucucuguauucaggguguggcacugggaaugaaugcacacaguuucagcucacaccucggucucaguauucaggguguggcuugggggaaugaaugugcgcaguuucagcucacaccacgggucucgguauucaggggguggugcuggggaacgcacauacuuuacuacugagcccuaaggucaaauccuaggaacuaaauagagacaccauuucuuuuaaauuuuauuuuagacaaguaaaauucguacauauuuuuaaaaacagaaacaaacauucauauuuaauugaaaucuagagaaaauaucuucuacccagaaugccugauuucugaauauuuuuauuuuuugauuuauugacgugccaccuuuucuuuccucaacagaauacucauuuuaugcaagcaaccagauuuacaaaauauauuuuauuauucuccacugucacacauuuucacugaacauuuaaggucacaaauagacaggcaaggugauccagcacccugacagcugcagggcacuaacaccuuaguaagugcacacaaauacauacugagguuuuuuuuuuuuaaagcaaaauuaggauuaucuuguaaauaucacuucaaggccuacgauagccaucuuuccacaucagcauuuuuaaaugauuguccgugcagcguugccaggcgaguaguacugagccacaacucuccucgccuguuucauuuugguuuguauuuuuacuguuaacauagcuuacauaaauaguacaucuuaagucuguacuagauugaccuuucuauuauuugcaaguauacucuacuguguggcuuccuccccaucaacaaggcuuuaaacaagagggcucuucuaaucccaaucagacuguauuuacacuuuacaguucauaugcaguuucccauuaaauguucuaauguacaaagaacuucugguucaacugguguggggaucugacauuuuuaccucucugugugaauuguggaugcuggcugugucauucagucguggguuugguguccugcagagauuuguagacagcaaguguaaagaaaucaaacccccagccugaaacagggaugguccaacuguucccuguauauuccaaccugguggguccgcgguaaagcacaaguuugggguuauuuuuuguguaauaaucuuuuacuguuuaaaucuucaucgcugccuccuaaguuaucccaaacacauuauuacaucguuagugcaccuaaaacagcaaaacaacaacaaaccccaagcgacuucacuccugcuuuuguccccuaaucuauacccaguucuaaaccaccuagccaaacagugaagccgcgcccuaaaaauaaacgggcacaugugugaaaacuucuaacaccuagaaaccuacaauguacuuaaacucagccugauuuuucccuguaaacuaaaaucaugguaggacuacccaacuuggccuuguccaucacccuacagcauauuuauucaguauggaccugcaaaaaaggaagccacacaaaaaagaagcaucccuuagaaaccagaagccaguaaagucugcuuuggagggaucaguuauacugaagagcugucaaaauacacacucaugugcuacagcaugcuucuccauaccuucauguuuuagguggugauacccagcaaaguuaaucauccccccgcccccgcaacucccccacccaccauucccuucuuucucuguuaguuacuacugcauaucugguauacauuaucucauuuaauccaucaaucuaauuuaagugagaaaaggcuggacuaaagagauuauauuucaacaaggacacugcucuacuuccccaaacugagcaucaugaaacuaaccaggcaugauguaauucuguaacccaaguccucaaaaagaucgggccaaaugcaagaccgcuucaaaaacaaaagcaaaaaaauuguuauuuccacugggcgcagacuaaccaccaucagcauuuccggaagauggcggcugcacugggcucaaaaugugagcuggaagcucagacgaccgaguuaagcaggaagcugcacuacggugcuuuacagcgaggauuaaagaagggauaagcucggccgcuguauguagccucgucgcucugcuccgugaaggucccaggaaaacgccgcccggcucgagcgccgcgcacccggccagccugcaggcgcagcucccgcagcugcucucccgagcggaagggcagccgccgugacgcagacagcgccggggaaacgcccugcucugugguacaagcacucgcucugucacugugggacucaaggcuugaggucuagagcacaagcccacgcuaugcuucgccaagagguguuuuuccucugguguaaaauuuggcagccacaacgggguagcuugguuuuauccaugguuaggacacgccggcuauagguauuauacgguaaaagcccgauuacuacaaaaggucaaaacuaagcuacugaaccacucgucaaucaaaccgggcuuaagagaauggauccucaguacuucucacuaaagaaaaauccuuuccuacagcuuuucacucaggccacuuuuacuggacuaauuucuaaugucaguuagggaaaggaucacuccaguugaaagcuacaagaacauuaaacgcuagaauagcuagcugcgcguuacaggcauggugauguaugccuguaaccugagcuagaaacaggaaaaaaaaaaaggcguugaucuuuugacuaccaagugauuucgaggccagccugaauuacacgaaccacgccucgccuuuaaaaaauaaaauuauuuagucccauuagggcaccauuaugucuaagcuucauuauuugucagccuucucuuagaaucugaacaccuugcacaggauuucuaagcaggaguguccauggagaauuuaacaggaucugugcacuaugcuacucuacgcacauuaacagcauuccgagaagggauccgccuuucagaagcauuaauuaggauggauuucugguuccgaauuccugcaguguauugugccaagccuguaacucuagaggcaguguugaguugguggucagucagucugagucaccugagaccucguuuaaacucuugcccacccucguccucgaaaagcaacccacauuaaggucauguggaccauggagucaaucuuauaaaaaaccuucucaaccuauguaaaagcuaagucuccaacuccucauacuuccugagagccggggcugcagugauuucccacuaugccuagauuuucuauuaggacuauuuuucaauuguggcuggguucacagacuucuacccuaacuuuugcuggggauugagcccagugcuuucccagagcuacgccucacucagccccuaaccccuccccuucccucaguacuaagaaucaaacgugcuggaacugacgaagacuacauuucaacucaaggcaggugaucuccuauguuugaggccagucuagucuauaaagcaaguuccaggccagccacugagaacuuguccucuaaacaagacaaacccaugaccugaagcauacuaaacaagugcucuaccaucaagcuaugaccaaagcccuauauaaucuaaaagccccaguaacugaccacuuauggagcacaucugcuaauauugagcugacuagauaggcacuuucucuaaaucuguuaaaucauuuguugcagcgaauccccucucgauagaaucuucagaaguguacaagucuccguacagugaguuuaaagugugcaguuuuuccguucucaggaaggggacuauuaaaucucagcugugau

SEQ ID NO: 11728 - RNA, 3928 nt, Mus musculus
aucacagcugagauuuaauaguccccuuccugagaacggaaaaacugcacacuuuaaacucacuguacggagacuuguacacuucugaagauucuaucgagaggggauucgcugcaacaaaugauuuaacagauuuagagaaagugccuaucuagucagcucaauauuagcagaugugcuccauaaguggucaguuacuggggcuuuuagauuauauagggcuuuggucauagcuugaugguagagcacuuguuuaguaugcuucaggucauggguuugucuuguuuagaggacaaguucucaguggcuggccuggaacuugcuuuauagacuagacuggccucaaacauaggagaucaccugccuugaguugaaauguagucuucgucaguuccagcacguuugauucuuaguacugagggaaggggagggguuaggggcugagugaggcguagcucugggaaagcacugggcucaauccccagcaaaaguuaggguagaagucugugaacccagccacaauugaaaaauaguccuaauagaaaaucuaggcauagugggaaaucacugcagccccggcucucaggaaguaugaggaguuggagacuuagcuuuuacauagguugagaagguuuuuuauaagauugacuccaugguccacaugaccuuaauguggguugcuuuucgaggacgagggugggcaagaguuuaaacgaggucucaggugacucagacugacugaccaccaacucaacacugccucuagaguuacaggcuuggcacaauacacugcaggaauucggaaccagaaauccauccuaauuaaugcuucugaaaggcggaucccuucucggaaugcuguuaaugugcguagaguagcauagugcacagauccuguuaaauucuccauggacacuccugcuuagaaauccugugcaagguguucagauucuaagagaaggcugacaaauaaugaagcuuagacauaauggugcccuaaugggacuaaauaauuuuauuuuuuaaaggcgaggcgugguucguguaauucaggcuggccucgaaaucacuugguagucaaaagaucaacgccuuuuuuuuuuuccuguuucuagcucagguuacaggcauacaucaccaugccuguaacgcgcagcuagcuauucuagcguuuaauguucuuguagcuuucaacuggagugauccuuucccuaacugacauuagaaauuaguccaguaaaaguggccugagugaaaagcuguaggaaaggauuuuucuuuagugagaaguacugaggauccauucucuuaagcccgguuugauugacgagugguucaguagcuuaguuuugaccuuuuguaguaaucgggcuuuuaccguauaauaccuauagccggcguguccuaaccauggauaaaaccaagcuaccccguuguggcugccaaauuuuacaccagaggaaaaacaccucuuggcgaagcauagcgugggcuugugcucuagaccucaagccuugagucccacagugacagagcgagugcuuguaccacagagcagggcguuuccccggcgcugucugcgucacggcggcugcccuuccgcucgggagagcagcugcgggagcugcgccugcaggcuggccgggugcgcggcgcucgagccgggcggcguuuuccugggaccuucacggagcagagcgacgaggcuacauacagcggccgagcuuaucccuucuuuaauccucgcuguaaagcaccguagugcagcuuccugcuuaacucggucgucugagcuuccagcucacauuuugagcccagugcagccgccaucuuccggaaaugcugauggugguuagucugcgcccaguggaaauaacaauuuuuuugcuuuuguuuuugaagcggucuugcauuuggcccgaucuuuuugaggacuuggguuacagaauuacaucaugccugguuaguuucaugaugcucaguuuggggaaguagagcaguguccuuguugaaauauaaucucuuuaguccagccuuuucucacuuaaauuagauugauggauuaaaugagauaauguauaccagauaugcaguaguaacuaacagagaaagaagggaauggugggugggggaguugcgggggcggggggaugauuaacuuugcuggguaucaccaccuaaaacaugaagguauggagaagcaugcuguagcacaugaguguguauuuugacagcucuucaguauaacugaucccuccaaagcagacuuuacuggcuucugguuucuaagggaugcuucuuuuuuguguggcuuccuuuuuugcagguccauacugaauaaauaugcuguagggugauggacaaggccaaguuggguaguccuaccaugauuuuaguuuacagggaaaaaucaggcugaguuuaaguacauuguagguuucuagguguuagaaguuuucacacaugugcccguuuauuuuuagggcgcggcuucacuguuuggcuaggugguuuagaacuggguauagauuaggggacaaaagcaggagugaagucgcuugggguuuguuguuguuuugcuguuuuaggugcacuaacgauguaauaauguguuugggauaacuuaggaggcagcgaugaagauuuaaacaguaaaagauuauuacacaaaaaauaaccccaaacuugugcuuuaccgcggacccaccagguuggaauauacagggaacaguuggaccaucccuguuucaggcuggggguuugauuucuuuacacuugcugucuacaaaucucugcaggacaccaaacccacgacugaaugacacagccagcauccacaauucacacagagagguaaaaaugucagauccccacaccaguugaaccagaaguucuuuguacauuagaacauuuaaugggaaacugcauaugaacuguaaaguguaaauacagucugauugggauuagaagagcccucuuguuuaaagccuuguugauggggaggaagccacacaguagaguauacuugcaaauaauagaaaggucaaucuaguacagacuuaagauguacuauuuauguaagcuauguuaacaguaaaaauacaaaccaaaaugaaacaggcgaggagaguuguggcucaguacuacucgccuggcaacgcugcacggacaaucauuuaaaaaugcugauguggaaagauggcuaucguaggccuugaagugauauuuacaagauaauccuaauuuugcuuuaaaaaaaaaaaaccucaguauguauuugugugcacuuacuaagguguuagugcccugcagcugucagggugcuggaucaccuugccugucuauuugugaccuuaaauguucagugaaaaugugugacaguggagaauaauaaaauauauuuuguaaaucugguugcuugcauaaaaugaguauucuguugaggaaagaaaagguggcacgucaauaaaucaaaaaauaaaaauauucagaaaucaggcauucuggguagaagauauuuucucuagauuucaauuaaauaugaauguuuguuucuguuuuuaaaaauauguacgaauuuuacuugucuaaaauaaaauuuaaaagaaauggugucucuauuuaguuccuaggauuugaccuuagggcucaguaguaaaguaugugcguuccccagcaccacccccugaauaccgagacccguggugugagcugaaacugcgcacauucauucccccaagccacacccugaauacugagaccgaggugugagcugaaacugugugcauucauucccagugccacacccugaauacagagacuguggugugaacuuaacuggauaaucuaguuguucccaccuaaguuacuugcacuuucucugucacuaugcagcaaagaaaacgccuaagugaaaggcaccuuguac

SEQ ID NO: 11729 - RNA, 1153 nt, Mus musculus
cagggaaaagagcuggcgacagagaggagggauggaggagagagggcuggacaagagaauguggaggguuauggcgccagcacuuaccuugcccauagaaugacaacuucacucaaccaaaacuucccauuuguccuaaagaagaucuauaggacaccagguggguaguggcucauaucuuuaaugccagcacuaaugaggcagaggcagaccaucucugaguuugagaccauccuggucuacacagugaguuccaggauaaccagggguauacaaagaaacccuguuuccaccccccaacaaaaaaccuauaaaccugcauguuuauuugaaaguuccagagccucaaauuuaguaagucagcugguaugacugcaaucacuggguucuaaaaaaaaccauuuuuauaguuguuguuaucucucuugccauguguggcacauaccuuuuaaucccaacacucaggucauaaguaccuuuuacccacugagcucuuuuguccaccccauaaaacccuuuaauaagagaauagaaugaauaaagaucaguuuaaaaaaaaucaguuaaguucuggcuuuugcuaaauauagguuugucuguuacauagauucucaggauggaauuuaaaauaccugaacucauguuucuguagccaagccuguccuguaacugacaauccuccugucucagccuccugagcaguaggaauauacccauacagcacacaccauucuaggcucaucuuuaguuugaaucccccuuuaugcacacuuaucaagacaaguguguuaggaaaugaaauacuuuuccuuuuuccuaaccuuaauuucuuuuaguccugaagaaaagauuaggaauggaaucuguaacccagcacacaggcuguaccguuuucuauuuggauuaggacauuguuugaaguccaggucuagcuuuucacucacuacucaagacugggguucuaguuagccauuuuccuaauugaaacuauguaaaaggagaagggagucaguuucuacugucacaauuaagaaccccuagcgugagguggaaauggacacuggugugagagcacuugcacuuagauguccuuggagcugagccugucccagcaggacaagaccaaaaagguaccaucuucaauucuuuucac

SEQ ID NO: 11730 - RNA, 1153 nt, Mus musculus
gugaaaagaauugaagaugguaccuuuuuggucuuguccugcugggacaggcucagcuccaaggacaucuaagugcaagugcucucacaccaguguccauuuccaccucacgcuagggguucuuaauugugacaguagaaacugacucccuucuccuuuuacauaguuucaauuaggaaaauggcuaacuagaaccccagucuugaguagugagugaaaagcuagaccuggacuucaaacaauguccuaauccaaauagaaaacgguacagccugugugcuggguuacagauuccauuccuaaucuuuucuucaggacuaaaagaaauuaagguuaggaaaaaggaaaaguauuucauuuccuaacacacuugucuugauaagugugcauaaagggggauucaaacuaaagaugagccuagaauggugugugcuguauggguauauuccuacugcucaggaggcugagacaggaggauugucaguuacaggacaggcuuggcuacagaaacaugaguucagguauuuuaaauuccauccugagaaucuauguaacagacaaaccuauauuuagcaaaagccagaacuuaacugauuuuuuuuaaacugaucuuuauucauucuauucucuuauuaaaggguuuuaugggguggacaaaagagcucaguggguaaaagguacuuaugaccugaguguugggauuaaaagguaugugccacacauggcaagagagauaacaacaacuauaaaaaugguuuuuuuuagaacccagugauugcagucauaccagcugacuuacuaaauuugaggcucuggaacuuucaaauaaacaugcagguuuauagguuuuuuguugggggguggaaacaggguuucuuuguauaccccugguuauccuggaacucacuguguagaccaggauggucucaaacucagagauggucugccucugccucauuagugcuggcauuaaagauaugagccacuacccaccugguguccuauagaucuucuuuaggacaaaugggaaguuuugguugagugaaguugucauucuaugggcaagguaagugcuggcgccauaacccuccacauucucuuguccagcccucucuccuccaucccuccucucugucgccagcucuuuucccug

SEQ ID NO: 11731 - RNA, 325 nt, Mus musculus
gguccagacagcagggugacccgccuccaggaagguagauaagcuacuagcagucucagagauuaccaacugcaccugaaguuuuggggaacuuuuguugcuucacauagagaaagucagguguuugguacacauuuauaauccuaacauucaaggaggccaaggcaagaggaagacuccaaguuccagaccaucuugagcuacuugacaacucuguucaaccaaccaaccagccaaccaaucaauaaacaagacaaguauaguggcacaugccuguaauccaucacuugggacuccacagagauggaaacagaagggccaggag

SEQ ID NO: 11732 - RNA, 325 nt, Mus musculus
cuccuggcccuucuguuuccaucucuguggagucccaagugauggauuacaggcaugugccacuauacuugucuuguuuauugauugguuggcugguugguugguugaacagaguugucaaguagcucaagauggucuggaacuuggagucuuccucuugccuuggccuccuugaauguuaggauuauaaauguguaccaaacaccugacuuucucuaugugaagcaacaaaaguuccccaaaacuucaggugcaguugguaaucucugagacugcuaguagcuuaucuaccuuccuggaggcgggucacccugcugucuggacc

SEQ ID NO: 11733 - RNA, 127 nt, Mus musculus
aggcguggauauuuggaagcucugcaugcugcuuaauaggggaauggaugaagcauagacugucacccugucauaaucacagauguuuaaaacguggaacaaagagucugcuggaaacugcugaggg

SEQ ID NO: 11734 - RNA, 127 nt, Mus musculus
cccucagcaguuuccagcagacucuuuguuccacguuuuaaacaucugugauuaugacagggugacagucuaugcuucauccauuccccuauuaagcagcaugcagagcuuccaaauauccacgccu

SEQ ID NO: 11735 - RNA, 2881 nt, Mus musculus
agacgggccaauaggaaaugccccuucucgccugcgcuaccugaaugauucucaagccccugccuucaccugugccaacugcgauuauuuuacuguuauuuugcccagcaaaaaaggagaguucuuguuuccuuaacaggugacaaacuaaagcuuuagaaauguuaauuaguuuauccaaggccucaggcccuaaaggagguguaaacugggagaugugguggugggggggggaggggacgacgaccuagaaauggagcccuggagggaaggaggugagaggugggucugggaacugggggacugaagugagcuggaggcaaacuggcguguuguggaugcagggaaagugagucugggcucagcucaacaggcugaagagcagccuguugcacagacaguguguaaauuggagacaggaaaacgcuauccaggcuggaacaauggaggguggggacggcggccucuauccacccccuucccagaaccgugggcauccuguccccaacguguucugcugucuccugccacccauuagaggggccgguaggcuuugccucuggcugcucagguuccugccugcccccuacacccugagacagcaccgcaacuuugaggugaugccucccucauccacccuaacuccaggcacuccucucucucaaagccaaaggggagggcgggaccuggucccagguguuccgcugacuccccuggaggcccacucucaacgcaugugguucccagacuccugcccccucccagguugccuacccucaccaggggauuccccaacccucccuuccucccucccgguuguguugccagugaagucugcacaucuccuaaucccuuccugggucagcaucaugucugcuccccucaaaugaucccagagccccuccagguguguucacacacaacuccccaccccuaaacucuccuccuuucuuucuccuaaccaaguccagaugugguggggccucugcuggagcugagcgaggcagggaacccaagaguccaggcuuccagaacuuauuucucuggugguagcaaaugggggaggugcacugccucaggcgagggcaucaccuugaaggacugggugucuggugugaaaagggggcggggaccgggauggaagccaauuuuggcacuuaggaaagggagggaguguggagccuaagacaggccucuaggaaaccuuagccuggaccagcaguucucagccccaggaggcaaggccaggacuggguuuuguccuguuuuuuguuuguuuguuuguuuguuuccagacaagaucucaugcaauucagacugggcacaaacucacuagcuggucuugaacucuugaucuuucugucucuaccucccaagugcuggcauuacaggaaugugcuaccaggcccagaacuuucuuuucuuuucuuuucuuuucuuuucuuuucuuuucuuuucuuuucuuuucucuucucuucucuucucuucucuucucuucucuucucuucucuucucuucuuuucuuuucuuuucucuucuuucuuuucuuuucuuuuuuuuuuuucuuuugcaauucugggggugaagccuggagccugacuacacgaagcaagcacuccagcugugccauaccugccuucccugagagcaaaugcugagaaucagcccaagagcgccugcugcugcugcuucuucuccuucuucuucuucuucuccuucuccuucuccuucuccuucuccuucuucuucuucuucuucuccuuccuuccuuccuuccuuccuuccuuccuuccuuccuuccuuccuuccuuccuuccuuccugaguugugugcacauuuaacuuccagcaugaguuucccucauuuuucuggguacagccccuccggggaaaucuagaagcuauccagugcccaccagcugcugaugggagaguuggcacugggaacagggguuacaaaucuaagggcauugggcuggugagggcguucaucagggaaugcuaccugcgagccugccgaccugcuuuaaauuaucaacaugcgcuuuaugugagguuggggacaaagaggaagacaaagacuucucuugugccuaguacuugugucacacucagaggacaacuugugaggcucucuccuuccaccaugugggucccaaggaugaaacucaggucugcaggguugguggcuagggucuuauuuccuucguccaagagaauaaauuuugcuaccuccuggaacuagaaagacaacccacucgcccucauucccguuuguucccagcaagcuguuggcccuaccucucacacauaccuccccaguggggcugacuuugucucucugucuuagagacccuguugaacacaaaacuggaaacggcggaucugaaaugggugacuuacccucaggcagagggccagguaagagcuggaggggaacugaagcaggagguugcacagaaacacuccgagauacuuguuuccuguagccacucugacccuagcuagacguccugacugacagcuuucgucucugcacagugggaggagcuaagcggccuggaugaggaacagcacagcguccgcaccuaugaggugugcgacaugaagcguccagggggccaggcucacuggcugcgcacuggcugggucccaaggcgaggugcuguccacguguaugccacgauacgcuucaccaugauggaaugccugucccugccgagggccagucgcuccugcaaggagacauucacugucuucuauuacgagagcgaagcugauacggccacggcccauacgcccgccuggauggagaaccccuacaucaagguaccaacagucugggggaucgaugccacuacaagcaguuaaguccagggagg

SEQ ID NO: 11736 - RNA, 2881 nt, Mus musculus
ccucccuggacuuaacugcuuguaguggcaucgaucccccagacuguugguaccuugauguagggguucuccauccaggcgggcguaugggccguggccguaucagcuucgcucucguaauagaagacagugaaugucuccuugcaggagcgacuggcccucggcagggacaggcauuccaucauggugaagcguaucguggcauacacguggacagcaccucgccuugggacccagccagugcgcagccagugagccuggcccccuggacgcuucaugucgcacaccucauaggugcggacgcugugcuguuccucauccaggccgcuuagcuccucccacugugcagagacgaaagcugucagucaggacgucuagcuagggucagaguggcuacaggaaacaaguaucucggaguguuucugugcaaccuccugcuucaguuccccuccagcucuuaccuggcccucugccugaggguaagucacccauuucagauccgccguuuccaguuuuguguucaacagggucucuaagacagagagacaaagucagccccacuggggagguaugugugagagguagggccaacagcuugcugggaacaaacgggaaugagggcgaguggguugucuuucuaguuccaggagguagcaaaauuuauucucuuggacgaaggaaauaagacccuagccaccaacccugcagaccugaguuucauccuugggacccacaugguggaaggagagagccucacaaguuguccucugagugugacacaaguacuaggcacaagagaagucuuugucuuccucuuuguccccaaccucacauaaagcgcauguugauaauuuaaagcaggucggcaggcucgcagguagcauucccugaugaacgcccucaccagcccaaugcccuuagauuuguaaccccuguucccagugccaacucucccaucagcagcuggugggcacuggauagcuucuagauuuccccggaggggcuguacccagaaaaaugagggaaacucaugcuggaaguuaaaugugcacacaacucaggaaggaaggaaggaaggaaggaaggaaggaaggaaggaaggaaggaaggaaggaaggaaggagaagaagaagaagaagaaggagaaggagaaggagaaggagaaggagaagaagaagaagaaggagaagaagcagcagcagcaggcgcucuugggcugauucucagcauuugcucucagggaaggcagguauggcacagcuggagugcuugcuucguguagucaggcuccaggcuucacccccagaauugcaaaagaaaaaaaaaaaagaaaagaaaagaaagaagagaaaagaaaagaaaagaagagaagagaagagaagagaagagaagagaagagaagagaagagaagagaaaagaaaagaaaagaaaagaaaagaaaagaaaagaaaagaaaagaaaagaaaguucugggccugguagcacauuccuguaaugccagcacuugggagguagagacagaaagaucaagaguucaagaccagcuagugaguuugugcccagucugaauugcaugagaucuugucuggaaacaaacaaacaaacaaacaaaaaacaggacaaaacccaguccuggccuugccuccuggggcugagaacugcugguccaggcuaagguuuccuagaggccugucuuaggcuccacacucccucccuuuccuaagugccaaaauuggcuuccaucccgguccccgcccccuuuucacaccagacacccaguccuucaaggugaugcccucgccugaggcagugcaccucccccauuugcuaccaccagagaaauaaguucuggaagccuggacucuuggguucccugccucgcucagcuccagcagaggccccaccacaucuggacuugguuaggagaaagaaaggaggagaguuuagggguggggaguugugugugaacacaccuggaggggcucugggaucauuugaggggagcagacaugaugcugacccaggaagggauuaggagaugugcagacuucacuggcaacacaaccgggagggaggaagggaggguuggggaauccccuggugaggguaggcaaccugggagggggcaggagucugggaaccacaugcguugagagugggccuccaggggagucagcggaacaccugggaccaggucccgcccuccccuuuggcuuugagagagaggagugccuggaguuaggguggaugagggaggcaucaccucaaaguugcggugcugucucaggguguagggggcaggcaggaaccugagcagccagaggcaaagccuaccggccccucuaauggguggcaggagacagcagaacacguuggggacaggaugcccacgguucugggaaggggguggauagaggccgccguccccacccuccauuguuccagccuggauagcguuuuccugucuccaauuuacacacugucugugcaacaggcugcucuucagccuguugagcugagcccagacucacuuucccugcauccacaacacgccaguuugccuccagcucacuucagucccccaguucccagacccaccucucaccuccuucccuccagggcuccauuucuaggucgucguccccucccccccccaccaccacaucucccaguuuacaccuccuuuagggccugaggccuuggauaaacuaauuaacauuucuaaagcuuuaguuugucaccuguuaaggaaacaagaacucuccuuuuuugcugggcaaaauaacaguaaaauaaucgcaguuggcacaggugaaggcaggggcuugagaaucauucagguagcgcaggcgagaaggggcauuuccuauuggcccgucu

SEQ ID NO: 11737 - RNA, 153 nt, Mus musculus
gaccuaccugcugaccugcuugcucacugcugggcccuacuguacucuuugcgucucugucaauaucggguccucucacaucccuaccugguuccucuacaccaagcucucaccuguccuuuuauuuguuugcuuucuugagacagggucuug

SEQ ID NO: 11738 - RNA, 153 nt, Mus musculus
caagacccugucucaagaaagcaaacaaauaaaaggacaggugagagcuugguguagaggaaccagguagggaugugagaggacccgauauugacagagacgcaaagaguacaguagggcccagcagugagcaagcaggucagcagguagguc

SEQ ID NO: 11739 - RNA, 193 nt, Mus musculus
auuuuuuuuuguuuuauagacaagaaauuugaaguugauacguaacuuggccacacuucgaagcuguaaauaaaugagccaagacuucaaccuaaguucgcagacucuuaucaccaaaaguacagaauggugucagguacaucaagacuaaccgaacagaaaucagcuaucauaguaagucaaauuccaaaaa

SEQ ID NO: 11740 - RNA, 193 nt, Mus musculus
uuuuuggaauuugacuuacuaugauagcugauuucuguucgguuagucuugauguaccugacaccauucuguacuuuuggugauaagagucugcgaacuuagguugaagucuuggcucauuuauuuacagcuucgaaguguggccaaguuacguaucaacuucaaauuucuugucuauaaaacaaaaaaaaau

SEQ ID NO: 11741 - RNA, 668 nt, Mus musculus
cgaauuuuagaauuaaauugcuagcugaaacuauacaguguaaugggaugucuguaacaacuugugacagaaugaccuaaaugcugccauaggaaacacaagagcucuuucuccaugaaaauaacaggauuucuaugacucugcacagccagagaugguaaugcagcaggcaguucagaagaacuacaaacacuggccaaaacucccccgcagagaaugagaaggaccauuaaugcugcauuaguguagcagucacaaacaccugccgccuucaaugcuaauguuuucauguauauucaaacccuaauuguagcaauauccuuuaaauauuuccaucacgauuccuucugcugggcucaggaccauguuuuaugcuccugacuuucccauaaugaccgcaugguaggaccagcagagaaagccugcccaaagaccacacugcagacaagccagcaaccuaugaagccagcaugaaagagaaauuugcucaaauauaccuaauucaacuaaucauauuuuccauuaagagacugagccaaagcuacacagggaaagaaaacagauaaaaggugccagaaaggugagaaguaccuacaaauauauugagaagacagagugagaaaucuuuuuagucuuagaagagcuaggagaagagacacaguacuucu

SEQ ID NO: 11742 - RNA, 668 nt, Mus musculus
agaaguacugugucucuucuccuagcucuucuaagacuaaaaagauuucucacucugucuucucaauauauuuguagguacuucucaccuuucuggcaccuuuuaucuguuuucuuucccuguguagcuuuggcucagucucuuaauggaaaauaugauuaguugaauuagguauauuugagcaaauuucucuuucaugcuggcuucauagguugcuggcuugucugcaguguggucuuugggcaggcuuucucugcugguccuaccaugcggucauuaugggaaagucaggagcauaaaacaugguccugagcccagcagaaggaaucgugauggaaauauuuaaaggauauugcuacaauuaggguuugaauauacaugaaaacauuagcauugaaggcggcagguguuugugacugcuacacuaaugcagcauuaaugguccuucucauucucugcgggggaguuuuggccaguguuuguaguucuucugaacugccugcugcauuaccaucucuggcugugcagagucauagaaauccuguuauuuucauggagaaagagcucuuguguuuccuauggcagcauuuaggucauucugucacaaguuguuacagacaucccauuacacuguauaguuucagcuagcaauuuaauucuaaaauucg

SEQ ID NO: 11743 - RNA, 387 nt, Mus musculus
aaaaaaaaaaaaaaacucuugaucaaauaguaccuaaagucgauaaaccuuuuauaaucaaggacaggucuaaauauaaauaaacaguuugggaugacuacuaccucacuuuacacuacaguaagagaaagucacaggaacauucauauagacugcaugcagaaagguuucggcacaauaaauccaaaaaguagggacacaggucagaaaggaacaagaaaagucaauacuuucaaauacccuuguuugacccaaacuggucccaauuuagccucucuucugucuacuaugacaaaaugccaccaccuaggugcuucuaauccaggcaaguucugauagagcaucucuuuucuauaacggccgaggaagaaaucuuuugacgacaca

SEQ ID NO: 11744 - RNA, 387 nt, Mus musculus
ugugucgucaaaagauuucuuccucggccguuauagaaaagagaugcucuaucagaacuugccuggauuagaagcaccuaggugguggcauuuugucauaguagacagaagagaggcuaaauugggaccaguuugggucaaacaaggguauuugaaaguauugacuuuucuuguuccuuucugaccugugucccuacuuuuuggauuuauugugccgaaaccuuucugcaugcagucuauaugaauguuccugugacuuucucuuacuguaguguaaagugagguaguagucaucccaaacuguuuauuuauauuuagaccuguccuugauuauaaaagguuuaucgacuuuagguacuauuugaucaagaguuuuuuuuuuuuuuu

SEQ ID NO: 11745 - RNA, 953 nt, Mus musculus
gggcagcugugauagaucaaguucagccauuugccaagguauauacacauuuuauuuaaaaaaguuuacaguuuucauuauacacaacuauuaagagguuauagucagaagaggcaauuguccaggugacagacaugcccacuagaucaucacaaugcaaggagggcagaagggaggagagagggcaaggaggggaaagcgguaaaaagcuuagauuucaauuaagggcugguaagucccuuuuaucucuucaaguaucacacaauauguaccaaauacaaucaguaauuaaaggccauuucuucccgcaccuagagcuguguaauugcuaaaccaagagcccuggccacuccucccgugagugggaagcugcacaccccuggcccccaggggccgccuuuccauccaauucccaaagagcugguggagguguucaguggccagaggaagaggaacauggauucacacguccaaagaaugcaguucuuugugcccaaucagaaaugaguugguuucacucagcaaggcuaugacccaguuacaaguugacaaaacaaacugcuaacuuuugcaaauggcuugacuuuucugagucacuaaaacacaaagggucacaugccgcuuaaaauccaaugccaguacucagaaaccugacccagagaaacuagagacuggcagagggucugucaugauucucagccaccccaaagaguggccuagaaaaugcaagugucaggucaaggccaccuagaacuucggggagcccuuuccagggcgcaguuccuuugagaagggacacuccucaggagccuagagcagccgguuggcaauuagaacagcguuugaaguggacaaaacacauuagugcuggagagauguugcaacuucugauaacucauuaauagaaacgucaguugaggcugcucaucucucucgagagggcagagacugcu

SEQ ID NO: 11746 - RNA, 953 nt, Mus musculus
agcagucucugcccucucgagagagaugagcagccucaacugacguuucuauuaaugaguuaucagaaguugcaacaucucuccagcacuaauguguuuuguccacuucaaacgcuguucuaauugccaaccggcugcucuaggcuccugaggagugucccuucucaaaggaacugcgcccuggaaagggcuccccgaaguucuagguggccuugaccugacacuugcauuuucuaggccacucuuugggguggcugagaaucaugacagacccucugccagucucuaguuucucugggucagguuucugaguacuggcauuggauuuuaagcggcaugugacccuuuguguuuuagugacucagaaaagucaagccauuugcaaaaguuagcaguuuguuuugucaacuuguaacugggucauagccuugcugagugaaaccaacucauuucugauugggcacaaagaacugcauucuuuggacgugugaauccauguuccucuuccucuggccacugaacaccuccaccagcucuuugggaauuggauggaaaggcggccccugggggccaggggugugcagcuucccacucacgggaggaguggccagggcucuugguuuagcaauuacacagcucuaggugcgggaagaaauggccuuuaauuacugauuguauuugguacauauugugugauacuugaagagauaaaagggacuuaccagcccuuaauugaaaucuaagcuuuuuaccgcuuuccccuccuugcccucucuccucccuucugcccuccuugcauugugaugaucuagugggcaugucugucaccuggacaauugccucuucugacuauaaccucuuaauaguuguguauaaugaaaacuguaaacuuuuuuaaauaaaauguguauauaccuuggcaaauggcugaacuugaucuaucacagcugccc

SEQ ID NO: 11747 - RNA, 1107 nt, Mus musculus
aagaccaacaccaccuuucucucuacacugggcugacaguuccuuuuucuggaagcacugauuggccuuuuuauagacuuccgaguugcuaugcggcuaguuaauucauuuuuauguuuucucuacauuccucucuaacuugaucuguggagaaucuuagcuuuaaugcucugcaaggacaguauuaaguccuggugcucagccaugcucagggagacacugcaaggugcagacugccaucaguguccagucacugguuuagcccuguucacgcugccuggagcugauucuccacaaugacugaguggcacuauccauaaagcacauuggccaucagucacagcacagacauucugucccuuucgaauacaacaagcagcuaugcaaaggccugcucuccauguacucacagaggcaagccaccuucaaguuuacugugucccacaagugaguuauauagcuacucucaacagaaaggugaccugugauacuuuuauaucuucucaaauuuuauuuacuuacuuauuugagacagggucucaccaugaaacccuggcuagccuugaacucacagagaucugccugcuaagcaauguaccaccaugucugguuauguucuuuuuuuuuuuuuuugguuauguucuuuuaaugcuauuuuauuuauuuauauuuaguuuugagacaaggucuuuccacacaguucugccuaugaucgaacucacagagagccacuuccucugccucucgagugcuggaauuagagucaugcgcuaccauauuauauaaaaaaaggaacuauucugugaaaguuaguccaagaauccuuagaacacggcauagaauaagggauagugcaagggacugaauuucuaagaucugaucacauaagcaacucuaaaucaaucucucucucucucuccucccgccuccaacucacacacacguuucacuuuccccaagucucuaucauaagacuucaucugauccugaucuggguucuaguagcagguuccucagcugcagugcccaccacucugcaguguuuccucaaccugucaaucaucccacuaugugguguuccccuggaacgcuggauccaugaacuag

SEQ ID NO: 11748 - RNA, 1107 nt, Mus musculus
cuaguucauggauccagcguuccaggggaacaccacauagugggaugauugacagguugaggaaacacugcagaguggugggcacugcagcugaggaaccugcuacuagaacccagaucaggaucagaugaagucuuaugauagagacuuggggaaagugaaacgugugugugaguuggaggcgggaggagagagagagagagauugauuuagaguugcuuaugugaucagaucuuagaaauucagucccuugcacuaucccuuauucuaugccguguucuaaggauucuuggacuaacuuucacagaauaguuccuuuuuuuauauaauaugguagcgcaugacucuaauuccagcacucgagaggcagaggaaguggcucucugugaguucgaucauaggcagaacuguguggaaagaccuugucucaaaacuaaauauaaauaaauaaaauagcauuaaaagaacauaaccaaaaaaaaaaaaaaagaacauaaccagacauggugguacauugcuuagcaggcagaucucugugaguucaaggcuagccaggguuucauggugagacccugucucaaauaaguaaguaaauaaaauuugagaagauauaaaaguaucacaggucaccuuucuguugagaguagcuauauaacucacuugugggacacaguaaacuugaagguggcuugccucugugaguacauggagagcaggccuuugcauagcugcuuguuguauucgaaagggacagaaugucugugcugugacugauggccaaugugcuuuauggauagugccacucagucauuguggagaaucagcuccaggcagcgugaacagggcuaaaccagugacuggacacugauggcagucugcaccuugcagugucucccugagcauggcugagcaccaggacuuaauacuguccuugcagagcauuaaagcuaagauucuccacagaucaaguuagagaggaauguagagaaaacauaaaaaugaauuaacuagccgcauagcaacucggaagucuauaaaaaggccaaucagugcuuccagaaaaaggaacugucagcccaguguagagagaaaggugguguuggucuu

SEQ ID NO: 11749 - RNA, 1460 nt, Mus musculus
auccuagggccuacacuuaccaaagucucccaugccaccuacaguuucagccauauaccagugcauaacugaaaaaagcacuggucugaaaauuggagauuugagcaucuucucuuugaagguguggagaucugggcuuugcuuuuuguaaguaucucccaucuuccaggguccguaacugcuuuaacccauggacucaugaaaugcagcauuugcaugagcaaacuuuacccauacuccugggaauagacucaugagcuucugaagcuuccguuaaaauagcugucuucuaccuucucaauggcgcugcugcuuugguggagcucucucucaucagcccuguuacugcacugaugcccugaacuaucaggcaaacaagguucauaacccaggguacaguucgcucaaggaaaggauggcggcacggcgagcaccucgucaggcuguguaagcacccgugaacugccuggagagccuggauguuccugcuacacgcuaaguacuguagacgccucugcaguugcucguuugcaugccuuaaauguguauauauauauauguauguauguauauauauauacaugcaugcuaggacguucaaaacaggaacccgaaagacaccuuaagcccugguaucccaaugccuggucccaugacuggcugguggaagcauaaaaaugugugugugugugugugguguguacguacauacaagaauacgugcgcgcgugaaaagauacaaaucaaagcagagcaugaacauccuaauuuaguguguauccucucaucagagguuuucaaaaauguauuuaaaaaauuauuuacuuaauguuaagugaauaagagugcacacugugacaccagccugcggaccaccuccuucaggauucagguuuggaaguacuuaccuuuuagcucuucaucuuuaauuacugcuucggugguugcccuggaaaccuccuagcuaaauggagaacugcacgugagcucuagcgucccagcuugcaggccgacuccccaucucugccugagucuuccugagagcccagagucagguaucugugcagccugcuggcacgggagaaaaaagcacgugaggaauggcuuacuuugaauauuuucaccaaaaauucaaguuaagcaaaugaagucccguucacauuuagagaagaaagggcuacucuuaaaacuccuaguaccaagaccggagagguggcgcaggggcuaagagcauuuauuguucuuguagagguaaaugcagcuccagaggaccugcaucccuccuucuguacucuaugggaaccaggcaaaccugugauucauauacagagacaaagcguucauacacagaaaaaaagccauuaaaaauguaauccguuaacaagaaauuauggauuguuauuaugugccuauuauaacaaccaccaagguagugguuguuauaauaauaaauguuuaua

SEQ ID NO: 11750 - RNA, 1460 nt, Mus musculus
uauaaacauuuauuauuauaacaaccacuaccuuggugguuguuauaauaggcacauaauaacaauccauaauuucuuguuaacggauuacauuuuuaauggcuuuuuuucuguguaugaacgcuuugucucuguauaugaaucacagguuugccugguucccauagaguacagaaggagggaugcagguccucuggagcugcauuuaccucuacaagaacaauaaaugcucuuagccccugcgccaccucuccggucuugguacuaggaguuuuaagaguagcccuuucuucucuaaaugugaacgggacuucauuugcuuaacuugaauuuuuggugaaaauauucaaaguaagccauuccucacgugcuuuuuucucccgugccagcaggcugcacagauaccugacucugggcucucaggaagacucaggcagagauggggagucggccugcaagcugggacgcuagagcucacgugcaguucuccauuuagcuaggagguuuccagggcaaccaccgaagcaguaauuaaagaugaagagcuaaaagguaaguacuuccaaaccugaauccugaaggaggugguccgcaggcuggugucacagugugcacucuuauucacuuaacauuaaguaaauaauuuuuuaaauacauuuuugaaaaccucugaugagaggauacacacuaaauuaggauguucaugcucugcuuugauuuguaucuuuucacgcgcgcacguauucuuguauguacguacacaccacacacacacacacacauuuuuaugcuuccaccagccagucaugggaccaggcauugggauaccagggcuuaaggugucuuucggguuccuguuuugaacguccuagcaugcauguauauauauauacauacauacauauauauauauacacauuuaaggcaugcaaacgagcaacugcagaggcgucuacaguacuuagcguguagcaggaacauccaggcucuccaggcaguucacgggugcuuacacagccugacgaggugcucgccgugccgccauccuuuccuugagcgaacuguacccuggguuaugaaccuuguuugccugauaguucagggcaucagugcaguaacagggcugaugagagagagcuccaccaaagcagcagcgccauugagaagguagaagacagcuauuuuaacggaagcuucagaagcucaugagucuauucccaggaguauggguaaaguuugcucaugcaaaugcugcauuucaugaguccauggguuaaagcaguuacggacccuggaagaugggagauacuuacaaaaagcaaagcccagaucuccacaccuucaaagagaagaugcucaaaucuccaauuuucagaccagugcuuuuuucaguuaugcacugguauauggcugaaacuguagguggcaugggagacuuugguaaguguaggcccuaggau

SEQ ID NO: 11751 - RNA, 283 nt, Mus musculus
ugccugaggaggcagggguagagcagccugucaacacugucucuguguucccugagcucaugaugucaauucugacuguccucaaaccuccaacaaucauuuacccaaaccaaacaauuaauaauuuaguuaauuaacaaguaauuaaaaccgcugugcagcuaccccagggcugcuccuggagaggguaagaaggagcagggaagaggaaaggagggacuguuaacugcaggcuggagccaccucucccucucuucucuaagcugccccuguaauaacuacg

SEQ ID NO: 11752 - RNA, 283 nt, Mus musculus
cguaguuauuacaggggcagcuuagagaagagagggagagguggcuccagccugcaguuaacagucccuccuuuccucuucccugcuccuucuuacccucuccaggagcagcccugggguagcugcacagcgguuuuaauuacuuguuaauuaacuaaauuauuaauuguuugguuuggguaaaugauuguuggagguuugaggacagucagaauugacaucaugagcucagggaacacagagacaguguugacaggcugcucuaccccugccuccucaggca

SEQ ID NO: 11753 - RNA, 156 nt, Mus musculus
uacaguugguauuuaguaacauuaaaaacuauucaaauauauaaaauuacauauuuuguaaaauuuuauuuauugguacagaacuugguagaaauuuaauuugcauauuaauacaggguacaucauauaaagacagcugagacaguagccccauga

SEQ ID NO: 11754 - RNA, 156 nt, Mus musculus
ucauggggcuacugucucagcugucuuuauaugauguacccuguauuaauaugcaaauuaaauuucuaccaaguucuguaccaauaaauaaaauuuuacaaaauauguaauuuuauauauuugaauaguuuuuaauguuacuaaauaccaacugua

SEQ ID NO: 11755 - RNA, 322 nt, Mus musculus
aaauagauacuuaaaauauacacuuauaaagauauguauuuuaagaacccuggaggagaauggguaguguuccaacuuuuucauguuacaagaccagagacuacucacuugcuaaaucuuagauuccuuagugauaagauagaauaagacugucuguacccuccaaccuguuuaaaauucaacuacgaugacaaaugaguaugcugcauaguucuuaauagagcaagacauuuaauaaagguuaacuaucauuuuuauggaccacugcuguugguuuaacccaucugucuguuugcccaccuguuuuucuagccuauccauu

SEQ ID NO: 11756 - RNA, 322 nt, Mus musculus
aauggauaggcuagaaaaacaggugggcaaacagacagauggguuaaaccaacagcagugguccauaaaaaugauaguuaaccuuuauuaaaugucuugcucuauuaagaacuaugcagcauacucauuugucaucguaguugaauuuuaaacagguuggaggguacagacagucuuauucuaucuuaucacuaaggaaucuaagauuuagcaagugaguagucucuggucuuguaacaugaaaaaguuggaacacuacccauucuccuccaggguucuuaaaauacauaucuuuauaaguguauauuuuaaguaucuauuu

SEQ ID NO: 11757 - RNA, 100 nt, Mus musculus
uuuuucuguucaccugccaagucaaugccacacauuuuauuuuauauguuucaaaaacaugauugcauguuagcgcauguguguagagcgcaucugucuu

SEQ ID NO: 11758 - RNA, 100 nt, Mus musculus
aagacagaugcgcucuacacacaugcgcuaacaugcaaucauguuuuugaaacauauaaaauaaaauguguggcauugacuuggcaggugaacagaaaaa

SEQ ID NO: 11759 - RNA, 117 nt, Mus musculus
agcgccgaaggucaggcaagccccggcgcaugcugugucccuuggaggcuuucaggcuggcaugagcagcagggaaaauauacgacugcugcucacacaaaucccauuccagaaagg

SEQ ID NO: 11760 - RNA, 117 nt, Mus musculus
ccuuucuggaaugggauuugugugagcagcagucguauauuuucccugcugcucaugccagccugaaagccuccaagggacacagcaugcgccggggcuugccugaccuucggcgcu

SEQ ID NO: 11761 - RNA, 17 nt, Mus musculus
ugguucccagggaagaa

SEQ ID NO: 11762 - RNA, 17 nt, Mus musculus
uucuucccugggaacca

SEQ ID NO: 11763 - RNA, 84 nt, Mus musculus
aaauaaaaaggaaucuuaaaaaaaguuacaaauuguuucuaauucuuaacauuauaaaggagcaauauuaauauuuaguuugga

SEQ ID NO: 11764 - RNA, 84 nt, Mus musculus
uccaaacuaaauauuaauauugcuccuuuauaauguuaagaauuagaaacaauuuguaacuuuuuuuaagauuccuuuuuauuu

SEQ ID NO: 11765 - RNA, 235 nt, Mus musculus
aaaggucugcuugccucugacucccgaauuuugggauuaaagguaugugcugccaucuccuggcugccuuuuuuguuuguuuguuuugguuuguuguuguuguuguuguuuugguuuugguuuugguuuugguuuugguuuugguuuugguuuugguuuuucaagacagggguucucuguguagcccuggcuguccuggaacucacucuuuagaccagguuggccuugaacucag

SEQ ID NO: 11766 - RNA, 235 nt, Mus musculus
cugaguucaaggccaaccuggucuaaagagugaguuccaggacagccagggcuacacagagaaccccugucuugaaaaaccaaaaccaaaaccaaaaccaaaaccaaaaccaaaaccaaaaccaaaacaacaacaacaacaacaaaccaaaacaaacaaacaaaaaaggcagccaggagauggcagcacauaccuuuaaucccaaaauucgggagucagaggcaagcagaccuuu

SEQ ID NO: 11767 - RNA, 1759 nt, Mus musculus
guguccaucuuaccgguuggaacaucuucuggauauaugcccaggagagguauugcgggauccuccgguaguacuauguccaauuuucugaggaaccgccagacugauuuccggagugguuguacaagcuugcaauuccaccaacauugaaggaguguuccucuuucucuacauccucgacagcaucugcugucaccugaauuuuugaucuuagccauucuggcugguaugagguggaaucucacugacugcuuauuuuuaaaauuauaugucuauguguauauuugaauguggguuuaugcacuuaaguacccacgaaggccaaaaaagaucauugaaucuccuggagcuguuacagaugguugugagucaugccaugugguugcugugguuaaaacucagguccccuccaagagcagugagugaccuuagccacugagccauuucucuaguauacaagauaagucauuuucuuuaacaaaugugauggauuggguaguuuaaaauaauagaaaaauuaauuaaauguauuauguauguauuuauguauguaugguuacaguugucagagacaaggggcagacgauggcacccugcgggcugaggggcagcaauaaaccaugauggcaauagaggaucugagaugaugaggacagacacuugagcugaggaagcagugcuauccacuguguuucuccucucaaggauguagguaaugugggaagauggagggcugacaggagaugcuuguaggagauucccagggagguguccuagaaacacuuucagcuacuuucccaaagcuaaguguuuccaaagaugcuugaaacaguuguguagagaacaggauggaccaaacugggagaugacugagcaccggaugucccuugugauucucagagugccaugaagugagcccucugugacaucacaggguaaaucccugccuuaguaacugcagagugcuuagccugaggauaacucagaguccagcaaggaggucugggauucacacugagcacgugugucugccuaggcuugggcuguuuucugggauggacuaccugaaauucaucacgugaguagcucacucagugcaaggcacuucuucacuggggucuuaagcgggggaggcagaaauagggagaggaacuuaaaauguuucugagugaagacagcucuaagacuuucuucaagagagcuaaggagagcuagaaacagaagucucacaguagugggaauggccacucaagacuguaggaagaagaaccccucacucaccaggaggagaggccuuggaaagaagauacacacacacacacacacacacacacacacacacacacacacacacacauauauauggaccuggacuugagcccccagccuaggccaggaaggacggaacagugcuuuugccaugcccacauuugaccauuuaaccaucauacauagcuuguccagggaaggaggcagagcaucccugacacuggugucugaucuucccuggugauuucagucccuggcaguaacaaucuuugcauguguacucagagagcugccacgaugagucaaacaucaaugccaguaucacgggaaaugccaugacagcaccuuccccucucauucuguauauaaauacauauuuucacuuuguagguguguuguauauguucuuauguaugugcucaugucugcagguccaccuccauaugugugaaagugcaugaggaggacauggaauuaugccacauaucuu

SEQ ID NO: 11768 - RNA, 1759 nt, Mus musculus
aagauauguggcauaauuccauguccuccucaugcacuuucacacauauggagguggaccugcagacaugagcacauacauaagaacauauacaacacaccuacaaagugaaaauauguauuuauauacagaaugagaggggaaggugcugucauggcauuucccgugauacuggcauugauguuugacucaucguggcagcucucugaguacacaugcaaagauuguuacugccagggacugaaaucaccagggaagaucagacaccagugucagggaugcucugccuccuucccuggacaagcuauguaugaugguuaaauggucaaaugugggcauggcaaaagcacuguuccguccuuccuggccuaggcugggggcucaaguccagguccauauauauguguguguguguguguguguguguguguguguguguguguguguguguaucuucuuuccaaggccucuccuccuggugagugagggguucuucuuccuacagucuugaguggccauucccacuacugugagacuucuguuucuagcucuccuuagcucucuugaagaaagucuuagagcugucuucacucagaaacauuuuaaguuccucucccuauuucugccucccccgcuuaagaccccagugaagaagugccuugcacugagugagcuacucacgugaugaauuucagguaguccaucccagaaaacagcccaagccuaggcagacacacgugcucagugugaaucccagaccuccuugcuggacucugaguuauccucaggcuaagcacucugcaguuacuaaggcagggauuuacccugugaugucacagagggcucacuucauggcacucugagaaucacaagggacauccggugcucagucaucucccaguuugguccauccuguucucuacacaacuguuucaagcaucuuuggaaacacuuagcuuugggaaaguagcugaaaguguuucuaggacaccucccugggaaucuccuacaagcaucuccugucagcccuccaucuucccacauuaccuacauccuugagaggagaaacacaguggauagcacugcuuccucagcucaagugucuguccucaucaucucagauccucuauugccaucaugguuuauugcugccccucagcccgcagggugccaucgucugccccuugucucugacaacuguaaccauacauacauaaauacauacauaauacauuuaauuaauuuuucuauuauuuuaaacuacccaauccaucacauuuguuaaagaaaaugacuuaucuuguauacuagagaaauggcucaguggcuaaggucacucacugcucuuggaggggaccugaguuuuaaccacagcaaccacauggcaugacucacaaccaucuguaacagcuccaggagauucaaugaucuuuuuuggccuucguggguacuuaagugcauaaacccacauucaaauauacacauagacauauaauuuuaaaaauaagcagucagugagauuccaccucauaccagccagaauggcuaagaucaaaaauucaggugacagcagaugcugucgaggauguagagaaagaggaacacuccuucaauguugguggaauugcaagcuuguacaaccacuccggaaaucagucuggcgguuccucagaaaauuggacauaguacuaccggaggaucccgcaauaccucuccugggcauauauccagaagauguuccaaccgguaagauggacac

SEQ ID NO: 11769 - RNA, 119 nt, Mus musculus
uuuuccccaaaauauugaccaagaucaaggcuaaaaacaaagaagcuuuggacaaauuugaacucaaaagaauccaguacuucaaacauaaaaagaaucauauacccugauagugaggu

SEQ ID NO: 11770 - RNA, 119 nt, Mus musculus
accucacuaucaggguauaugauucuuuuuauguuugaaguacuggauucuuuugaguucaaauuuguccaaagcuucuuuguuuuuagccuugaucuuggucaauauuuuggggaaaa

SEQ ID NO: 11771 - RNA, 71 nt, Mus musculus
acuguagccagcccagacucgccuugaauuccugauuuuccugccucagccuuuaguauuaggauuacagg

SEQ ID NO: 11772 - RNA, 71 nt, Mus musculus
ccuguaauccuaauacuaaaggcugaggcaggaaaaucaggaauucaaggcgagucugggcuggcuacagu

SEQ ID NO: 11773 - RNA, 105 nt, Mus musculus
gacauguuauauaccauucugauacuuugucucaagaaugggccuuuagccacuauuguggaguacauuuuuuuuaaagauuuauuuauuuacuuaacaugagua

SEQ ID NO: 11774 - RNA, 105 nt, Mus musculus
uacucauguuaaguaaauaaauaaaucuuuaaaaaaaauguacuccacaauaguggcuaaaggcccauucuugagacaaaguaucagaaugguauauaacauguc

SEQ ID NO: 11775 - RNA, 260 nt, Mus musculus
ccugaacuuuccagcccaaaggcuggguuguccuucccacagaggcucuucccuauauaauccagacauuugcuugucccucuccucuuucugagcaaacaugccuguuucucccuuucuccucccuccucccacgcccauggcgacuccccuagcuucaauccuuggggccagugaacuuacccaagagcagcuucccaauaaacccgccuuuaauauaaccuaaucuggcuugaauuggcucauuucaccgguggaga

SEQ ID NO: 11776 - RNA, 260 nt, Mus musculus
ucuccaccggugaaaugagccaauucaagccagauuagguuauauuaaaggcggguuuauugggaagcugcucuuggguaaguucacuggccccaaggauugaagcuaggggagucgccaugggcgugggaggagggaggagaaagggagaaacaggcauguuugcucagaaagaggagagggacaagcaaaugucuggauuauauagggaagagccucugugggaaggacaacccagccuuugggcuggaaaguucagg

SEQ ID NO: 11777 - RNA, 314 nt, Mus musculus
auauaggacucaaagugguguucacguggucuugaacucagguccucagacuugcuucugugucaacagugugaucagaucagcucuugcaagggaugggaagacugacugguaggggcugcaaaaaagggcaaggucuguagggcacacagcuuggccuggagagcagaguagcugaggugccagggccucuuguauccugucacuaacagccucaagcugucccuccauuagcccacuucaaggaccccuggaagguuggaugggaagaacaagcccucacaucauuggucaagagugucacauugucuuuc

SEQ ID NO: 11778 - RNA, 314 nt, Mus musculus
gaaagacaaugugacacucuugaccaaugaugugagggcuuguucuucccauccaaccuuccagggguccuugaagugggcuaauggagggacagcuugaggcuguuagugacaggauacaagaggcccuggcaccucagcuacucugcucuccaggccaagcugugugcccuacagaccuugcccuuuuuugcagccccuaccagucagucuucccaucccuugcaagagcugaucugaucacacuguugacacagaagcaagucugaggaccugaguucaagaccacgugaacaccacuuugaguccuauau

SEQ ID NO: 11779 - RNA, 100 nt, Mus musculus
cugaggucuuucccuggccuuuugcuaguguguggaauuucacagcugaaagcucuuguuuuaauuguguguaugcaugcgugcaugcgugugugugugu

SEQ ID NO: 11780 - RNA, 100 nt, Mus musculus
acacacacacacgcaugcacgcaugcauacacacaauuaaaacaagagcuuucagcugugaaauuccacacacuagcaaaaggccagggaaagaccucag

SEQ ID NO: 11781 - RNA, 594 nt, Mus musculus
uauauguuuagaauuagagaauuagugauacacaaguugacucagaacagugcuuuuucugcucaaauguuucauauuuguggauauauuugcuuauaagcauguuuucauagagcuuagaauuauggcugacaccugcaaucccagcacucaggaggcugggacaggcacuuacugcagaucugaggucagcuggcucuguacugaguuccagaucagucuaguguuaaacaaaauagagcauccacauugguaguuuuucucaaagaguugcacugaaaguuagcagugcguaucucuuaguaguaggguggugaaugcauuaauuuuuuucuuuaauuuguguuucuuagugguuuccaaauguaugccuuguuuuucuguggcagugcugugguggggccuagggccuuaagugagcuaggccagugcucaccacggagcuacccucucgucugugugcucacuuuguaauuagaaaaguggagaccaaagaaguucagugaaaaaggauguccuaaggcagaguguguucuuuucccuguagacccgucagguccuggaggagcugaccgagcugcccgugauggugga

SEQ ID NO: 11782 - RNA, 594 nt, Mus musculus
uccaccaucacgggcagcucggucagcuccuccaggaccugacgggucuacagggaaaagaacacacucugccuuaggacauccuuuuucacugaacuucuuuggucuccacuuuucuaauuacaaagugagcacacagacgagaggguagcuccguggugagcacuggccuagcucacuuaaggcccuaggccccaccacagcacugccacagaaaaacaaggcauacauuuggaaaccacuaagaaacacaaauuaaagaaaaaaauuaaugcauucaccacccuacuacuaagagauacgcacugcuaacuuucagugcaacucuuugagaaaaacuaccaauguggaugcucuauuuuguuuaacacuagacugaucuggaacucaguacagagccagcugaccucagaucugcaguaagugccugucccagccuccugagugcugggauugcaggugucagccauaauucuaagcucuaugaaaacaugcuuauaagcaaauauauccacaaauaugaaacauuugagcagaaaaagcacuguucugagucaacuuguguaucacuaauucucuaauucuaaacauaua

SEQ ID NO: 11783 - RNA, 1382 nt, Mus musculus
uuagguaccuuucccacugcuguguuugauuacuugacaaaaagaaggggcuauuuuggcucaugguuugagaagaugcaguccaucauggcaaaugaaggcaaggugguaggagcuagcaguucaucagauuacauucaaagucagcaagcagagaaaaauggaugcuggcacucaccuggcuuccuccuuucccccuuuacucaguauggaucucagccaaaaggacagugucacccauauucagaguggaucuuucuucccuagaguuuucuggaaaggucuucaagcauauccaaagggguaucucucagauaauuccaaaucuaggcaagcuggcaauaaagagaguaaccuccacaaauaucagcuccuuuaaacuauaccuuacuggaguuuaugcuggcuaauuaggugggcuuucagacaccuucaggguagggcugguugccaggaaaccuauauaugggacuuaacaccucuaccuaggugaaaaggagaggagcuggaaaggaacuaacugauggaauauggagaguuugugaauaggugaaaacaaggcgguagcuacaagaugugcacacaagcucugcaggacaccccccaccccccaccucccaguguggccuguucucccuucuaccugccugcuacugaguugcauccuuuaaaguaaaccaucaaauuuaaguaacauguuuuccaauggucuaugagucacuagcaaauuaaugagaggaaagauuaaugguaaccuuagaauccgcagccaaguugaacaaaaauauggguggucaugaacuugcagcuggaguagcacagucuuguggaacugucuuuauacuuggaaagaaucugaugguaacuccaggcaaucaguguaaacaacugaaggaaucuugagauauucaguaaacacugaauaaugaagagaguugguaaugaucugagagaaaaaaauauuuuucuaguaauuucuaauuuauacuuguaaagcuuagagacacaaauagauuuguugacauaaccuccuagcucaccuugcuguaucauuuacaaauaggaagcccaaagaauguaaguaaugcuaugagaacagugguuacuaaagggagaugguauuaacucaaggucauaaugugccaagcauaaauuaugugcaaaaaacucuaaaaauccaauuccaucccuaauaacagagaaauuaaccucauuuuuuuuuuacuguacaagcaaguaacagaagugggaacuaaauucaguuuuaaucccugcaucugucuacauuauaguagccuucauuuuuuauuauauaguauaaaauuauaaauucuaaugauuacuaagcauaauauauucuaaaguguacuuauggaaaacua

SEQ ID NO: 11784 - RNA, 1382 nt, Mus musculus
uaguuuuccauaaguacacuuuagaauauauuaugcuuaguaaucauuagaauuuauaauuuuauacuauauaauaaaaaaugaaggcuacuauaauguagacagaugcagggauuaaaacugaauuuaguucccacuucuguuacuugcuuguacaguaaaaaaaaaaugagguuaauuucucuguuauuagggauggaauuggauuuuuagaguuuuuugcacauaauuuaugcuuggcacauuaugaccuugaguuaauaccaucucccuuuaguaaccacuguucucauagcauuacuuacauucuuugggcuuccuauuuguaaaugauacagcaaggugagcuaggagguuaugucaacaaaucuauuugugucucuaagcuuuacaaguauaaauuagaaauuacuagaaaaauauuuuuuucucucagaucauuaccaacucucuucauuauucaguguuuacugaauaucucaagauuccuucaguuguuuacacugauugccuggaguuaccaucagauucuuuccaaguauaaagacaguuccacaagacugugcuacuccagcugcaaguucaugaccacccauauuuuuguucaacuuggcugcggauucuaagguuaccauuaaucuuuccucucauuaauuugcuagugacucauagaccauuggaaaacauguuacuuaaauuugaugguuuacuuuaaaggaugcaacucaguagcaggcagguagaagggagaacaggccacacugggagguggggggugggggguguccugcagagcuugugugcacaucuuguagcuaccgccuuguuuucaccuauucacaaacucuccauauuccaucaguuaguuccuuuccagcuccucuccuuuucaccuagguagagguguuaagucccauauauagguuuccuggcaaccagcccuacccugaaggugucugaaagcccaccuaauuagccagcauaaacuccaguaagguauaguuuaaaggagcugauauuuguggagguuacucucuuuauugccagcuugccuagauuuggaauuaucugagagauaccccuuuggauaugcuugaagaccuuuccagaaaacucuagggaagaaagauccacucugaauaugggugacacuguccuuuuggcugagauccauacugaguaaagggggaaaggaggaagccaggugagugccagcauccauuuuucucugcuugcugacuuugaauguaaucugaugaacugcuagcuccuaccaccuugccuucauuugccaugauggacugcaucuucucaaaccaugagccaaaauagccccuucuuuuugucaaguaaucaaacacagcagugggaaagguaccuaa

SEQ ID NO: 11785 - RNA, 128 nt, Mus musculus
aaagaguagcuguucuugggucucagauagacaaaagaagcaaauccauaauguaugaacaccacugugaaaugggaggagcaaguugaaaaggucuuauaccuucccuuggcagagggcaucuuuau

SEQ ID NO: 11786 - RNA, 128 nt, Mus musculus
auaaagaugcccucugccaagggaagguauaagaccuuuucaacuugcuccucccauuucacagugguguucauacauuauggauuugcuucuuuugucuaucugagacccaagaacagcuacucuuu

SEQ ID NO: 11787 - RNA, 1054 nt, Mus musculus
uuggaugcccucuucaacaucaugauggagaacucagagagugagacguuugauaccuugguguuugaugcucugguaaggggccucccuuucauccucucagagggugagguguucuuucaugcugcagccuuugaagggggaagggacccaucccagucaccuugaaagagagucaaucaaaaaggaagcccggaggagugcaaauauacuuugaaugugaaacuauaguuauguuaauacccucucuaggguagacagauauaaaucugggaauggccucugccuggaccauuuccagcucguuuccugauaucacaguggauaauuccaaaaugguuuuccuugucccacucacgagaauguuuugguuauguugauaggucuuuauuauuggacuaaucgcggauaggaaauuucagcauuuuaauccuguuuuggagacuuacauuaagaaacacuucagugcaacauuagccuacacgugaguucucuuacguuauuucaaaccacugcuuuauucuccgauguuugcaaucauuuuccacugugacuuuggccuaugaccauacguuucuccacucaaaacucugaguuuacuggcauacuuuguauuguuauuguuuccuucuuaacagaccugaaaaucuuguugaaagagaugcaugauaaauuagccuuacauuuuggaauaaauccacguucuccuucacaccuuccauuuaucuuugaaaauuucugcuuauguucgaugaagcugauguauggaugcugcucccugucacaucgcagccccccaauaaacaacugaugaaugaauaaauggauguguuucuguuuugaggcuguuggguuuuucuuagugaacauaaaaugcaguuuuguauucucuagcuagccuccuugcuccuuaagguaugucuucucuuuucugaaacaaauuguagcuauuaagcuacuuagauuuuuuuuuucuucuguccauguaggacccuuguuucuagcccucucugaggauacagggaacuuauggggcuugggccgucaagacagg

SEQ ID NO: 11788 - RNA, 1054 nt, Mus musculus
ccugucuugacggcccaagccccauaaguucccuguauccucagagagggcuagaaacaaggguccuacauggacagaagaaaaaaaaaaucuaaguagcuuaauagcuacaauuuguuucagaaaagagaagacauaccuuaaggagcaaggaggcuagcuagagaauacaaaacugcauuuuauguucacuaagaaaaacccaacagccucaaaacagaaacacauccauuuauucauucaucaguuguuuauuggggggcugcgaugugacagggagcagcauccauacaucagcuucaucgaacauaagcagaaauuuucaaagauaaauggaaggugugaaggagaacguggauuuauuccaaaauguaaggcuaauuuaucaugcaucucuuucaacaagauuuucaggucuguuaagaaggaaacaauaacaauacaaaguaugccaguaaacucagaguuuugaguggagaaacguauggucauaggccaaagucacaguggaaaaugauugcaaacaucggagaauaaagcagugguuugaaauaacguaagagaacucacguguaggcuaauguugcacugaaguguuucuuaauguaagucuccaaaacaggauuaaaaugcugaaauuuccuauccgcgauuaguccaauaauaaagaccuaucaacauaaccaaaacauucucgugagugggacaaggaaaaccauuuuggaauuauccacugugauaucaggaaacgagcuggaaaugguccaggcagaggccauucccagauuuauaucugucuacccuagagaggguauuaacauaacuauaguuucacauucaaaguauauuugcacuccuccgggcuuccuuuuugauugacucucuuucaaggugacugggaugggucccuucccccuucaaaggcugcagcaugaaagaacaccucacccucugagaggaugaaagggaggccccuuaccagagcaucaaacaccaagguaucaaacgucucacucucugaguucuccaucaugauguugaagagggcauccaa

SEQ ID NO: 11789 - RNA, 36 nt, Mus musculus
ggugugauggguuacucucugugggaggagucagga

SEQ ID NO: 11790 - RNA, 36 nt, Mus musculus
uccugacuccucccacagagaguaacccaucacacc

SEQ ID NO: 11791 - RNA, 129 nt, Mus musculus
gaagagauaagggggcagggucauguuauccaccaaauuagauacagacaacuaugggcacacuuaaagucuguauaaauucugcacaucuucgauuguucaucccugagacuuugcuuaugagcuacu

SEQ ID NO: 11792 - RNA, 129 nt, Mus musculus
aguagcucauaagcaaagucucagggaugaacaaucgaagaugugcagaauuuauacagacuuuaagugugcccauaguugucuguaucuaauuugguggauaacaugacccugcccccuuaucucuuc

SEQ ID NO: 11793 - RNA, 317 nt, Mus musculus
aauucuaaucuggugaugcauuuuuaaucucuccucauggaguagaagacugcuacacuucuugggcaaggauauccaguaggaagaggguagcauugggccucaggcccaugggcauugucugcuuccacagugaugcuuugcuuaccugggaaagacaguggcuucucuuugguugguuuuagcuuuauugggacaaggcccugcuccaucaccaagcugacauggaucuuacucuguauuucuugaacuugugguaaucaccuaucucugccucccgaguacgucuauuauaagcaugaaccuucuuaccugcu

SEQ ID NO: 11794 - RNA, 317 nt, Mus musculus
agcagguaagaagguucaugcuuauaauagacguacucgggaggcagagauaggugauuaccacaaguucaagaaauacagaguaagauccaugucagcuuggugauggagcagggccuugucccaauaaagcuaaaaccaaccaaagagaagccacugucuuucccagguaagcaaagcaucacuguggaagcagacaaugcccaugggccugaggcccaaugcuacccucuuccuacuggauauccuugcccaagaaguguagcagucuucuacuccaugaggagagauuaaaaaugcaucaccagauuagaauu

SEQ ID NO: 11795 - RNA, 5231 nt, Mus musculus
uuauacacuuguuguguauaaaacucgguuuucugccgaguuauuucuuagcaagaaaaauaugcuguuuuaauuaucuccagaggugauuugaagccaugucacuuaaaguaaugaaaggcuguuuagaaauaaagguguuuaaauauacauaacugcaggagccaugccaggagcaaugugaagcaggaauugaaaguaggaauauguuauugaguucuuagaagagaaggaggcggacacucugcuuagccauagaccuauaaguggauaucauguaggaauccugcuguacacuuacacucuauauguugucuguugcuguccuuaauauguggucuaauauagcccaggcugguguuaaauccugauucuccugccucgccucccaugaguaugguuacacucuguuuugucuacuucuugguaagguuuuugcaugucccaaaugucacauuuucuaccaauuaacacuuuuuuauacuagaaaucugagcuagaaagguuagaacauuaucuauccuuacauuuccaaaauacagaaaauuacccauguaaaagagaagaggaauaggagguuguuuugugggcccagcagaauugcaaucaccguguucugauagcuuuucauaauuguccgcuuuacugguaaagagaaaaugagcaguuuuaguuuguuaaguaggauccuacacuuacccaucaaaguuguuggcauaggagguguccacaggggucccccaacaaaagcagggacagggacuuuaccuuuuacauggccccucacuugagagcucugacauuuuacccuagagcuuacuacccuccuuuuagcgccaagaagauucccacucgucuugguguguccccuuuacccagucuuccugccuaagacugcagcccucacaaugcccagugaucaucauguuuaacugggagacuuccauauguaccaauggcuuuucuuuuucagcgacaaaaaugcuggacgaaggcaacucgaggggggaggggaugauuuguuuuugcuccugaucuguggcucugugaccacagaggugaggaaggaccagaugucagcagaaugagguggcugcucacacugcauuccaccagggaggggcaggcagcuggggcaaagcuugcuggagaagcaggcuaaugguggaggcccacauuugagguacccucuucucaucagucagaguucucucagacacagaaagggguucuaaauccugaugaguaucaggcugggcaaacccucauacuccacagacguaaaggguugcuuaggaauaauuaguagaaguuacccuuuugaguaccagugguuggacguacagcuuaggaaaaacugaucacauccuuuauauccuuucccuugcuaacugacaggcauggagcuuguguuuaacucugauauccccggcaguuacuguguagcgugugcucaucccaagaugcuggaguuacccggauguugccuccuuccccucacacugaaugcuguggacuacagaaguauauaauaccagauggaggucgucaaauaaaaucgcauaaugcucuucccaucccagcccuacuuugugugauuucacaucuuugggcacgcugagccaugguccucuucucugcuauugugucgucacuuccugccucuccagacugagcauccuccccucuuggcacuguuggguaccggcucucaggcucuuggcguugugauuccauagcagcucuucugugggacugacccucuccucuuccacacccaucuccacccugagagguccccaucauguucccucuuagcucacaacucugcccaguauggcccugccacaccuuuaaaggacacuuauuagauguaggagcgaggaccauguagcacauuuccguaccucagcacagcacuuagccugcagcaagugcccaggaacauacugggcauaaauacauuggguccugagaccccaguuuaagguaaaguccucagguggucaccuuuggcucauuuagccuaccccacagcuuugggucuuauucuggauggcauacuugugugugguauccucuccagccaauccucacuugguuuuuggcgugccugcuccagagcauccauccugaaugccuucuuuucugauccuccauagugcaaauucccuugauaggugagccaccacugaggacuccugugacaacgccgucgaugcggauuguaguggcuaggucuggcauuguuuggccauaccaucuguacacaauguaucuguauacuaguguaccguguguuuccauuacaaaacuucucugugucacaagcucugucuggccaggcaggagacaaggcaagaugagagcugugucuccuuguguuaccccccauccccagauuaaaguaccuucaggaagaaagguguaauguuggcucauggguuaagguuauaguuaauacuggcagggaagucagugcaggaaccuacacaguuuuucacacuguaucugcagucaggaagcagagagaaaggaacucuggugcucaauuccuugucuucuuuuuauucagccugguaccccagccugugagcaggugcuaucuacaugggcguugggucuuuugucuuccauuaaaccucuccagagacauccccacaguuacaccugacguguuucuucuagguguuuccaaacccaaguuaacagcgaagauuaacuuuagccaucacacucuucuugccuucuuuuugaagcaauuucuaguagccucucccagcaacaucuggccacaauggaugauggaccaaacacuacacagucuauaucaaaauaacccacuauuuccauaccuggagugcuggagaaaaauucuucaaccuggugcaggauuaagcuucauugcagugagacugaccagacauuugacaaagcgauacaaacuugaaaacacuagggcugaggagauggcucagucaucagcaugcuugccucaugagucugagggcuugacuuuguaucccagcaucuacauaauaguuggcuguagcagccaaugggaagaccuuagagaaacagaugaauccuuggagcuaaucuuccagccauguuagcugaucaauagguuccaaguucagugagauacccugucucaaaaaauaaggugcaggguuggagcaagggcucagugagugaacggugaguggagggucucuaggucauauguaaagccaggccugguggcaugguaauccuaguacuuugaaaacacaacugaaggcagcaacaggaauucugggagcucacaggugagccagccagguauauccuaaucuugucuucuuuuaguaaguaucuaauagugaacucuuuguccaugggcuucauuuuuuuuuuuuuuugagaguacacaguuuuccauaauggcuguacuaauguauauucucccuacuggugugccggguuccucucuccuuccuuuagccugcguuccuccucuucccuccuuuaacuaauaagccaaccaaaccaauguaguccaucuuucucugcuuuugauuuguaucaucccauucacuagugagcagaacaucgucucccaccccugcaucucugccuacaugucugcucacacccuuuaccaagauauaaucaggccaguagggguuuuuguuugguuuuuuguuuguuuguuauuuuugguuuugaguugaguuucuuacacauuuuggauaguaacauuuauccaaaugaugccucuaaacauuucuugcuuaacaaaugguuucauuauggaaaugguucauuuugcagugcagccuguuaguuuaaugcaauucuauuuguuuguuuuugcuuggauucacugcccauagccauucuguguuuucuuuuaguauaguacauauguacacguguauucacacacacauaggcacacauuuuauguguauguuauacauauuuauuguauguaacacauauguuguauaccauauacacacauauccacaugccaaaaaaauuuggauuuuugagacagacacucuauugcuauguaggcuggaguggcccaguacuuacagugauccuccuguuuaucauuugaguuuuuuugaucagauuacacacaugugccauucagccagccaggguuuuuaauauacuucaaguugacuuuugccuuugguaugagggucuaauuuaauuuaccugugagucuccuauucccucaacgucacuguaaaauugccagcaccuuugccuucuagccaucuugaucaaaacuugcaugccaaacgaacuggaugguaaaaagcccauaagccucaacccuacacaaggaacuacaggcaacuguagaaagcugacaguaggagaaugcagcaauugguuguucagggccaacuggucaaccuugacaacauaugaacaaguaacauggauucacuaaguuacauuuaggauuagaaauguauauaaaaauacauguguguauacaauagcaauucaugaaaagagaggcugugcauuugaaggaaaguguggagcuaaauuggagaguuuagagggaggaaaggaaagagaggaaacauaauuagauuacaaucucaaaaacaaacagaaaaugucacuugaauggucuuccagaaucuauuccuugagggaugugcuugauuuugugccuugccaugcuguuuugauuacuguagcuuugcuuuguauuuugaacucuaguaguauguugccugccugccugccugccugccugccugccugccugccucccucccucccucccucccucccucccucccucccucccucccucccucccucccucucucucucucucuuucuuucuuucuuucuuucuuucuuucuuucuuucuucagacaggguuucucuguauaacccuggcugucauggaacucacuuuguagaccaggcuggccuugaacucagaaauccuccugccucugccucccaagugcugugauuaaagguaugccaugcugguuggccaguauauugccuuuaauauugcucauuuuguugaagauuucauugucaguucaagaucuuuugugguuuccuacagaugcuuaauuuucauugcuguuuguuuuucuuuuucugaugguuuuuuuuuuuuucugugacuacugcccuugugauuucauggucuugcauuuugacaagauuaauacuuuugggcuuuaagcau

SEQ ID NO: 11796 - RNA, 5231 nt, Mus musculus
augcuuaaagcccaaaaguauuaaucuugucaaaaugcaagaccaugaaaucacaagggcaguagucacagaaaaaaaaaaaaaccaucagaaaaagaaaaacaaacagcaaugaaaauuaagcaucuguaggaaaccacaaaagaucuugaacugacaaugaaaucuucaacaaaaugagcaauauuaaaggcaauauacuggccaaccagcauggcauaccuuuaaucacagcacuugggaggcagaggcaggaggauuucugaguucaaggccagccuggucuacaaagugaguuccaugacagccaggguuauacagagaaacccugucugaagaaagaaagaaagaaagaaagaaagaaagaaagaaagagagagagagagagggagggagggagggagggagggagggagggagggagggagggagggagggagggaggcaggcaggcaggcaggcaggcaggcaggcaggcaggcaacauacuacuagaguucaaaauacaaagcaaagcuacaguaaucaaaacagcauggcaaggcacaaaaucaagcacaucccucaaggaauagauucuggaagaccauucaagugacauuuucuguuuguuuuugagauuguaaucuaauuauguuuccucucuuuccuuuccucccucuaaacucuccaauuuagcuccacacuuuccuucaaaugcacagccucucuuuucaugaauugcuauuguauacacacauguauuuuuauauacauuucuaauccuaaauguaacuuagugaauccauguuacuuguucauauguugucaagguugaccaguuggcccugaacaaccaauugcugcauucuccuacugucagcuuucuacaguugccuguaguuccuuguguaggguugaggcuuaugggcuuuuuaccauccaguucguuuggcaugcaaguuuugaucaagauggcuagaaggcaaaggugcuggcaauuuuacagugacguugagggaauaggagacucacagguaaauuaaauuagacccucauaccaaaggcaaaagucaacuugaaguauauuaaaaacccuggcuggcugaauggcacauguguguaaucugaucaaaaaaacucaaaugauaaacaggaggaucacuguaaguacugggccacuccagccuacauagcaauagagugucugucucaaaaauccaaauuuuuuuggcauguggauauguguguauaugguauacaacauauguguuacauacaauaaauauguauaacauacacauaaaaugugugccuaugugugugugaauacacguguacauauguacuauacuaaaagaaaacacagaauggcuaugggcagugaauccaagcaaaaacaaacaaauagaauugcauuaaacuaacaggcugcacugcaaaaugaaccauuuccauaaugaaaccauuuguuaagcaagaaauguuuagaggcaucauuuggauaaauguuacuauccaaaauguguaagaaacucaacucaaaaccaaaaauaacaaacaaacaaaaaaccaaacaaaaaccccuacuggccugauuauaucuugguaaagggugugagcagacauguaggcagagaugcaggggugggagacgauguucugcucacuagugaaugggaugauacaaaucaaaagcagagaaagauggacuacauugguuugguuggcuuauuaguuaaaggagggaagaggaggaacgcaggcuaaaggaaggagagaggaacccggcacaccaguagggagaauauacauuaguacagccauuauggaaaacuguguacucucaaaaaaaaaaaaaaaugaagcccauggacaaagaguucacuauuagauacuuacuaaaagaagacaagauuaggauauaccuggcuggcucaccugugagcucccagaauuccuguugcugccuucaguuguguuuucaaaguacuaggauuaccaugccaccaggccuggcuuuacauaugaccuagagacccuccacucaccguucacucacugagcccuugcuccaacccugcaccuuauuuuuugagacaggguaucucacugaacuuggaaccuauugaucagcuaacauggcuggaagauuagcuccaaggauucaucuguuucucuaaggucuucccauuggcugcuacagccaacuauuauguagaugcugggauacaaagucaagcccucagacucaugaggcaagcaugcugaugacugagccaucuccucagcccuaguguuuucaaguuuguaucgcuuugucaaaugucuggucagucucacugcaaugaagcuuaauccugcaccagguugaagaauuuuucuccagcacuccagguauggaaauaguggguuauuuugauauagacuguguaguguuugguccaucauccauuguggccagauguugcugggagaggcuacuagaaauugcuucaaaaagaaggcaagaagagugugauggcuaaaguuaaucuucgcuguuaacuuggguuuggaaacaccuagaagaaacacgucagguguaacuguggggaugucucuggagagguuuaauggaagacaaaagacccaacgcccauguagauagcaccugcucacaggcugggguaccaggcugaauaaaaagaagacaaggaauugagcaccagaguuccuuucucucugcuuccugacugcagauacagugugaaaaacuguguagguuccugcacugacuucccugccaguauuaacuauaaccuuaacccaugagccaacauuacaccuuucuuccugaagguacuuuaaucuggggaugggggguaacacaaggagacacagcucucaucuugccuugucuccugccuggccagacagagcuugugacacagagaaguuuuguaauggaaacacacgguacacuaguauacagauacauuguguacagaugguauggccaaacaaugccagaccuagccacuacaauccgcaucgacggcguugucacaggaguccucagugguggcucaccuaucaagggaauuugcacuauggaggaucagaaaagaaggcauucaggauggaugcucuggagcaggcacgccaaaaaccaagugaggauuggcuggagaggauaccacacacaaguaugccauccagaauaagacccaaagcugugggguaggcuaaaugagccaaaggugaccaccugaggacuuuaccuuaaacuggggucucaggacccaauguauuuaugcccaguauguuccugggcacuugcugcaggcuaagugcugugcugagguacggaaaugugcuacaugguccucgcuccuacaucuaauaaguguccuuuaaagguguggcagggccauacugggcagaguugugagcuaagagggaacaugauggggaccucucaggguggagauggguguggaagaggagagggucagucccacagaagagcugcuauggaaucacaacgccaagagccugagagccgguacccaacagugccaagaggggaggaugcucagucuggagaggcaggaagugacgacacaauagcagagaagaggaccauggcucagcgugcccaaagaugugaaaucacacaaaguagggcugggaugggaagagcauuaugcgauuuuauuugacgaccuccaucugguauuauauacuucuguaguccacagcauucagugugaggggaaggaggcaacauccggguaacuccagcaucuugggaugagcacacgcuacacaguaacugccggggauaucagaguuaaacacaagcuccaugccugucaguuagcaagggaaaggauauaaaggaugugaucaguuuuuccuaagcuguacguccaaccacugguacucaaaaggguaacuucuacuaauuauuccuaagcaacccuuuacgucuguggaguaugaggguuugcccagccugauacucaucaggauuuagaaccccuuucugugucugagagaacucugacugaugagaagaggguaccucaaaugugggccuccaccauuagccugcuucuccagcaagcuuugccccagcugccugccccucccugguggaaugcagugugagcagccaccucauucugcugacaucugguccuuccucaccucuguggucacagagccacagaucaggagcaaaaacaaaucauccccuccccccucgaguugccuucguccagcauuuuugucgcugaaaaagaaaagccauugguacauauggaagucucccaguuaaacaugaugaucacugggcauugugagggcugcagucuuaggcaggaagacuggguaaaggggacacaccaagacgagugggaaucuucuuggcgcuaaaaggaggguaguaagcucuaggguaaaaugucagagcucucaagugaggggccauguaaaagguaaagucccugucccugcuuuuguugggggaccccuguggacaccuccuaugccaacaacuuugauggguaaguguaggauccuacuuaacaaacuaaaacugcucauuuucucuuuaccaguaaagcggacaauuaugaaaagcuaucagaacacggugauugcaauucugcugggcccacaaaacaaccuccuauuccucuucucuuuuacauggguaauuuucuguauuuuggaaauguaaggauagauaauguucuaaccuuucuagcucagauuucuaguauaaaaaaguguuaauugguagaaaaugugacauuugggacaugcaaaaaccuuaccaagaaguagacaaaacagaguguaaccauacucaugggaggcgaggcaggagaaucaggauuuaacaccagccugggcuauauuagaccacauauuaaggacagcaacagacaacauauagaguguaaguguacagcaggauuccuacaugauauccacuuauaggucuauggcuaagcagaguguccgccuccuucucuucuaagaacucaauaacauauuccuacuuucaauuccugcuucacauugcuccuggcauggcuccugcaguuauguauauuuaaacaccuuuauuucuaaacagccuuucauuacuuuaagugacauggcuucaaaucaccucuggagauaauuaaaacagcauauuuuucuugcuaagaaauaacucggcagaaaaccgaguuuuauacacaacaaguguauaa

SEQ ID NO: 11797 - RNA, 243 nt, Mus musculus
uaaggggcuguuuggcuacauuccugaagauguucucauucagauaaaagauuccaggcugggcauuuaugucuuuccgggacucacuuuaaggauaccacuguauucauggguuuuggccucuuuccccaccauuuccuuugcuuaguguggacuuuccgcauuaccuggaaaucaguucuugggugaaugagucuaugucacuucuucugcccucaggccugacccaagugugcuggaucu

SEQ ID NO: 11798 - RNA, 243 nt, Mus musculus
agauccagcacacuugggucaggccugagggcagaagaagugacauagacucauucacccaagaacugauuuccagguaaugcggaaaguccacacuaagcaaaggaaaugguggggaaagaggccaaaacccaugaauacagugguauccuuaaagugagucccggaaagacauaaaugcccagccuggaaucuuuuaucugaaugagaacaucuucaggaauguagccaaacagccccuua

SEQ ID NO: 11799 - RNA, 885 nt, Mus musculus
uucaugaucaugaaauaauaucauuuuacaacauaaagcauguauuuuuaauuauuuugcuuguguguuugagagagggguggagggguugggggacgccaccgagugcuuguggaggacagaaggcaacuccucaggugccaguucucucuuucuaccuucauguggauucuggguaccagagucaggcuggcagccuugugaagcugagccaucucaccagccccaauaaaaucuguauuuuuuuuuuuaauuuaagagaaugguguucugcuauuauuauuaaaguaucagaauagcauagcacaggcagcauguguaguaugaacguuuucuauuagauuuaguguucguuacgucucugcccucccuccuccacucuuccuuucuuucucuccauucuguuuuauagacaguacacuugcaugguuggugcuggccucuaaaucugacguucaggagcuucuggaaacccaggucuaggccccgcugucuucagugucugggccacacuguugagagugcagguuucugggggaacuucagacuguggggagccaguguucccccucugaugcagcggacccuuuagacccuuuuuaucugacuuguuugccaggacuucuuggagacucgacugcugcugauuccugccugcuguccaaaugcugucaggguguuaagaagaaaucucugaaagcuaaccucccgcugagcccacgugugcgccucacaaaagucaauauuuucagcuuucccucggccccaguguguuuaaagggcuuucuaguguacauccuuugauugugggugaguguucauaaggaaaauggcuuccaucuuuugucugcagagagugaaaaagaagcagagucgcucuaguuu

SEQ ID NO: 11800 - RNA, 885 nt, Mus musculus
aaacuagagcgacucugcuucuuuuucacucucugcagacaaaagauggaagccauuuuccuuaugaacacucacccacaaucaaaggauguacacuagaaagcccuuuaaacacacuggggccgagggaaagcugaaaauauugacuuuugugaggcgcacacgugggcucagcgggagguuagcuuucagagauuucuucuuaacacccugacagcauuuggacagcaggcaggaaucagcagcagucgagucuccaagaaguccuggcaaacaagucagauaaaaagggucuaaaggguccgcugcaucagagggggaacacuggcuccccacagucugaaguucccccagaaaccugcacucucaacaguguggcccagacacugaagacagcggggccuagaccuggguuuccagaagcuccugaacgucagauuuagaggccagcaccaaccaugcaaguguacugucuauaaaacagaauggagagaaagaaaggaagaguggaggagggagggcagagacguaacgaacacuaaaucuaauagaaaacguucauacuacacaugcugccugugcuaugcuauucugauacuuuaauaauaauagcagaacaccauucucuuaaauuaaaaaaaaaaauacagauuuuauuggggcuggugagauggcucagcuucacaaggcugccagccugacucugguacccagaauccacaugaagguagaaagagagaacuggcaccugaggaguugccuucuguccuccacaagcacucgguggcgucccccaaccccuccaccccucucucaaacacacaagcaaaauaauuaaaaauacaugcuuuauguuguaaaaugauauuauuucaugaucaugaa

SEQ ID NO: 11801 - RNA, 3788 nt, Mus musculus
guguaaguauuucacugugagaguccuugcucuguaugcuaacucuaacuccagccccgggcgacugacgcccucuucuggugcacaugugcacagacguacauggaagcagcauauucaguauuuggauuuuaaaaguaauucuuuuagaaggaaacaaaagaauuagagcuagagaguuguauucauaguucuuuucccuaaauacaagcacugucccauaauuaagaguauagcuguaaauucuaugcugagcaugguggugugcauggaaucccagcuaaaagaaaccagcaacaucccagcucgaaaaaagaaaggaaaagaaaagaaaaaaaaagaaaaaagaaaaaagaaaggcguggggguggggcguuacagcugugauuuguaagccugugaaaucuuuuauaucuuauauugaaggacagcagcuuccucugcagccucaggagacagucucaacccucaccguuugcuccuuuaucuaacucuguuggagacggaguuguuguuuggaugugugcaguguuaguggcuccucauccuuaaaagagaaacgucugagggagggagucggcagcagaggcggggaggucucugugaguuugacaccugucuugccugcauagcaaguuccaggucugccagagauggacaaaacagaaugacaggaaacagcaacaacaaaaacagagaaagaaaaaugccuguauuuagaaagguuguaccuuuggaagacuuuaaggcuauguuuguaucuaaaguuggaauuacuuuuacuuauuuauguguguaugugugcacuugcacacgugccacagcaugcauguagaucucaggggacugcuugugggagacagucucuuauuuauuuauuuauuuauuuauuuauuauuuucuuuauauacauuucaaaugcuaucccgaaaguucccuauacccucccuccgcccugcuccccuacccacucacuuccccuucuuggcccuggcauuccucuguacuggggcauauaaaguuugcaauacccaggggccucuguucccagugaugaccgacuaggccaucuucugcuacauaugcagcuagagacacgagcucuggggguauugguuaauucauaauguuguuccaccuauaggguugcagaucccuucagcuccuugagugcuuucucuagcuucuccauuggggacccugugauccaucuuauagaugacugugagcauccacuucuguauuugccaggcacuugcauagccucauacgagacagcuauaacagggucccuucagcaaaaucuuucuggcauauacaauagugggaaacaguuuuuuaacguggguccuggggaucaaacaagucagauguggcagggagcacccguauucacugagccaucuuagcagauugaagcuauuuuucuuucuuuuuuuucuuucuuucuuucuuuuuucuuuuucgacacaggguuucucuguguagcccuggcuguccuggaacucacuuuguagaccaggcuggccucgaacucagaaaucugccugccucugccucccaagugcugggauuaaaggcgugcgccaccggcagcuauuuuucaaaaagacuuuaauauguaucuuaguuuuaauagaucaugugcuacguuguuauucauaauaacaguacuaugugaaugauaaaaugaauaauuaauauauauuauuagaaauaguauuauauguuauuuugauuucuauagucaguagaaauagaucuguaaucaguuggagagucuuccaugagcaugccgguuccaaggccaguguauccugcuuaguaagaccuugggccaaaauaaaaagcuauaguggggugcgagccaugugugugguuuccugccuguuauccagcacucagaagaccaagcaagaagaucacugucagccaaaguuagcuugggcuauuucaggauagccugggcugcagagugagaaccugucucaaccacucucccauccccauaggcugguagagugguugucugguaugcacacuggccuaaguucaauauuuaauugaacgagaaaaucuuaauuagcuuggucauuuagaaucuuaucuuauaaauaagaguuuauuuuguucuuuaaaagauuuugaaugcuaagaaaugauuuuguaauuuaggaagaaaaaacuugaaccauuucuguucugccauauguuggccacauugaauaguccugggacccagauuaguggauuauuuuuccccauacugaccaucuuagacaccugcuaagcaaccuuuuuugucuauuuuuguuuugagacaaggccucucuucauagcccuggcuguccuggaacucacucuguagaccaggcuagcccugaaggcaagauaccuccuacuucugcuugccuuguaugggauuaaagguguaccacuucgucucuugauucauuucucucagugccagacccuucagguuuaagcuuguguguguaugugugugugugugugugugugugugugugugugugguuucauagcguaugguaggaaacgcagucugccuggacuccccugccuuuugccaccucccacugcugcuccaaccagcaucggcucccacaccccaggcacugcagagacuccagauaacuccuggacucgcuguuggugguugguuuguuucgguguucuuuugguuugguuuuggacgggauucuuccaauguaggccaggcuagcucuggguaacaggacuuaggugagcacuucauugaagcuuaccggguuguuuuuaaagccagcacaggugugcagacaaagggcuguauaguuucuauguccuucuuagguuucugcccucccaggccccuccuguuuccucaucugggaguuuuccacggccacaguugagaaggucuuaggaggcuuuggcacguacagacagucuauugguaauuuagguuucagccucucuuccccaggaguuuguccuucuagugaccagccagugccuagcagcccauuaagaguugugucaccagaguaaaagacagaucugcugucauccacuuaaaggcucugugccaggaacuaggucagagaccaaacaacaaauuaugcuuuuauucauaccaccuagagaauuagaagggauuuaggagggaaggucagagaccauguauauacuucuuccuuuuucagagaugacauuuauuuauuugucagugugcugcaugugugccacugugcacagaggucagaaaaaccugcagaaauggguucuguccuuccauggugugggucucuggggcaaguuucuuuaaccacugagcuaugucacuggcucaguauacuuuuuauuauauuguaauauuauacugaucaaagaaucuucuggaagagucagagucuggaaaguagaaauagaaacagaucucgagucaguagcaaucaggcaagucugugacugaggaaacugaagguuauuuuuugaguugaauuuaagucaaaucugaauuguuacaaaaacuauauaacaaccaccauucuacuugggucaggcagggguggcacaugccuucaaucccagcacucaggaggcagaggcaggcacaucucugaauuugaagucugccuggucuacagagcaaguuucaggacaggacagccagggguagucagaaaaacccugucuuagagggaacaaaagggaagaaagaaaaggacuuggacuagcuauuuaaaaaaacuacggugaggguugcaggacaggguguggcguuc

SEQ ID NO: 11802 - RNA, 3788 nt, Mus musculus
gaacgccacacccuguccugcaacccucaccguaguuuuuuuaaauagcuaguccaaguccuuuucuuucuucccuuuuguucccucuaagacaggguuuuucugacuaccccuggcuguccuguccugaaacuugcucuguagaccaggcagacuucaaauucagagaugugccugccucugccuccugagugcugggauugaaggcaugugccaccccugccugacccaaguagaauggugguuguuauauaguuuuuguaacaauucagauuugacuuaaauucaacucaaaaaauaaccuucaguuuccucagucacagacuugccugauugcuacugacucgagaucuguuucuauuucuacuuuccagacucugacucuuccagaagauucuuugaucaguauaauauuacaauauaauaaaaaguauacugagccagugacauagcucagugguuaaagaaacuugccccagagacccacaccauggaaggacagaacccauuucugcagguuuuucugaccucugugcacaguggcacacaugcagcacacugacaaauaaauaaaugucaucucugaaaaaggaagaaguauauacauggucucugaccuucccuccuaaaucccuucuaauucucuaggugguaugaauaaaagcauaauuuguuguuuggucucugaccuaguuccuggcacagagccuuuaaguggaugacagcagaucugucuuuuacucuggugacacaacucuuaaugggcugcuaggcacuggcuggucacuagaaggacaaacuccuggggaagagaggcugaaaccuaaauuaccaauagacugucuguacgugccaaagccuccuaagaccuucucaacuguggccguggaaaacucccagaugaggaaacaggaggggccugggagggcagaaaccuaagaaggacauagaaacuauacagcccuuugucugcacaccugugcuggcuuuaaaaacaacccgguaagcuucaaugaagugcucaccuaaguccuguuacccagagcuagccuggccuacauuggaagaaucccguccaaaaccaaaccaaaagaacaccgaaacaaaccaaccaccaacagcgaguccaggaguuaucuggagucucugcagugccuggggugugggagccgaugcugguuggagcagcagugggagguggcaaaaggcaggggaguccaggcagacugcguuuccuaccauacgcuaugaaaccacacacacacacacacacacacacacacacacacauacacacacaagcuuaaaccugaagggucuggcacugagagaaaugaaucaagagacgaagugguacaccuuuaaucccauacaaggcaagcagaaguaggagguaucuugccuucagggcuagccuggucuacagagugaguuccaggacagccagggcuaugaagagaggccuugucucaaaacaaaaauagacaaaaaagguugcuuagcaggugucuaagauggucaguauggggaaaaauaauccacuaaucugggucccaggacuauucaauguggccaacauauggcagaacagaaaugguucaaguuuuuucuuccuaaauuacaaaaucauuucuuagcauucaaaaucuuuuaaagaacaaaauaaacucuuauuuauaagauaagauucuaaaugaccaagcuaauuaagauuuucucguucaauuaaauauugaacuuaggccagugugcauaccagacaaccacucuaccagccuauggggaugggagagugguugagacagguucucacucugcagcccaggcuauccugaaauagcccaagcuaacuuuggcugacagugaucuucuugcuuggucuucugagugcuggauaacaggcaggaaaccacacacauggcucgcaccccacuauagcuuuuuauuuuggcccaaggucuuacuaagcaggauacacuggccuuggaaccggcaugcucauggaagacucuccaacugauuacagaucuauuucuacugacuauagaaaucaaaauaacauauaauacuauuucuaauaauauauauuaauuauucauuuuaucauucacauaguacuguuauuaugaauaacaacguagcacaugaucuauuaaaacuaagauacauauuaaagucuuuuugaaaaauagcugccgguggcgcacgccuuuaaucccagcacuugggaggcagaggcaggcagauuucugaguucgaggccagccuggucuacaaagugaguuccaggacagccagggcuacacagagaaacccugugucgaaaaagaaaaaagaaagaaagaaagaaaaaaaagaaagaaaaauagcuucaaucugcuaagauggcucagugaauacgggugcucccugccacaucugacuuguuugauccccaggacccacguuaaaaaacuguuucccacuauuguauaugccagaaagauuuugcugaagggacccuguuauagcugucucguaugaggcuaugcaagugccuggcaaauacagaaguggaugcucacagucaucuauaagauggaucacaggguccccaauggagaagcuagagaaagcacucaaggagcugaagggaucugcaacccuauagguggaacaacauuaugaauuaaccaauacccccagagcucgugucucuagcugcauauguagcagaagauggccuagucggucaucacugggaacagaggccccuggguauugcaaacuuuauaugccccaguacagaggaaugccagggccaagaaggggaagugaguggguaggggagcagggcggagggaggguauagggaacuuucgggauagcauuugaaauguauauaaagaaaauaauaaauaaauaaauaaauaaauaaauaagagacugucucccacaagcaguccccugagaucuacaugcaugcuguggcacgugugcaagugcacacauacacacauaaauaaguaaaaguaauuccaacuuuagauacaaacauagccuuaaagucuuccaaagguacaaccuuucuaaauacaggcauuuuucuuucucuguuuuuguuguugcuguuuccugucauucuguuuuguccaucucuggcagaccuggaacuugcuaugcaggcaagacaggugucaaacucacagagaccuccccgccucugcugccgacucccucccucagacguuucucuuuuaaggaugaggagccacuaacacugcacacauccaaacaacaacuccgucuccaacagaguuagauaaaggagcaaacggugaggguugagacugucuccugaggcugcagaggaagcugcuguccuucaauauaagauauaaaagauuucacaggcuuacaaaucacagcuguaacgccccacccccacgccuuucuuuuuucuuuuuucuuuuuuuuucuuuucuuuuccuuucuuuuuucgagcugggauguugcugguuucuuuuagcugggauuccaugcacaccaccaugcucagcauagaauuuacagcuauacucuuaauuaugggacagugcuuguauuuagggaaaagaacuaugaauacaacucucuagcucuaauucuuuuguuuccuucuaaaagaauuacuuuuaaaauccaaauacugaauaugcugcuuccauguacgucugugcacaugugcaccagaagagggcgucagucgcccggggcuggaguuagaguuagcauacagagcaaggacucucacagugaaauacuuacac

SEQ ID NO: 11803 - RNA, 2237 nt, Mus musculus
cuauuggguuugcuaggaaaaucaaaauacccgugagacuggcugaaauuaaugggcaggaggaguugguuugcucaguagcaguauacuugggugucacgucuggaacccugaauuuaauccucagcaccacaaaagaagagagggaaggaagaagaaauuaaagacugacuuauguuggaaacagucagcuuacucgcagcugucuggugacuuucagcucagccuggacugucuccagcacacugggcuaggcagauggcuugcuggguaaauguuugcugcacagucaugagagccugaguuggcuccccagcacugggaggugaaaacagacagauucugugaucucagaggccagccagucaagcacacaccaagaguuccagguuccuugagagacugucucaaaaaauccgauagagagguaaagacgcccuaugucagccuuuacuuguacaugcacguaagcgcccuucucaaacaaaguguauucauaccucagcuuaaaauaguuugugguagagcuagaaagauggcuuagcaguuaagagcaugugcucuugcaaagaaccuggguuauccucccagaagccacaugguggcuuacagucaucuguaacuuaaguuuugagggcgcugaugccuucaguagguacuaggcaugaacacagugcacauauucauucuuuuuuuaaaaggauaauuauggaagggaucugcaacccuauagguggaacagcauuaugaacuaaccaguacccccagagcucgugucucuagcugcauauguagcaaaagauggccuagucggccaucacugggaagagaggccccuugguauugcaaacuuuauaugccccaguacaggggaaugccagggccaagaagugggagaggguggguaggggagcagggcugggggaggguauaggggacuuuugggauagcauuugaaauguaaaugaaggagauaucuaauaaaaaaauauuuuuuuaaaaaaggaugauuaugugaaucagcaauuagucugaaaaaauuauguacuaaagcucaagaaaaccuagaaucucuuuagaaaaacauuacauugaauaaguagucucuaauguaccccaugguggcauggaggcugagguaggaucagaucacaaguuuacggccagccugggcucugccucucugaugaaagauuccagcacuaagggcguuuacugucgagaugguugcuucacagucauggugaguagcuuagugaguaacauacugaaaaccaggaagagagcuaagaacagccuuuucuucaucccaggguuaugcgggaaagguugggugauuauauaguuuuuagcagauaaccuuugacucaagugacuuaugcaacuugcguggcuucuaaucuccuggugagagcccuccaucugauaccacagugcugagcucugcaaccuuggaggccugugucaguuaacuugcagacugagacaucuguagauguuuuugaucagugucuuucuagaccaucucaucaaaagucauaaaaggaacuggagagaugguucaauaauugagugcuuacuacuguuuuagagaacacgaguuccauucccagcacccacauaggguucucauaacugacuauaacucuagcuccagaagaucugaacccugucuagccucugcagguacccuguauacacauaaauaaaaaauaaaaucuuuuaaaaagaaaugcaucacaggaacagaaaugagaauauagccugcugaauuggcacaccuguaaucccaguauucacuagcagggggcaguggguaugagggcagccugggcugcagagugaauucuaggacagcuuuugcugaauaaccaagagccugucugggcuuaguggggggaguccagccauacuucacuacauugucuguauaggcugucuuuguuacagaaauauaaauaauaccuauacauuuuaagggugagaggguaagugagguucguuuauaguucuacauacaaaguuggcucuuaaauauuuaugacauaaaaaguauaucaugcuguguuaaaugaaaacaaaauuuagucacuauuuucacuauggguuugguuuuguucuaagucauagauaugccuggucugaugacauagcuaagcaguagaaugcuucccugugugaccccuagcaccacagaacaaaagcaguuccuaggccugcaagagugugcaaggcug

SEQ ID NO: 11804 - RNA, 2237 nt, Mus musculus
cagccuugcacacucuugcaggccuaggaacugcuuuuguucuguggugcuaggggucacacagggaagcauucuacugcuuagcuaugucaucagaccaggcauaucuaugacuuagaacaaaaccaaacccauagugaaaauagugacuaaauuuuguuuucauuuaacacagcaugauauacuuuuuaugucauaaauauuuaagagccaacuuuguauguagaacuauaaacgaaccucacuuacccucucacccuuaaaauguauagguauuauuuauauuucuguaacaaagacagccuauacagacaauguagugaaguauggcuggacuccccccacuaagcccagacaggcucuugguuauucagcaaaagcuguccuagaauucacucugcagcccaggcugcccucauacccacugcccccugcuagugaauacugggauuacaggugugccaauucagcaggcuauauucucauuucuguuccugugaugcauuucuuuuuaaaagauuuuauuuuuuauuuauguguauacaggguaccugcagaggcuagacaggguucagaucuucuggagcuagaguuauagucaguuaugagaacccuaugugggugcugggaauggaacucguguucucuaaaacaguaguaagcacucaauuauugaaccaucucuccaguuccuuuuaugacuuuugaugagauggucuagaaagacacugaucaaaaacaucuacagaugucucagucugcaaguuaacugacacaggccuccaagguugcagagcucagcacugugguaucagauggagggcucucaccaggagauuagaagccacgcaaguugcauaagucacuugagucaaagguuaucugcuaaaaacuauauaaucacccaaccuuucccgcauaacccugggaugaagaaaaggcuguucuuagcucucuuccugguuuucaguauguuacucacuaagcuacucaccaugacugugaagcaaccaucucgacaguaaacgcccuuagugcuggaaucuuucaucagagaggcagagcccaggcuggccguaaacuugugaucugauccuaccucagccuccaugccaccaugggguacauuagagacuacuuauucaauguaauguuuuucuaaagagauucuagguuuucuugagcuuuaguacauaauuuuuucagacuaauugcugauucacauaaucauccuuuuuuaaaaaaauauuuuuuuauuagauaucuccuucauuuacauuucaaaugcuaucccaaaaguccccuauacccucccccagcccugcuccccuacccacccucucccacuucuuggcccuggcauuccccuguacuggggcauauaaaguuugcaauaccaaggggccucucuucccagugauggccgacuaggccaucuuuugcuacauaugcagcuagagacacgagcucuggggguacugguuaguucauaaugcuguuccaccuauaggguugcagaucccuuccauaauuauccuuuuaaaaaaagaaugaauaugugcacuguguucaugccuaguaccuacugaaggcaucagcgcccucaaaacuuaaguuacagaugacuguaagccaccauguggcuucugggaggauaacccagguucuuugcaagagcacaugcucuuaacugcuaagccaucuuucuagcucuaccacaaacuauuuuaagcugagguaugaauacacuuuguuugagaagggcgcuuacgugcauguacaaguaaaggcugacauagggcgucuuuaccucucuaucggauuuuuugagacagucucucaaggaaccuggaacucuuggugugugcuugacuggcuggccucugagaucacagaaucugucuguuuucaccucccagugcuggggagccaacucaggcucucaugacugugcagcaaacauuuacccagcaagccaucugccuagcccagugugcuggagacaguccaggcugagcugaaagucaccagacagcugcgaguaagcugacuguuuccaacauaagucagucuuuaauuucuucuuccuucccucucuucuuuuguggugcugaggauuaaauucaggguuccagacgugacacccaaguauacugcuacugagcaaaccaacuccuccugcccauuaauuucagccagucucacggguauuuugauuuuccuagcaaacccaauag

SEQ ID NO: 11805 - RNA, 902 nt, Mus musculus
ggcacuauuaggagguguggauuuguuggaguauguguggccuuauuagaggaagugugucacugugggggcaggcuuugaagucucuuuuacuuuaagcuccgcccaauguggaauucagucuccuccuggcuuucuuugcaucaagauguagaacucucagcuccuccagugccaugucugccugaacacugccaugcuuccugccuugaggauaaugaacuaaacuucugaacuguaagccagcccccaauuaaaugcuaguuuuauaagaguugcuguggucacagugucucuucacagcaauaaaacccuaacuaacgcccugugcuauggugugaguguggagaucagagcaugacuuuccggaguuuauucuuucuuucacaauguggguuauaggaauuaaacuugggucguuagccuuggcagcaagugccuuugcuugcugagccaucuugcuggccccaaauaaguauuaaagcuccuaggagaaccaacaagggcacaacaaauggcacuauaaaaaagcguuagggcauuuugacucuuguugaauuauuuugcagaugaacauuucaugacguagacuagaagguacuuugaaucacauggcuagguaaaccugauucaaaggcagugaucauuuaggugaucacauacgauucaaauuuuguaaaaacauucaggaaacauauuuuccuacuuucuaauagggacagaguuugcauuaaguucuugcauauuagaacuagagauugcugcuacucacuaaauuaagccuaaucuauuuguacacacacacacacacacacacacacacacacacacauuuguaaugugaguacaguuuaacaaccaggaugcccauuugccugcacagcagggaaacaucaauauau

SEQ ID NO: 11806 - RNA, 902 nt, Mus musculus
auauauugauguuucccugcugugcaggcaaaugggcauccugguuguuaaacuguacucacauuacaaauguguguguguguguguguguguguguguguguguguacaaauagauuaggcuuaauuuagugaguagcagcaaucucuaguucuaauaugcaagaacuuaaugcaaacucugucccuauuagaaaguaggaaaauauguuuccugaauguuuuuacaaaauuugaaucguaugugaucaccuaaaugaucacugccuuugaaucagguuuaccuagccaugugauucaaaguaccuucuagucuacgucaugaaauguucaucugcaaaauaauucaacaagagucaaaaugcccuaacgcuuuuuuauagugccauuuguugugcccuuguugguucuccuaggagcuuuaauacuuauuuggggccagcaagauggcucagcaagcaaaggcacuugcugccaaggcuaacgacccaaguuuaauuccuauaacccacauugugaaagaaagaauaaacuccggaaagucaugcucugaucuccacacucacaccauagcacagggcguuaguuaggguuuuauugcugugaagagacacugugaccacagcaacucuuauaaaacuagcauuuaauugggggcuggcuuacaguucagaaguuuaguucauuauccucaaggcaggaagcauggcaguguucaggcagacauggcacuggaggagcugagaguucuacaucuugaugcaaagaaagccaggaggagacugaauuccacauugggcggagcuuaaaguaaaagagacuucaaagccugcccccacagugacacacuuccucuaauaaggccacacauacuccaacaaauccacaccuccuaauagugcc

SEQ ID NO: 11807 - RNA, 1531 nt, Mus musculus
cacacacacacacacacacacacacacacacacacaaauaaacaauaaaaaacccaacaucaauaauaaaauagaacaauucuaacaauauagcauaaguuacuuuacauguaugaauuguuugucucuggaacuuccauuuaauauuuucagacagugugugaccuucaguaauuaaaaccacggaaacaauggauaagggagaaaacuguaauaaguuacauguuauuuauuuaaaaaauauugauuaaccuuuggcuuuugccacaggcuaugaccguugaagcacauagauuugugggggcuuuccuuggggagacugagaaaucuugcugagggaguaauuuugaagcuaaaucagaaaacucaguaagccaauguauuagucacuuuuuuacuagacacuauguugcucuagcuggccuggaacuaauuuuguagaccaggcugaccuugaacucacaaagauccacuugccucugucugagggguuagaggcaugccccaccacaccuggucuuaguuacuuuuuuguguuguuguugugaccaaaucccuggcaagaaucaagggaagaaagauuuguuuugacagacauuuggauacaaugucguauggauacacugaauuuagauacaauggauucuucauugaggccaaagggcaucgugguggaaaugacuguggcaacaauaggaguaagaggcugcucauucacaucuggaugcaucagcaagcauugaggggucaggcggcaaggcuggccuagaaaccccaaggucugcagauagcugacuuccuccugcuaagugcucccuccuaagcauuccaaagagcaaucuucuaagccucccaaaacugcccagggaacugguaacuaagugcucacauacaggagcuaguagcggagggcggagggcgcuuucucagacaguagcagcaaguggaagagcacauacaugaggcugagcgacaacagcuauugaagccuuggcguagacacucccugcccccgcccaagcaguuuggggugcaaagacagcacaggggcuggaagucaguuacugugacaucaguggguuuucagcagacggacagaaucuuaacugguguuuuuagagagaguguucuggcugcucugcccgggcaggcuugugggagguggagggcagucgggauggcugcuugguccagucuuuguagaaggaagcaauuguucuugagccacuggcuucacuuuccaugggcacagagucuuagcuguuccucccuggacaaugguuauauguacucugcuugguucucugaggucagugcagugagugcaguuuccagccuggcuggaacaaguaggacugaagguucauucagacuuccuucugcaaaugaggaaaaguugcaaaugagaaacagagcgcagcccuuccucagggugggccaucguggagccaaguacccgaaaggcugugggagugaggauuucaaucaugcucuaaaugaacggauacugggaaggacaauuuuaggggcu

SEQ ID NO: 11808 - RNA, 1531 nt, Mus musculus
agccccuaaaauuguccuucccaguauccguucauuuagagcaugauugaaauccucacucccacagccuuucggguacuuggcuccacgauggcccacccugaggaagggcugcgcucuguuucucauuugcaacuuuuccucauuugcagaaggaagucugaaugaaccuucaguccuacuuguuccagccaggcuggaaacugcacucacugcacugaccucagagaaccaagcagaguacauauaaccauuguccagggaggaacagcuaagacucugugcccauggaaagugaagccaguggcucaagaacaauugcuuccuucuacaaagacuggaccaagcagccaucccgacugcccuccaccucccacaagccugcccgggcagagcagccagaacacucucucuaaaaacaccaguuaagauucuguccgucugcugaaaacccacugaugucacaguaacugacuuccagccccugugcugucuuugcaccccaaacugcuugggcgggggcagggagugucuacgccaaggcuucaauagcuguugucgcucagccucauguaugugcucuuccacuugcugcuacugucugagaaagcgcccuccgcccuccgcuacuagcuccuguaugugagcacuuaguuaccaguucccugggcaguuuugggaggcuuagaagauugcucuuuggaaugcuuaggagggagcacuuagcaggaggaagucagcuaucugcagaccuugggguuucuaggccagccuugccgccugaccccucaaugcuugcugaugcauccagaugugaaugagcagccucuuacuccuauuguugccacagucauuuccaccacgaugcccuuuggccucaaugaagaauccauuguaucuaaauucaguguauccauacgacauuguauccaaaugucugucaaaacaaaucuuucuucccuugauucuugccagggauuuggucacaacaacaacacaaaaaaguaacuaagaccaggugugguggggcaugccucuaaccccucagacagaggcaaguggaucuuugugaguucaaggucagccuggucuacaaaauuaguuccaggccagcuagagcaacauagugucuaguaaaaaagugacuaauacauuggcuuacugaguuuucugauuuagcuucaaaauuacucccucagcaagauuucucagucuccccaaggaaagcccccacaaaucuaugugcuucaacggucauagccuguggcaaaagccaaagguuaaucaauauuuuuuaaauaaauaacauguaacuuauuacaguuuucucccuuauccauuguuuccgugguuuuaauuacugaaggucacacacugucugaaaauauuaaauggaaguuccagagacaaacaauucauacauguaaaguaacuuaugcuauauuguuagaauuguucuauuuuauuauugauguuggguuuuuuauuguuuauuugugugugugugugugugugugugugugugugugug

SEQ ID NO: 11809 - RNA, 1579 nt, Mus musculus
cugcuuaugauauauaaccuaaaguaagggagauuuucuuagacuauuuucuuccuuuuagcccauauguauauuuaccuuauaauuuauuuuuauauuagcuuuuagccugaagcacuuggcuggauaauaggaauuaaauuacuaaacaaugaauuacucuauuuuugaggauuauuuucuuauauuucuuuccucacagaacauacugugggagagguuauuaaauuagauucuaauggcucuccaagaaaagucugggggaaaaacccuacagauucugugcugaagauacuuggagaagcugaauuacagcuacagacagaacuacuagaaaacacaucuuuuaaaagugguaagcuuaaguaccaauauuauuaaaaauuaauguguuaagaugucuucauuuuauuguguggaauuauuuuccguucuggguggugguuguuauaaaggaaucuugaguuaugacuuagaccugagugaaaucuaaaugaggaaacuaaaugaaggaaaccuggaugagggagcuggaaaaaugcacgcaugucuuccaugagggaaaauguuggaauaauuuaagauuccugguguaucuuuaaaagagacuaaggaauuaaauugaguaaaagaaaugugugguaaguuuguguaucauuauucuuggacugggaagaauagcugucaugagacaauaggaggacauucuggacccaugaauuuuagguguuugagugucacagcagcacuuaaggaagagcagcugugugaugccuguucacagguagggaaugaauggaacugaauccagacauggacagggucuggacauguguguuuccuuuugcauucucuuuucucuguuguuccuugauguuuaggacaaaacucauaucuaaagcaugugaaaauuugacuuaggacauggggauauugacauguucuauaguggucagcgagauucugagaaauagacugaaaagagccugccgcauauguuacaaaagggcaaaagaagguuguucauucuugccaaaggugaauaucauagccauaagaaacagcccugaagguuagaaauggggauucugaaaguugggacuuuggagaggccauaauuuacaaggucucuaaagcauagcuuaagacuaagacagugagguugagaacugagaggucugcauauuggcaggauuacuuauuguguauauaaaaucaucuaccuaugacagaauugcuuuuagggagcagguacagcggcuacuaaaauguucagcagucacacaggaaugcugagagcagauagcugcaggcagcuguuguacaauaaaccaguucuuuccuggaaacagccaaaguguacagaauuuauaacaaauuagaaguauuaguugcuauuaugaaaaaaaaaaggugguuaauacuuuuuaaaguuugauucuaauacagguauuuuacccaaaaagaaaaagaaaaugaaaacuguguuaaacauccuagaggucguuauggaaucaaauuuggcuguacauuaucuuaacuuguuuuuaguuauuaguguauaauagagcuuuacuag

SEQ ID NO: 11810 - RNA, 1579 nt, Mus musculus
cuaguaaagcucuauuauacacuaauaacuaaaaacaaguuaagauaauguacagccaaauuugauuccauaacgaccucuaggauguuuaacacaguuuucauuuucuuuuucuuuuuggguaaaauaccuguauuagaaucaaacuuuaaaaaguauuaaccaccuuuuuuuuuucauaauagcaacuaauacuucuaauuuguuauaaauucuguacacuuuggcuguuuccaggaaagaacugguuuauuguacaacagcugccugcagcuaucugcucucagcauuccugugugacugcugaacauuuuaguagccgcuguaccugcucccuaaaagcaauucugucauagguagaugauuuuauauacacaauaaguaauccugccaauaugcagaccucucaguucucaaccucacugucuuagucuuaagcuaugcuuuagagaccuuguaaauuauggccucuccaaagucccaacuuucagaauccccauuucuaaccuucagggcuguuucuuauggcuaugauauucaccuuuggcaagaaugaacaaccuucuuuugcccuuuuguaacauaugcggcaggcucuuuucagucuauuucucagaaucucgcugaccacuauagaacaugucaauauccccauguccuaagucaaauuuucacaugcuuuagauaugaguuuuguccuaaacaucaaggaacaacagagaaaagagaaugcaaaaggaaacacacauguccagacccuguccaugucuggauucaguuccauucauucccuaccugugaacaggcaucacacagcugcucuuccuuaagugcugcugugacacucaaacaccuaaaauucauggguccagaauguccuccuauugucucaugacagcuauucuucccaguccaagaauaaugauacacaaacuuaccacacauuucuuuuacucaauuuaauuccuuagucucuuuuaaagauacaccaggaaucuuaaauuauuccaacauuuucccucauggaagacaugcgugcauuuuuccagcucccucauccagguuuccuucauuuaguuuccucauuuagauuucacucaggucuaagucauaacucaagauuccuuuauaacaaccaccacccagaacggaaaauaauuccacacaauaaaaugaagacaucuuaacacauuaauuuuuaauaauauugguacuuaagcuuaccacuuuuaaaagauguguuuucuaguaguucugucuguagcuguaauucagcuucuccaaguaucuucagcacagaaucuguaggguuuuucccccagacuuuucuuggagagccauuagaaucuaauuuaauaaccucucccacaguauguucugugaggaaagaaauauaagaaaauaauccucaaaaauagaguaauucauuguuuaguaauuuaauuccuauuauccagccaagugcuucaggcuaaaagcuaauauaaaaauaaauuauaagguaaauauacauaugggcuaaaaggaagaaaauagucuaagaaaaucucccuuacuuuagguuauauaucauaagcag

SEQ ID NO: 11811 - RNA, 2175 nt, Mus musculus
agccaugauccggcaagccccgacagucacuucccacggagcuaugaaugagucucgagauuccgucugcaugugcccguuuguaccgcucuguguaggccucgcugcauguccaccagggccugcguggggaggugccugccgcuucugaggauggaauggugcggcugggugccuaccaucugcccguucugggccgagcagggggugggggcggggagcggcggcuguggccguggaccccaccucgaggcugcugcacgcacaugcugcugacaucugccuucugcucuuucucuuuggguggacgugagagggagccuccgagaagaacucugaggcagggcaagaaccuggggaaggaacuccggaccccuggaccucaggucccacaggcaguguucaaaacaaaaacaaacaaauaauugggcuaaaaaugguggcagguccuggcgucccagcuacucaggaagccaaggcaggaggaagacuuugucuucaaaaaaagaaaggauggcaagguagggacagcagcguagaaagcccuggauucauuugcagcuccaugcaggggaaaugagagauucugcgcugacuucggugaucauagagggaguugccccaacuucagaguucuuccuggggcuuccugggucaggugaacuuggcuuacaagguacugguagagccuaagaaugacugucuucacccgggguuuccuauagagacuccugcggauggaccugccgguagcagaugacaacacaguucacuucaacuccacccugauggcucugauccgaaccgcccuugauaucaaaauugccaaggguaaggcaagccgccgaccugagggggugggguggggugggggaauagaugaugcuuuggagggggaagcagaagaccagaacccucccuggucgguugucauggggaccgcuguucuuaacuaguucuucauucuugcaucugggaaaagauuuagugcacagaucaggugugccagacaccccuccaaccaaagggaugagagguuuacacguacaaaaaaaaaaagaccacuccagucucugauguaggugguaccaugagguguguggacacagaagggaaaggacccccaggcugagagcagccugugugcaaaagcccugagaggugggaaugaacgcagcaaggagaaggaaucacacggggcccugcugagcugacccaugucacaccggaaugaugucuccuaguccauggagacaacccagugggaagagggacguuagggccugcguuagccuaacuuuuaauacugucaugaacuagcugggaccaggugcuuuaugaagaagagacaggauggcgagauggcccagugaguaaaagcacuugcauccaauucuggcuaaccuaugaccugaguucaguuguuaagagcuguuuucacccauccauguguacgauguggcauacacaaccugcccccaacacacacacacacuggaauaaauguaauuuuuaaaaaaucuccaagaguccugguugcucucaagagacucuauaaucaaauuuuucagccagacagcucagcuaaggucagagccuucuccucucuaggaucuguuaccuuucuuugagacagaauuuuguuuauguggagauuagaaaagagaguaaaaggagaggagagacucgugugggcagcugaggagaguuucacuccucaggcuccgucuucagagcacccucuaucccucucuuaucuacuuccugacauucccucccucuccuuuuuauuuuuuaaauuaauuaauuauuuuuuugauuuugggggacaggauuucucuguguagcccuggcugucuuggcacuugcucuguagaccaggcuggccucgaacucaaagaucugccugccccugcuucccaagugcugggaguggcaucugcccccucuuuuuaaagguugauaugaucucuaggacccuucgcgucuucugaaugagcgauuucaucauuucuugaugcuuuucgccuccagcuaagcgggcuaugcaguucucucaugguuuucaguucuguugcugguuuauuucagugcugacaaaagacuuuuagggauaggagcagcgcagugauggugcacaccuuuaguuccagcacuugggaagcagaggcaggc

SEQ ID NO: 11812 - RNA, 2175 nt, Mus musculus
gccugccucugcuucccaagugcuggaacuaaaggugugcaccaucacugcgcugcuccuaucccuaaaagucuuuugucagcacugaaauaaaccagcaacagaacugaaaaccaugagagaacugcauagcccgcuuagcuggaggcgaaaagcaucaagaaaugaugaaaucgcucauucagaagacgcgaaggguccuagagaucauaucaaccuuuaaaaagagggggcagaugccacucccagcacuugggaagcaggggcaggcagaucuuugaguucgaggccagccuggucuacagagcaagugccaagacagccagggcuacacagagaaauccugucccccaaaaucaaaaaaauaauuaauuaauuuaaaaaauaaaaaggagagggagggaaugucaggaaguagauaagagagggauagagggugcucugaagacggagccugaggagugaaacucuccucagcugcccacacgagucucuccucuccuuuuacucucuuuucuaaucuccacauaaacaaaauucugucucaaagaaagguaacagauccuagagaggagaaggcucugaccuuagcugagcugucuggcugaaaaauuugauuauagagucucuugagagcaaccaggacucuuggagauuuuuuaaaaauuacauuuauuccaguguguguguguguugggggcagguuguguaugccacaucguacacauggaugggugaaaacagcucuuaacaacugaacucaggucauagguuagccagaauuggaugcaagugcuuuuacucacugggccaucucgccauccugucucuucuucauaaagcaccuggucccagcuaguucaugacaguauuaaaaguuaggcuaacgcaggcccuaacgucccucuucccacuggguugucuccauggacuaggagacaucauuccggugugacaugggucagcucagcagggccccgugugauuccuucuccuugcugcguucauucccaccucucagggcuuuugcacacaggcugcucucagccuggggguccuuucccuucuguguccacacaccucaugguaccaccuacaucagagacuggaguggucuuuuuuuuuuuguacguguaaaccucucaucccuuugguuggaggggugucuggcacaccugaucugugcacuaaaucuuuucccagaugcaagaaugaagaacuaguuaagaacagcgguccccaugacaaccgaccagggaggguucuggucuucugcuucccccuccaaagcaucaucuauucccccaccccaccccacccccucaggucggcggcuugccuuacccuuggcaauuuugauaucaagggcgguucggaucagagccaucaggguggaguugaagugaacuguguugucaucugcuaccggcagguccauccgcaggagucucuauaggaaaccccgggugaagacagucauucuuaggcucuaccaguaccuuguaagccaaguucaccugacccaggaagccccaggaagaacucugaaguuggggcaacucccucuaugaucaccgaagucagcgcagaaucucucauuuccccugcauggagcugcaaaugaauccagggcuuucuacgcugcugucccuaccuugccauccuuucuuuuuuugaagacaaagucuuccuccugccuuggcuuccugaguagcugggacgccaggaccugccaccauuuuuagcccaauuauuuguuuguuuuuguuuugaacacugccugugggaccugagguccagggguccggaguuccuuccccagguucuugcccugccucagaguucuucucggaggcucccucucacguccacccaaagagaaagagcagaaggcagaugucagcagcaugugcgugcagcagccucgaggugggguccacggccacagccgccgcuccccgcccccacccccugcucggcccagaacgggcagaugguaggcacccagccgcaccauuccauccucagaagcggcaggcaccuccccacgcaggcccugguggacaugcagcgaggccuacacagagcgguacaaacgggcacaugcagacggaaucucgagacucauucauagcuccgugggaagugacugucggggcuugccggaucauggcu

SEQ ID NO: 11813 - RNA, 138 nt, Mus musculus
gggucacaacccauagguugagaaccacugugcuaagugcuaaagcaagauaguagguaguccauaggcugucauauuuaacaggggguuuuauuuguuugcuugcuuuuguuuuuugagauagugcuucacuaugua

SEQ ID NO: 11814 - RNA, 138 nt, Mus musculus
uacauagugaagcacuaucucaaaaaacaaaagcaagcaaacaaauaaaacccccuguuaaauaugacagccuauggacuaccuacuaucuugcuuuagcacuuagcacagugguucucaaccuauggguugugaccc

SEQ ID NO: 11815 - RNA, 1686 nt, Mus musculus
gcccucgggaagccagaucucucgcuuugcuggggcugcaccgagggagcccacccacccuccgcacuaaccuggccgccgcacacucgccuggcucugcugcgcgcggcuuccgggugugcgcggagacgcaggggcggugcccuagcagagucgccggguccgcccgcgcgucccgccuucuccgcccagggccucuccuuccugcccuagcuguccuccguggccaguccccugucuccggguaaagcccaccuaguccgcugagcagguaagauaacggacacccaaguuuagauggcaggacgaacugcccacuggacauagcaguuuggggguuuugaagccgaaagggcuucagagugagagccgccaaauuuaaguuaguuccugggguucaaucagagggcaucuccuggagaugagaauuuuuucuggcgcccccuaggaaaucugguuugaugaucuaaucucugcuagucuuuaacacagaaaauggggugcugugguuccaggacaagccuagcuuggaguauccgggaacucuaguguauacuugagguaaauuccacgagagaccauacaccuggaagacauggggaaaugaaacggcaagugugaaccuuuacaaaaaccuuacagcacuuugaagcaaaacuggcagcuucagagaaaacgcagauuccgaucccaccccucucguaaaagccaagcucuggggugugucugcaggguuccacccgagucuuuauuagcuagcaggaaccaaggcuccgcgagggucaggguccuaacuugaacaacagcuccucaagggugccagagcgguccggccccagacagagccacaagcuuuuuaccacaggucugucacagaaagcaugcaggaagucaguccguuacuaggggguggaggcaguguaaaggugacuccccuucugggacgcccaucacuuccugauuggccugugauuucagacaaaaagaaacaaacaaaaaauauucucuaagacuggugccugauuagccccaacagucaguuucuaguggacaggauuccucaacuugaaaccuauuucucauuuguucaacacacgagaaaguaguuugaagagccagugagggccaggcuuggugacacacaccuuuagucauagcuuucccaggcagaggcaggaggaucucugugaguucaaggccagccuggucuacauagggaguuccaggccagccaaggcuagacagugagacccuauuuuuuaaaaaagaaagaaaaaccaaaccacugaggcaggaguauucucaaguucaauaccagccagggccacacagcagagaugagaaaagagaaaaaaaagagaggguagauaggaaagugugugugugugugugugugcguguguguauguauguguguguguguaggcacaaccacuggaacuauaccuuuaagccuuuagggagauuuacuauucugagcagagacuucuguuuaaaaaaaaauuuauguauuuaauguaugugaauauacuguagcugucuucagacacaccagaagagggcaucagaucccauuacagaugguugugagccaccaugugguugcugggaauugaacucaggaccucugaaagagcagucagugcucuuaaccgcugagccaucucuccagcccugcauuuucuu

SEQ ID NO: 11816 - RNA, 1686 nt, Mus musculus
aagaaaaugcagggcuggagagauggcucagcgguuaagagcacugacugcucuuucagagguccugaguucaauucccagcaaccacaugguggcucacaaccaucuguaaugggaucugaugcccucuucuggugugucugaagacagcuacaguauauucacauacauuaaauacauaaauuuuuuuuuaaacagaagucucugcucagaauaguaaaucucccuaaaggcuuaaagguauaguuccagugguugugccuacacacacacacauacauacacacacgcacacacacacacacacacacuuuccuaucuacccucucuuuuuuuucucuuuucucaucucugcuguguggcccuggcugguauugaacuugagaauacuccugccucagugguuugguuuuucuuucuuuuuuaaaaaauagggucucacugucuagccuuggcuggccuggaacucccuauguagaccaggcuggccuugaacucacagagauccuccugccucugccugggaaagcuaugacuaaaggugugugucaccaagccuggcccucacuggcucuucaaacuacuuucucguguguugaacaaaugagaaauagguuucaaguugaggaauccuguccacuagaaacugacuguuggggcuaaucaggcaccagucuuagagaauauuuuuuguuuguuucuuuuugucugaaaucacaggccaaucaggaagugaugggcgucccagaaggggagucaccuuuacacugccuccacccccuaguaacggacugacuuccugcaugcuuucugugacagaccugugguaaaaagcuuguggcucugucuggggccggaccgcucuggcacccuugaggagcuguuguucaaguuaggacccugacccucgcggagccuugguuccugcuagcuaauaaagacucggguggaacccugcagacacaccccagagcuuggcuuuuacgagaggggugggaucggaaucugcguuuucucugaagcugccaguuuugcuucaaagugcuguaagguuuuuguaaagguucacacuugccguuucauuuccccaugucuuccagguguauggucucucguggaauuuaccucaaguauacacuagaguucccggauacuccaagcuaggcuuguccuggaaccacagcaccccauuuucuguguuaaagacuagcagagauuagaucaucaaaccagauuuccuagggggcgccagaaaaaauucucaucuccaggagaugcccucugauugaaccccaggaacuaacuuaaauuuggcggcucucacucugaagcccuuucggcuucaaaacccccaaacugcuauguccagugggcaguucguccugccaucuaaacuuggguguccguuaucuuaccugcucagcggacuaggugggcuuuacccggagacaggggacuggccacggaggacagcuagggcaggaaggagaggcccugggcggagaaggcgggacgcgcgggcggacccggcgacucugcuagggcaccgccccugcgucuccgcgcacacccggaagccgcgcgcagcagagccaggcgagugugcggcggccagguuagugcggagggugggugggcucccucggugcagccccagcaaagcgagagaucuggcuucccgagggc

SEQ ID NO: 11817 - RNA, 1641 nt, Mus musculus
cuucuggcacugaggugcgcgugccccgaagaugcucgugcuuccccucugccugaugaagccugggcgacgcugaguugccgccauccugggcuggagguggagcuggagcuggagccugugcuuccagaugaggccgugacgcgcauccugcaaccagcaguaccaguggcugugcugcgucucaaccucuccggugacacuguaggacccgugcgcuucgcaacgcgccacuacgcugaaacuuugcgcgcccucgaggugcgcgcguccgcauccccggaguugcacaccgcgcuggaggagcuggcggcgcgcugcgcgggcuugagagaaauacacugcuucugcguggugagacccucgguacuggacgccuuccgagcgcacuguccgcgccugcgcagcuauacgcucaagcuaaagcgugagccgcaucccuggcggcccacacuggugcggugauugggcaaucuagcccccccagggccgcgcgaaccccaagccucgggaaggccuaagcaaguugcgcaggcacgccccaguugcuagucucuuuaggggcuccguugacuaaggcgcuuuuggggaacugggggucuaugaaagcauccagaccaaucucaggcaccauaaauucagcgagcccucucaaccucugugucucugucuauucugggcccuccguccccucuguacacucgcacuagcucuagcucagguccagagcuggggggagggcaggcacaaguaggagccaagagucaagggugaguguaaaguaaauaaauccuuuaauauuccugcguccugugaucucgagucagcuguggggguggggggcaggaaauacacaaaggcuggaagggcagucaggcccgacauucaaggagaccucaagggccuuuguacugugacugugggggaucgggauccgggcacccuauaccucgggaaugaccaguuuccuagcguccucgcagaccgggcaaguccaacuucacccaccgcccuaucugcccgcccuuaccuaggcuucaauguguccacagaugaacuaggacuuuccgagcccaccagauguuuucucccaaaacaacagagaaagagaggcacucgagacucgaacgugggcucacccacccacacaccuacguuucagccagcccuuccucuccgccgguggcugggccgcuguccgagccccgccucuuggguucgcacgcggcccccgccugacccggcgcccaggggcggaguagggcggggcgggcggcaaacgcagcacuuucgcggcuuugacaagcccgcagcggccgggcuggaacgcugagcccggccggccgagacugcgccaugcaggaagcgccagcugcgcugcccacggagccaggccccagcccgguaccugccuuccucggcaagcuaugggcgcugguaggcgacccaggcaccgaccaccucauccgcuggagcccggugagggcuggggccccucaacuccuucagugguccccgggaucccuccaaugucgugaacaccccuguccacccagcccccgccugggccugggcugugaguaccucaauucagcuguccagaguggaucacgguggaaggggugugugaagcaaagaugg

SEQ ID NO: 11818 - RNA, 1641 nt, Mus musculus
ccaucuuugcuucacacaccccuuccaccgugauccacucuggacagcugaauugagguacucacagcccaggcccaggcgggggcuggguggacagggguguucacgacauuggagggaucccggggaccacugaaggaguugaggggccccagcccucaccgggcuccagcggaugagguggucggugccugggucgccuaccagcgcccauagcuugccgaggaaggcagguaccgggcuggggccuggcuccgugggcagcgcagcuggcgcuuccugcauggcgcagucucggccggccgggcucagcguuccagcccggccgcugcgggcuugucaaagccgcgaaagugcugcguuugccgcccgccccgcccuacuccgccccugggcgccgggucaggcgggggccgcgugcgaacccaagaggcggggcucggacagcggcccagccaccggcggagaggaagggcuggcugaaacguaggugugugggugggugagcccacguucgagucucgagugccucucuuucucuguuguuuugggagaaaacaucuggugggcucggaaaguccuaguucaucuguggacacauugaagccuagguaagggcgggcagauagggcggugggugaaguuggacuugcccggucugcgaggacgcuaggaaacuggucauucccgagguauagggugcccggaucccgaucccccacagucacaguacaaaggcccuugaggucuccuugaaugucgggccugacugcccuuccagccuuuguguauuuccugccccccacccccacagcugacucgagaucacaggacgcaggaauauuaaaggauuuauuuacuuuacacucacccuugacucuuggcuccuacuugugccugcccuccccccagcucuggaccugagcuagagcuagugcgaguguacagaggggacggagggcccagaauagacagagacacagagguugagagggcucgcugaauuuauggugccugagauuggucuggaugcuuucauagacccccaguuccccaaaagcgccuuagucaacggagccccuaaagagacuagcaacuggggcgugccugcgcaacuugcuuaggccuucccgaggcuugggguucgcgcggcccugggggggcuagauugcccaaucaccgcaccagugugggccgccagggaugcggcucacgcuuuagcuugagcguauagcugcgcaggcgcggacagugcgcucggaaggcguccaguaccgagggucucaccacgcagaagcaguguauuucucucaagcccgcgcagcgcgccgccagcuccuccagcgcggugugcaacuccggggaugcggacgcgcgcaccucgagggcgcgcaaaguuucagcguaguggcgcguugcgaagcgcacggguccuacagugucaccggagagguugagacgcagcacagccacugguacugcugguugcaggaugcgcgucacggccucaucuggaagcacaggcuccagcuccagcuccaccuccagcccaggauggcggcaacucagcgucgcccaggcuucaucaggcagaggggaagcacgagcaucuucggggcacgcgcaccucagugccagaag

SEQ ID NO: 11819 - RNA, 517 nt, Mus musculus
cccacaucaaagccaggcaggcagcccgggaagaggggacuggaagaccccagggccgcugagcagcccacccagcugaauccacaagcuccacagucagugagagauuugucucagaacaagacugcaaugauugaaaaagacauccaacacugaccucuggccuccacacucacguacacacacacacacacacacacacacacacacacacacacacgaaugcacacaaacacgcaauacacauuuuucuuaguuugaaaacacaaaauaacccauuaaaaccuuaccuagugaaagagaagaaaaguuuaaccgcagagcagaagagaagacuuggcaguuaacaguacuugcuucucuuccgggacccagguuccgcucuuagcacacacacacacacacacacacacacacacacacacacacacucacacacacacacacacacacacacacacucacacacacacucacacacacacacacacacacacacacucacacacacacacac

SEQ ID NO: 11820 - RNA, 517 nt, Mus musculus
gugugugugugugugagugugugugugugugugugugugugugagugugugugugagugugugugugugugugugugugugugugagugugugugugugugugugugugugugugugugugugugugugcuaagagcggaaccugggucccggaagagaagcaaguacuguuaacugccaagucuucucuucugcucugcgguuaaacuuuucuucucuuucacuagguaagguuuuaauggguuauuuuguguuuucaaacuaagaaaaauguguauugcguguuugugugcauucguguguguguguguguguguguguguguguguguguguguguacgugaguguggaggccagaggucaguguuggaugucuuuuucaaucauugcagucuuguucugagacaaaucucucacugacuguggagcuuguggauucagcugggugggcugcucagcggcccuggggucuuccaguccccucuucccgggcugccugccuggcuuugauguggg

SEQ ID NO: 11821 - RNA, 543 nt, Mus musculus
ugaagggaacgugguagaugagugggcugcuuacugccuugaagggcugauuaggguucaggagugugcuuugaagauuuucuuucuuuagaugcauuuauuuuuauguguguggauguuuuugcccauauguaugcaugagccucgugcccauggagguuuucagagucucuggaaccgaaauuaucagucagaagucaugagcugccacgugggcaguagaaguugaacccagguccugugcaaaagcaacaaaaaaaagagcuauuuugcauguaugucugcaugacagaauagagcaucagauaccauuauaguuaguugugagccaccaugugguugcugggaauugaacucaggaccucuggaagagcagucagugcucuuaaccgcugagccaucucuccagcccccauuaaaucauauuuuuauuauacuaccauuuucuuuuuuuuuuuuuaaagauuuguuuauuuuuuauuuaugaguacacugcagcugucuucagacacacacuagaagagugcagaggaucccauuaca

SEQ ID NO: 11822 - RNA, 543 nt, Mus musculus
uguaaugggauccucugcacucuucuagugugugucugaagacagcugcaguguacucauaaauaaaaaauaaacaaaucuuuaaaaaaaaaaaaagaaaaugguaguauaauaaaaauaugauuuaaugggggcuggagagauggcucagcgguuaagagcacugacugcucuuccagagguccugaguucaauucccagcaaccacaugguggcucacaacuaacuauaaugguaucugaugcucuauucugucaugcagacauacaugcaaaauagcucuuuuuuuuguugcuuuugcacaggaccuggguucaacuucuacugcccacguggcagcucaugacuucugacugauaauuucgguuccagagacucugaaaaccuccaugggcacgaggcucaugcauacauaugggcaaaaacauccacacacauaaaaauaaaugcaucuaaagaaagaaaaucuucaaagcacacuccugaacccuaaucagcccuucaaggcaguaagcagcccacucaucuaccacguucccuuca

SEQ ID NO: 11823 - RNA, 25 nt, Mus musculus
ucucuauguagucuuggcuguacca

SEQ ID NO: 11824 - RNA, 25 nt, Mus musculus
ugguacagccaagacuacauagaga

SEQ ID NO: 11825 - RNA, 147 nt, Mus musculus
gcaagacguuguauauguugguguaauggcucacugaaauaccucaugaaaauagaucucauggcagggggaugugcugugugcgucuugaugggauucacugaugcacaggaaccagugggaagggaggagucaggauggaguugc

SEQ ID NO: 11826 - RNA, 147 nt, Mus musculus
gcaacuccauccugacuccucccuucccacugguuccugugcaucagugaaucccaucaagacgcacacagcacaucccccugccaugagaucuauuuucaugagguauuucagugagccauuacaccaacauauacaacgucuugc

SEQ ID NO: 11827 - RNA, 87 nt, Mus musculus
accauguccugguaugaauuauuugcaagaaaagcacucuggcagacuuuuucaagugacaccaaauaaggaaccaagugaaaaguc

SEQ ID NO: 11828 - RNA, 87 nt, Mus musculus
gacuuuucacuugguuccuuauuuggugucacuugaaaaagucugccagagugcuuuucuugcaaauaauucauaccaggacauggu

SEQ ID NO: 11829 - RNA, 131 nt, Mus musculus
uaccugucacaguuucacauucuucucucuuauccacaucccaauugcaguguccgccuugaccuaucuccugcccccccugccuacccuccaaaagaacaggccuaggaacaucaggcuuacgcggcaua

SEQ ID NO: 11830 - RNA, 131 nt, Mus musculus
uaugccgcguaagccugauguuccuaggccuguucuuuuggaggguaggcagggggggcaggagauaggucaaggcggacacugcaauugggauguggauaagagagaagaaugugaaacugugacaggua

SEQ ID NO: 11831 - RNA, 343 nt, Mus musculus
ucgugaccucugugaggccccgugaggcccagucaguugauucugugggccuuguucuccuaguguauccccagccccuuuggcuccuccaggcuuuccuccugccccugaaggacucccaagcucugcucaguguuuggcuguggggcucugcaucugcucccaucaguuguggggcaaagucucuuggucuuuuuaaugacaauucuguuaagcacuggccccagagucugcaggcaggacaaacuguaggucaaagguuuuauggcuggguuggugucccgaucacuccacuccuggccuugucugguuauauaagauggccgguucacgauccauguuc

SEQ ID NO: 11832 - RNA, 343 nt, Mus musculus
gaacauggaucgugaaccggccaucuuauauaaccagacaaggccaggaguggagugaucgggacaccaacccagccauaaaaccuuugaccuacaguuuguccugccugcagacucuggggccagugcuuaacagaauugucauuaaaaagaccaagagacuuugccccacaacugaugggagcagaugcagagccccacagccaaacacugagcagagcuugggaguccuucaggggcaggaggaaagccuggaggagccaaaggggcuggggauacacuaggagaacaaggcccacagaaucaacugacugggccucacggggccucacagaggucacga

SEQ ID NO: 11833 - RNA, 16 nt, Mus musculus
acccacaccacuaguc

SEQ ID NO: 11834 - RNA, 16 nt, Mus musculus
gacuaguggugugggu

SEQ ID NO: 11835 - RNA, 193 nt, Mus musculus
uauuuucauuuuguucauuugagauaaggucgcauguaaaccaagauggccucugacucacuguggagcugaggauguccuugaacuucuaaucuucccgccccgacuucccaaguucuaagguuauuaggcccaugguaccacuccuugcuuggcaaacagcauuuuaaguccugagugguagggggugcua

SEQ ID NO: 11836 - RNA, 193 nt, Mus musculus
uagcacccccuaccacucaggacuuaaaaugcuguuugccaagcaaggagugguaccaugggccuaauaaccuuagaacuugggaagucggggcgggaagauuagaaguucaaggacauccucagcuccacagugagucagaggccaucuugguuuacaugcgaccuuaucucaaaugaacaaaaugaaaaua

SEQ ID NO: 11837 - RNA, 93 nt, Mus musculus
cguauggcguggaggcugaugaaccccggaucacgugcacacacacacacacacacacacacacacacacacacacacggccuacagcagcac

SEQ ID NO: 11838 - RNA, 93 nt, Mus musculus
gugcugcuguaggccgugugugugugugugugugugugugugugugugugugugugcacgugauccgggguucaucagccuccacgccauacg

SEQ ID NO: 11839 - RNA, 171 nt, Mus musculus
guuucaucugaauucuuuccccagggguaacaaggagcccagagcaagauuccaguaucuagaguuauuguucaaaaccacagcucaguuccccaaaucucucagcgcuguuuuccucucccccauucugguccaggcucaguccuuccaccucuccccacaagguacuca

SEQ ID NO: 11840 - RNA, 171 nt, Mus musculus
ugaguaccuuguggggagagguggaaggacugagccuggaccagaaugggggagaggaaaacagcgcugagagauuuggggaacugagcugugguuuugaacaauaacucuagauacuggaaucuugcucugggcuccuuguuaccccuggggaaagaauucagaugaaac

SEQ ID NO: 11841 - RNA, 119 nt, Mus musculus
cagcaaagccacagaguucuaauuuguuuguuuguuguuguuguuuugagacaugguuucucuguguugcccucacuguccuggaacucacucuguagaacaggcuggccuugaacuca

SEQ ID NO: 11842 - RNA, 119 nt, Mus musculus
ugaguucaaggccagccuguucuacagagugaguuccaggacagugagggcaacacagagaaaccaugucucaaaacaacaacaacaaacaaacaaauuagaacucuguggcuuugcug

SEQ ID NO: 11843 - RNA, 1271 nt, Mus musculus
ccauacaccucuaaauagccaugcacuuguagguaaccccgaugagcuuagcaguucacugaggcggaccugaauggaauugaggcagaauagaaagacagggacuucaaggacccugggaacagaaaaaagcccucacccugaccuuucuugcucgcugagaguuaagaaaccagcaagauugauaaaggcaguauugccuccagagacaguguguuuuccucaagacaacacaaacaggauguuaaaaacaggaaauaaauugugcacacucacggucagauuguuugugcggaucuagcuuagcuaaauaauaaaagcaccuuacucagcaagagacccugucuugaaaaaucccccaucccuugaggaccucuggccuuggaguacccaggcagacauacaaaugcacacacacacacauacacacacacacaagaauaaaauauaagcuugacuuggagauggcuggagagguggcucuguaauuaauagcacuugcugcuuuugcagaggacccauguaugguucccaauacucacacaauagcucacaacuaucugagcuacaguuccaggggacaugaugcccuccucugaccuuggaggcgcaugcugcacauucauacauacauacauacauacaugugugcaaaacacucauauacauaaaauuaaaaaaauuuuuuuaaguuaccagcucauguauuuuacuuaacauuaacuuauguaauuaguuauuuugaggcaggaucucauauagcccggguuagccucagacuuaccaugaagccugggguuccauccccuguacugaauaaccuugguaguggucaugauaacucaugcuuguaguuucaacgcuuggaaagugaaggugggaagaucagaaguucaaggccauccuccuuuacaaaauguuaagcuuugauuacucuugaaagcuuauaaacugcaucuuuugaagaaugugacuuaacaggcuguagguugcuaugugcggccauugugaagacagcuaaguacgacuuccuggaaaaagcccacacacccaucaugagacuguauuauccuucuccucugugacugucuccauacuuaauaaagucacuagcuuugcuucuguucgguucauccugaauuccuuccuacagccaagucuacgauccuucuguugagaucccggagcaggaagggaauuccucaggcugcugccagcuguugggcuguaucccacaaccgcucacacgaaacgaugucuuuggucuuucg

SEQ ID NO: 11844 - RNA, 1271 nt, Mus musculus
cgaaagaccaaagacaucguuucgugugagcgguugugggauacagcccaacagcuggcagcagccugaggaauucccuuccugcuccgggaucucaacagaaggaucguagacuuggcuguaggaaggaauucaggaugaaccgaacagaagcaaagcuagugacuuuauuaaguauggagacagucacagaggagaaggauaauacagucucaugaugggugugugggcuuuuuccaggaagucguacuuagcugucuucacaauggccgcacauagcaaccuacagccuguuaagucacauucuucaaaagaugcaguuuauaagcuuucaagaguaaucaaagcuuaacauuuuguaaaggaggauggccuugaacuucugaucuucccaccuucacuuuccaagcguugaaacuacaagcaugaguuaucaugaccacuaccaagguuauucaguacaggggauggaaccccaggcuucaugguaagucugaggcuaacccgggcuauaugagauccugccucaaaauaacuaauuacauaaguuaauguuaaguaaaauacaugagcugguaacuuaaaaaaauuuuuuuaauuuuauguauaugaguguuuugcacacauguauguauguauguauguaugaaugugcagcaugcgccuccaaggucagaggagggcaucauguccccuggaacuguagcucagauaguugugagcuauugugugaguauugggaaccauacauggguccucugcaaaagcagcaagugcuauuaauuacagagccaccucuccagccaucuccaagucaagcuuauauuuuauucuuguguguguguguaugugugugugugugcauuuguaugucugccuggguacuccaaggccagagguccucaagggaugggggauuuuucaagacagggucucuugcugaguaaggugcuuuuauuauuuagcuaagcuagauccgcacaaacaaucugaccgugagugugcacaauuuauuuccuguuuuuaacauccuguuuguguugucuugaggaaaacacacugucucuggaggcaauacugccuuuaucaaucuugcugguuucuuaacucucagcgagcaagaaaggucagggugagggcuuuuuucuguucccaggguccuugaagucccugucuuucuauucugccucaauuccauucagguccgccucagugaacugcuaagcucaucgggguuaccuacaagugcauggcuauuuagagguguaugg

SEQ ID NO: 11845 - RNA, 564 nt, Mus musculus
uagccaccugcauggggacacucaggcuccacggcucacacuucagagugcuggagagacccuuuacugucuggcugggucagcaaaacagugcucgggccaugggagaaguccuaggcucacccugauaccaccugacccauggcugagcaggcaccagaaucucuucccuaaagggccaaaugugacggccggagcugcugccucaguacaaugggcaggagguagaaacucauggggcuggugcugcccacacucucccaccaagucucccaggccuccuggggcaggguagagcaaguggcugguggcuucacugguuccaggaagcaugacuggucccccagggugcaucuauccuuggcccacugauuggacgaaggccugagccugggugggcuuagaugaccugucuggaggugauccuagcuccaucugaaucgagucagucagcacacgcagggauucccugauggacccaggacucccgacaucaguaguacuuccuuacuccuuaaagucuggguguuucagguuccccacucaagucucucagguagagcc

SEQ ID NO: 11846 - RNA, 564 nt, Mus musculus
ggcucuaccugagagacuugaguggggaaccugaaacacccagacuuuaaggaguaaggaaguacuacugaugucgggaguccuggguccaucagggaaucccugcgugugcugacugacucgauucagauggagcuaggaucaccuccagacaggucaucuaagcccacccaggcucaggccuucguccaaucagugggccaaggauagaugcacccugggggaccagucaugcuuccuggaaccagugaagccaccagccacuugcucuacccugccccaggaggccugggagacuuggugggagagugugggcagcaccagccccaugaguuucuaccuccugcccauuguacugaggcagcagcuccggccgucacauuuggcccuuuagggaagagauucuggugccugcucagccaugggucaggugguaucagggugagccuaggacuucucccauggcccgagcacuguuuugcugacccagccagacaguaaagggucucuccagcacucugaagugugagccguggagccugaguguccccaugcagguggcua

SEQ ID NO: 11847 - RNA, 255 nt, Mus musculus
uucauucgggauggaggccaagucauuucccaauccagucuuaacuaggugaaggaaacuuguggagagacaaacacagaggacuccagaagacucaaccacguaaaccagaccucugcccuaaaaccugacucucagugcuuccucggggucuuuccuaaggcauggaagccagggaacacuauguuccccagaagugcccucgagaaagaacagggcacucacuccaugaacacugaaacucuccucagagug

SEQ ID NO: 11848 - RNA, 255 nt, Mus musculus
cacucugaggagaguuucaguguucauggagugagugcccuguucuuucucgagggcacuucuggggaacauaguguucccuggcuuccaugccuuaggaaagaccccgaggaagcacugagagucagguuuuagggcagaggucugguuuacgugguugagucuucuggaguccucuguguuugucucuccacaaguuuccuucaccuaguuaagacuggauugggaaaugacuuggccuccaucccgaaugaa

SEQ ID NO: 11849 - RNA, 1185 nt, Mus musculus
ucuguugcccucuucuggugugucugaagacagcuacaguguacuuauauauaauaaaaaauaaaucauuuaaaaaagagagagaaagaaagaggggaagagagggaagaaagaaagagagagagaaagaaaaggagaaagacagaaagaaagagauagaaaaggucuugcauuguaauccagguuggccuugaacuggugauccucuuaccucagacaccuggguggugcugggauaacaagucagacuuugaaaaucuacuuaaagaagcuaggcacuuuuuaaacuaaugguguagucuguaauccuagcacuagccaggagaauaguaacacacacuaccauucucagcuacauagucaaggucugagcuacguuagacccuguguguggggugggggauccacuuguuguuuuguucuuuuuuaagugaguaaggucauuugcuaacaucugagaaccuaaguuugagcccuggaaccucucugauuaaaaaaaggcuuuuucuuauacaaaucuugaggcaaaucuugcaggcuuuuucucccucuuucucaaaauuaacauauaaauguucaugggcaaauuuacucggucaucuuuuucagaggaacaaaauaacuacuuugaaaaaaacuacuuuguaaaauauuuccaaagcugcuuuuucuuauugaaagcagcuccuucccuguuugugacagaguuuaggcagcgugcaggucuuuauaucagcuuguaagagcugcucauaagacucuaaguuaaauccccaauuguaacuggcuaucuuacuuuaauaaaagucuuuggaaagacuacagaacaguuuuaccaaagaacaauuuguaucugauuaaauagccaaaauacuccuaaaagaccuuauuuacaggaaacaaaacccaacagcaaagggcagucauugaagugcuuggcucacauuuuuuuaccuuccaggcaagggcagguuguaucccaaaagggaucugcaaucuucaguaucucaaagauccagugcauggcaacuagagaaucugucagaguccugucacacagaccagcuggagugagccguucacuucacugcuccugugcaccaacggagaucacaccacagugcuuuuuagaguuuugguuuuugguaagaugauacuuuuaggaguuagcagaggauuuaagcc

SEQ ID NO: 11850 - RNA, 1185 nt, Mus musculus
ggcuuaaauccucugcuaacuccuaaaaguaucaucuuaccaaaaaccaaaacucuaaaaagcacuguggugugaucuccguuggugcacaggagcagugaagugaacggcucacuccagcuggucugugugacaggacucugacagauucucuaguugccaugcacuggaucuuugagauacugaagauugcagaucccuuuugggauacaaccugcccuugccuggaagguaaaaaaaugugagccaagcacuucaaugacugcccuuugcuguuggguuuuguuuccuguaaauaaggucuuuuaggaguauuuuggcuauuuaaucagauacaaauuguucuuugguaaaacuguucuguagucuuuccaaagacuuuuauuaaaguaagauagccaguuacaauuggggauuuaacuuagagucuuaugagcagcucuuacaagcugauauaaagaccugcacgcugccuaaacucugucacaaacagggaaggagcugcuuucaauaagaaaaagcagcuuuggaaauauuuuacaaaguaguuuuuuucaaaguaguuauuuuguuccucugaaaaagaugaccgaguaaauuugcccaugaacauuuauauguuaauuuugagaaagagggagaaaaagccugcaagauuugccucaagauuuguauaagaaaaagccuuuuuuuaaucagagagguuccagggcucaaacuuagguucucagauguuagcaaaugaccuuacucacuuaaaaaagaacaaaacaacaaguggaucccccaccccacacacagggucuaacguagcucagaccuugacuauguagcugagaaugguaguguguguuacuauucuccuggcuagugcuaggauuacagacuacaccauuaguuuaaaaagugccuagcuucuuuaaguagauuuucaaagucugacuuguuaucccagcaccacccaggugucugagguaagaggaucaccaguucaaggccaaccuggauuacaaugcaagaccuuuucuaucucuuucuuucugucuuucuccuuuucuuucucucucucuuucuuucuucccucucuuccccucuuucuuucucucucuuuuuuaaaugauuuauuuuuuauuauauauaaguacacuguagcugucuucagacacaccagaagagggcaacaga

SEQ ID NO: 11851 - RNA, 268 nt, Mus musculus
aguaaccaguaaauguguguugacugagcaaauaaaagaacaacagugcaacaguuuuacgacgucaaaugaggacuguucucaaaccaauuagugaaaugaguguaagcauaaaacgacagaugucuguacauggacuguaguaguaauaguaauaguagcuguagcaguagcaauaguagugcccccucagacacagucccaucauuacagccauuggcauuuuccuuucuuucuuuugauucuuacuauggaauuuuuuuguacu

SEQ ID NO: 11852 - RNA, 268 nt, Mus musculus
aguacaaaaaaauuccauaguaagaaucaaaagaaagaaaggaaaaugccaauggcuguaaugaugggacugugucugagggggcacuacuauugcuacugcuacagcuacuauuacuauuacuacuacaguccauguacagacaucugucguuuuaugcuuacacucauuucacuaauugguuugagaacaguccucauuugacgucguaaaacuguugcacuguuguucuuuuauuugcucagucaacacacauuuacugguuacu

SEQ ID NO: 11853 - RNA, 115 nt, Mus musculus
cuuuguagaaagucaauauucagaguuuuaaauuucucuaauguaaaucauguugaggguccuacuauuucauacauucugguauagauaggcgguagaaauucagaaguuaaac

SEQ ID NO: 11854 - RNA, 115 nt, Mus musculus
guuuaacuucugaauuucuaccgccuaucuauaccagaauguaugaaauaguaggacccucaacaugauuuacauuagagaaauuuaaaacucugaauauugacuuucuacaaag

SEQ ID NO: 11855 - RNA, 768 nt, Mus musculus
uuccaagauucacucagugcuuuauuuguauaguauauaccguguucauuuucuagggauaucauaucaaaauacuacagacuguggcuuaaauaccagaaaauauuuucacaagcuucuggaaguuagaaguccaugacuaaaggagcuaucagauuugauuuccuccaaggucugucuccuuggcuugcagaugguuuucaucuuacuguauccucacauggcauuuccucuaaguguauggguuucuguguccuaauugcuuuuuuuuuuaaaagaaaauaaagauagagauuagguccugcccauaugagcucauuuaccauaauuaccccaauaaaagcuauuucuaaauaaagacacauucuuagauauuauucaacauaagaauuugagauuauuacaauacaagacaaccagucugaaauggagaauuagguucacuuuaggaguggugaaagguauaucucauacacauauuugauagagaguagggccuuccguaaguuccuagggcaaaggcagucagaacuuuggauguuggccaugccucauaagagauugaugucuguauaaagaaagauugcuacggagguauccugcuuugcuucuguuaucaggugcaucucagcaaggccugugucaggcucacagaccagcguuaggcacuccuuauuguggcacugggcacagugguccaaggcacagaggacaaacaggcuuagugccuucuucaguguuuccugugaaggagagacucagcuaguu

SEQ ID NO: 11856 - RNA, 768 nt, Mus musculus
aacuagcugagucucuccuucacaggaaacacugaagaaggcacuaagccuguuuguccucugugccuuggaccacugugcccagugccacaauaaggagugccuaacgcuggucugugagccugacacaggccuugcugagaugcaccugauaacagaagcaaagcaggauaccuccguagcaaucuuucuuuauacagacaucaaucucuuaugaggcauggccaacauccaaaguucugacugccuuugcccuaggaacuuacggaaggcccuacucucuaucaaauauguguaugagauauaccuuucaccacuccuaaagugaaccuaauucuccauuucagacugguugucuuguauuguaauaaucucaaauucuuauguugaauaauaucuaagaaugugucuuuauuuagaaauagcuuuuauugggguaauuaugguaaaugagcucauaugggcaggaccuaaucucuaucuuuauuuucuuuuaaaaaaaaaagcaauuaggacacagaaacccauacacuuagaggaaaugccaugugaggauacaguaagaugaaaaccaucugcaagccaaggagacagaccuuggaggaaaucaaaucugauagcuccuuuagucauggacuucuaacuuccagaagcuugugaaaauauuuucugguauuuaagccacagucuguaguauuuugauaugauaucccuagaaaaugaacacgguauauacuauacaaauaaagcacugagugaaucuuggaa

SEQ ID NO: 11857 - RNA, 443 nt, Mus musculus
uaugcuucuguuguuguccuucagacaaucuuuaaaugacuccaacuucucaauauuaaaaggaucacuagaccaaaaauucccaagcaaccuuauuuuucauuccauauauauauauauauaugaaccucaaacauagcacacagacauuaccagccuccagaacacaauaugaaauauuccuaaggaacauaaagauuuaguauauaauaaugaaauuacaguauacuuuugauauaugagcuucagaacacaaaagaccagggacccuaauugaaauaguguacagauuuuuuuuuuucaagacaggguuucucuguguagccuuggcuguccuggaacucacucuguagaccaggcuggccucgaacucagaaauucaccugccuccaccucccaagugcugggauucaaggcaugcaccaccauacccggcuccagaa

SEQ ID NO: 11858 - RNA, 443 nt, Mus musculus
uucuggagccggguaugguggugcaugccuugaaucccagcacuugggagguggaggcaggugaauuucugaguucgaggccagccuggucuacagagugaguuccaggacagccaaggcuacacagagaaacccugucuugaaaaaaaaaaaucuguacacuauuucaauuagggucccuggucuuuuguguucugaagcucauauaucaaaaguauacuguaauuucauuauuauauacuaaaucuuuauguuccuuaggaauauuucauauuguguucuggaggcugguaaugucugugugcuauguuugagguucauauauauauauauauauggaaugaaaaauaagguugcuugggaauuuuuggucuagugauccuuuuaauauugagaaguuggagucauuuaaagauugucugaaggacaacaacagaagcaua

SEQ ID NO: 11859 - RNA, 1957 nt, Mus musculus
ccaggugauuuuagugugucaaguuaacagucaaaacuaaccaacacaguguccucaugagaaaaaaagaaaaaguaaaauuauucagaacuccucaaagaaaauacauccaaggccuccaaauucuuuaaaauauguacacaagccgggcagugguggcacacgccuuuaaucccagcacuugggaggcagaggcaggcggauuucugaguucgaggccagucuggucuacaaagugaguuccaggacagccagcagggcuauacagggaaacccugucucaaaaaaccaaaaaaaaaaaaaaaaaauacguacacaaaacaaaaugacaaguuuuuuuugcaaacaaaguacaggccuuaaacuuuugaagcaauguuauuaaauaggaacguguuauuuuuaagcuuucaguaagucaaaaaacuguacuucucauuuccaaguguuucauaagccucaauuuuaggcacuauuaacaaugaccccagucugcaaucagacaaagcuacguucaaaccauggcucccaucuaguaaauguggaacuguggacacagucccagucuccuccucagcagaaggaaaaacugugccgcauuucauuguuuggggaauuuaaagaaaaucuguaaaauaguucucagaagaaaaaaagaugcuuagaaaauguuagguuaaauuaugaacuaaccaguaccccggagcucuugacucuagcugcauauguaucaaaagauggccuagucggccaucacuggaaagagaggcccauuggacacgcaaacuuuauaugccccaguacaggggaacaccagggccaaaaagggggaauggguggguaggggaguggggguggguggguaugggggacuuuugguauagcauuggaaauguaaaugagcuaaauaccuaauaaaaauggaaaaaaaaaaaagaaaaaaaaaaaaaaagaaaauguuagguuaaaaagaauuauguaaaggggguaggggagguggugucaugcuguauguggagaguaaaguucaaccuuugaguauuaacucuuuccuuccaccaugaguucuggggaucuaacugaauccuagcagcaagugccuucacccacugagcccauuuggguugguuuguuuguuuguuggaguuaggggcuuucuaugcagcuccagaugaccuaggaccuauguauccagaguugacuuccaacuugccaaaauccucucgccucuuggccccgaggguccuaagguuacaggcaucaccaccaccacacgcagcuaauguuaguuauuaauacuacugaaggcuuuaccauaucuuuuuuaaucuaauaaacaaaaucuuagauuuuuuuauuuaggucuucgaaggguuuuuuuuucaacauauauauauuuuuuuuauuuuuauuuuuuuauuuuuugguuuuuuuuuuuuuccgagacaagguuucucuguguaccuuggcuguccuggaacucacuuuguagaccaggcuggccucgaacucagaaauccgccugccucugccucccaagugcugggaucaaaggcguucgccaccacgcccagcauauuuuuuuaacuauguguuuaugaaggugucucaagaugucagaggccucgugguagugagccaucuuacccgggugcuggaaacuaaauguggacccucugcaaaagcaguguguacucuuaaccaucuccagcccacacugguuuuuguuucauuucauucuuuugagacaggauuucacgguacugccuugaaggcuuagcuggccuggaacucacuauguaaaccaaccuggucuugaucucagagaucugccugccucuccucccaagugcuaggauuaaaaacaugugccacuaagcccaaauuuuuuaaauuuuaauuuguauuggcuuuuuuuuaauuuuuugagagagacucucacuauacaguccaggau

SEQ ID NO: 11860 - RNA, 1957 nt, Mus musculus
auccuggacuguauagugagagucucucucaaaaaauuaaaaaaaagccaauacaaauuaaaauuuaaaaaauuugggcuuaguggcacauguuuuuaauccuagcacuugggaggagaggcaggcagaucucugagaucaagaccagguugguuuacauagugaguuccaggccagcuaagccuucaaggcaguaccgugaaauccugucucaaaagaaugaaaugaaacaaaaaccagugugggcuggagaugguuaagaguacacacugcuuuugcagaggguccacauuuaguuuccagcacccggguaagauggcucacuaccacgaggccucugacaucuugagacaccuucauaaacacauaguuaaaaaaauaugcugggcgugguggcgaacgccuuugaucccagcacuugggaggcagaggcaggcggauuucugaguucgaggccagccuggucuacaaagugaguuccaggacagccaagguacacagagaaaccuugucucggaaaaaaaaaaaaaccaaaaaauaaaaaaauaaaaauaaaaaaaauauauauauguugaaaaaaaaacccuucgaagaccuaaauaaaaaaaucuaagauuuuguuuauuagauuaaaaaagauaugguaaagccuucaguaguauuaauaacuaacauuagcugcguguggugguggugaugccuguaaccuuaggacccucggggccaagaggcgagaggauuuuggcaaguuggaagucaacucuggauacauagguccuaggucaucuggagcugcauagaaagccccuaacuccaacaaacaaacaaaccaacccaaaugggcucagugggugaaggcacuugcugcuaggauucaguuagauccccagaacucaugguggaaggaaagaguuaauacucaaagguugaacuuuacucuccacauacagcaugacaccaccuccccuacccccuuuacauaauucuuuuuaaccuaacauuuucuuuuuuuuuuuuuuucuuuuuuuuuuuuccauuuuuauuagguauuuagcucauuuacauuuccaaugcuauaccaaaagucccccauacccacccacccccacuccccuacccacccauucccccuuuuuggcccugguguuccccuguacuggggcauauaaaguuugcguguccaaugggccucucuuuccagugauggccgacuaggccaucuuuugauacauaugcagcuagagucaagagcuccgggguacugguuaguucauaauuuaaccuaacauuuucuaagcaucuuuuuuucuucugagaacuauuuuacagauuuucuuuaaauuccccaaacaaugaaaugcggcacaguuuuuccuucugcugaggaggagacugggacuguguccacaguuccacauuuacuagaugggagccaugguuugaacguagcuuugucugauugcagacuggggucauuguuaauagugccuaaaauugaggcuuaugaaacacuuggaaaugagaaguacaguuuuuugacuuacugaaagcuuaaaaauaacacguuccuauuuaauaacauugcuucaaaaguuuaaggccuguacuuuguuugcaaaaaaaacuugucauuuuguuuuguguacguauuuuuuuuuuuuuuuuuugguuuuuugagacaggguuucccuguauagcccugcuggcuguccuggaacucacuuuguagaccagacuggccucgaacucagaaauccgccugccucugccucccaagugcugggauuaaaggcgugugccaccacugcccggcuuguguacauauuuuaaagaauuuggaggccuuggauguauuuucuuugaggaguucugaauaauuuuacuuuuucuuuuuuucucaugaggacacuguguugguuaguuuugacuguuaacuugacacacuaaaaucaccugg

SEQ ID NO: 11861 - RNA, 244 nt, Mus musculus
cagagggaagcuguuuccagccgugcacacugagccuccguuauccaggacagaacuaaaaaugccaauaacacacccacugaaugcauuccuucaugaaagagacaugaguugacacuucagccuacucagugaggaaagucaaguuuuccaaguuuuuuuuuuaauuuuuuuauuauuauuaaaaauagaauuuguugcugggcaugaugggacagaccuuuuugaucccaggacuugggag

SEQ ID NO: 11862 - RNA, 244 nt, Mus musculus
cucccaaguccugggaucaaaaaggucugucccaucaugcccagcaacaaauucuauuuuuaauaauaauaaaaaaauuaaaaaaaaaacuuggaaaacuugacuuuccucacugaguaggcugaagugucaacucaugucucuuucaugaaggaaugcauucaguggguguguuauuggcauuuuuaguucuguccuggauaacggaggcucagugugcacggcuggaaacagcuucccucug

SEQ ID NO: 11863 - RNA, 358 nt, Mus musculus
cuccugucagaugguucugcgguccaggccagccuggcacuuugcauacgcaagucucggcuucccaagugcguuuaacacaaacuaacaagcaaacaaacaaaagcauaacacgguaagcugagagggguggugcacaucugcagucggaauacuggacaggcugaagcaggaggacugugaauuugaggcuaccuugacuacauagaaaaucccaaacccauuugaguuaccuaguuaaauccugucucaaaaaccaaaagguuguggguguugcucacucauggauccaagaggguguuucgguugaacaggggcuauagggugugugagaaccuauguaggaaugcagggccag

SEQ ID NO: 11864 - RNA, 358 nt, Mus musculus
cuggcccugcauuccuacauagguucucacacacccuauagccccuguucaaccgaaacacccucuuggauccaugagugagcaacacccacaaccuuuugguuuuugagacaggauuuaacuagguaacucaaauggguuugggauuuucuauguagucaagguagccucaaauucacaguccuccugcuucagccuguccaguauuccgacugcagaugugcaccaccccucucagcuuaccguguuaugcuuuuguuuguuugcuuguuaguuuguguuaaacgcacuugggaagccgagacuugcguaugcaaagugccaggcuggccuggaccgcagaaccaucugacaggag

SEQ ID NO: 11865 - RNA, 490 nt, Mus musculus
uggauugugucucucagccuggcuguaacuuuccacuuucgaggggguguugugaggguuuacaagccugaaucugacaaauacucuacaucagaagcuucaagaaauucuucuaaagaggaaacuggauuuggcaccaacuaaaacauaacaagcguuagauaaaaaaauuacaggaaguggccugagagauagcccagugaauacaagacggacagacaugcguggugcgugccgggcgugguggcgcacgccuuuaaucccagcacucgggaggcagaggcagguggauuucugaguucgaggccagccuggucuacagagugaguuccaggacagccagggcuauacagagaaacacugucucggaaaaacaaaaacaaaaacaaacaaacaaacaaacacggacagacggagcuccaucccuggaggcacauggcagaaaaaaagaaucagauccccaaagcuguucuuuuguaagugugugagu

SEQ ID NO: 11866 - RNA, 490 nt, Mus musculus
acucacacacuuacaaaagaacagcuuuggggaucugauucuuuuuuucugccaugugccuccagggauggagcuccgucuguccguguuuguuuguuuguuuguuuuuguuuuuguuuuuccgagacaguguuucucuguauagcccuggcuguccuggaacucacucuguagaccaggcuggccucgaacucagaaauccaccugccucugccucccgagugcugggauuaaaggcgugcgccaccacgcccggcacgcaccacgcaugucuguccgucuuguauucacugggcuaucucucaggccacuuccuguaauuuuuuuaucuaacgcuuguuauguuuuaguuggugccaaauccaguuuccucuuuagaagaauuucuugaagcuucugauguagaguauuugucagauucaggcuuguaaacccucacaacacccccucgaaaguggaaaguuacagccaggcugagagacacaaucca

SEQ ID NO: 11867 - RNA, 239 nt, Mus musculus
gauggcgacuuuuggguguggcagggaagcugcacccaugaacuccaaugacaugguugcuuacacaagaccacacaugccagucaacaugccaagguagagggggcacguuggggggggcgggggugguggugguggggaaucucacaaggcuccaugcuuagaaaaagagcuggagguaguaaauggcuguugaaagaggggaagaauaggguguuuuaaggaaugagcccuaugau

SEQ ID NO: 11868 - RNA, 239 nt, Mus musculus
aucauagggcucauuccuuaaaacacccuauucuuccccucuuucaacagccauuuacuaccuccagcucuuuuucuaagcauggagccuugugagauuccccaccaccaccacccccgccccccccaacgugcccccucuaccuuggcauguugacuggcauguguggucuuguguaagcaaccaugucauuggaguucaugggugcagcuucccugccacacccaaaagucgccauc

SEQ ID NO: 11869 - RNA, 265 nt, Mus musculus
aaggucucaugaguuugagaggguacaggaaagacacaggaggacaagagaagguggaaaagguguaaauauaguauucauauauaaaauccucaaauuauuaaaacugggaagaggaacugugagaagauaaauuaauguuuuguuuuguugguuuuuguuguuguuguuguuguuguuuuuaaugcaguaaagcugugauuggcugugcagaccuuuaauagcagcacuuggaaaaaggaaacagguggcucagguauuccag

SEQ ID NO: 11870 - RNA, 265 nt, Mus musculus
cuggaauaccugagccaccuguuuccuuuuuccaagugcugcuauuaaaggucugcacagccaaucacagcuuuacugcauuaaaaacaacaacaacaacaacaacaaaaaccaacaaaacaaaacauuaauuuaucuucucacaguuccucuucccaguuuuaauaauuugaggauuuuauauaugaauacuauauuuacaccuuuuccaccuucucuuguccuccugugucuuuccuguacccucucaaacucaugagaccuu

SEQ ID NO: 11871 - RNA, 1704 nt, Mus musculus
uuguacuugcuguucccucugaguagaagauuuucuccucuucuucuaaaacuccaguuuaucuuuccucagggaagccuucccaauccagaaguuuaaagcuccuuuguagcauugcuguaguuauuauucuguauauguuggagauuaauauuuaguuuuuccucauuguaaccuccagaaaugcuaguaaugguuuuuguuguuguuuacaauuauagaccuauacuuacuaguaugcuugaaacaugagcauucauugcaaaaacuaaucaauggaugauagucaucacagaaaauaacccauauaucuaacaaaugggaaguaauuucauaaauggagcauauuccagcaaaacauucauuccuaagucauguuuuagauuauauaacuguugugaaaguauuagcuuacaaaauaaucauuuaaaugcagaaaauuuuauugaaauaaagguugguucuauguagaaagucuucuguauuuuucagauuuuucugcagauaacauauguugacuuaauaguuuguaaaagacugcucacauguuuguuaagagaaagccaguuuucuagauguguuucagaagcauaguaagaaaaagguaugagacucauucagcucuccaaaauaaauauccacuaaagugcauaauuaauuacauuaugguguuuugaucuugauuauuaauucagaaaaugucaaaaacuuuuuuuuguaaagcaaacuagcaauuuuuagauugacauaucuauuuguuugugaaguuguuuuaauuuuaaagugugggaguaggugucugaaaaugugcuuucuuguaaugagugucagucagacgcuggggcuugugcauaccaggugaguguuccagcugaguucucacuccaggacuuaagaugguuuugacacacaauagcaaugcaacagaguaaaacucagaaaugaauucauauguguuagcaccuuaaaacaaagauacuauuuuugauuuauaguugagaaaugauuauuaaauaaugaucuuuguagauagauugcuacuauucugaacaaaaaguaaguuggcuuccagaguugucaaaaacaugugaaauaaggaacaggaucauauuuuugaugugguuuaggaaugaugaauggcuuucagaguaugaaaaaacugaagcuagauucucaauuuucuuuuuuuuuuuuuugagacaggguuucucuguguagcccuggcuguucuggaacucacucuguagaccaggcuggccucgaacucagaaauccgccugccucugccucccaagugcugggauuaaaggcgugugccaccacuguccagcuagauucugaauuuuauaacacaaauaaaacuccauuuguggaaaaaacacaagguaaaagguaaauaaaacuuguaagcucauuuguacuuuugaaaagggcccacuuucuucccaauaaauagcuccuacuaguagagaagugaacaaagacaauucaugugaaaaguguuauauguauauaauaugccuuauacaguuauaauuauagcugcagcauauuucaucaucugucauauuugcaaagcuacuuuggauaaguugagaauggugaggaaagaacggcagucucagacauuggugguaagaucauaaagccuuugggccccauguaaagcaguuuggaaagguucaaaauuggaagugcgcuuuu

SEQ ID NO: 11872 - RNA, 1704 nt, Mus musculus
aaaagcgcacuuccaauuuugaaccuuuccaaacugcuuuacauggggcccaaaggcuuuaugaucuuaccaccaaugucugagacugccguucuuuccucaccauucucaacuuauccaaaguagcuuugcaaauaugacagaugaugaaauaugcugcagcuauaauuauaacuguauaaggcauauuauauacauauaacacuuuucacaugaauugucuuuguucacuucucuacuaguaggagcuauuuauugggaagaaagugggcccuuuucaaaaguacaaaugagcuuacaaguuuuauuuaccuuuuaccuuguguuuuuuccacaaauggaguuuuauuuguguuauaaaauucagaaucuagcuggacagugguggcacacgccuuuaaucccagcacuugggaggcagaggcaggcggauuucugaguucgaggccagccuggucuacagagugaguuccagaacagccagggcuacacagagaaacccugucucaaaaaaaaaaaaaagaaaauugagaaucuagcuucaguuuuuucauacucugaaagccauucaucauuccuaaaccacaucaaaaauaugauccuguuccuuauuucacauguuuuugacaacucuggaagccaacuuacuuuuuguucagaauaguagcaaucuaucuacaaagaucauuauuuaauaaucauuucucaacuauaaaucaaaaauaguaucuuuguuuuaaggugcuaacacauaugaauucauuucugaguuuuacucuguugcauugcuauugugugucaaaaccaucuuaaguccuggagugagaacucagcuggaacacucaccugguaugcacaagccccagcgucugacugacacucauuacaagaaagcacauuuucagacaccuacucccacacuuuaaaauuaaaacaacuucacaaacaaauagauaugucaaucuaaaaauugcuaguuugcuuuacaaaaaaaaguuuuugacauuuucugaauuaauaaucaagaucaaaacaccauaauguaauuaauuaugcacuuuaguggauauuuauuuuggagagcugaaugagucucauaccuuuuucuuacuaugcuucugaaacacaucuagaaaacuggcuuucucuuaacaaacaugugagcagucuuuuacaaacuauuaagucaacauauguuaucugcagaaaaaucugaaaaauacagaagacuuucuacauagaaccaaccuuuauuucaauaaaauuuucugcauuuaaaugauuauuuuguaagcuaauacuuucacaacaguuauauaaucuaaaacaugacuuaggaaugaauguuuugcuggaauaugcuccauuuaugaaauuacuucccauuuguuagauauauggguuauuuucugugaugacuaucauccauugauuaguuuuugcaaugaaugcucauguuucaagcauacuaguaaguauaggucuauaauuguaaacaacaacaaaaaccauuacuagcauuucuggagguuacaaugaggaaaaacuaaauauuaaucuccaacauauacagaauaauaacuacagcaaugcuacaaaggagcuuuaaacuucuggauugggaaggcuucccugaggaaagauaaacuggaguuuuagaagaagaggagaaaaucuucuacucagagggaacagcaaguacaa

SEQ ID NO: 11873 - RNA, 439 nt, Mus musculus
acaaggccacaucuccuaauagugccacucccugggccaaguauauucaaauuauaauaguguuuaugcccaugcauguuucacaguaugcaugauauagguuggaggacagacaacuuuguggagucaggucuucucuuucauuuuuuauguggguucccaggauccaacuugagcaccaggcuuguauagcaaguaccuuuaccugcugaucuaucugucucuggauuccuguauuuuuuuuuuuuuauuauaguaauauugucuucccauuuguuugagagucauacaagcauguuuagacaaaguguuucauguagcacaggcuguccuggcauucacuauuuagugacucugaacuugacuggccugccccugccuccuaagugcuggaauuauggccauucaccauuagaccugguuuaugugguacuggggg

SEQ ID NO: 11874 - RNA, 439 nt, Mus musculus
cccccaguaccacauaaaccaggucuaauggugaauggccauaauuccagcacuuaggaggcaggggcaggccagucaaguucagagucacuaaauagugaaugccaggacagccugugcuacaugaaacacuuugucuaaacaugcuuguaugacucucaaacaaaugggaagacaauauuacuauaauaaaaaaaaaaaaauacaggaauccagagacagauagaucagcagguaaagguacuugcuauacaagccuggugcucaaguuggauccugggaacccacauaaaaaaugaaagagaagaccugacuccacaaaguugucuguccuccaaccuauaucaugcauacugugaaacaugcaugggcauaaacacuauuauaauuugaauauacuuggcccagggaguggcacuauuaggagauguggccuugu

SEQ ID NO: 11875 - RNA, 1450 nt, Mus musculus
acaagcauuacgauacugugacagaaucuaagacagcuacuaagugacuaaugcauggguagaacauaccauguuuuugucuaggaguggcgccuagacaaaagaaggacuccuaggcauagugggucaaagcauguauaagguuucaucaugcuauaaagaauggaugcagcuuauguguugugggucuguagagguggcugagcaauuaagaguacuuuagaggauccaguauaguucccaucacucuaauggcagcucacaaccaucuauaacucccaauucuaggagacacagcauccuuuuuagacaucuauggguaccagguacauguaaauauauuaaggcuguauauucacacacuaaaauuguguguguguguguguguguauuauauaauacauuuauuauacauaugcauguauauguauauguguguguguauguuugaauuuccacuuaacuguauuccaaucauauaguguauagcuacagauaaaaagagauuaucauuauguaucaguauggaggacaacccucaaauuuguaaguggucuggacgucgauuaugugggucucagggacugaauucaguucauuagguuugguaccaagugcuuuuauucaccgaauccucucucugcuuccugacaacuuggaucuugguccauuguuaaaacaaauugaugugcauguauaccugugcauauuugaauuucuaaugcaaauaaguucuaaugaguucuucaagacuuauuuauaaaagaauuucuaugggauaguuuuuaauuuuucauauauucucaauuauuuaaaacuuugaaacuuuaaguauguuuugaucauauucuuuccuuccuucaagucuuccagauccuuguccccuucuuccccacccaacuuuaaguuauuucucaaaaaacagacuuaguugggguuuuacggcugugaacagacaccgugacugagguaacucuuacaagaucaacauuuaauuggggcuagcuuacaggaucagagauucaguccaguaucaaggcaggaacacccaggcaggcauagugcaggaggagcugagaguucuacaucuucaucugaaggcuguuagcagaauacuggcuuccaggcagcuaggaugacagucuuaagcccaugccuucagugauacaccuacuccaacugggccacaccuucuaauaguaccacuuccugggcugaguguauacauucaucacaacagauaaaaccccaauacaauaauccgcccccaaaccaagacaacaaaauaaagccacucccaaaaugaguaacaaacaaaucccccaaacaaaauaacaaaacaccccacaccagacugcaagcaaauaaaaguguacauacacacaaccccaaaaaaccuggaguccauuauacauuggccuguucaggagugguuuauauacccaguguc

SEQ ID NO: 11876 - RNA, 1450 nt, Mus musculus
gacacuggguauauaaaccacuccugaacaggccaauguauaauggacuccagguuuuuugggguuguguguauguacacuuuuauuugcuugcagucuggugugggguguuuuguuauuuuguuugggggauuuguuuguuacucauuuugggaguggcuuuauuuuguugucuugguuugggggcggauuauuguauugggguuuuaucuguugugaugaauguauacacucagcccaggaagugguacuauuagaagguguggcccaguuggaguagguguaucacugaaggcaugggcuuaagacugucauccuagcugccuggaagccaguauucugcuaacagccuucagaugaagauguagaacucucagcuccuccugcacuaugccugccuggguguuccugccuugauacuggacugaaucucugauccuguaagcuagccccaauuaaauguugaucuuguaagaguuaccucagucacggugucuguucacagccguaaaaccccaacuaagucuguuuuuugagaaauaacuuaaaguuggguggggaagaaggggacaaggaucuggaagacuugaaggaaggaaagaauaugaucaaaacauacuuaaaguuucaaaguuuuaaauaauugagaauauaugaaaaauuaaaaacuaucccauagaaauucuuuuauaaauaagucuugaagaacucauuagaacuuauuugcauuagaaauucaaauaugcacagguauacaugcacaucaauuuguuuuaacaauggaccaagauccaaguugucaggaagcagagagaggauucggugaauaaaagcacuugguaccaaaccuaaugaacugaauucagucccugagacccacauaaucgacguccagaccacuuacaaauuugaggguuguccuccauacugauacauaaugauaaucucuuuuuaucuguagcuauacacuauaugauuggaauacaguuaaguggaaauucaaacauacacacacacauauacauauacaugcauauguauaauaaauguauuauauaauacacacacacacacacacacaauuuuagugugugaauauacagccuuaauauauuuacauguaccugguacccauagaugucuaaaaaggaugcugugucuccuagaauugggaguuauagaugguugugagcugccauuagagugaugggaacuauacuggauccucuaaaguacucuuaauugcucagccaccucuacagacccacaacacauaagcugcauccauucuuuauagcaugaugaaaccuuauacaugcuuugacccacuaugccuaggaguccuucuuuugucuaggcgccacuccuagacaaaaacaugguauguucuacccaugcauuagucacuuaguagcugucuuagauucugucacaguaucguaaugcuugu

SEQ ID NO: 11877 - RNA, 195 nt, Mus musculus
acuggcgugauagugugugcuuguaaugcuagcacuggggaggcauagacagauggaucucugaggcucuguggccagccagcauaaccuacuuggugagagaccauguccaaaaaaaaucaaaugggguuggaaauuuguucagagguugagaacacuggcuccuauucuaaaggaccuggaccugacucucaa

SEQ ID NO: 11878 - RNA, 195 nt, Mus musculus
uugagagucagguccagguccuuuagaauaggagccaguguucucaaccucugaacaaauuuccaaccccauuugauuuuuuuuggacauggucucucaccaaguagguuaugcuggcuggccacagagccucagagauccaucugucuaugccuccccagugcuagcauuacaagcacacacuaucacgccagu

SEQ ID NO: 11879 - RNA, 257 nt, Mus musculus
auguuuuugauguuuuccagucuaaaaaaaaaaaaagcagaaauugagcauauccguuccgucgguccuuaucucaguugaugaucagagccuacucuccugggacuugacuugucucuuacacuacagaggcuaggcugggacagguggguuuuauggagaucagacucccagacagaacaccagaaacuuucuaaguccuaaacuccauccagaaccacuggcuuuucccagucuacccgacuccuaagucucag

SEQ ID NO: 11880 - RNA, 257 nt, Mus musculus
cugagacuuaggagucggguagacugggaaaagccagugguucuggauggaguuuaggacuuagaaaguuucugguguucugucugggagucugaucuccauaaaacccaccugucccagccuagccucuguaguguaagagacaagucaagucccaggagaguaggcucugaucaucaacugagauaaggaccgacggaacggauaugcucaauuucugcuuuuuuuuuuuuuagacuggaaaacaucaaaaacau

SEQ ID NO: 11881 - RNA, 1387 nt, Mus musculus
gaguucgaggccagccuggucuacaaagugaguuccaggacagccagggcuauacagagaaacccugucucgaaaaaaaacaaaaacaaacaaacaaacaaaaaaaccaacagaaagaaagaaagaaaaaaagaaagaaagaaagaaagaaagaaagaaagaaagaaagaaagaaagaaagaaaagaaaagaaaagaaaagaaaagaaaagaaaagaaaagaaggacggacuaaguucuaaaacaaaacauaaccaaauuuucugcaagacagucuaccaaagccagcucuuccccucgaacaauguauaguccugggguuuacccaggaucacagagcaacagaauacggggggggggggggggggcgcacacacaaaaaaaacaaaaaaaacucuucacuguacaagaaauaaucucacuaaugugaaagaagguagcuuuuuaaaacuugacacuggggucaagaaaaaccacuuuaaaagaagaaaaugcagaaagagccagggcugugguaccacacacaugugguacaaucacagcaauagggagagggagguaggagaaucaggaguucaagguuagccucagcuacaaagcagguuuaaggccaaccugagcuaugaaacucuagcucaaaaauaccaaaaagaaacagggagaggaggggagcagaguagauaaauggagaucaauaguuauauaaaugagaaggugagaaaaauggagagaauaagccaaguagaaagauguggcaggggcuggugagauggcucagugguuaagagcgccgacugcucuucugaagguccugaguucaaaucccagcaaccacaugguggcucacaaccauccauaacgaaaucugaugcccucuucuggagugucugaagacagcuacaguguacuuacauauaauaaauaaauaaaucuuuaaaaaaaaaagauguggcagaauaucuaguaaacacaguguuccuuaaacucuccuaccaacuuuauauaggcugaaagauuuuugaaaauaugaagcugaagagaaaaauuccuaaaauauauaccaaaaugugacacucgguauuuuaaaaguauauguaacauuuuaaaacaguacuucaucuagaccauucuacaauaacagaacaauaauuguauuacagacuaucuuaaaacuucuauucaaaccacuuacacauccacaggaaucuggucccccauugaagagggaacaagucauccuaacgauuucugccucuaacuuccgcaauccagggaagauaucuggaugcaguggauugcuccacgugaauucuccauaagccugcaaagaaauacaagggaguguaagacaggcugcuauccuaaccaagacaaaaucguguacugag

SEQ ID NO: 11882 - RNA, 1387 nt, Mus musculus
cucaguacacgauuuugucuugguuaggauagcagccugucuuacacucccuuguauuucuuugcaggcuuauggagaauucacguggagcaauccacugcauccagauaucuucccuggauugcggaaguuagaggcagaaaucguuaggaugacuuguucccucuucaaugggggaccagauuccuguggauguguaagugguuugaauagaaguuuuaagauagucuguaauacaauuauuguucuguuauuguagaauggucuagaugaaguacuguuuuaaaauguuacauauacuuuuaaaauaccgagugucacauuuugguauauauuuuaggaauuuuucucuucagcuucauauuuucaaaaaucuuucagccuauauaaaguugguaggagaguuuaaggaacacuguguuuacuagauauucugccacaucuuuuuuuuuuaaagauuuauuuauuuauuauauguaaguacacuguagcugucuucagacacuccagaagagggcaucagauuucguuauggaugguugugagccaccaugugguugcugggauuugaacucaggaccuucagaagagcagucggcgcucuuaaccacugagccaucucaccagccccugccacaucuuucuacuuggcuuauucucuccauuuuucucaccuucucauuuauauaacuauugaucuccauuuaucuacucugcuccccuccucucccuguuucuuuuugguauuuuugagcuagaguuucauagcucagguuggccuuaaaccugcuuuguagcugaggcuaaccuugaacuccugauucuccuaccucccucucccuauugcugugauuguaccacaugugugugguaccacagcccuggcucuuucugcauuuucuucuuuuaaagugguuuuucuugaccccagugucaaguuuuaaaaagcuaccuucuuucacauuagugagauuauuucuuguacagugaagaguuuuuuuuguuuuuuuugugugugcgccccccccccccccccccguauucuguugcucugugauccuggguaaaccccaggacuauacauuguucgaggggaagagcuggcuuugguagacugucuugcagaaaauuugguuauguuuuguuuuagaacuuaguccguccuucuuuucuuuucuuuucuuuucuuuucuuuucuuuucuuuucuuucuuucuuucuuucuuucuuucuuucuuucuuucuuucuuucuuucuuuuuuucuuucuuucuuucuguugguuuuuuuguuuguuuguuuguuuuuguuuuuuuucgagacaggguuucucuguauagcccuggcuguccuggaacucacuuuguagaccaggcuggccucgaacuc

SEQ ID NO: 11883 - RNA, 209 nt, Mus musculus
aaaaaaaaaagggaaaugaacauuuuaucuguuuagccaggcagcuugugccagauuuccuucugaaagucaaagaugcauuaaauuuccccuuuucugggcugugcugaugucaccagcacuguguugcccuugauuugaacuggaagucaaauagccugaguacuacauuaggucccuguugcuguguuggcaacagcaauagugug

SEQ ID NO: 11884 - RNA, 209 nt, Mus musculus
cacacuauugcuguugccaacacagcaacagggaccuaauguaguacucaggcuauuugacuuccaguucaaaucaagggcaacacagugcuggugacaucagcacagcccagaaaaggggaaauuuaaugcaucuuugacuuucagaaggaaaucuggcacaagcugccuggcuaaacagauaaaauguucauuucccuuuuuuuuuu

SEQ ID NO: 11885 - RNA, 109 nt, Mus musculus
uuuaauacacacuauaaaaguauauccauggaaugaauucccagaagcagaacugccagucaaaugacacauauauuccaguucuugaccuucccaagguuuccaaaug

SEQ ID NO: 11886 - RNA, 109 nt, Mus musculus
cauuuggaaaccuugggaaggucaagaacuggaauauaugugucauuugacuggcaguucugcuucugggaauucauuccauggauauacuuuuauaguguguauuaaa

SEQ ID NO: 11887 - RNA, 533 nt, Mus musculus
ggacacuugugcauuacuacugcauacaccucuacggaccccagcagcagcauuuuaaggcggggcuaaaaggcuuuacaggguaucuauggcaggcaugaaaggcaaccaaggauuggagaauuagaacuuguucaaggcacaguucauagcagugagagaguaguccaggacuccugcuacucuacacugccucaaaugcacuguggagauuguuuuaucaucaaggucuaucagccuaggagaccccagaccaacuuuucucugaagcaugaacucaguaagauccuuugcugcauuccuaagggaucugguagggcaacuccuaguguggugccacacagauaugucaacucccucagcugguacucaucaaggccuaccugcauccuugcuuuacugugcuugcuuagguaguacuggccuucuacuacugaguccuaucaacacugcaagaccugcuguagugauuugaauaggaauggccccacagacucauguguuugaaugcuuggcccacagaaaauggcauu

SEQ ID NO: 11888 - RNA, 533 nt, Mus musculus
aaugccauuuucugugggccaagcauucaaacacaugagucuguggggccauuccuauucaaaucacuacagcaggucuugcaguguugauaggacucaguaguagaaggccaguacuaccuaagcaagcacaguaaagcaaggaugcagguaggccuugaugaguaccagcugagggaguugacauaucuguguggcaccacacuaggaguugcccuaccagaucccuuaggaaugcagcaaaggaucuuacugaguucaugcuucagagaaaaguuggucuggggucuccuaggcugauagaccuugaugauaaaacaaucuccacagugcauuugaggcaguguagaguagcaggaguccuggacuacucucucacugcuaugaacugugccuugaacaaguucuaauucuccaauccuugguugccuuucaugccugccauagauacccuguaaagccuuuuagccccgccuuaaaaugcugcugcugggguccguagagguguaugcaguaguaaugcacaagugucc

SEQ ID NO: 11889 - RNA, 343 nt, Mus musculus
aaaccaccuggcagaggugauggaagggaggaaagauugaucucgguucaugguucacaggacacauuccaacauggcaggaaggcuuggagccuggaaagcacccuccacgggaggcaggaauuaguggugcagucagccuuagaagggagacaggaaaccgguuuacaucuagcacuccggugcccuacaccagcaacucacuuccuucagcugagccccacagugguccucauccucccuaaugcagcgaccguuuaauacaguuccucauaucauggugaccccucaaccauaaaauuauuaucauugcuacuuuguuuuguuuuguuuugauuuuuca

SEQ ID NO: 11890 - RNA, 343 nt, Mus musculus
ugaaaaaucaaaacaaaacaaaacaaaguagcaaugauaauaauuuuaugguugaggggucaccaugauaugaggaacuguauuaaacggucgcugcauuagggaggaugaggaccacuguggggcucagcugaaggaagugaguugcugguguagggcaccggagugcuagauguaaaccgguuuccugucucccuucuaaggcugacugcaccacuaauuccugccucccguggagggugcuuuccaggcuccaagccuuccugccauguuggaauguguccugugaaccaugaaccgagaucaaucuuuccucccuuccaucaccucugccaggugguuu

SEQ ID NO: 11891 - RNA, 4036 nt, Mus musculus
guuuauuuauuuauuuauuuugguuuugguuuguguguuugauaaucaucauuuugccaaagucaugugugaaucaaugucuucaguugcccugaaguagagcguaucuuguugaccuugaacuucggcauugaaggaccccucuccugagcucucagcaucaccuuuggagacgccuaauagguauuucuaauuaaacaucccugaacugagcccugauaaccccucccacuuagaacaaaagcaugcuguuccucugcaccugcccugccucuccugccagggaucccaguucagucgcuagggcuaaaaggcucagggcaucacacgaccaauugcucccauacacacccgucgaccaauccuuccacucgagguuucacaacaaucuuagacuugaagugcuugccacacaucuagugcacaccgggacaaacuagccuaaccucugccccggucacugcugugucucuuccauggcuuccucgccccuuugcagccucuccucgacagagaagcaagaguucacguguggaaacuggguuguuuucuucuggcccaacccaaaugacuacauugcagccaaauaaaagacgaagcccugccacuugcagggucuuucaggauccauucccacuuaccuuucggaucuuguuuccuacacccuugagucccaggccuauuuauacucauagcccacucuugccccagucagccucagucucaggcauucuggacuccuugccuuuccuaaaaugcucuucugcugcugcuucugguccaauugucuguuccacgacuuguguucauucagacaucuuuaugguuuacuccugaguacauuccuuacaucuuuuuuuuuuuccaaaauuuauuuauuuauguaugugaguacacuauggcuguucagaugguugugagccuucaugugguuguugggaauugaauuuuaggaccucugcucgcucagucccugcuugcuccggcucaaagauuuauuucuuauuauuacauaaguacacuguagcugacuucagacgcaccaaaagagggugucagaucucaugagccaccaugugguugcugggauuugaacucaggaucuucagaaaagcagucagugcucuuaccugcuaagccaucucgccagucccccuuagaucuuuauuuaauguugccuucuuagcaagacucgacacccaauuuagaaucuuacacacacacacaacacacaaacacacacacgcacaacccucuucuaggcacuaacgcuauucacuguuuugauguuuuauuuggggggacaaagggccuuuuggaucaagguuucacucaguagcccaaacuggccacauacucaagggaauccuccugccucggcuucccaaacacaggcaugaaagguguaagcugccacaccaacuuaaauaaaauuucguguaccuguggaacucacacuauuucuuuucuucuagaaugugagcaucguguacucuuccuuccauugcucacaaauguggcugcugcuugcacaccaagaaccauccuuaacauguaggaggcacuggacaucacugauuaaggaguguaaguaagaaugaaugaaugaaugaaugaaugaaugaaugaaugaaucaucaaggcuuuaugauugcacuucccagguguaaacugucaauuuuuuauauauguuaccuuuggcaaguuagagagacggugauagaaccuauauuacggggauguugugccuggugcccacugaacagauauguugccccacaagauaucugacaauuaaaauaauccaugaaaagagcuuuggcacuuagugcauucuuucuaaggacuggcugguauuucacuugcccuucuacucucagagaguuugguugugcucaguauggagaagcuugucuuacuuucacguacauggaaugaaaugaucacacacacacacacacacacacacacacacacacacacaccauucucaccacaaacuuccaucgguggcugcccaagaacuccagggaguucugguucaacuuuaaaauuuacaggguguuacagcuagagacauaggucaguguuuaagagcacuggcugcucuuccagaggaccuggcuucaauucucagcacccacaugguggcuuacaaccauuuguaaccccaguuucaggggaccaagugccaccuucuggcuucugaggggaguaggcaugaacacaaugcagaaacauacauccagacaaaacaccucacaccuaaagaauagaauuuuuaaacaaauaaauaaaacuuauagagggucaaagagggauauaauucuauuacuggaugccuaagaacaugucuguucaguuggaugacauacugacuauggcaaaucccuacuaugguucuacccugcgagggcacaggaguguugcccacagaacuagagagcugcuuucauugccugcauugaggaguguccugggcuugaacacccaaucaaaguguaccaaacuggauauguuuguucugcaaugacaguacgcuaguacuggaguuggcaagcuucuaccagcuuacagaaguugggugaacaauggaugaucuuuggcaacuaaaucugauaugagucuggcguacauguagacagaaaucacguauuuaauuauccucuggcccucuucuucaaagguuccacgucucacauuuguacagccagcaugcaguguaucuucagcucucucugacgcugggacuguucucuuuucuagagcauauguaagccuggcuuauucacaggagugacucaugcccugggacacaaggccuugucuagugucacaaccccuuuaggcaacuagauccuugucuuugaguauaaaugcuucaggagaaacagcaaugauaaccaggugggucaacuuguuuuuagccacaucaaagaaggaaggcaacaggggcuggagggacaaaggaccccguguguuggaauuccaaccuguaugacgcuguaugucuuggguaugggaacugauaaauuuacucuuccuuggccugguuugauuuggguuucuguaacugcaggugaggcauuccuaugcugugguuggccuaagugugagagauuuaggggaaggaguguagaguccugagaagaugcagacaggagucaucuucuaugccaaggcaucucacacuuucuaccaugcgcuucuuaauagcauacuccauucauaauauccuacuugugccauccccacaacagaggacuuguuagggaggaagggaggaggaugccacuaaaaucagugcccuagaucaggguuguggaaucaggagaaguaggucagguggaacccauccuccagacuucugagaccuaagaacauaguggauuuucccacaaaaguggauguugauggauggauguuguuaaugcuauugaaaucaagucucucagagauucuuguaacuauagagaccacaaaccacuugccuauggguuggcuuccucagguugguugauugguuggugugccggcauucaaaagcagaaagagauuaaaacucuauagauuuuaugccccugguauauccagauuaauccccucuuuugcccaaguauaugaucugccgaugugaggucccacucccacaaaacaggaucagcagacauagaguaguggcuagcuucuuuggccagcacauggcccucccauuggccacaguccucacccaucuugggaccucuccagcauggacaggaguugccuuuuguaacacuugugguuuuaucuuacgguggagaaauaacucacuauugauaguggggaaauaggagaaagccccaaaguuuuaaauaucaagccagagaggcagguggauuucugaguuugaggcuagccuggucuacaaagugaguuccaggacagccagagcuauacagagaaacaccgucucaaaaaaaaaaaaaaaaaaaucaagccagugagacagcucaguggcugcagguacuuaccauggaaccugacaacugaguuc

SEQ ID NO: 11892 - RNA, 4036 nt, Mus musculus
gaacucaguugucagguuccaugguaaguaccugcagccacugagcugucucacuggcuugauuuuuuuuuuuuuuuuuuugagacgguguuucucuguauagcucuggcuguccuggaacucacuuuguagaccaggcuagccucaaacucagaaauccaccugccucucuggcuugauauuuaaaacuuuggggcuuucuccuauuuccccacuaucaauagugaguuauuucuccaccguaagauaaaaccacaaguguuacaaaaggcaacuccuguccaugcuggagaggucccaagaugggugaggacuguggccaaugggagggccaugugcuggccaaagaagcuagccacuacucuaugucugcugauccuguuuugugggagugggaccucacaucggcagaucauauacuugggcaaaagaggggauuaaucuggauauaccaggggcauaaaaucuauagaguuuuaaucucuuucugcuuuugaaugccggcacaccaaccaaucaaccaaccugaggaagccaacccauaggcaagugguuuguggucucuauaguuacaagaaucucugagagacuugauuucaauagcauuaacaacauccauccaucaacauccacuuuugugggaaaauccacuauguucuuaggucucagaagucuggaggauggguuccaccugaccuacuucuccugauuccacaacccugaucuagggcacugauuuuaguggcauccuccucccuuccucccuaacaaguccucuguuguggggauggcacaaguaggauauuaugaauggaguaugcuauuaagaagcgcaugguagaaagugugagaugccuuggcauagaagaugacuccugucugcaucuucucaggacucuacacuccuuccccuaaaucucucacacuuaggccaaccacagcauaggaaugccucaccugcaguuacagaaacccaaaucaaaccaggccaaggaagaguaaauuuaucaguucccauacccaagacauacagcgucauacagguuggaauuccaacacacgggguccuuugucccuccagccccuguugccuuccuucuuugauguggcuaaaaacaaguugacccaccugguuaucauugcuguuucuccugaagcauuuauacucaaagacaaggaucuaguugccuaaagggguugugacacuagacaaggccuugugucccagggcaugagucacuccugugaauaagccaggcuuacauaugcucuagaaaagagaacagucccagcgucagagagagcugaagauacacugcaugcuggcuguacaaaugugagacguggaaccuuugaagaagagggccagaggauaauuaaauacgugauuucugucuacauguacgccagacucauaucagauuuaguugccaaagaucauccauuguucacccaacuucuguaagcugguagaagcuugccaacuccaguacuagcguacugucauugcagaacaaacauauccaguuugguacacuuugauuggguguucaagcccaggacacuccucaaugcaggcaaugaaagcagcucucuaguucugugggcaacacuccugugcccucgcaggguagaaccauaguagggauuugccauagucaguaugucauccaacugaacagacauguucuuaggcauccaguaauagaauuauaucccucuuugacccucuauaaguuuuauuuauuuguuuaaaaauucuauucuuuaggugugagguguuuugucuggauguauguuucugcauuguguucaugccuacuccccucagaagccagaagguggcacuugguccccugaaacugggguuacaaaugguuguaagccaccaugugggugcugagaauugaagccagguccucuggaagagcagccagugcucuuaaacacugaccuaugucucuagcuguaacacccuguaaauuuuaaaguugaaccagaacucccuggaguucuugggcagccaccgauggaaguuuguggugagaauggugugugugugugugugugugugugugugugugugugugugaucauuucauuccauguacgugaaaguaagacaagcuucuccauacugagcacaaccaaacucucugagaguagaagggcaagugaaauaccagccaguccuuagaaagaaugcacuaagugccaaagcucuuuucauggauuauuuuaauugucagauaucuuguggggcaacauaucuguucagugggcaccaggcacaacauccccguaauauagguucuaucaccgucucucuaacuugccaaagguaacauauauaaaaaauugacaguuuacaccugggaagugcaaucauaaagccuugaugauucauucauucauucauucauucauucauucauucauucuuacuuacacuccuuaaucagugauguccagugccuccuacauguuaaggaugguucuuggugugcaagcagcagccacauuugugagcaauggaaggaagaguacacgaugcucacauucuagaagaaaagaaauagugugaguuccacagguacacgaaauuuuauuuaaguugguguggcagcuuacaccuuucaugccuguguuugggaagccgaggcaggaggauucccuugaguauguggccaguuugggcuacugagugaaaccuugauccaaaaggcccuuuguccccccaaauaaaacaucaaaacagugaauagcguuagugccuagaagaggguugugcguguguguguuuguguguuguguguguguguaagauucuaaauugggugucgagucuugcuaagaaggcaacauuaaauaaagaucuaagggggacuggcgagauggcuuagcagguaagagcacugacugcuuuucugaagauccugaguucaaaucccagcaaccacaugguggcucaugagaucugacacccucuuuuggugcgucugaagucagcuacaguguacuuauguaauaauaagaaauaaaucuuugagccggagcaagcagggacugagcgagcagagguccuaaaauucaauucccaacaaccacaugaaggcucacaaccaucugaacagccauaguguacucacauacauaaauaaauaaauuuuggaaaaaaaaaaagauguaaggaauguacucaggaguaaaccauaaagaugucugaaugaacacaagucguggaacagacaauuggaccagaagcagcagcagaagagcauuuuaggaaaggcaaggaguccagaaugccugagacugaggcugacuggggcaagagugggcuaugaguauaaauaggccugggacucaaggguguaggaaacaagauccgaaagguaagugggaauggauccugaaagacccugcaaguggcagggcuucgucuuuuauuuggcugcaauguagucauuuggguugggccagaagaaaacaacccaguuuccacacgugaacucuugcuucucugucgaggagaggcugcaaaggggcgaggaagccauggaagagacacagcagugaccggggcagagguuaggcuaguuugucccggugugcacuagauguguggcaagcacuucaagucuaagauuguugugaaaccucgaguggaaggauuggucgacggguguguaugggagcaauuggucgugugaugcccugagccuuuuagcccuagcgacugaacugggaucccuggcaggagaggcagggcaggugcagaggaacagcaugcuuuuguucuaagugggagggguuaucagggcucaguucagggauguuuaauuagaaauaccuauuaggcgucuccaaaggugaugcugagagcucaggagagggguccuucaaugccgaaguucaaggucaacaagauacgcucuacuucagggcaacugaagacauugauucacacaugacuuuggcaaaaugaugauuaucaaacacacaaaccaaaaccaaaauaaauaaauaaauaaac

SEQ ID NO: 11893 - RNA, 1054 nt, Mus musculus
cauaguaggcccccacuucagaugagaaaaaagaacaaccaaaauagauggagugcauccuuaagucaggaaauggaaaccuuuuucuuaucuuccuucuggcuuccaucccuuuaacucuucaucuuacacuuugaugugccucuuggcuuacucuugugauucacuccacucuugggccugugacucaaaggagccuggcucucgugaaguuuuuccuugaucccuugugagucugacccccccacuacauguagaaucggguaaagagcaaaagaucaccugauccucaaacccacgugaguucuuucaacguccuggacuuuuggguucaccccuuaaauaggucacaguguaagugagagggccucagucuaaggauaauuccaaaaggggugagaccucgugggagaacacaaagagaagcuuuguagacacuugggaaguaucguuccgaccacuuuggaagaucucagcuaacaucacagaagaggggacccugaucaagacccuugguagauacuaguaugcugccgcugcuguugcugcugcuguuuggaacaccagugcacgugccauggugcacguguggaguucagaggagucagcucucuccuuccacauuuauuuaugugaguuccagggaccaaaccggcucgccaucuuguccagcaaggguuuuauguacugagccaucucuguagacuuccucuacacuuucgcuuucucguuaaguguuaugaaaaagggggucagguugagugugcuauuaagcuuucuucucaggcuggagggaugguucauucaguaaaauguuugccuuguaagcacaagagccugaguuugacacacacacacacacacacacacacacacacacacacacacacacaugugcccccaaagacuccuucacguguuugucccagcaaaacaccauccaacacaacugacucuccaaagaacccuuaaguuuccacuucacaggggaguucuugggguucacuggcaacccagacaaaccuacuugaugaguucugugccaaugagagac

SEQ ID NO: 11894 - RNA, 1054 nt, Mus musculus
gucucucauuggcacagaacucaucaaguagguuugucuggguugccagugaaccccaagaacuccccugugaaguggaaacuuaaggguucuuuggagagucaguuguguuggaugguguuuugcugggacaaacacgugaaggagucuuugggggcacaugugugugugugugugugugugugugugugugugugugugugugugucaaacucaggcucuugugcuuacaaggcaaacauuuuacugaaugaaccaucccuccagccugagaagaaagcuuaauagcacacucaaccugacccccuuuuucauaacacuuaacgagaaagcgaaaguguagaggaagucuacagagauggcucaguacauaaaacccuugcuggacaagauggcgagccgguuuggucccuggaacucacauaaauaaauguggaaggagagagcugacuccucugaacuccacacgugcaccauggcacgugcacugguguuccaaacagcagcagcaacagcagcggcagcauacuaguaucuaccaagggucuugaucaggguccccucuucugugauguuagcugagaucuuccaaaguggucggaacgauacuucccaagugucuacaaagcuucucuuuguguucucccacgaggucucaccccuuuuggaauuauccuuagacugaggcccucucacuuacacugugaccuauuuaaggggugaacccaaaaguccaggacguugaaagaacucacguggguuugaggaucaggugaucuuuugcucuuuacccgauucuacauguagugggggggucagacucacaagggaucaaggaaaaacuucacgagagccaggcuccuuugagucacaggcccaagaguggagugaaucacaagaguaagccaagaggcacaucaaaguguaagaugaagaguuaaagggauggaagccagaaggaagauaagaaaaagguuuccauuuccugacuuaaggaugcacuccaucuauuuugguuguucuuuuuucucaucugaagugggggccuacuaug

SEQ ID NO: 11895 - RNA, 589 nt, Mus musculus
guauugguuacuucucuguugcugugaccaaaacaccauaacuuaaagaaggaagaguuuauguaggggcuacagucccagaggaggagaaaugguaucagaagaccaaaacaggaagcuaagaaaucauagcuucaacuguaaacacaaaguagaaagcaaaaauguacggaugaagcuaugaacccucaaaacuguccccaaugacauauuucuuccaacaaggcuguuuuaccccacuaaacaucucuacaaccaaguauucaaguaccugagucuauggggaccauucuuauucaaaccauaauagugagagaccaugucucacaaaguaagauggagagcaacugagcaggaaacuugacuucaaccuccauuccucaugcaugugcacacacucacacacacacgcacacgcgcacacacacacgcacacgcacgcacgcacacccaagcauauaaacauuugcacacauauacaaaaugugugcaugcacacaacacacacacacacacacacacacgcacacacacacacuacaaaauagcauaaaagguuaauuuaaaaagaugaucacggggcugguga

SEQ ID NO: 11896 - RNA, 589 nt, Mus musculus
ucaccagccccgugaucaucuuuuuaaauuaaccuuuuaugcuauuuuguagugugugugugugcguguguguguguguguguguguguugugugcaugcacacauuuuguauaugugugcaaauguuuauaugcuugggugugcgugcgugcgugugcgugugugugugcgcgugugcgugugugugugagugugugcacaugcaugaggaauggagguugaagucaaguuuccugcucaguugcucuccaucuuacuuugugagacauggucucucacuauuaugguuugaauaagaaugguccccauagacucagguacuugaauacuugguuguagagauguuuagugggguaaaacagccuuguuggaagaaauaugucauuggggacaguuuugaggguucauagcuucauccguacauuuuugcuuucuacuuuguguuuacaguugaagcuaugauuucuuagcuuccuguuuuggucuucugauaccauuucuccuccucugggacuguagccccuacauaaacucuuccuucuuuaaguuaugguguuuuggucacagcaacagagaaguaaccaauac

SEQ ID NO: 11897 - RNA, 1279 nt, Mus musculus
acaacucgguacuaaaaaauaaaaaaugaaaaacaccaucuucucaugauuccaauagaagcacuauuaauauucugcuaugcuuucuuuuuaguuuuauuauauuuacaaauuuuaguuacuuguuaaguuuauuuucaaguaucauugugauaaugaauuaaguuuaccuuucauaaauggaacaguauuuucaaauaagcauauggcaaauuacugagacgauucaaauguucaacaagugaaaccauuaagccuguaagcucaaaaauguggacuguaacuaauuauaaauucaagcuuccaagugagaaaguauaaagcagaaaaacauacuugucacuuaugacuauaaguucacaguacuuaaagacuuuucauaaauugauaugacauuaacaagugugacuuugauacaguguaacagaaagauguuagcaacucaguaaaccagcacuuuucaacccauuuuuuguagaaaauaaucacacacagguaaaaggcccacucguuccaagagagaaccaagaacuuuaugaagcagaauacaaaacuucacugacaguggcaacuacugcauuacuacuugggcucagagggcagggagccugagagaccgcaugaggaacagaguucggauacccagcgcccauacaaaggccaggaauacuaacauucacagggaaccuggggagucugggggaguggggguagcggcaaauucuaggcacacggaaaagcuaauuuagucaggacacaaacuccaucuucagugagagacauguucuccaaauagaaguuggaaaaggaggaagaaagauacucaacauccacacacucacauacuuuaguugaacaaccugacagguggaguuuggucuucagaagcuauauaaaaagcuagauguaguggguacauuuaugacagaaacacuacugcaagaugagaggcagagacagcagacccaggggaggaagugggccagcuaggcuggaguacgcaggacagccaggagagaccagaugagcacugcuccaggucaucgccugccaugacacuuaaguauacgugcacgcacaggcacuacaguuuaaaguauuuuugccauauagaaagcucacagacacuacauuuuauaaguacugugccauguacaaagcucauuauuauuucaaaugaauaauuuuaaauguuuucaguuuuaguuacuaaugugauguuuaaguguauacuaacacauuaaccacaucagccagccagccacaccuacacagcaag

SEQ ID NO: 11898 - RNA, 1279 nt, Mus musculus
cuugcuguguagguguggcuggcuggcugaugugguuaauguguuaguauacacuuaaacaucacauuaguaacuaaaacugaaaacauuuaaaauuauucauuugaaauaauaaugagcuuuguacauggcacaguacuuauaaaauguagugucugugagcuuucuauauggcaaaaauacuuuaaacuguagugccugugcgugcacguauacuuaagugucauggcaggcgaugaccuggagcagugcucaucuggucucuccuggcuguccugcguacuccagccuagcuggcccacuuccuccccugggucugcugucucugccucucaucuugcaguaguguuucugucauaaauguacccacuacaucuagcuuuuuauauagcuucugaagaccaaacuccaccugucagguuguucaacuaaaguaugugaguguguggauguugaguaucuuucuuccuccuuuuccaacuucuauuuggagaacaugucucucacugaagauggaguuuguguccugacuaaauuagcuuuuccgugugccuagaauuugccgcuacccccacucccccagacuccccagguucccugugaauguuaguauuccuggccuuuguaugggcgcuggguauccgaacucuguuccucaugcggucucucaggcucccugcccucugagcccaaguaguaaugcaguaguugccacugucagugaaguuuuguauucugcuucauaaaguucuugguucucucuuggaacgagugggccuuuuaccugugugugauuauuuucuacaaaaaauggguugaaaagugcugguuuacugaguugcuaacaucuuucuguuacacuguaucaaagucacacuuguuaaugucauaucaauuuaugaaaagucuuuaaguacugugaacuuauagucauaagugacaaguauguuuuucugcuuuauacuuucucacuuggaagcuugaauuuauaauuaguuacaguccacauuuuugagcuuacaggcuuaaugguuucacuuguugaacauuugaaucgucucaguaauuugccauaugcuuauuugaaaauacuguuccauuuaugaaagguaaacuuaauucauuaucacaaugauacuugaaaauaaacuuaacaaguaacuaaaauuuguaaauauaauaaaacuaaaaagaaagcauagcagaauauuaauagugcuucuauuggaaucaugagaagaugguguuuuucauuuuuuauuuuuuaguaccgaguugu

SEQ ID NO: 11899 - RNA, 222 nt, Mus musculus
gaaugugagccauacauauaagucuaaagacaugaagcugcaucuacccuuuuguccccacacucauguccaggaaacaaggacaacaagcuuccacacuaugagaaacaaaguuuugucaaugcaaccaugaucugugauggaggaagaagccuucagauccccgccucaugcccucgccuaugucucgauugacacaguauucaucccuccagcuggcgc

SEQ ID NO: 11900 - RNA, 222 nt, Mus musculus
gcgccagcuggagggaugaauacugugucaaucgagacauaggcgagggcaugaggcggggaucugaaggcuucuuccuccaucacagaucaugguugcauugacaaaacuuuguuucucauaguguggaagcuuguuguccuuguuuccuggacaugaguguggggacaaaaggguagaugcagcuucaugucuuuagacuuauauguauggcucacauuc

SEQ ID NO: 11901 - RNA, 724 nt, Mus musculus
caaccacaaacugcuuuuugauauuaaaaaagagaaagaagacagggucaagaacaaaguguguguggggguggggugagggugggaggggagagaaguaagggcuuaaaaauuguccucaagcaaugccgaaccaauuagagcugaaauagcgccaguuaaagggaaucagcaaaagacaggacgaugaugggcucaguacacuucucauucuuccaagaguuuaccaaugugaucuaucacacuuuagagugauuaucugaugauacuaagguagauuaaauuacuauagacuacagggcugacugcaggagagggggagaaaagacugagagcagagaaccugggggagcugcucaguuugugucuccuagaaaggacagggaagcgucauccaagacaccuuguugacauggcugccuaagccucacgugaacaaaaggcaaugcuaauauggcaggaagaaacuucacagacccucagaucuacacaaagagcucggagcaccgaaggaggguagagagugggaagacagucucguucacggcugaccucuaacuggucaucacugccgagcagccggcccuggaaucauacagacacauacgacuuguuuacauguaugcgugauguuucgguaacacuaacacagaaaaggaggcuaugauuuacgagggagugggggguuguugugagagggacuggaaggaggaaaagggaaaaa

SEQ ID NO: 11902 - RNA, 724 nt, Mus musculus
uuuuucccuuuuccuccuuccagucccucucacaacaaccccccacucccucguaaaucauagccuccuuuucuguguuaguguuaccgaaacaucacgcauacauguaaacaagucguaugugucuguaugauuccagggccggcugcucggcagugaugaccaguuagaggucagccgugaacgagacugucuucccacucucuacccuccuucggugcuccgagcucuuuguguagaucugagggucugugaaguuucuuccugccauauuagcauugccuuuuguucacgugaggcuuaggcagccaugucaacaaggugucuuggaugacgcuucccuguccuuucuaggagacacaaacugagcagcucccccagguucucugcucucagucuuuucucccccucuccugcagucagcccuguagucuauaguaauuuaaucuaccuuaguaucaucagauaaucacucuaaagugugauagaucacauugguaaacucuuggaagaaugagaaguguacugagcccaucaucguccugucuuuugcugauucccuuuaacuggcgcuauuucagcucuaauugguucggcauugcuugaggacaauuuuuaagcccuuacuucucuccccucccacccucaccccacccccacacacacuuuguucuugacccugucuucuuucucuuuuuuaauaucaaaaagcaguuugugguug

SEQ ID NO: 11903 - RNA, 421 nt, Mus musculus
guuguuuuccaaguuuuuguagaaggaccugaguaacugaauucuuagguugucagaaauaauuauuuucuuaaaagaucugaaacuauuguuuucagguuucuuaugucucaggaaugacaauuuuucuuucuuucuuugaugggcagaauaauuauuuuaaaauaucaaguuggaaaaggccuggugaugcaggccuguaauaaaucccagcuaccuggcaauuugagcgagguuaaggccaaccuggaucuucucucaaaaccuaagagggccaaggccagcgguggcaaagcacuggccuacugugugugaaguacugggucaguuccuacuacaaugcaaaaaucaguaacuaaccaaaauuacaacguuccauguuaaagugggccuuugagauuuguaucaucacaacaacgaa

SEQ ID NO: 11904 - RNA, 421 nt, Mus musculus
uucguuguugugaugauacaaaucucaaaggcccacuuuaacauggaacguuguaauuuugguuaguuacugauuuuugcauuguaguaggaacugacccaguacuucacacacaguaggccagugcuuugccaccgcuggccuuggcccucuuagguuuugagagaagauccagguuggccuuaaccucgcucaaauugccagguagcugggauuuauuacaggccugcaucaccaggccuuuuccaacuugauauuuuaaaauaauuauucugcccaucaaagaaagaaagaaaaauugucauuccugagacauaagaaaccugaaaacaauaguuucagaucuuuuaagaaaauaauuauuucugacaaccuaagaauucaguuacucagguccuucuacaaaaacuuggaaaacaac

SEQ ID NO: 11905 - RNA, 159 nt, Mus musculus
gcuauccucugaacaggguggcauuuauaguuuuaaauaaacauaggagauaauaugaucgacugaaggucuguagaucucaggagugauggauccuuuccaugguccuguuugcagugaagaacauccauggucgcucaaagcacagauguggaccug

SEQ ID NO: 11906 - RNA, 159 nt, Mus musculus
cagguccacaucugugcuuugagcgaccauggauguucuucacugcaaacaggaccauggaaaggauccaucacuccugagaucuacagaccuucagucgaucauauuaucuccuauguuuauuuaaaacuauaaaugccacccuguucagaggauagc

SEQ ID NO: 11907 - RNA, 1144 nt, Mus musculus
ggagugggguugucagguuuccauggcagcuaccugggcauuuaaagggucuagcccgugguugagaagcuagaaaagugaacacagacauccccaucaucaguuuuguauuaccuaagcaagcucuauuaagaaugaguggcgggggccucucuucccagugauggccagggaaugccagggccaagaagcgggaguggguggguaggggagcagggcggggggagaauauagggaacuuucaggauagcauuugaaauuugaaauguauauaaagaaaauaucuaauaaaaaaaagaaugaguggcaggaaaguaaacguuuuuuugcugcuuacacauccaacuucacuggcaauccaccaaccugugccaacccaugaaccuccgacucccagaaggaaaaccucgaccuauuauuuugacugcagcagacagauugcuaaauacuuauguggguuuuguaagaauaaaacuccaagaagaggaaccuugcauuaagaaaaacacacacauacacacacauaugcacacauaccuccaccugcacacacagguacacaggcucaugcaugcacacacuugcauacauacacgcacacaugcacucauaccugcaccugcacacccagguacacagacucucucucacacacacacacacuacacacuauacugagauaaaacacugaagcaguaauccagaguuuuccauacgcauagugaucuuccugucuuaccugaauuaccagcaaaauuguugucauuaccucacagcagcagaaaaauauaggaaaagauuugaguuuaugcaucuuacaugaacuuuuuauuuggaaaauauaaugccaaugcuguacucucuugauuuggauacaaaguguuguuacuguauaauacgaaggcaucgaaaugaugacaccccaggauauaaugacuguuucuagaugugaugacaugacuaaccacagacagcaguaaucuuguguuaguuucacucaugcaauagcuuuacagcuucuuauaugguacauuuuaacuuuguaaagucaugcaguuaugaaagcaauauuuguacaaaugcaaagcaagaucucucuuacauacuguugauaagaacauguugauuguacauuaaguauuaa

SEQ ID NO: 11908 - RNA, 1144 nt, Mus musculus
uuaauacuuaauguacaaucaacauguucuuaucaacaguauguaagagagaucuugcuuugcauuuguacaaauauugcuuucauaacugcaugacuuuacaaaguuaaaauguaccauauaagaagcuguaaagcuauugcaugagugaaacuaacacaagauuacugcugucugugguuagucaugucaucacaucuagaaacagucauuauauccuggggugucaucauuucgaugccuucguauuauacaguaacaacacuuuguauccaaaucaagagaguacagcauuggcauuauauuuuccaaauaaaaaguucauguaagaugcauaaacucaaaucuuuuccuauauuuuucugcugcugugagguaaugacaacaauuuugcugguaauucagguaagacaggaagaucacuaugcguauggaaaacucuggauuacugcuucaguguuuuaucucaguauaguguguagugugugugugugugagagagagucuguguaccugggugugcaggugcagguaugagugcaugugugcguguauguaugcaagugugugcaugcaugagccuguguaccugugugugcagguggagguaugugugcauauguguguguauguguguguuuuucuuaaugcaagguuccucuucuuggaguuuuauucuuacaaaacccacauaaguauuuagcaaucugucugcugcagucaaaauaauaggucgagguuuuccuucugggagucggagguucauggguuggcacagguugguggauugccagugaaguuggauguguaagcagcaaaaaaacguuuacuuuccugccacucauucuuuuuuuuauuagauauuuucuuuauauacauuucaaauuucaaaugcuauccugaaaguucccuauauucuccccccgcccugcuccccuacccacccacucccgcuucuuggcccuggcauucccuggccaucacugggaagagaggcccccgccacucauucuuaauagagcuugcuuagguaauacaaaacugaugauggggaugucuguguucacuuuucuagcuucucaaccacgggcuagacccuuuaaaugcccagguagcugccauggaaaccugacaaccccacucc

SEQ ID NO: 11909 - RNA, 3130 nt, Mus musculus
aaacucagcagccacccucacugguggcugugcguggacucccuaucaauagcucaucucaauuauagcaagcaaagaaaacaaaagcucaucugaaccaggcagugguggccaugccuuuaaucccagcacucgggaggcagaggcaggcagguuucugaguucgaggccagccuggucuacaaagugaguuccaggacagcuagggcuacacagagaaacccugucucgggggggggggggggggggggaagaagcucaucugcucaucacguauaauauguauacaccaaucauuucuacacgcgugugucaugagaauugaaugagaacauuccagggcaguaaaugcuauuccuagccuggugcacauaaauaaauaaacaaauaaacaaacaaauaaauaaauaaauaaagucuuuccugaggcgaaaguaaacagguuuuuuuuuuuuuuuuuuuuuuuugaccugguuaauuacagauacuugucuauguucuguugugaaugucagcauucaguaacuuaccuuaacaauaucgagccuguuguugcugauuguuaguauuuuggcucuaugaguuguuuuguugcuuuguuugucuuagagagcuauuucaucaggaccugagaaagcuuagcccucagaagugcuuauagugagaccacacaaugacaugcaacaucacucagacucgugaguauucuccaucccccuuugguuaggagcuuccacggaugacauaaaaaggaaauuuagcauugcagaugauccugugaaacaaguauaucuggcaguguggcaauuguuugagguacuagaaaguguuaguuagccccgcuuuacucuguuacaaacaucucuuguaaaggugaagaaaaugagcugaagaacaaagucaacauuccauagacugagguagucaggaaacauggucagggaaaugggggacucaguuagaugcaacccaggacagcuaagacggggccuggcucugcaugucuuugauuugaccaugucaccacaaagaaauuccaaagagacaagccuccuagaccaagcugaugcagauuucaggcauacaguaaagggccauccaccaagggucucucucagggcugucuuugcugcagcaccgaaugcccuacagagcuaguaugcugcagcuucccaaagucaggguggaccggaagacccucccgccccuuucagacacauauucugccugauacaaaacaaccacucaguccacgauaccuguguuguuuuccaacuaucuuaaagauuuucaaucagaaauucuacaagcaagaaaaacacaugacauucccaacuacggaaauguauauccauaccaccauacacaaguguuuauagcuacuuuuuauucaucgugaauaaugaaucugcuuuaaagacaggcuguugaguucgagaccagaauuuaguuucuccuugucugcagcauuccaugcuggcaucaagagggccuccuuuaauuaggaaggacacaaguggaaaagaacguaauugggcugagguuuuaaugccuggcuuugccaggcucucuuacugcagacccgaggcacuggcccaagcauuccaccaggcuccacccaaacccaccagcuggacgaggaaccacgggacguuagaaucagaguaacuuuggccaacaaucugagacacuugggagaaaauucauucuaaaucuaacagcuuccugcucucaggaaggccucugggcuuccggugccucugguccuccuucccggcucuucuguggaggcuagcuuccuccaagcugaccccgagggagccgccuucucguagguggaaagcgaagagaagagagcggguaagcaguggagacacauuggcuguacucaggaccuguaccagagguggcaggaggacaccaccgagcccugcuccacccaucgcagccucgagacccucugcgcggggaugcugaccccugcuggccaccugagagauugcagcguggccgacucccaaggggcggcaaguguaaggguaaggguaaggagauggggaugggaaagggguugcuguguaguaagcgugggugguagaagacuagggccaggauguugggcaccaucagaggccccuccaccacccgguggcugcccaagugcuguccgcuccucuuguuucuaggaaaaagagugagaggagccguaagggcuauggagcccaaaucagcaugccucuaggaccuaccugagccuccagaagaccccucaacaggaaccguuguccgaaccaaccaacuccaaaccuaaaccucagaggccuccucaugcagacagauugcugaccuaucucugggguagucagcugaaauaccccagagauauucacggccuaaucccaggaaguuucuuuaaauggcaaaagaaaccuagaguguguuacccucgauuauuuagguagauucuacauguaaucagguauaucaccaaaggggaagugagguaaaggaauauuuauuucacuacagaacagaaggcaagccaucuugcaggaggaccugaggagagaaggagagagucaggagagaacagauucccucuacagugcccagagucuccccugacugauuuggacccaaugaaauuccaaacucuggugucaagaacuuuaaaagaauaaaugugugcuguuuugagguauugaguuuguagcuuuuuuaaaaaagcagcagcacugagguaauguguugcuucccacucaguagugaguucuuagaauuaaguggcuaaugaacaagacaaaccccauuuccauccccagggaguuuuaucugccaucuccugagcuuuaaaauauugcuggcaaauucuuagauaggguagcagagaagacaaggaacacaucaaaaagacuagcccguagacaugcaacaaacaaacaaacaacagcaacgaagaacagauuucacaccugcugggcagcuacagucaaagugacaggggcaagcaguuucuuguuuguuuguuguuguuuguuuauuuugcuuuuuugaugacuuggagaagcccaguccgcacacacuguuggagggacucuauggcauacccaaccuggaaaguagcuuggca

SEQ ID NO: 11910 - RNA, 3130 nt, Mus musculus
ugccaagcuacuuuccagguuggguaugccauagagucccuccaacagugugugcggacugggcuucuccaagucaucaaaaaagcaaaauaaacaaacaacaacaaacaaacaagaaacugcuugccccugucacuuugacuguagcugcccagcaggugugaaaucuguucuucguugcuguuguuuguuuguuuguugcaugucuacgggcuagucuuuuugauguguuccuugucuucucugcuacccuaucuaagaauuugccagcaauauuuuaaagcucaggagauggcagauaaaacucccuggggauggaaaugggguuugucuuguucauuagccacuuaauucuaagaacucacuacugagugggaagcaacacauuaccucagugcugcugcuuuuuuaaaaaagcuacaaacucaauaccucaaaacagcacacauuuauucuuuuaaaguucuugacaccagaguuuggaauuucauuggguccaaaucagucaggggagacucugggcacuguagagggaaucuguucucuccugacucucuccuucucuccucagguccuccugcaagauggcuugccuucuguucuguagugaaauaaauauuccuuuaccucacuuccccuuuggugauauaccugauuacauguagaaucuaccuaaauaaucgaggguaacacacucuagguuucuuuugccauuuaaagaaacuuccugggauuaggccgugaauaucucugggguauuucagcugacuaccccagagauaggucagcaaucugucugcaugaggaggccucugagguuuagguuuggaguugguugguucggacaacgguuccuguugaggggucuucuggaggcucagguagguccuagaggcaugcugauuugggcuccauagcccuuacggcuccucucacucuuuuuccuagaaacaagaggagcggacagcacuugggcagccaccgggugguggaggggccucugauggugcccaacauccuggcccuagucuucuaccacccacgcuuacuacacagcaaccccuuucccauccccaucuccuuacccuuacccuuacacuugccgccccuugggagucggccacgcugcaaucucucagguggccagcaggggucagcauccccgcgcagagggucucgaggcugcgauggguggagcagggcucggugguguccuccugccaccucugguacagguccugaguacagccaaugugucuccacugcuuacccgcucucuucucuucgcuuuccaccuacgagaaggcggcucccucggggucagcuuggaggaagcuagccuccacagaagagccgggaaggaggaccagaggcaccggaagcccagaggccuuccugagagcaggaagcuguuagauuuagaaugaauuuucucccaagugucucagauuguuggccaaaguuacucugauucuaacgucccgugguuccucguccagcugguggguuuggguggagccugguggaaugcuugggccagugccucgggucugcaguaagagagccuggcaaagccaggcauuaaaaccucagcccaauuacguucuuuuccacuuguguccuuccuaauuaaaggaggcccucuugaugccagcauggaaugcugcagacaaggagaaacuaaauucuggucucgaacucaacagccugucuuuaaagcagauucauuauucacgaugaauaaaaaguagcuauaaacacuuguguauggugguauggauauacauuuccguaguugggaaugucauguguuuuucuugcuuguagaauuucugauugaaaaucuuuaagauaguuggaaaacaacacagguaucguggacugagugguuguuuuguaucaggcagaauaugugucugaaaggggcgggagggucuuccgguccacccugacuuugggaagcugcagcauacuagcucuguagggcauucggugcugcagcaaagacagcccugagagagacccuugguggauggcccuuuacuguaugccugaaaucugcaucagcuuggucuaggaggcuugucucuuuggaauuucuuuguggugacauggucaaaucaaagacaugcagagccaggccccgucuuagcuguccuggguugcaucuaacugagucccccauuucccugaccauguuuccugacuaccucagucuauggaauguugacuuuguucuucagcucauuuucuucaccuuuacaagagauguuuguaacagaguaaagcggggcuaacuaacacuuucuaguaccucaaacaauugccacacugccagauauacuuguuucacaggaucaucugcaaugcuaaauuuccuuuuuaugucauccguggaagcuccuaaccaaagggggauggagaauacucacgagucugagugauguugcaugucauuguguggucucacuauaagcacuucugagggcuaagcuuucucagguccugaugaaauagcucucuaagacaaacaaagcaacaaaacaacucauagagccaaaauacuaacaaucagcaacaacaggcucgauauuguuaagguaaguuacugaaugcugacauucacaacagaacauagacaaguaucuguaauuaaccaggucaaaaaaaaaaaaaaaaaaaaaaaaccuguuuacuuucgccucaggaaagacuuuauuuauuuauuuauuuguuuguuuauuuguuuauuuauuuaugugcaccaggcuaggaauagcauuuacugcccuggaauguucucauucaauucucaugacacacgcguguagaaaugauugguguauacauauuauacgugaugagcagaugagcuucuucccccccccccccccccccccgagacaggguuucucuguguagcccuagcuguccuggaacucacuuuguagaccaggcuggccucgaacucagaaaccugccugccucugccucccgagugcugggauuaaaggcauggccaccacugccugguucagaugagcuuuuguuuucuuugcuugcuauaauugagaugagcuauugauagggaguccacgcacagccaccagugaggguggcugcugaguuu

SEQ ID NO: 11911 - RNA, 1008 nt, Mus musculus
uuuagaaaauggucuauuuauuacaucaacaaaaaucacaguauacaaagauauuacaaaaguaacacaauaugcuauauaauaaaaggcaucuugacauuaaaaaaauauuucaucuugauacaaagcuuaacuucuuaaguaccaguaucuugagaacuuaaaaaaaaauaauuucaucagagccuugaaauucauucaucaucaagcauauaaaaucaguuugaaaugcagacaacuuagugguagagagcuaacaccaaccauaacuuguaugagacccuggguucaaucccagcaugaugcuccccuccucucugaaaucuaaauauuuuacauuaggugagguguggugacauaugccuacaauccuaguacucagaagggagaggcaggucaauauucaauuuaaggucaaaacaacagcaaagauuccccuguuuuguaggggucuauuaaccauagccaauaguguuuuaaaguucucuggugacugacuagcugaggucucccucaagcaucccuccugccucauccuuccaaguauuggagcuacaggauauaucacuauggcugcuucacuaagagcagugaagucauaguuaucccaagaugccucagccuuacuuuacuccagcucaugagaaguuacauuuuggcuaaagaagcuuagaaaaaaauuaccauagguaaauuugguauuuuaccaaaaauuauaaagcugcuaaaaacucaauuuguugaggagucaacauuucuuuuuauuuuguuugugauucuuuuguuguuguauugguuuguuuuuggguuuguuguuuuuugagacaaguuuucucuguguauccccaucuggccugacacuuacuacagaguaaguguccagcccaaacuaacagaaaucugccugccucugcccccugggugcugguuuuaaaggaguguguuagugccaccuggcuuguuugugauucuuuaaaguucugaaagcuaaaaaaaauaaauaaaguc

SEQ ID NO: 11912 - RNA, 1008 nt, Mus musculus
gacuuuauuuauuuuuuuuagcuuucagaacuuuaaagaaucacaaacaagccagguggcacuaacacacuccuuuaaaaccagcacccagggggcagaggcaggcagauuucuguuaguuugggcuggacacuuacucuguaguaagugucaggccagauggggauacacagagaaaacuugucucaaaaaacaacaaacccaaaaacaaaccaauacaacaacaaaagaaucacaaacaaaauaaaaagaaauguugacuccucaacaaauugaguuuuuagcagcuuuauaauuuuugguaaaauaccaaauuuaccuaugguaauuuuuuucuaagcuucuuuagccaaaauguaacuucucaugagcuggaguaaaguaaggcugaggcaucuugggauaacuaugacuucacugcucuuagugaagcagccauagugauauauccuguagcuccaauacuuggaaggaugaggcaggagggaugcuugagggagaccucagcuagucagucaccagagaacuuuaaaacacuauuggcuaugguuaauagaccccuacaaaacaggggaaucuuugcuguuguuuugaccuuaaauugaauauugaccugccucucccuucugaguacuaggauuguaggcauaugucaccacaccucaccuaauguaaaauauuuagauuucagagaggaggggagcaucaugcugggauugaacccagggucucauacaaguuaugguugguguuagcucucuaccacuaaguugucugcauuucaaacugauuuuauaugcuugaugaugaaugaauuucaaggcucugaugaaauuauuuuuuuuuaaguucucaagauacugguacuuaagaaguuaagcuuuguaucaagaugaaauauuuuuuuaaugucaagaugccuuuuauuauauagcauauuguguuacuuuuguaauaucuuuguauacugugauuuuuguugauguaauaaauagaccauuuucuaaa

SEQ ID NO: 11913 - RNA, 102 nt, Mus musculus
cuuacucuacacuaagguuuuccaaauggagaacuaauuagcaaaagaaaaggauaggaagucagcaggcucucaaaaaucagaacagugguuuggaggugc

SEQ ID NO: 11914 - RNA, 102 nt, Mus musculus
gcaccuccaaaccacuguucugauuuuugagagccugcugacuuccuauccuuuucuuuugcuaauuaguucuccauuuggaaaaccuuaguguagaguaag

SEQ ID NO: 11915 - RNA, 286 nt, Mus musculus
gcagagagaggcagagcugcaccucucagcuguagcagcaggaccaagccuugcagagaagccugcuguuaaaagcuaaguguugggagcacaggcagaauagguuacaucuauagacaccugugggaauaaauucaacauguuccaacuacaacgucuaagaggaauaagguaucaaaaaaaaaaaaaccuuaaacauauggaaaagauauucacugaagaaaaagaauaaagauuuccaguaacagaaugggcagacacaggacacugaguaggcagacucaaa

SEQ ID NO: 11916 - RNA, 286 nt, Mus musculus
uuugagucugccuacucaguguccugugucugcccauucuguuacuggaaaucuuuauucuuuuucuucagugaauaucuuuuccauauguuuaagguuuuuuuuuuuuugauaccuuauuccucuuagacguuguaguuggaacauguugaauuuauucccacaggugucuauagauguaaccuauucugccugugcucccaacacuuagcuuuuaacagcaggcuucucugcaaggcuugguccugcugcuacagcugagaggugcagcucugccucucucugc

SEQ ID NO: 11917 - RNA, 1073 nt, Mus musculus
gcaacugcauacaaguuguuuuaugccaguguucaaucuggaaaacguuauaaaacuuugagcagacaauggcacgcuagugcagugcuugcugaagcaccauaugccuuucugauaaagauauaacuuuauugcuuuuuauguacucucuuguuuaauacaguaagcaaaugggagauaauuugaaauacuuuuaccaccguuuacagugucagaacaugcaacuuaccuuuaagaaugcaaaugauucauugcuggcauugugaagacaacaaaugcaucuuuuuuuuuuuuugagacaggguuucucuguguagcccuggccaaaugcaucuuaaaaacaaucacuugcauggugccgaagggaucagauucuuaggcucuucccucugugguaaugaagugggauggucuugugaacuguauucuuggagcaucugagccgggucaaauauaucuuugugaucucuguagguucuuucagaggcagggggugaaaagcuggcuccucugugcuugaaaagaaguauuuaaaauuccuuugggaagaagaaugauguuugauggcaaagaguccaaagauacaccccugguuuagcggguaaaauaguucuggcagagggagagggacuguggagucacagguaacaacagaucauugcacagugucuuucuucauggaacgguagcuuuuccuugcacugauauaccguagucuuauaacccugguucuugguagacagaaucugaggugcaugcauugcauccuuuugggagagcuggcagggaccaaugaagagaacacugaguugaggcggcauggcuuuuagacgcgguugugcuguuuccucugggauguaucuuguggucucugacccuuaccuauauuaauaugggaauagacugauugaaccucgugauguccuagcuacuucuuaagucuaacuuucuagagauguaaaugaugugugugugaucacguguccaacucguuagcauccauuuaaaugaauuaugucacauuuccagaacaccuucauauuuuuaaucuuauuuuuaacccucccacaaac

SEQ ID NO: 11918 - RNA, 1073 nt, Mus musculus
guuugugggaggguuaaaaauaagauuaaaaauaugaagguguucuggaaaugugacauaauucauuuaaauggaugcuaacgaguuggacacgugaucacacacacaucauuuacaucucuagaaaguuagacuuaagaaguagcuaggacaucacgagguucaaucagucuauucccauauuaauauagguaagggucagagaccacaagauacaucccagaggaaacagcacaaccgcgucuaaaagccaugccgccucaacucaguguucucuucauuggucccugccagcucucccaaaaggaugcaaugcaugcaccucagauucugucuaccaagaaccaggguuauaagacuacgguauaucagugcaaggaaaagcuaccguuccaugaagaaagacacugugcaaugaucuguuguuaccugugacuccacagucccucucccucugccagaacuauuuuacccgcuaaaccagggguguaucuuuggacucuuugccaucaaacaucauucuucuucccaaaggaauuuuaaauacuucuuuucaagcacagaggagccagcuuuucacccccugccucugaaagaaccuacagagaucacaaagauauauuugacccggcucagaugcuccaagaauacaguucacaagaccaucccacuucauuaccacagagggaagagccuaagaaucugaucccuucggcaccaugcaagugauuguuuuuaagaugcauuuggccagggcuacacagagaaacccugucucaaaaaaaaaaaaagaugcauuuguugucuucacaaugccagcaaugaaucauuugcauucuuaaagguaaguugcauguucugacacuguaaacggugguaaaaguauuucaaauuaucucccauuugcuuacuguauuaaacaagagaguacauaaaaagcaauaaaguuauaucuuuaucagaaaggcauauggugcuucagcaagcacugcacuagcgugccauugucugcucaaaguuuuauaacguuuuccagauugaacacuggcauaaaacaacuuguaugcaguugc

SEQ ID NO: 11919 - RNA, 17 nt, Mus musculus
caccccagcccccaccc

SEQ ID NO: 11920 - RNA, 17 nt, Mus musculus
gggugggggcuggggug

SEQ ID NO: 11921 - RNA, 2443 nt, Mus musculus
guggacugauugaagcggagcccgucagcacgagccuguggucccagcugaagcaggaggaggauuugaggacuuuggggccagccugggaacacagugaggcauguuuguaaacaaccaagacagcagagugcucccauuguuuagugcugggaugcuccacuucauaucgccagacugcaguugacuguggacaguccaaaugauagaaagccaaacugcucauaaauggggugacuguauuuagaaguuguuuugaagauauuaaguuagaauaaugucauaauggauuaagauggauccuaaaaccaauaaauccuuauaaaaaggccaagaaggacacagggauucagggaaaauguugugcugcaugccaagggacuucaggggcuguuggcagccggugauggaagccaagaagacagagaucuuccuugcagccuucagagagcacaguccugccccaaccuugauuucagaccuucugccuccauaauaguaagagaauggaugccugucauuuacagcuacccaguuuacagucagucauuauagcagucugggaaaaguagagguauugcuaggaaacacaccacagacagauaagcacgcagcuugcauucaugucugcuuccaugucuaucucuauauauuuccucuaugauaacccaaccuaaagcaguagcagaacuggcucauuuuugucuucuccaugucuguacaucugcucucccacaacacaaacuuggcucccuuuauuuguaacauagccacuaucugaccauucccccuuccccagaaggcagcaguuaccaccuuaugcucccucacacagcggcucugucucacucugcccugucucugacucccuuggcauuucagacagacacacuccucaccuccaaugcccagagcuaggugagccccugcauuguggggcuccuucucacccggcucugccucuaaucacacacgccggacugggcuagccugcacugauuuuaacguuauguaagcagcacguguugcccauuuccucccacaguuugcacugucacucagcaccauguuucggaccuucacccagacagacagauugacagacaggagucuguaacuacaguucacccaucugaacugcugcgaguauuuccugaugugagaccgccuugguggaaggacauucaacugccugcauuuuauuuuucugugacaucuauggacuugucucuggugcagagcucuuuuucuagggcauguccccagggacagcucugcugcaucauagggugugcauugccacaucagguacugccaaaauguuucccaaaaugguccauuugucauuccuuccccccacugcuucucucacccgcaggacagcugcugcugucacauaucucaguggcuuuacauuuggaccuguaaaauguugccugucugaugggguaaaacaauagcuaacucugauuuuauuuguaguuguccacccagugcccagugagguugagcaucccccacccagugcccagugaggccaagcaucccccccacagugcccagugaggccgaggccgaggccgagcaucucucccaguguugacuggcucacuggguuugcauuuuucaagaaaugccugcugaugucucucuucuaaaauuuuuauuuuuauuuuguaauuauuucacguauggguuuuaucugcacguaugucuaugucucuugccuggugccugcggaggccagaagaggguguuggaucccaggaacuggaguuggagucauggagaguugugagccacuaugugggugcugggaauugaaccccaguccucugggaaaagcagccaucacccuucacagauaagccagcucuccagccccuacuuuaaaaaaaaucucuuguuaagccaagcccuuuauauugaaauuuaaaaaugaacaauuuacuauaaaucuuaacaugcgauuuaauauagcauuaacaucugccagagcagcaaaugcucuuaacugcugagcugccucuccagccugcaaaacugauacugugaagagaauguuucuaacauacccuacuaagaacagugccugcagagcuagggagaggccacaguggauaaagcgcuugccccacaugcaagacagggguucagauucccagaauccauacugguuugucuucaucgucuuaaguggccacugucauaaauacaugaugcuuguaucucugaauuaauuuuucuuucuuucuuucuuucuuucuuucuuucuuucuuucuuuuuuuuuuuuuuuuuuuuuuuuuuuuuuuuuuuuuugagacaggguuucucuguguagcccuggcuguccuggaacucacucuguagacugggcuggcccugaacucugaucugccugccagugccucccaagugcuagaauuagagauggccugcuac

SEQ ID NO: 11922 - RNA, 2443 nt, Mus musculus
guagcaggccaucucuaauucuagcacuugggaggcacuggcaggcagaucagaguucagggccagcccagucuacagagugaguuccaggacagccagggcuacacagagaaacccugucucaaaaaaaaaaaaaaaaaaaaaaaaaaaaaaaaaaaaaagaaagaaagaaagaaagaaagaaagaaagaaagaaagaaaaauuaauucagagauacaagcaucauguauuuaugacaguggccacuuaagacgaugaagacaaaccaguauggauucugggaaucugaaccccugucuugcauguggggcaagcgcuuuauccacuguggccucucccuagcucugcaggcacuguucuuaguaggguauguuagaaacauucucuucacaguaucaguuuugcaggcuggagaggcagcucagcaguuaagagcauuugcugcucuggcagauguuaaugcuauauuaaaucgcauguuaagauuuauaguaaauuguucauuuuuaaauuucaauauaaagggcuuggcuuaacaagagauuuuuuuuaaaguaggggcuggagagcuggcuuaucugugaagggugauggcugcuuuucccagaggacugggguucaauucccagcacccacauaguggcucacaacucuccaugacuccaacuccaguuccugggauccaacacccucuucuggccuccgcaggcaccaggcaagagacauagacauacgugcagauaaaacccauacgugaaauaauuacaaaauaaaaauaaaaauuuuagaagagagacaucagcaggcauuucuugaaaaaugcaaacccagugagccagucaacacugggagagaugcucggccucggccucggccucacugggcacugugggggggaugcuuggccucacugggcacugggugggggaugcucaaccucacugggcacuggguggacaacuacaaauaaaaucagaguuagcuauuguuuuaccccaucagacaggcaacauuuuacagguccaaauguaaagccacugagauaugugacagcagcagcuguccugcgggugagagaagcaguggggggaaggaaugacaaauggaccauuuugggaaacauuuuggcaguaccugauguggcaaugcacacccuaugaugcagcagagcugucccuggggacaugcccuagaaaaagagcucugcaccagagacaaguccauagaugucacagaaaaauaaaaugcaggcaguugaauguccuuccaccaaggcggucucacaucaggaaauacucgcagcaguucagaugggugaacuguaguuacagacuccugucugucaaucugucugucugggugaagguccgaaacauggugcugagugacagugcaaacugugggaggaaaugggcaacacgugcugcuuacauaacguuaaaaucagugcaggcuagcccaguccggcgugugugauuagaggcagagccgggugagaaggagccccacaaugcaggggcucaccuagcucugggcauuggaggugaggagugugucugucugaaaugccaagggagucagagacagggcagagugagacagagccgcugugugagggagcauaaggugguaacugcugccuucuggggaagggggaauggucagauaguggcuauguuacaaauaaagggagccaaguuuguguugugggagagcagauguacagacauggagaagacaaaaaugagccaguucugcuacugcuuuagguuggguuaucauagaggaaauauauagagauagacauggaagcagacaugaaugcaagcugcgugcuuaucugucugugguguguuuccuagcaauaccucuacuuuucccagacugcuauaaugacugacuguaaacuggguagcuguaaaugacaggcauccauucucuuacuauuauggaggcagaaggucugaaaucaagguuggggcaggacugugcucucugaaggcugcaaggaagaucucugucuucuuggcuuccaucaccggcugccaacagccccugaagucccuuggcaugcagcacaacauuuucccugaaucccuguguccuucuuggccuuuuuauaaggauuuauugguuuuaggauccaucuuaauccauuaugacauuauucuaacuuaauaucuucaaaacaacuucuaaauacagucaccccauuuaugagcaguuuggcuuucuaucauuuggacuguccacagucaacugcagucuggcgauaugaaguggagcaucccagcacuaaacaaugggagcacucugcugucuugguuguuuacaaacaugccucacuguguucccaggcuggccccaaaguccucaaauccuccuccugcuucagcugggaccacaggcucgugcugacgggcuccgcuucaaucaguccac

SEQ ID NO: 11923 - RNA, 1099 nt, Mus musculus
uuggaggguggucugagaguugcgccacugauccagagaagggucugucccaagcacagcuggacguccuacgccaguggcaggugacuugucaucucggagaagggugcugagugaugauggucaggacagagcagcugggugggcaguucacgccccccaacguggucagggugugugggugguuucaucaagagagugacagugaauggcagccacgugagagucacagcugggcaguucggccaccccagacugacggggucacgagggggggaugggggcugcacuugacacaaaagagcccggggcagagaugacgaggguggggccgggggcaucuggcuccccagacauucuccugucucucuucaaaucugaggugacccgagaccucggcggccagcuaggggggaguggacgguauguccaagucuuacuccaggaaguggucugcguggaguguggccaccaccugccucuggucaucagccgcuacaaacauucgcacgcccccucccacgcgugccaccgcacaccccuaaguuggcgggcaccgaagucccugcagguggaggggcugguccgcgggccacugucccaccucugcuugcccaaguccccagcggagggcgucggguggcagucagcuccacaccccgaacccacucggcuucaguccgaccccaccggggcccggcccaaggggcgcucacgcggccgccccucccccacgcgccccuccccccacgccgccguccggucgccggggucuccgcggucccucgcucggccugggaggggggcccuggcuucgcuacggccguuuccugccuacccccuccccgccgagggugaaaaaaauaaaucuccucccccgaaagccgcgaccaaguggcccgguccgcgcgcgcagcucgcucccugcgcucuccagcccgggcgcggcggcggcggcggcggcggcgguggcggcggccgcgguagcggcggaggaggggugcggcgggggaggggaggaggccuggccccaaggccgccgccgcccggacugccgggcccgucuagacccgccaggcgcccgggacucuccucggcu

SEQ ID NO: 11924 - RNA, 1099 nt, Mus musculus
agccgaggagagucccgggcgccuggcgggucuagacgggcccggcaguccgggcggcggcggccuuggggccaggccuccuccccucccccgccgcaccccuccuccgccgcuaccgcggccgccgccaccgccgccgccgccgccgccgccgcgcccgggcuggagagcgcagggagcgagcugcgcgcgcggaccgggccacuuggucgcggcuuucgggggaggagauuuauuuuuuucacccucggcggggaggggguaggcaggaaacggccguagcgaagccagggccccccucccaggccgagcgagggaccgcggagaccccggcgaccggacggcggcguggggggaggggcgcgugggggaggggcggccgcgugagcgccccuugggccgggccccgguggggucggacugaagccgaguggguucgggguguggagcugacugccacccgacgcccuccgcuggggacuugggcaagcagaggugggacaguggcccgcggaccagccccuccaccugcagggacuucggugcccgccaacuuaggggugugcgguggcacgcgugggagggggcgugcgaauguuuguagcggcugaugaccagaggcaggugguggccacacuccacgcagaccacuuccuggaguaagacuuggacauaccguccacuccccccuagcuggccgccgaggucucgggucaccucagauuugaagagagacaggagaaugucuggggagccagaugcccccggccccacccucgucaucucugccccgggcucuuuugugucaagugcagcccccaucccccccucgugaccccgucagucugggguggccgaacugcccagcugugacucucacguggcugccauucacugucacucucuugaugaaaccacccacacacccugaccacguuggggggcgugaacugcccacccagcugcucuguccugaccaucaucacucagcacccuucuccgagaugacaagucaccugccacuggcguaggacguccagcugugcuugggacagacccuucucuggaucaguggcgcaacucucagaccacccuccaa

SEQ ID NO: 11925 - RNA, 345 nt, Mus musculus
cagcugggggggcuguggcggucgcggcuccggucguggcccggcccgcgcccgaguacucccucuucguccuccuccucaucguccucgucggccgccuccaccuccuccuccuccucgucgcccucuucuuccuccucuucuuccuccuccgacaccaccaucuccuccuccuccuccuccucgucccucagaggggaagccauccuguggcucuggcccccccaccacccccccacccaccgcccgcccgccucccccaccgcuaccaccaccaccuccuccuccuccuccuccuccuccuccuccuccucggcggcggcguccuccuccuccuccuccuca

SEQ ID NO: 11926 - RNA, 345 nt, Mus musculus
ugaggaggaggaggaggaggacgccgccgccgaggaggaggaggaggaggaggaggaggaggaggaggugguggugguagcggugggggaggcgggcgggcgguggguggggggguggugggggggccagagccacaggauggcuuccccucugagggacgaggaggaggaggaggaggagaugguggugucggaggaggaagaagaggaggaagaagagggcgacgaggaggaggaggagguggaggcggccgacgaggacgaugaggaggaggacgaagagggaguacucgggcgcgggccgggccacgaccggagccgcgaccgccacagcccccccagcug

SEQ ID NO: 11927 - RNA, 1002 nt, Mus musculus
gggcaugaaggauuucugcauaaaacaaaaauggcugcugugacuuaacucccccccuuauaaaaauauuuggggggguauuaaucaguacucaugcucagucugacaucagcauaaauuguuaaagguuaacuaguuagauacuaguccaacuagauugaauuuuucuuuucuuuacuagucuucuuccuccccccaccucccuucucuaaagaaaagcuuuuuuuuuuuuuuucugaauacuucagaagggagugguuugaugugaagguuuuuuuuuuuuuuccuucaggcauugaaaaggaaaaagaugaaauauauguuuauauauaacucucuacauaccucauugaagucaaaaugcauuuaauuguguacguagcuuuuaaaugagaaaugguacuggcuuuuuuuuuuuuucuccuuaaaaaaaaagugacagaaauccuagugacuuuggggggagagauaugaauagaugauugaguuuuuuuuccaaggaguccauguuugauucucuccuuugcccagcccucaguguucugugaauguugucaauuuuaucucuacucuuucccuuccucuccuccaguggcuugcuuguaaaaucgucugacuugagaaauuaauuugguggugacuaggucagauuuuuaggagaaagaggagagggucggaucugaagauugugaaauucuuuucuccugugucaucgaacgccucuuccuccaugaccuucgacacugauaaaguagaagaaacugaggcacggggagaggaaagcaacugagaagagaggaacgagguagggcgaacacucaggccuuuucacugaaccggcugaccuguccuuucagacuggaucccaguguuuaucuuaaaguuguagcagggaucagaugagcagcugagcuggagcccagaaguaaguuuuuccuacagagaauugacagagccggcucuacuggaauaaaacuugccaagaagccaagcaagaagggc

SEQ ID NO: 11928 - RNA, 1002 nt, Mus musculus
gcccuucuugcuuggcuucuuggcaaguuuuauuccaguagagccggcucugucaauucucuguaggaaaaacuuacuucugggcuccagcucagcugcucaucugaucccugcuacaacuuuaagauaaacacugggauccagucugaaaggacaggucagccgguucagugaaaaggccugaguguucgcccuaccucguuccucucuucucaguugcuuuccucuccccgugccucaguuucuucuacuuuaucagugucgaaggucauggaggaagaggcguucgaugacacaggagaaaagaauuucacaaucuucagauccgacccucuccucuuucuccuaaaaaucugaccuagucaccaccaaauuaauuucucaagucagacgauuuuacaagcaagccacuggaggagaggaagggaaagaguagagauaaaauugacaacauucacagaacacugagggcugggcaaaggagagaaucaaacauggacuccuuggaaaaaaaacucaaucaucuauucauaucucuccccccaaagucacuaggauuucugucacuuuuuuuuuaaggagaaaaaaaaaaaaagccaguaccauuucucauuuaaaagcuacguacacaauuaaaugcauuuugacuucaaugagguauguagagaguuauauauaaacauauauuucaucuuuuuccuuuucaaugccugaaggaaaaaaaaaaaaaaccuucacaucaaaccacucccuucugaaguauucagaaaaaaaaaaaaaaagcuuuucuuuagagaagggagguggggggaggaagaagacuaguaaagaaaagaaaaauucaaucuaguuggacuaguaucuaacuaguuaaccuuuaacaauuuaugcugaugucagacugagcaugaguacugauuaauacccccccaaauauuuuuauaagggggggaguuaagucacagcagccauuuuuguuuuaugcagaaauccuucaugccc

SEQ ID NO: 11929 - RNA, 331 nt, Mus musculus
uuuauuucaucacuggggaaugggaugaucuucaucuaacugcuuccuccucccucaaaagcacagacgucucuuucgcagaucauacguagguggaucagggcgcguuguggagagagagagagagagagagagagagagagagagagagagagagagagagagagagaggaaggagggggaaaagguugauagguuugugcgcgggucccucgugcaggcugcgcuccuccugggugcuauuugacaauuccugccucugccauuggucaguguuggaucagaugguuguauuuccuucuggcccucacuggcaccucgccaucccccc

SEQ ID NO: 11930 - RNA, 331 nt, Mus musculus
ggggggauggcgaggugccagugagggccagaaggaaauacaaccaucugauccaacacugaccaauggcagaggcaggaauugucaaauagcacccaggaggagcgcagccugcacgagggacccgcgcacaaaccuaucaaccuuuucccccuccuuccucucucucucucucucucucucucucucucucucucucucucucucucucucucucuccacaacgcgcccugauccaccuacguaugaucugcgaaagagacgucugugcuuuugagggaggaggaagcaguuagaugaagaucaucccauuccccagugaugaaauaaa

SEQ ID NO: 11931 - RNA, 1512 nt, Mus musculus
ugccaccacugcccagcuccugggacaguuucuuuucuuuuuuuuucuuuuucugucuuucuuuuuaaagauuuauugauugauugauuuuuauguauaugaguacacuauggcugucuucagacacaccagaagagggcaucagaucccauuacagaugguugugagccaccaugugguugcugggaauugaacucaggaccuucggaagagcagucagugcucuuaaccacugagccaucucuccagcccccugggacaguuucuuuuugccacauugaugacuugugugguucucccucagccccaaguaugcugcaugugccccauuucacagauagguaaauuaagguuccccgagguuagauagcuuguuuuauaguuggugagugggauuuggggcaaacaguuugaucagaaagccccucaggaagguggaaaggagccuccguugguggcagcaggggaggcuguugaggaccagguguggaaugaguuccagacgggggugagagcuucauucaguccaagggucucauggcugagcagacuuggagauuccucauaaugugaugaucuacagaggcagggugcaggcaggacucugugccccaggccacagcuuggagagcgccuaagccauagaguaacaagaucagauuuguguuacaggcagauuacccuggcaagcaaccauggagcuggggagagagacagcugggaggaugggggcgggugacaggcugaugcuggagucaccauagguggaccuggcugagcagcgugagaguggccagagguggcaaggugaauuugagcuaagauucaggcuguagcgaucacgggguagggagaggcgcacuccggagcaucuugguuuguuccuguugccugcugcaaugauaauaguuccuuucccacagugaccuggguugcucacacauuaccugguugucaagcuuuagagucuuggagcagcuuaggacuagggcaguuguccaguugcacuugcaggugacaccaaauggagaugucagauugggugggaguccccaggcaaguggcaagggcagauggugggugcaggcagaggcugucucuguggguguccagaugugaaagagacauggaagagaagguguagaauuugaugagguaggaguggagccugaggaggccugaaguuaaucacaggcuguggcaauuggaggagguuggugaccuuagggcgcagcugugagccugggaugagagcaguuccagggacgcaguguaguuuagguugguguucauugccagcagcccccaguccagggcagcagggcuucugcuauacagcugcacagaggaaaaugagggaggaggauggaauggggcuccuggggagcaggggcucccuguguguccuucccagacccugcuucucagggaaggagauggaaaugggcugugguccagucugcuaggggagcucuguggggguggagcagaaggagaagcccagguccugcc

SEQ ID NO: 11932 - RNA, 1512 nt, Mus musculus
ggcaggaccugggcuucuccuucugcuccacccccacagagcuccccuagcagacuggaccacagcccauuuccaucuccuucccugagaagcagggucugggaaggacacacagggagccccugcuccccaggagccccauuccauccuccucccucauuuuccucugugcagcuguauagcagaagcccugcugcccuggacugggggcugcuggcaaugaacaccaaccuaaacuacacugcgucccuggaacugcucucaucccaggcucacagcugcgcccuaaggucaccaaccuccuccaauugccacagccugugauuaacuucaggccuccucaggcuccacuccuaccucaucaaauucuacaccuucucuuccaugucucuuucacaucuggacacccacagagacagccucugccugcacccaccaucugcccuugccacuugccuggggacucccacccaaucugacaucuccauuuggugucaccugcaagugcaacuggacaacugcccuaguccuaagcugcuccaagacucuaaagcuugacaaccagguaaugugugagcaacccaggucacugugggaaaggaacuauuaucauugcagcaggcaacaggaacaaaccaagaugcuccggagugcgccucucccuaccccgugaucgcuacagccugaaucuuagcucaaauucaccuugccaccucuggccacucucacgcugcucagccagguccaccuauggugacuccagcaucagccugucacccgcccccauccucccagcugucucucuccccagcuccaugguugcuugccaggguaaucugccuguaacacaaaucugaucuuguuacucuauggcuuaggcgcucuccaagcuguggccuggggcacagaguccugccugcacccugccucuguagaucaucacauuaugaggaaucuccaagucugcucagccaugagacccuuggacugaaugaagcucucacccccgucuggaacucauuccacaccugguccucaacagccuccccugcugccaccaacggaggcuccuuuccaccuuccugaggggcuuucugaucaaacuguuugccccaaaucccacucaccaacuauaaaacaagcuaucuaaccucggggaaccuuaauuuaccuaucugugaaauggggcacaugcagcauacuuggggcugagggagaaccacacaagucaucaauguggcaaaaagaaacugucccagggggcuggagagauggcucagugguuaagagcacugacugcucuuccgaagguccugaguucaauucccagcaaccacaugguggcucacaaccaucuguaaugggaucugaugcccucuucuggugugucugaagacagccauaguguacucauauacauaaaaaucaaucaaucaauaaaucuuuaaaaagaaagacagaaaaagaaaaaaaaagaaaagaaacugucccaggagcugggcagugguggca

SEQ ID NO: 11933 - RNA, 325 nt, Mus musculus
cuuuaggauagcuaggcugagcggagugucauggcagacacaggggaccugcagcagcacaggaguugcuucuaggauccugcgaccuucaggaacccucccuaggcuccugaaagaacggguuggcaauuccucucaaucucuucccccagaagacaucccggcacuccagcgggggaggaggaggagcaggaggaggcagcagcggcgggggaggagguggcagcaguagugccagcggugguggagguggcaccgggggaggcagcggcaacagcuuccuuagcggcaggagaagccggucagccucgccauccacccagcc

SEQ ID NO: 11934 - RNA, 325 nt, Mus musculus
ggcuggguggauggcgaggcugaccggcuucuccugccgcuaaggaagcuguugccgcugccucccccggugccaccuccaccaccgcuggcacuacugcugccaccuccucccccgccgcugcugccuccuccugcuccuccuccucccccgcuggagugccgggaugucuucugggggaagagauugagaggaauugccaacccguucuuucaggagccuagggaggguuccugaaggucgcaggauccuagaagcaacuccugugcugcugcagguccccugugucugccaugacacuccgcucagccuagcuauccuaaag

SEQ ID NO: 11935 - RNA, 34 nt, Mus musculus
gcuggacaccuaggcuguccuucugucaaacagu

SEQ ID NO: 11936 - RNA, 34 nt, Mus musculus
acuguuugacagaaggacagccuagguguccagc

SEQ ID NO: 11937 - RNA, 190 nt, Mus musculus
aaagaacuaugaacaaucucacuugaaaaugucacagugcauuaguauauguaagcacguggacugcauuacaugcugacugaaagccaugaaccgcgucaagacagcuuagaggcuaagagcaugaauuguuccugcagagguuucuaguagcaacauugaacagcucauagcuacauguaacuuuagg

SEQ ID NO: 11938 - RNA, 190 nt, Mus musculus
ccuaaaguuacauguagcuaugagcuguucaauguugcuacuagaaaccucugcaggaacaauucaugcucuuagccucuaagcugucuugacgcgguucauggcuuucagucagcauguaaugcaguccacgugcuuacauauacuaaugcacugugacauuuucaagugagauuguucauaguucuuu

SEQ ID NO: 11939 - RNA, 870 nt, Mus musculus
cuuuguuugaugagaaugaccuucagugugagucaccugcuccuccuccucccucuaagaaguguuaggcuguaggugggagggugcucaguuuuaagacuaaaucuauggcuccugagccccaugaggcagaggcagauuuccccacgauaagucgaaggcucuggcuaagcugcaaagacucuugagacccugcuucaguaacaagacaguugacucuccaaggcagcaaccauuaagucaccuaaacucuuaauagggagguaacagcaauguuuacaaaauuacuuacuacuccaauguggcaaaguaaaacugaacucugaggguugauaucaagugcuuucuggaaaugcauuucugcgaggcugaacuucucuugcuuguaauaaaucauuccuaaaccauaccugaaauuauaagaaaguaugauuuuaaggacacaaguuuuggcuucauauaauaagacaguuuggguaucuggcauuucaauacacaaugggaaaaaauaauggacaaaaaauauuaguuauaauaauaaucaaugaaacauuuuagaagauacauuuuuauaaguguaaacaguaaauuacccaaacaggcaaaacuaugauagagaaaagaagccacaucuugaaacucaccacucuaauguagacagaacagccaauuccugcagugauuauauauguagcaagcacuuugcuaaauuauucccuuuucuuuucuuuucuuuucuuuuuuuuuuuagacaggguuucucuguguggcccuggcuauacugccucacagagaucugccugccucuggcuccccagugcugggacuaaaggggcacaacaccacugcccagccuaaauuauuauuuuu

SEQ ID NO: 11940 - RNA, 870 nt, Mus musculus
aaaaauaauaauuuaggcugggcagugguguugugccccuuuagucccagcacuggggagccagaggcaggcagaucucugugaggcaguauagccagggccacacagagaaacccugucuaaaaaaaaaaagaaaagaaaagaaaagaaaagggaauaauuuagcaaagugcuugcuacauauauaaucacugcaggaauuggcuguucugucuacauuagaguggugaguuucaagauguggcuucuuuucucuaucauaguuuugccuguuuggguaauuuacuguuuacacuuauaaaaauguaucuucuaaaauguuucauugauuauuauuauaacuaauauuuuuuguccauuauuuuuucccauuguguauugaaaugccagauacccaaacugucuuauuauaugaagccaaaacuuguguccuuaaaaucauacuuucuuauaauuucagguaugguuuaggaaugauuuauuacaagcaagagaaguucagccucgcagaaaugcauuuccagaaagcacuugauaucaacccucagaguucaguuuuacuuugccacauuggaguaguaaguaauuuuguaaacauugcuguuaccucccuauuaagaguuuaggugacuuaaugguugcugccuuggagagucaacugucuuguuacugaagcagggucucaagagucuuugcagcuuagccagagccuucgacuuaucguggggaaaucugccucugccucauggggcucaggagccauagauuuagucuuaaaacugagcacccucccaccuacagccuaacacuucuuagagggaggaggaggagcaggugacucacacugaaggucauucucaucaaacaaag

SEQ ID NO: 11941 - RNA, 276 nt, Mus musculus
uccuguggaggugaugcaugcccaggccacacaaguaggugaagauccagcaaccuucaagccaccaaagauggaugucccauugguagaaggaaagaagcaaccacuucgaacccauaaucucaaaccccgugaccugaaugugcucacacgcacuggcuucuagaaugcucuguccagggucugcaacuucccugggcucugacauaggagugauguggcuaacugaggccugagcgagugugcagauuguccuugggugagugagaaaaaaca

SEQ ID NO: 11942 - RNA, 276 nt, Mus musculus
uguuuuuucucacucacccaaggacaaucugcacacucgcucaggccucaguuagccacaucacuccuaugucagagcccagggaaguugcagacccuggacagagcauucuagaagccagugcgugugagcacauucaggucacgggguuugagauuauggguucgaagugguugcuucuuuccuucuaccaaugggacauccaucuuugguggcuugaagguugcuggaucuucaccuacuuguguggccugggcaugcaucaccuccacagga

SEQ ID NO: 11943 - RNA, 25 nt, Mus musculus
gauagcuuuucuuuuaaaaauguuu

SEQ ID NO: 11944 - RNA, 25 nt, Mus musculus
aaacauuuuuaaaagaaaagcuauc

SEQ ID NO: 11945 - RNA, 1168 nt, Mus musculus
caccaagcaugcacuugggacacaggcauauacguggggaaaacaucuauacacacaaaauaauaacaacaauucaaauuauuaaaaccggucagaaccaggcaugcugaugcacaccuuugaccaggcaugcugaugcacaccuuugauagcucugaaggcuucaaguccagccugagauaccuugucuugacaaaucagacauauauuaaaaacuaaauaauucugauggcuaaauaggugaaauaaaaagcucauguuuguuauguuuguuuugaguaauuuaucuaauaaugaccuaaauaugaacuuuaccaguuuugcuacugaacuuuaaguuuaagugcagcaccuguguuuucugagcagauuucuuaguaaaugucuccuuuuugucuuaacugcucuacuuugcuuucugcuuuuaggaccuggggacuuguuucugaugaacauaaaugacagcuuauccagcacucugcaggaugcccuugaaaugguaaggagaagcugacuccaggcccacugcaagaauggcuugaugucuaguugccguugagcaguuucugaguuuucacuuguuugagggauacacacaaagguuagugaauuguuaccaugagaccaggcacaguuguaaaucccugucuguggucacagacacuucagaggcucaguugaggaggcugagagcuacuuugcaccaccuugcuuagcaggaaaaggaaagauagcagggaaggagggagggagguagacauacuaguaguagaggguuguuuacuauuucauuauauauuuaauuauauaauccuauauaaugggagaaugaacagaaaauuguuacugaccucuaagguucugauagucaaaaaauacauguuaauguaauuagguaaugagaucuggaauuguuucagcagugccuugaacaggaucuuaaguacucuaagucuccugugguaguuugugauauauagauagauauauagauuuauguauauaugcauuaauauguauguguauauaaauuuaauggguuaaaaaucaaaauggcacagcggucaagaggaggaccacuauugcagaggacccauguuugguuuccagcccccacaucagguggguuacagccaccuguaacuccaguuuuuggagaucugacguc

SEQ ID NO: 11946 - RNA, 1168 nt, Mus musculus
gacgucagaucuccaaaaacuggaguuacagguggcuguaacccaccugaugugggggcuggaaaccaaacauggguccucugcaauagugguccuccucuugaccgcugugccauuuugauuuuuaacccauuaaauuuauauacacauacauauuaaugcauauauacauaaaucuauauaucuaucuauauaucacaaacuaccacaggagacuuagaguacuuaagauccuguucaaggcacugcugaaacaauuccagaucucauuaccuaauuacauuaacauguauuuuuugacuaucagaaccuuagaggucaguaacaauuuucuguucauucucccauuauauaggauuauauaauuaaauauauaaugaaauaguaaacaacccucuacuacuaguaugucuaccucccucccuccuucccugcuaucuuuccuuuuccugcuaagcaagguggugcaaaguagcucucagccuccucaacugagccucugaagugucugugaccacagacagggauuuacaacugugccuggucucaugguaacaauucacuaaccuuuguguguaucccucaaacaagugaaaacucagaaacugcucaacggcaacuagacaucaagccauucuugcagugggccuggagucagcuucuccuuaccauuucaagggcauccugcagagugcuggauaagcugucauuuauguucaucagaaacaaguccccagguccuaaaagcagaaagcaaaguagagcaguuaagacaaaaaggagacauuuacuaagaaaucugcucagaaaacacaggugcugcacuuaaacuuaaaguucaguagcaaaacugguaaaguucauauuuaggucauuauuagauaaauuacucaaaacaaacauaacaaacaugagcuuuuuauuucaccuauuuagccaucagaauuauuuaguuuuuaauauaugucugauuugucaagacaagguaucucaggcuggacuugaagccuucagagcuaucaaaggugugcaucagcaugccuggucaaaggugugcaucagcaugccugguucugaccgguuuuaauaauuugaauuguuguuauuauuuuguguguauagauguuuuccccacguauaugccugugucccaagugcaugcuuggug

SEQ ID NO: 11947 - RNA, 2379 nt, Mus musculus
uuuaaccuggcuuuauguguguuucuguuuaaagacauuguauuuaguuucugugauugauucaccaacacugaaaucacagccaaaacacuauaauucauucccaaagaaguguauauaacacauaguccuccccaggcgugucagagucuucuugugcucaggaacacugggcaguaauuuucuuuugaaaugauuuagguaucauucuaaguucccaaagcacaaaugugcgugucuguacuuaggucugucugucuuucugucugucugucucugugucuugcacauacguaaguggggaggaaggaaaguauaaaggagagugaaugaacacaaaaauguggaaaacuuggcauuaacuucacuguucaaaggucaucucuuauagcuaauguaaaaaggcagaguggggaauuuuauggugggugaugguuuuucacugcauugcuaagagccacaaaaagaccauaaaguuucugugaacagugaguuuucauuagaauuauguuucugugaguagguaacuuugcaaauggaaauuggccaguuagguggguucugacuuucccagacucauuaaugcauucuguauuagguuggugcaaaaucaauugugguuuuagacaauaaaauuuaaaucacuguaacuaaacucuaacacaucuuuaucagauagaaacuauuauaaucaacaugcuuuuuucuacaagaaauugacuugcuuauuucuauaacauaaaacucuaugcuuugcagcuugacaaauuccugaaaaguauuuucugcauucugcugguuguggaaauacucauccugcuaaaaguucugcaaaagcuuaaagaggcagcaguugguuggugagauaagugaagcugguguaucaggcaacagcuugguacuaauuucuuuggcccuguccguucaccuuuugaagcacuggcugcgcagggcgcugaguaaccccgagcuuucccgccugugccuaaaucccaaguguccacuuagaggcugcuuacuaacaaugcgauggccuuugcuacacuuguucccugacugccucauaacuuauuucaccuaugcaaacucuucuguuugccacaaggcugguuaccuccccucaguuucuuucuuuauucuuuuuguuuuuuucgaguccccucaguuucauacgccuaacuuccucagaaucuggguggcaaaucuccugccucuaucuaccagaguuuuaaucugucuacugaaacuuucaccuucuacauccugcuuuuuguuaauaggccaucagguuuuuauugacacaaaguacucaagggucgucccuauaguaaguaguuggcugugguuguggagaagacgcugacagagaguugggccucgcuggccagggcugucuaagcaucccagugugcugagugucucaagcaucccagugugcgagugucucaagcaucccagugugcugagcgucucaagcaucccagugugcgagugucucaagcaucccagugugcugagugcuccucagaugccaugguuuccugggguucaggaagauuccguggcuggauggauuggccacgggcaggagccaggauuuuucuuuccaugcaaguuuagcuuugggaaguguuuuggagcuuuuuaguccaaccucugaguuggucacugaugguugucagauacgaaccacuuuuugcuccauguugcaguccaaucaaauaauguuugguuaucgcugcauagaauaacaggguggaaguucaaagguaugacuuauaaauuauuuuuuagucaucucaugagguccucacccaacuuuucuacuuuuccaacuuaauucaagugucuagcggccaucagugauccacacugaauucuuggcaacauuaguguagucauaagagcaucgcuucaguaaugaacgauugucaccagguuugaugacugggccacugcacaccucguugucaaggccuucaucucuuuugcagagcgucuccacacaccucugccuuguguguucauuagcacuuucagggccagaugaguugguaauguuguuaguugucuguacuuuuucauugucuauuugaacuggaauaagaaaauugcuucaacuuguuucuuguucauagucauuacuauaauauaaauauaaaguaggcaacaaguagugucacuagcaaaaaaccaaaaccaaacaaagccaaaagacccacgacuccgaaguaggagcguuaaaaugauauaaaauauuaccguauuuauuuaagaauuuauuccaaaaucaaaagauaaauuucaacaauacaaaaaaguuuacucuugccgggcaugguggcacauaccuuuaaucccagcacuugggaggcagag

SEQ ID NO: 11948 - RNA, 2379 nt, Mus musculus
cucugccucccaagugcugggauuaaagguaugugccaccaugcccggcaagaguaaacuuuuuuguauuguugaaauuuaucuuuugauuuuggaauaaauucuuaaauaaauacgguaauauuuuauaucauuuuaacgcuccuacuucggagucgugggucuuuuggcuuuguuugguuuugguuuuuugcuagugacacuacuuguugccuacuuuauauuuauauuauaguaaugacuaugaacaagaaacaaguugaagcaauuuucuuauuccaguucaaauagacaaugaaaaaguacagacaacuaacaacauuaccaacucaucuggcccugaaagugcuaaugaacacacaaggcagagguguguggagacgcucugcaaaagagaugaaggccuugacaacgaggugugcaguggcccagucaucaaaccuggugacaaucguucauuacugaagcgaugcucuuaugacuacacuaauguugccaagaauucaguguggaucacugauggccgcuagacacuugaauuaaguuggaaaaguagaaaaguugggugaggaccucaugagaugacuaaaaaauaauuuauaagucauaccuuugaacuuccacccuguuauucuaugcagcgauaaccaaacauuauuugauuggacugcaacauggagcaaaaagugguucguaucugacaaccaucagugaccaacucagagguuggacuaaaaagcuccaaaacacuucccaaagcuaaacuugcauggaaagaaaaauccuggcuccugcccguggccaauccauccagccacggaaucuuccugaaccccaggaaaccauggcaucugaggagcacucagcacacugggaugcuugagacacucgcacacugggaugcuugagacgcucagcacacugggaugcuugagacacucgcacacugggaugcuugagacacucagcacacugggaugcuuagacagcccuggccagcgaggcccaacucucugucagcgucuucuccacaaccacagccaacuacuuacuauagggacgacccuugaguacuuugugucaauaaaaaccugauggccuauuaacaaaaagcaggauguagaaggugaaaguuucaguagacagauuaaaacucugguagauagaggcaggagauuugccacccagauucugaggaaguuaggcguaugaaacugaggggacucgaaaaaaacaaaaagaauaaagaaagaaacugaggggagguaaccagccuuguggcaaacagaagaguuugcauaggugaaauaaguuaugaggcagucagggaacaaguguagcaaaggccaucgcauuguuaguaagcagccucuaaguggacacuugggauuuaggcacaggcgggaaagcucgggguuacucagcgcccugcgcagccagugcuucaaaaggugaacggacagggccaaagaaauuaguaccaagcuguugccugauacaccagcuucacuuaucucaccaaccaacugcugccucuuuaagcuuuugcagaacuuuuagcaggaugaguauuuccacaaccagcagaaugcagaaaauacuuuucaggaauuugucaagcugcaaagcauagaguuuuauguuauagaaauaagcaagucaauuucuuguagaaaaaagcauguugauuauaauaguuucuaucugauaaagauguguuagaguuuaguuacagugauuuaaauuuuauugucuaaaaccacaauugauuuugcaccaaccuaauacagaaugcauuaaugagucugggaaagucagaacccaccuaacuggccaauuuccauuugcaaaguuaccuacucacagaaacauaauucuaaugaaaacucacuguucacagaaacuuuauggucuuuuuguggcucuuagcaaugcagugaaaaaccaucacccaccauaaaauuccccacucugccuuuuuacauuagcuauaagagaugaccuuugaacagugaaguuaaugccaaguuuuccacauuuuuguguucauucacucuccuuuauacuuuccuuccuccccacuuacguaugugcaagacacagagacagacagacagaaagacagacagaccuaaguacagacacgcacauuugugcuuugggaacuuagaaugauaccuaaaucauuucaaaagaaaauuacugcccaguguuccugagcacaagaagacucugacacgccuggggaggacuauguguuauauacacuucuuugggaaugaauuauaguguuuuggcugugauuucaguguuggugaaucaaucacagaaacuaaauacaaugucuuuaaacagaaacacacauaaagccagguuaaa

SEQ ID NO: 11949 - RNA, 1601 nt, Mus musculus
ugaugguguaguuuacuccaaugacuccauuuugccauuucacagccaucgaugugcuagaacccaauucaggcaacccccuuggaccguggaggacacugaccgguucucuuuaagcuucgcuuugaacaccucuuccaggcuuuuguggggauccauggccuuggcccucaaggucacugauuuagacauggcuugacaguucuuuuugugcaccuccaaccacugaaugcucaugucugauuuguccuucuuuucaagugacauucuaaaggagagagcagagauaguagaugaccugggcacaugcauaagcaaucguaggaccuucucugcgcucaguuaugucuucucuuuucuuucuuuaagguguuuguuugcuuguauauguguguauuuggggauagggguaugugcaggucugaaugcaagugcccccagggucuagaagaaggcaucaggucuguugcagcuagaguuacaguugugagcagcccaguguggauacugagaucuauauuuaaguccucugcgguacaugcucuuaaccacggagccaucucuccagccccuaguggguguuucuaugaauaugauuuucuauacaucugccacaacuguuuucagaaaaggaugguucuggggaugggcguggcacagaccuguagucccagugcaggaggaaccagauguucaggaugucccagcuacacagugacuuucaugccaggauggccugcagggaaccccaucucaacagcuauucugaggcgaaaaccaauggcagaugaugcuuuccuacuuucuggguucugugauuucccacagaagagaaauccauugauugaacagaaaguauugaguaaaauggccauacccagcuaggagucaauagauuguuaguuguuucccuuggcuggagcaguacucauagcuacuauuuacagagcugccaaccaggaaccaaagacuuuauaucucgcguaacucucaccaggcucugaggagguagacauacuaggcccccuuccucugagggggacugaaagucagaaagccucuuguucaccgcuacuuacuaugcagaggaaaagccagcacaaccaggaugguggaucucugaguuugccccugauugcuguacuauaaacaguggucaagcaaugacuuagguucacaguucuuuuggaaauacaaaucgccauuuccauaaagaucuggaaacaggcuuccuuuaauguagacaauuuggguucaacuuauaguacucaguuuguauaaacuauuuuagaguucugagguggguuccaccaaaagacugcacuuaaaaauacauucaaacagaucaaggacaagggcacaaaagcuuaauuccacccccugauguuggaaaguagaugugauaucuucugcaggugggcugccucucauuugcaggaaauuguccugggccuuggaauacugauacacuuggccuacaguuaguauaaaugugaaaaggaagcaagccagcaucucuacauccuaaauauucuuacgaggucuuaguguagccaugcuacuguugugacuuuugcuucuccauucuauuuaaugucuuu

SEQ ID NO: 11950 - RNA, 1601 nt, Mus musculus
aaagacauuaaauagaauggagaagcaaaagucacaacaguagcauggcuacacuaagaccucguaagaauauuuaggauguagagaugcuggcuugcuuccuuuucacauuuauacuaacuguaggccaaguguaucaguauuccaaggcccaggacaauuuccugcaaaugagaggcagcccaccugcagaagauaucacaucuacuuuccaacaucaggggguggaauuaagcuuuugugcccuuguccuugaucuguuugaauguauuuuuaagugcagucuuuugguggaacccaccucagaacucuaaaauaguuuauacaaacugaguacuauaaguugaacccaaauugucuacauuaaaggaagccuguuuccagaucuuuauggaaauggcgauuuguauuuccaaaagaacugugaaccuaagucauugcuugaccacuguuuauaguacagcaaucaggggcaaacucagagauccaccauccugguugugcuggcuuuuccucugcauaguaaguagcggugaacaagaggcuuucugacuuucagucccccucagaggaagggggccuaguaugucuaccuccucagagccuggugagaguuacgcgagauauaaagucuuugguuccugguuggcagcucuguaaauaguagcuaugaguacugcuccagccaagggaaacaacuaacaaucuauugacuccuagcuggguauggccauuuuacucaauacuuucuguucaaucaauggauuucucuucugugggaaaucacagaacccagaaaguaggaaagcaucaucugccauugguuuucgccucagaauagcuguugagaugggguucccugcaggccauccuggcaugaaagucacuguguagcugggacauccugaacaucugguuccuccugcacugggacuacaggucugugccacgcccauccccagaaccauccuuuucugaaaacaguuguggcagauguauagaaaaucauauucauagaaacacccacuaggggcuggagagauggcuccgugguuaagagcauguaccgcagaggacuuaaauauagaucucaguauccacacugggcugcucacaacuguaacucuagcugcaacagaccugaugccuucuucuagacccugggggcacuugcauucagaccugcacauaccccuauccccaaauacacacauauacaagcaaacaaacaccuuaaagaaagaaaagagaagacauaacugagcgcagagaagguccuacgauugcuuaugcaugugcccaggucaucuacuaucucugcucucuccuuuagaaugucacuugaaaagaaggacaaaucagacaugagcauucagugguuggaggugcacaaaaagaacugucaagccaugucuaaaucagugaccuugagggccaaggccauggauccccacaaaagccuggaagagguguucaaagcgaagcuuaaagagaaccggucaguguccuccacgguccaaggggguugccugaauuggguucuagcacaucgauggcugugaaauggcaaaauggagucauuggaguaaacuacaccauca

SEQ ID NO: 11951 - RNA, 136 nt, Mus musculus
uuuccaauggcaggaaauugcuuuggauaucucucuuggaccuaugcccuuugguccaauaacaaaccuugccacaucaccugcacaccccuggaaauuuaggccuucuuucugguuuauauuuagaaaaaaacua

SEQ ID NO: 11952 - RNA, 136 nt, Mus musculus
uaguuuuuuucuaaauauaaaccagaaagaaggccuaaauuuccaggggugugcaggugauguggcaagguuuguuauuggaccaaagggcauagguccaagagagauauccaaagcaauuuccugccauuggaaa

SEQ ID NO: 11953 - RNA, 1034 nt, Mus musculus
caguaguuacagcucccaacagucauaaaaugcaccuaauuuauuaauuagcuucacaguaauuuauuaguuuccuauaggagcagcccugucaguguguuugcuugcucuugaguaagauccacuugugacaccuucuaugcuaaguuucuguuuggugauauagagaagauaaaacaucccuuccagcuaaagaucaaguaacucugugagcuugggaaauggaauugaaccaagccucaagccaccaucuguaucauacaaaguaaggccuagaaaauaauucucacaggauaacaccagaccuguugcucagaaucugugccgccaucucccgauacccaaacuauccuuacucuauaggaaucuuuuucuuugaaaaucacgcuuugggaaaauuauguucuacgaauuuacuaauuucucagccaaguucaaagaaccucugaguaucaccauuuuaaagccaggugacuagaagacaugaggacaacuccugcaaacuccgagugugggacccccaccagggcaaaccuauucuccgagguuugacacaccggaaagcuuuccccagccacccccuacuccccucgaaauacaacugaguuucucuaccgccaaggaccugucgugccuccgaugaaucccgcccacuucgcgcccucaagccaaucagaggguggcgucacucccucucaguugccauggugcccgccaaguccuuuccgccacuuaccagaugugagcaggcugguccagccggugaaagcggguggcaaaggacagcagcgucaccacagccaacguggcccaccacccugccgccuggaagcgccgcgagcuccaagcaggccguuuaaguuuccgugcugcagccugggggaccacgucucggcucacggcucuggcagccugcggcacacagcggccccuacggggacgcagcucggagcccgcuaggccaccgccuauggccggcggcauccuccccuuccgaaggaucacccuccgggccggaggcacgccgggucuug

SEQ ID NO: 11954 - RNA, 1034 nt, Mus musculus
caagacccggcgugccuccggcccggagggugauccuucggaaggggaggaugccgccggccauaggcgguggccuagcgggcuccgagcugcguccccguaggggccgcugugugccgcaggcugccagagccgugagccgagacguggucccccaggcugcagcacggaaacuuaaacggccugcuuggagcucgcggcgcuuccaggcggcaggguggugggccacguuggcuguggugacgcugcuguccuuugccacccgcuuucaccggcuggaccagccugcucacaucugguaaguggcggaaaggacuuggcgggcaccauggcaacugagagggagugacgccacccucugauuggcuugagggcgcgaagugggcgggauucaucggaggcacgacagguccuuggcgguagagaaacucaguuguauuucgaggggaguaggggguggcuggggaaagcuuuccggugugucaaaccucggagaauagguuugcccuggugggggucccacacucggaguuugcaggaguuguccucaugucuucuagucaccuggcuuuaaaauggugauacucagagguucuuugaacuuggcugagaaauuaguaaauucguagaacauaauuuucccaaagcgugauuuucaaagaaaaagauuccuauagaguaaggauaguuuggguaucgggagauggcggcacagauucugagcaacaggucugguguuauccugugagaauuauuuucuaggccuuacuuuguaugauacagaugguggcuugaggcuugguucaauuccauuucccaagcucacagaguuacuugaucuuuagcuggaagggauguuuuaucuucucuauaucaccaaacagaaacuuagcauagaaggugucacaaguggaucuuacucaagagcaagcaaacacacugacagggcugcuccuauaggaaacuaauaaauuacugugaagcuaauuaauaaauuaggugcauuuuaugacuguugggagcuguaacuacug

SEQ ID NO: 11955 - RNA, 228 nt, Mus musculus
gccuccaguagcagugagcucucucuccccagccgcuugcuugggggcucacguacugagacgcuccucucagcccuccccugucuuuuacaucagccuccgcagcuccaacagcagccugcuuaugucucggcccucaggucuuuagaggaggcaagcucccucucuucaggguccucucugugcugucgucaauagcaaaacccccacccacccugagaauaaauu

SEQ ID NO: 11956 - RNA, 228 nt, Mus musculus
aauuuauucucaggguggguggggguuuugcuauugacgacagcacagagaggacccugaagagagggagcuugccuccucuaaagaccugagggccgagacauaagcaggcugcuguuggagcugcggaggcugauguaaaagacaggggagggcugagaggagcgucucaguacgugagcccccaagcaagcggcuggggagagagagcucacugcuacuggaggc

SEQ ID NO: 11957 - RNA, 218 nt, Mus musculus
gcagugaacucuugcuauaguuguuauaguguagacacuuaacccugaaacccugcagggaaggaacuagaauguucauguucauagauaauauaugugggaucccagaagacuauuucaauuaaaaacucacuuuuuaauuuuuugagauaguauagaaguuuuagaaguauauuuaugaacauauuuuaucuagacucugccuauacuaaaugcca

SEQ ID NO: 11958 - RNA, 218 nt, Mus musculus
uggcauuuaguauaggcagagucuagauaaaauauguucauaaauauacuucuaaaacuucuauacuaucucaaaaaauuaaaaagugaguuuuuaauugaaauagucuucugggaucccacauauauuaucuaugaacaugaacauucuaguuccuucccugcaggguuucaggguuaagugucuacacuauaacaacuauagcaagaguucacugc

SEQ ID NO: 11959 - RNA, 557 nt, Mus musculus
ugucacugguccacgagccugccucguucagcccaggacgggaaaggguaguccuuuaagaaggccgaguggagcgcaagcgccgcacagcaguuccgugacgucuuuccguuccuaggcagaugggcggaaauugacagcaggagaauuuuagcugagacgccaccggaacugcuuagagggcggaaggugcuuauggagcuuuuguaagcugggagauccgcggguuccuucugcggguaugagggugucugagguggugggaugugguaccguguugccgguuccucucuuacuccccggcggacacuagcagaaccagccaggcgcccugugcgugccgcggucuugcuggucugccacugcugaccucguagcugcuacugacagcggguuccagacgagcacuccccggccuccgggccccgucugccgggucacggacguguugcuucauccauuauggagggcgacugauuuguuagucuguuucugucucuccuguugcuagcggaugcacaauugguugagauauguuauauggaaaauaaaacuac

SEQ ID NO: 11960 - RNA, 557 nt, Mus musculus
guaguuuuauuuuccauauaacauaucucaaccaauugugcauccgcuagcaacaggagagacagaaacagacuaacaaaucagucgcccuccauaauggaugaagcaacacguccgugacccggcagacggggcccggaggccggggagugcucgucuggaacccgcugucaguagcagcuacgaggucagcaguggcagaccagcaagaccgcggcacgcacagggcgccuggcugguucugcuaguguccgccggggaguaagagaggaaccggcaacacgguaccacaucccaccaccucagacacccucauacccgcagaaggaacccgcggaucucccagcuuacaaaagcuccauaagcaccuuccgcccucuaagcaguuccgguggcgucucagcuaaaauucuccugcugucaauuuccgcccaucugccuaggaacggaaagacgucacggaacugcugugcggcgcuugcgcuccacucggccuucuuaaaggacuacccuuucccguccugggcugaacgaggcaggcucguggaccagugaca

SEQ ID NO: 11961 - RNA, 435 nt, Mus musculus
uuacagaugguugugagccaccaugugguugcuaguaauugaacucaagaccagacaguauucuuaacugcugaaccaucucucaaaccuuuaauuucaaauauuugaauuuguccaaauaagauuguuuucauuaaaaaacaaaaacaaaucagucccauugaacaacagauuuaggccaagcaucuuccaugcaugugaucaccugaguuguccugagugucauggccuucugccuccugccucaguggcccaccagaucugaucaacccccaugcgguuucccagugugggaguaccuuagccuagcacuggagaguaaagucacaggucacacugaagcuuucaagcacuaaguaagguuugaacuguguucugggaacaauggagaauaaauguuuugaucagugaaguauauauagucagaacacagaa

SEQ ID NO: 11962 - RNA, 435 nt, Mus musculus
uucuguguucugacuauauauacuucacugaucaaaacauuuauucuccauuguucccagaacacaguucaaaccuuacuuagugcuugaaagcuucagugugaccugugacuuuacucuccagugcuaggcuaagguacucccacacugggaaaccgcauggggguugaucagaucuggugggccacugaggcaggaggcagaaggccaugacacucaggacaacucaggugaucacaugcauggaagaugcuuggccuaaaucuguuguucaaugggacugauuuguuuuuguuuuuuaaugaaaacaaucuuauuuggacaaauucaaauauuugaaauuaaagguuugagagaugguucagcaguuaagaauacugucuggucuugaguucaauuacuagcaaccacaugguggcucacaaccaucuguaa

SEQ ID NO: 11963 - RNA, 1383 nt, Mus musculus
uacauauuaaauuuaguaauaaaagccaucagcagucacauuaagagcauauaacugcaaaccuuuaaaauguuuugaaaaacuaaaauuuuaaucuuaacuuuuugucaacaaagagaaauguuuugaaauaaauuauuacaaggagaugugucaaaacuaaaacuugguuuuuuccacacacaguagaguucuguuucuaaggguaaagagucuacacagaaaaagcgcaaucauaaacauuuagccuugcauccauucacuggcagacaggaguuaaacgcacugcagagaacuguagugagacgugcgcucuauugaggaagaagaauaaguggggauggcaauacuaagacacuuuaaaauugucucuaauaaauugaaauuuaacaaaguugcuuucucuucacuggcuguacauccauacuaccaaaggaaaugacaccacguuauauuaagugugaaguuaucuuugaggcagcaaaaugcuuauuuacaaaauauaaccaaaaaaauuuuagugauacauuaccacugcgccauuaucugguaucauuggaguucccauauuugcagcuccuucuggucccauggcaggaccaggacccauuggugggccagguauaguuccucuguuguucauauucauacccaucauuggaggaggaccuuggguaccagcaggugcugggcuaaaugcaucuaugcaaaacaaucuacacuuagagcuggccuaucuuaguucagugaacauuaaaaacuauacaauucauucaaaucuauacacaagacuaucaucaaaauaacuuuccuuccuugagaguggaauacuaaaccaucaacaauaaacaucauauauacaguaaaauucucauuacuaaaacaaaccuacaaaggccaugucaauuuuuuagagccauuggaacuaucauauuaagaguuucaaaaaucaguaauauuagguguagcuuauaauuaaauuaaagaaaaugacucugaauaauuuacauucuaugagcuuuaauaaacaguaaagguuugucacucaaaaaacacaacuuguuuuccccuaaagucagagcuaaaaauauuagcauauaaaaaauaauaaauauuaaggaaaauuacucuagauaaucacacaaagacagcuguaaacuaaucacguggcuuuauauaaguacuaaauacuuuaaaaacguaucaaagaaugguuuucaauuuuauauuaaaauauauaaucuaaaaaaaaaaaacccaaaaacacuaggaugaagcuauguuuuaaaacacaguucaugcaaacaaauaaaaugauuaugugccuacuucuaacaaguacaacuuuagacagggagacaaugaugcuucuaauuuggucau

SEQ ID NO: 11964 - RNA, 1383 nt, Mus musculus
augaccaaauuagaagcaucauugucucccugucuaaaguuguacuuguuagaaguaggcacauaaucauuuuauuuguuugcaugaacuguguuuuaaaacauagcuucauccuaguguuuuuggguuuuuuuuuuuuagauuauauauuuuaauauaaaauugaaaaccauucuuugauacguuuuuaaaguauuuaguacuuauauaaagccacgugauuaguuuacagcugucuuugugugauuaucuagaguaauuuuccuuaauauuuauuauuuuuuauaugcuaauauuuuuagcucugacuuuaggggaaaacaaguuguguuuuuugagugacaaaccuuuacuguuuauuaaagcucauagaauguaaauuauucagagucauuuucuuuaauuuaauuauaagcuacaccuaauauuacugauuuuugaaacucuuaauaugauaguuccaauggcucuaaaaaauugacauggccuuuguagguuuguuuuaguaaugagaauuuuacuguauauaugauguuuauuguugaugguuuaguauuccacucucaaggaaggaaaguuauuuugaugauagucuuguguauagauuugaaugaauuguauaguuuuuaauguucacugaacuaagauaggccagcucuaaguguagauuguuuugcauagaugcauuuagcccagcaccugcugguacccaagguccuccuccaaugauggguaugaauaugaacaacagaggaacuauaccuggcccaccaauggguccugguccugccaugggaccagaaggagcugcaaauaugggaacuccaaugauaccagauaauggcgcagugguaauguaucacuaaaauuuuuuugguuauauuuuguaaauaagcauuuugcugccucaaagauaacuucacacuuaauauaacguggugucauuuccuuugguaguauggauguacagccagugaagagaaagcaacuuuguuaaauuucaauuuauuagagacaauuuuaaagugucuuaguauugccauccccacuuauucuucuuccucaauagagcgcacgucucacuacaguucucugcagugcguuuaacuccugucugccagugaauggaugcaaggcuaaauguuuaugauugcgcuuuuucuguguagacucuuuacccuuagaaacagaacucuacuguguguggaaaaaaccaaguuuuaguuuugacacaucuccuuguaauaauuuauuucaaaacauuucucuuuguugacaaaaaguuaagauuaaaauuuuaguuuuucaaaacauuuuaaagguuugcaguuauaugcucuuaaugugacugcugauggcuuuuauuacuaaauuuaauaugua

SEQ ID NO: 11965 - RNA, 374 nt, Mus musculus
gugaccuaggagggagcuggugguaaggcuuuuagaccgaugucccccucucccuuaaaauacagagggaagcagcaccaugacucuaagucggugguucucaaccuuccuaaggcugugacacuuaauacacugacucauguugugcugaccccaacuguaaaacuauuuucauugcugcaucccaacuguaauuuugcuaguuaugaauuguaauguaagcaucuuauauguagcauagcagauaugcaaccccugucaaggagucgaaauucacagauugaacaccucugcucuaagugauuuaaagaugcucaaagaugugauaucagagcuccugccguuugcugaggugggagguugcaaccaccaca

SEQ ID NO: 11966 - RNA, 374 nt, Mus musculus
uguggugguugcaaccucccaccucagcaaacggcaggagcucugauaucacaucuuugagcaucuuuaaaucacuuagagcagagguguucaaucugugaauuucgacuccuugacagggguugcauaucugcuaugcuacauauaagaugcuuacauuacaauucauaacuagcaaaauuacaguugggaugcagcaaugaaaauaguuuuacaguuggggucagcacaacaugagucaguguauuaagugucacagccuuaggaagguugagaaccaccgacuuagagucauggugcugcuucccucuguauuuuaagggagagggggacaucggucuaaaagccuuaccaccagcucccuccuaggucac

SEQ ID NO: 11967 - RNA, 253 nt, Mus musculus
ucgcuccaccucuguaacccaccccagccucgugcccaguucugucuaaucuaccacacccugaacccucuccuaaaugccaggaggcaugaaaggccuccaacaggcaaggaaagccagggggaaauagagggcuucuugcuggagcuaauaagcaacagucuaucccagaacuaaggucuccugauuuucucuaagaugcguccuugagagauggaggccucaaauucuuuccacugcaccucauguuucc

SEQ ID NO: 11968 - RNA, 253 nt, Mus musculus
ggaaacaugaggugcaguggaaagaauuugaggccuccaucucucaaggacgcaucuuagagaaaaucaggagaccuuaguucugggauagacuguugcuuauuagcuccagcaagaagcccucuauuucccccuggcuuuccuugccuguuggaggccuuucaugccuccuggcauuuaggagaggguucagggugugguagauuagacagaacugggcacgaggcugggguggguuacagagguggagcga

SEQ ID NO: 11969 - RNA, 2275 nt, Mus musculus
gucaaaugagcccuacaaagggaauaaucaaaguaucuauuacagacacagccagcuuacacuguguguucacacguaggcuugccacuggcggggagcaaacccgaaugccacauggaugaacaaaugacaagcaacggauguaccacaguggcacuccugagccacguccucucaaguuuccuccauccaccaagaggccuaggacaagcccaaaggguccagcagggucucuagggucaugugacuucuccuacagcuacaguccucagaaagcaagcucucuuugcuaugcagaccaucaugagcacuuacccaagaacaggucagggaaagagccugccuaguccacaaccacaggcuuacacgccugagcucugggcucuccccaacugcuggcagagcugagcauggcacugguauugguggugggugguuuguguggcuagagcagccucugucaucauagugagcacaagacaggcgggugucuuugaaacacaccuggcucagucacacagcaucacucaaaucaaggcuccuuugaguuuucuuuuauuuauucagccagcuagccagccagcucucauccaucccucuuagcacugacacugguugggugggaaacuugaaaacaaaacaaaaggucucaaaagacacaccacaagaaacuaagugucacaaaggaugagauaaaagcccaucuuuugccaggauucaaagaaguuauagacugcaggcagagggcaccgaugcugaaccucagagggaguaaggauucucauaggcagacgagaggacaaucaagaagucaaugggagccgggcaguggugaugcuugccuuuaaucccaguacuugggaugcagaggcagguggauuucugaguuccaggccagccuggucuacagcgggagauccaggacagccagggcuauacagagaaagccugucucgaaaaaccaaaaaaaaaaaaaaaaaaaaaaaaaccaugggaguggaggcuggguagcagguuagcaccacauugcagauaacuuggguuguguucucugaggggaccacugaaggauucagagaaaagagacagcaagagcaaagccuggagagaaagauuccagccacagagggcuggggucaaacgacaggaacagaaagcaaauguggaaauagagcaacaugcacuagaacuccugaagauccaaggagacucugggaaccaagccagcguaaccaugaggcagugcucuggaauugggcacuggagacacagcagaggagucaccggggugcacugugcccagguuccacaccuccaggaaaagccuugaacuuaggucagcacaguaacuucuguccuuggagauuuguccugagaagccagcacgggcuucggagagcucaacugugcucuguauucacguaguaaaucugauaaaucaacuaaucccggguccauuuuuuuuuccuuuuauuucaucuuacugaacauguguggacuuuucuugucaucaaguccugugcugguuauuuuguugcaaacuugacaacacagaguccccuggggagacagaaccucaacuggagaauugccuccaucagauuggccuguggccaaugaucaacgugagagggccccgcccacugugggcagcaccaucccuaagcaggcaggccugggcuguauaagaaagucaguuaagcgcgaggcagaaggagcaguaagcaguauucccccagaguuucugcuugaguugcuguccugacuucucucgaagauggacugugaccuggaagcauaaguugacuuaaacccuuuccuccacaagaugcuucuggucaucguguuuaucacagccacaggaaagcaaacuaggacacacccugaaauaacacagcuggacaacaauuuccuccagcauuuauauuguuaucaggcauuaggaauaauuuagagguuauuccaagucuccaggaaguuguguguaggagacauguaaauacuaugccauucuuacauaagagacuugcgugcucucaaauuuuaguauccuugugggggucguagaaccaauccccauuucucuaaagcagcauuccagucacccacacaagcagccaccuccagccaccaaccaccacgacuguggggccagucuggaugccaccagcugauuaugucuggugucucugcccacccaucccuggacagaaagggcaaagggcacccuaccacccuccucugggucccucacaaaggucccauuguguaaagc

SEQ ID NO: 11970 - RNA, 2275 nt, Mus musculus
gcuuuacacaaugggaccuuugugagggacccagaggagggugguagggugcccuuugcccuuucuguccagggaugggugggcagagacaccagacauaaucagcugguggcauccagacuggccccacagucguggugguugguggcuggagguggcugcuugugugggugacuggaaugcugcuuuagagaaauggggauugguucuacgacccccacaaggauacuaaaauuugagagcacgcaagucucuuauguaagaauggcauaguauuuacaugucuccuacacacaacuuccuggagacuuggaauaaccucuaaauuauuccuaaugccugauaacaauauaaaugcuggaggaaauuguuguccagcuguguuauuucaggguguguccuaguuugcuuuccuguggcugugauaaacacgaugaccagaagcaucuuguggaggaaaggguuuaagucaacuuaugcuuccaggucacaguccaucuucgagagaagucaggacagcaacucaagcagaaacucugggggaauacugcuuacugcuccuucugccucgcgcuuaacugacuuucuuauacagcccaggccugccugcuuagggauggugcugcccacagugggcggggcccucucacguugaucauuggccacaggccaaucugauggaggcaauucuccaguugagguucugucuccccaggggacucuguguugucaaguuugcaacaaaauaaccagcacaggacuugaugacaagaaaaguccacacauguucaguaagaugaaauaaaaggaaaaaaaaauggacccgggauuaguugauuuaucagauuuacuacgugaauacagagcacaguugagcucuccgaagcccgugcuggcuucucaggacaaaucuccaaggacagaaguuacugugcugaccuaaguucaaggcuuuuccuggagguguggaaccugggcacagugcaccccggugacuccucugcugugucuccagugcccaauuccagagcacugccucaugguuacgcuggcuugguucccagagucuccuuggaucuucaggaguucuagugcauguugcucuauuuccacauuugcuuucuguuccugucguuugaccccagcccucuguggcuggaaucuuucucuccaggcuuugcucuugcugucucuuuucucugaauccuucagugguccccucagagaacacaacccaaguuaucugcaauguggugcuaaccugcuacccagccuccacucccaugguuuuuuuuuuuuuuuuuuuuuuuuugguuuuucgagacaggcuuucucuguauagcccuggcuguccuggaucucccgcuguagaccaggcuggccuggaacucagaaauccaccugccucugcaucccaaguacugggauuaaaggcaagcaucaccacugcccggcucccauugacuucuugauuguccucucgucugccuaugagaauccuuacucccucugagguucagcaucggugcccucugccugcagucuauaacuucuuugaauccuggcaaaagaugggcuuuuaucucauccuuugugacacuuaguuucuuguggugugucuuuugagaccuuuuguuuuguuuucaaguuucccacccaaccagugucagugcuaagagggauggaugagagcuggcuggcuagcuggcugaauaaauaaaagaaaacucaaaggagccuugauuugagugaugcugugugacugagccagguguguuucaaagacacccgccugucuugugcucacuaugaugacagaggcugcucuagccacacaaaccacccaccaccaauaccagugccaugcucagcucugccagcaguuggggagagcccagagcucaggcguguaagccugugguuguggacuaggcaggcucuuucccugaccuguucuuggguaagugcucaugauggucugcauagcaaagagagcuugcuuucugaggacuguagcuguaggagaagucacaugacccuagagacccugcuggacccuuugggcuuguccuaggccucuugguggauggaggaaacuugagaggacguggcucaggagugccacugugguacauccguugcuugucauuuguucauccauguggcauucggguuugcuccccgccaguggcaagccuacgugugaacacacaguguaagcuggcugugucuguaauagauacuuugauuauucccuuuguagggcucauuugac

SEQ ID NO: 11971 - RNA, 292 nt, Mus musculus
uucccagccaacgggcgggggaggggagucggaauuauagucuguucaaccuagagccuucuagaaggcuucuuacauaagagacuggccacagugacagagggauugaacuaauagguccuagggcacagaacuagauaacuuuaaagaauggagagggcacucuuuuaaaaaguagucuuguugguugccuauuuuccccuuccauacugucaaaagauuuuugucuugaucgugcacgaaaacagcaaaucgugagguuugcuggaaaucuccccacccccacugcuca

SEQ ID NO: 11972 - RNA, 292 nt, Mus musculus
ugagcaguggggguggggagauuuccagcaaaccucacgauuugcuguuuucgugcacgaucaagacaaaaaucuuuugacaguauggaaggggaaaauaggcaaccaacaagacuacuuuuuaaaagagugcccucuccauucuuuaaaguuaucuaguucugugcccuaggaccuauuaguucaaucccucugucacuguggccagucucuuauguaagaagccuucuagaaggcucuagguugaacagacuauaauuccgacuccccucccccgcccguuggcugggaa

SEQ ID NO: 11973 - RNA, 173 nt, Mus musculus
guguguuaagaauguugaguaucauagugugcucaaguguuuaugcuacagcuuucaaguccacuuuaaacugcuuucaugaaggcauguuccucuugcucuugauguaccuaguucacucuagagucugcugaggcuacugaguaguggcuuacccuuucguuuaagagcau

SEQ ID NO: 11974 - RNA, 173 nt, Mus musculus
augcucuuaaacgaaaggguaagccacuacucaguagccucagcagacucuagagugaacuagguacaucaagagcaagaggaacaugccuucaugaaagcaguuuaaaguggacuugaaagcuguagcauaaacacuugagcacacuaugauacucaacauucuuaacacac

SEQ ID NO: 11975 - RNA, 1138 nt, Mus musculus
ggcuugacgacacuccuuuugaguugcuccuguuguacauuccugcuucuccuaagauguagacacaguucucuggccuaccuacuguguucucuuuugaccauuaaaaccucaacauguuuauaguaaagcuccaagaguucucaaguucuggucucagucuuucagcuugcucuuccaauuauacugauaacucacugcucagaacaggccaccucugcuaccacccgccauacuucucuccaaaauagcuuccuucaaguccagcccaccgcccuucuaaaauauugccccgguuccuuguaagcuguaagucaccaucucugauaccaucaaccaggcugaagucucuagcucuugacuagauacuuaucaaauauagccuuguucccacaauucagaaggagcucuuggucuaaauuucuuaccagucuacaauacaggguaagaacuggcuucuguuuauauuaauuagcccagcuacugcauugcacucuuuauuuggauucauuuacuccaucaaaguauagcaauguacuuuaaauuguucauuuucugcacacacugcuggugacauaugcagauccauuugggggagccauggguacuaacagcucacaucucuacucuuuguaaaacugcccgugcuuguaauacuuuggcacccuuucccccauacaacuagcuucccuaaaucgaugacugcuugcuuguagcauaguagcauacaccuuagcacuaggaggcagagguaggggaaucuaaguguuugagguuaaccuggucucaaaacaaccuaugguucaauccauuccucauacccuuuucugucaggcuaaugcuguucuaucuauucccaucuauguagaccaggcuggccucagacuuagagaucuaccugccucgacuucccaaguauugggcuuaaaggugugugccaccagauuucuuaaagcauuuauucugucacuucacuaagaauguccucuuugggaaucacuaggacuaaucuaacaccauuuacaaauaaaggugcuuaagacaggagugaaauguuugucuuaggucaaacagaaaaccagaaaauuaaaaucugaagugagccugauucuccaaccuguaaucucaacaaacugca

SEQ ID NO: 11976 - RNA, 1138 nt, Mus musculus
ugcaguuuguugagauuacagguuggagaaucaggcucacuucagauuuuaauuuucugguuuucuguuugaccuaagacaaacauuucacuccugucuuaagcaccuuuauuuguaaaugguguuagauuaguccuagugauucccaaagaggacauucuuagugaagugacagaauaaaugcuuuaagaaaucugguggcacacaccuuuaagcccaauacuugggaagucgaggcagguagaucucuaagucugaggccagccuggucuacauagaugggaauagauagaacagcauuagccugacagaaaaggguaugaggaauggauugaaccauagguuguuuugagaccagguuaaccucaaacacuuagauuccccuaccucugccuccuagugcuaagguguaugcuacuaugcuacaagcaagcagucaucgauuuagggaagcuaguuguaugggggaaagggugccaaaguauuacaagcacgggcaguuuuacaaagaguagagaugugagcuguuaguacccauggcucccccaaauggaucugcauaugucaccagcagugugugcagaaaaugaacaauuuaaaguacauugcuauacuuugauggaguaaaugaauccaaauaaagagugcaaugcaguagcugggcuaauuaauauaaacagaagccaguucuuacccuguauuguagacugguaagaaauuuagaccaagagcuccuucugaauugugggaacaaggcuauauuugauaaguaucuagucaagagcuagagacuucagccugguugaugguaucagagauggugacuuacagcuuacaaggaaccggggcaauauuuuagaagggcggugggcuggacuugaaggaagcuauuuuggagagaaguauggcgggugguagcagagguggccuguucugagcagugaguuaucaguauaauuggaagagcaagcugaaagacugagaccagaacuugagaacucuuggagcuuuacuauaaacauguugagguuuuaauggucaaaagagaacacaguagguaggccagagaacugugucuacaucuuaggagaagcaggaauguacaacaggagcaacucaaaaggagugucgucaagcc

SEQ ID NO: 11977 - RNA, 438 nt, Mus musculus
caaugugguuaucagacaggcaguuacagcaaagcagggaacuguauacuaagggucucagagucaaucuaguggcauccacaauuuuuuaaagauguauuuacucauguauacaguguucugcugcaugugugcaucuccugcaggccagaagagagaaccagaucucauuauaaaugauugcugugaauugaacucaaaaccucuagaagaacagccaguacucuuaaccucugcaccaucucucuaguccccgcaaauguuaacuaaaaguuaaaagaauggaagaccaggagccagagagauggcucaggaguuaagagcauuggcucuucuucagugguccugaguucaauucuaccauacacauguuggcuuacaaccaucuacaacuguagucccauaggauccaauaagcucuucugcugugcaaacaaa

SEQ ID NO: 11978 - RNA, 438 nt, Mus musculus
uuuguuugcacagcagaagagcuuauuggauccuaugggacuacaguuguagaugguuguaagccaacauguguaugguagaauugaacucaggaccacugaagaagagccaaugcucuuaacuccugagccaucucucuggcuccuggucuuccauucuuuuaacuuuuaguuaacauuugcggggacuagagagauggugcagagguuaagaguacuggcuguucuucuagagguuuugaguucaauucacagcaaucauuuauaaugagaucugguucucucuucuggccugcaggagaugcacacaugcagcagaacacuguauacaugaguaaauacaucuuuaaaaaauuguggaugccacuagauugacucugagacccuuaguauacaguucccugcuuugcuguaacugccugucugauaaccacauug

SEQ ID NO: 11979 - RNA, 722 nt, Mus musculus
uaugagaaagagggcaguccaguuucagcuggcaucagagucucuguggugaaaaacgcucaacacgggugguauggaguccuuaacuuaaaggggccaccuucagaaaucacacugugcaaaguaccauguuaggucagagccagagcucgagagaacgagacuuuaauuuuguuugucugcuuuugaaaacgaaguaucauaaugauugaaagcauuuuauugauuaaauaugauucaaaaauuuugacugaaaauuagcaugucuuucgugugaaaguuacaccucccauaagugaaguuuucaacaaaacuggcauaauucuguuaacagaaauucugguaauaaggacgaggagcuuuuucaagagaaagaaaaaaaaaaucaacaauccaaagugcuuucuaaacuccaagacaaguuucuggagaugguauuuaauacaaagaagaguuaagcaccacaauacagcacugacaaacaaagacaggacaugccaccgauacacaagggaaggaaagagcacucacaugucuacacagaaaguaaaaugugcauucuagccuuucaccuggaaccuugugcuugcugucgugggacaugugagcaaagaugaaucugucugccaccucaagucaugugaugcuagccugaccaaaggagaauauuacuuguguauaugagaauuugauguuuuuuacuuuuaugcuaucuuuccuua

SEQ ID NO: 11980 - RNA, 722 nt, Mus musculus
uaaggaaagauagcauaaaaguaaaaaacaucaaauucucauauacacaaguaauauucuccuuuggucaggcuagcaucacaugacuugagguggcagacagauucaucuuugcucacaugucccacgacagcaagcacaagguuccaggugaaaggcuagaaugcacauuuuacuuucuguguagacaugugagugcucuuuccuucccuuguguaucgguggcauguccugucuuuguuugucagugcuguauuguggugcuuaacucuucuuuguauuaaauaccaucuccagaaacuugucuuggaguuuagaaagcacuuuggauuguugauuuuuuuuuucuuucucuugaaaaagcuccucguccuuauuaccagaauuucuguuaacagaauuaugccaguuuuguugaaaacuucacuuaugggagguguaacuuucacacgaaagacaugcuaauuuucagucaaaauuuuugaaucauauuuaaucaauaaaaugcuuucaaucauuaugauacuucguuuucaaaagcagacaaacaaaauuaaagucucguucucucgagcucuggcucugaccuaacaugguacuuugcacagugugauuucugaagguggccccuuuaaguuaaggacuccauaccacccguguugagcguuuuucaccacagagacucugaugccagcugaaacuggacugcccucuuucucaua

SEQ ID NO: 11981 - RNA, 409 nt, Mus musculus
uuauuauauauauuauacacuauauuuuauagacuuagaaaaaauacagcugcuuucccccccauauugauuacauguugaaaugagauuucuguguucuggaaaaagugaaauauauugacaaaaugaaguuuaccucucucucucucucucucucucuauauauauauauauauauauauauauauauauauauauauauacacacacacauacauauauauguuaauguagcugguaaaaaauugaauuacauauguggcaugcauuauauaucuauuggauacuggccagugaaacugauaccagaauagaacaucaguuuugcaguauaugcauugcaugaccuuacauagcagaucuggcagguccccaucagguugccuggguuugagaugugacucugaca

SEQ ID NO: 11982 - RNA, 409 nt, Mus musculus
ugucagagucacaucucaaacccaggcaaccugauggggaccugccagaucugcuauguaaggucaugcaaugcauauacugcaaaacugauguucuauucugguaucaguuucacuggccaguauccaauagauauauaaugcaugccacauauguaauucaauuuuuuaccagcuacauuaacauauauauguauguguguguguauauauauauauauauauauauauauauauauauauauauauagagagagagagagagagagagagguaaacuucauuuugucaauauauuucacuuuuuccagaacacagaaaucucauuucaacauguaaucaauaugggggggaaagcagcuguauuuuuucuaagucuauaaaauauaguguauaauauauauaauaa

SEQ ID NO: 11983 - RNA, 679 nt, Mus musculus
aaccaaaaaaaaaaaaccacagccuggagagguugaguaacuuggcccaagguuggcccaguuaauaaaaggcagagaugggauucaaacccagauagugagacuggcagagagcccauggaagcacccacaucagucacauggcucuggguuagucacggugcccagcgaucaguuaaggaagguuuagugauagaugaggguuuagagguggagacaagacaguagguaguuuagcuagaacuggagaggaaggacugcuuugggggguggacgugaggaugaaccagucucugucacauggaaggaggcccccacccccccaauuccccgaucucucuguccucuaaauuccugcugguacccuccaacacuccagagcccagauguagcuucuaccugcaugccuccuggccuccaagacaauguauagcauuuggagaggauggccuauucuggugguucucaauguuaggaaaaaugauguagcccucugauuguuauauuauggugaucaccaaccauaaaauuguuuaaguuguuuguguugcuacuucauaacuguaaucuugcuacugauaugaaucauaauguaaauaucuguuuuaccauucccaugagagggucauuugacccccccccuccaaggaguugcaacccacagguggagaaucacuga

SEQ ID NO: 11984 - RNA, 679 nt, Mus musculus
ucagugauucuccaccuguggguugcaacuccuuggagggggggggucaaaugacccucucaugggaaugguaaaacagauauuuacauuaugauucauaucaguagcaagauuacaguuaugaaguagcaacacaaacaacuuaaacaauuuuaugguuggugaucaccauaauauaacaaucagagggcuacaucauuuuuccuaacauugagaaccaccagaauaggccauccucuccaaaugcuauacauugucuuggaggccaggaggcaugcagguagaagcuacaucugggcucuggaguguuggaggguaccagcaggaauuuagaggacagagagaucggggaauugggggggugggggccuccuuccaugugacagagacugguucauccucacguccaccccccaaagcaguccuuccucuccaguucuagcuaaacuaccuacugucuugucuccaccucuaaacccucaucuaucacuaaaccuuccuuaacugaucgcugggcaccgugacuaacccagagccaugugacugaugugggugcuuccaugggcucucugccagucucacuaucuggguuugaaucccaucucugccuuuuauuaacugggccaaccuugggccaaguuacucaaccucuccaggcugugguuuuuuuuuuuugguu

SEQ ID NO: 11985 - RNA, 1912 nt, Mus musculus
cuagcauagaaggcacaggcaaucaagcguuucuggccaucgcuuuggccuuugggaccacacacagcacaagacucagcaacaagucaagcucaugcuauacuggguaguauagugaaagguagugcuccucacgguggagaguagaguggagcuccacuaugacaggucacggaaaucuucuuaccuagguauaaaucucauuuaaaaaaaaacaaaaaacaaaaaacaaccaaaaaccugggagguuaauuuauucccucagauugacaguggaugacauguucaagacuuuagccauguccuuugucuucaaaugcuacugucaugacaugcaaagacaugucagagcaaaggaugagaagguggaauuaccaagauugaaaguguacuucguguccaucacuggauaaaugugaguuguaugaguuauuuuuuaucagucugauacauuccuaaagggaacagugccaaggugggaaagacugauuuuggccuuguggcuuuuaguucaguugucuggcuuuguugacauggucuaguguucgagaagaacaccauggcagcaaaagcaaguaauagagugaaauuacccacuccaugauagccagaaguagaaauagauugucugcaauaacugacuucuucccccuuuguuucauuggggcucccuggccaugggaugguaccucuccaguucagagaugggcuucuacucucuaugaauggugucucgaaauaaccucacaaacaaaugcaguugugugccuuacuaaucuuccuguguaucuuacuuagaaagcuacugggcuugaauuuggcuccuuccauguuacugcagacuuacagaauggcuccgcaugcaguacaccauacugaauguuacaugugcaguugaaagaauguucugcaauuugggacggagucuuccauaaauauccaccaugagaggcuggguaucugaccugaugaagauuuguuggugaaggaaaguguucuuuuauugcugugauacucaaauaaacccacacuaggacacagggcugucgcucucucucucucucucucucucucucucucucucucucucucucucucucucuccuuucuggguuugggaguagcaauaucaucaguuucauagaacaucaucucuuauaguuugucuucaggaucagaaaaggcaacauccaagugggugaaaagucauggccaggagacagacuuugugccaauguguucuccaugugaccaaauaagaagaaaaugccaggaacucuaaacagacagccaggaccaagcgaaaacagcucgauauuugcuagaggaagauucauucacaugaaugaggagauguuguguuaugacucugucucuuuccuuaucacauucacgugauacuuauuccaaggccuccugucacugucccgaguucuguagaugcugucccagagagagccaugaacucucauaggacaggaauuuauuucucaguuauaccuuugaauaaggcaugcucaaugucuuuucucuuauacagacaaccauguaauuuuugugcucucagucuuuagcagaagggcuaaggagugucuuuuguaaaaauacgaauccuauucacaagggccucaauuucacguucuaaucaaccauguugacuugaaguugaauaaugcucccgggcaaacccccugcccccucccucucccccccuaggcucagguguuucucaguuggcacugcuuugggauguuguggaaccuuuaggaaaugcagccuugacagaaggaaguaugucacaaagcugggggauuuugaaaguucauaacuuacaguuuccuuucuuggcuucuuggguguggauaaagaugugaucuuucugacucccgcucccugccauuguggaaucccu

SEQ ID NO: 11986 - RNA, 1912 nt, Mus musculus
agggauuccacaauggcagggagcgggagucagaaagaucacaucuuuauccacacccaagaagccaagaaaggaaacuguaaguuaugaacuuucaaaaucccccagcuuugugacauacuuccuucugucaaggcugcauuuccuaaagguuccacaacaucccaaagcagugccaacugagaaacaccugagccuagggggggagagggagggggcaggggguuugcccgggagcauuauucaacuucaagucaacaugguugauuagaacgugaaauugaggcccuugugaauaggauucguauuuuuacaaaagacacuccuuagcccuucugcuaaagacugagagcacaaaaauuacaugguugucuguauaagagaaaagacauugagcaugccuuauucaaagguauaacugagaaauaaauuccuguccuaugagaguucauggcucucucugggacagcaucuacagaacucgggacagugacaggaggccuuggaauaaguaucacgugaaugugauaaggaaagagacagagucauaacacaacaucuccucauucaugugaaugaaucuuccucuagcaaauaucgagcuguuuucgcuugguccuggcugucuguuuagaguuccuggcauuuucuucuuauuuggucacauggagaacacauuggcacaaagucugucuccuggccaugacuuuucacccacuuggauguugccuuuucugauccugaagacaaacuauaagagaugauguucuaugaaacugaugauauugcuacucccaaacccagaaaggagagagagagagagagagagagagagagagagagagagagagagagagagagagcgacagcccuguguccuaguguggguuuauuugaguaucacagcaauaaaagaacacuuuccuucaccaacaaaucuucaucaggucagauacccagccucucaugguggauauuuauggaagacuccgucccaaauugcagaacauucuuucaacugcacauguaacauucaguaugguguacugcaugcggagccauucuguaagucugcaguaacauggaaggagccaaauucaagcccaguagcuuucuaaguaagauacacaggaagauuaguaaggcacacaacugcauuuguuugugagguuauuucgagacaccauucauagagaguagaagcccaucucugaacuggagagguaccaucccauggccagggagccccaaugaaacaaagggggaagaagucaguuauugcagacaaucuauuucuacuucuggcuaucauggaguggguaauuucacucuauuacuugcuuuugcugccaugguguucuucucgaacacuagaccaugucaacaaagccagacaacugaacuaaaagccacaaggccaaaaucagucuuucccaccuuggcacuguucccuuuaggaauguaucagacugauaaaaaauaacucauacaacucacauuuauccagugauggacacgaaguacacuuucaaucuugguaauuccaccuucucauccuuugcucugacaugucuuugcaugucaugacaguagcauuugaagacaaaggacauggcuaaagucuugaacaugucauccacugucaaucugagggaauaaauuaaccucccagguuuuugguuguuuuuuguuuuuuguuuuuuuuuaaaugagauuuauaccuagguaagaagauuuccgugaccugucauaguggagcuccacucuacucuccaccgugaggagcacuaccuuucacuauacuacccaguauagcaugagcuugacuuguugcugagucuugugcuguguguggucccaaaggccaaagcgauggccagaaacgcuugauugccugugccuucuaugcuag

SEQ ID NO: 11987 - RNA, 491 nt, Mus musculus
acugugugccagcuugucuaugaaguauguuccugcucuggaacuucuauuguaaaguccagaaacuuuggugaucucacuaaugcuccuuugcuggugaagaaauaguaucuuagggaaauuaguuuacuuauggccacauagccaguuagugauggagacauuuuuaaacgaaguucugucaaauucuaaagacaguagguuuuggggguuuuuuguuuguuucuuuuguuuuuuguuuuuaaacuuguaacucagauguuugaaaagggcaucauuguuaggucuuagaccaagcaagaaaugauggcugucccuuugcuggccaggaagguuugggcaaguugauuuauaaacauggcaauuuugacaucuguucaacaagacuucaccauuucccucuucucgggguuguccgguccccaagcugugcuugaggaguauugggcuagccacuuccuucccacugcuuugguuuucuuacuuucaac

SEQ ID NO: 11988 - RNA, 491 nt, Mus musculus
guugaaaguaagaaaaccaaagcagugggaaggaaguggcuagcccaauacuccucaagcacagcuuggggaccggacaaccccgagaagagggaaauggugaagucuuguugaacagaugucaaaauugccauguuuauaaaucaacuugcccaaaccuuccuggccagcaaagggacagccaucauuucuugcuuggucuaagaccuaacaaugaugcccuuuucaaacaucugaguuacaaguuuaaaaacaaaaaacaaaagaaacaaacaaaaaacccccaaaaccuacugucuuuagaauuugacagaacuucguuuaaaaaugucuccaucacuaacuggcuauguggccauaaguaaacuaauuucccuaagauacuauuucuucaccagcaaaggagcauuagugagaucaccaaaguuucuggacuuuacaauagaaguuccagagcaggaacauacuucauagacaagcuggcacacagu

SEQ ID NO: 11989 - RNA, 529 nt, Mus musculus
cuugguaagugggcucugugggugaauggguuggaaucccaguuuugggauugcacugcagaugagcagaguggugagucgaaggggggugggggaugcucacagucaucuauaagguggaacacagggcccccaauugagaagcuauagagagcacccaaggagccaaaggggucugcaauccuauagguggaacaacaauaugaacuaaccaguacccccagagcucgugucucuggcugcauuuguaucagaagauggccuaguuggccaucacugggaagagaggccccuugguauugcaaacuuuauaugccccaguacaggggaaugccagggccaagaagugagaguggguggguggguaggggagcaggguagggggaggguauagggaaauuucgggauagcacuugaaauguauauaaagaaaauaucuaauaaaaauaaauaaaaaaagaaagaaagaaaaaaaugucuccaugccucugucuguccucucaucaugugaaaaugugcugguaagcuu

SEQ ID NO: 11990 - RNA, 529 nt, Mus musculus
aagcuuaccagcacauuuucacaugaugagaggacagacagaggcauggagacauuuuuuucuuucuuucuuuuuuuauuuauuuuuauuagauauuuucuuuauauacauuucaagugcuaucccgaaauuucccuauacccucccccuacccugcuccccuacccacccacccacucucacuucuuggcccuggcauuccccuguacuggggcauauaaaguuugcaauaccaaggggccucucuucccagugauggccaacuaggccaucuucugauacaaaugcagccagagacacgagcucuggggguacugguuaguucauauuguuguuccaccuauaggauugcagaccccuuuggcuccuugggugcucucuauagcuucucaauugggggcccuguguuccaccuuauagaugacugugagcaucccccaccccccuucgacucaccacucugcucaucugcagugcaaucccaaaacugggauuccaacccauucacccacagagcccacuuaccaag

SEQ ID NO: 11991 - RNA, 744 nt, Mus musculus
ccacaagguaaggcaaacgcaacuauggcaaauguaagugcacagcuuugggggacaacuacaaacagaauuaacaccaauuagcuggagaguccaggcugugggacauuaggccacguggcccagguguggccaacccacagagccacccuccuuacccucagccccguguccccagaggggcgggguaagcagacacacagacaggauacaguucugagaacaagugcacuuuauugguucugauacaaagcugccagaaaagccagcagguggguauaugguaucugguccugcccaaggggagugccaaguccucaauguugcacugugauguggauucugcccggcuguuuguagggcugucgcuuagcaggcagaccugccucugcaguccuguggcuggcauguccugccguggauguguggguucuuaggcagccaguccuucuuucagggacggggcuucccacccagccucugcuguagccacauggccuggccuacccagaccccgcaggccgugagaucucaaccaaggcuacucuuaaccaagagccauaguuuucugcugcugcaggccccugggcccuuugcaucucaggccuguuugggcuagucuaggcagcauggcaugacuggcuguccaagccugcccugggcgcucugagcuggccaccugccgcaggcugagcaguagagggaauggaguuucccugaguggccccaguaucagcaggugcu

SEQ ID NO: 11992 - RNA, 744 nt, Mus musculus
agcaccugcugauacuggggccacucagggaaacuccauucccucuacugcucagccugcggcagguggccagcucagagcgcccagggcaggcuuggacagccagucaugccaugcugccuagacuagcccaaacaggccugagaugcaaagggcccaggggccugcagcagcagaaaacuauggcucuugguuaagaguagccuugguugagaucucacggccugcggggucuggguaggccaggccauguggcuacagcagaggcugggugggaagccccgucccugaaagaaggacuggcugccuaagaacccacacauccacggcaggacaugccagccacaggacugcagaggcaggucugccugcuaagcgacagcccuacaaacagccgggcagaauccacaucacagugcaacauugaggacuuggcacuccccuugggcaggaccagauaccauauacccaccugcuggcuuuucuggcagcuuuguaucagaaccaauaaagugcacuuguucucagaacuguauccugucugugugucugcuuaccccgccccucuggggacacggggcugaggguaaggaggguggcucuguggguuggccacaccugggccacguggccuaaugucccacagccuggacucuccagcuaauugguguuaauucuguuuguaguugucccccaaagcugugcacuuacauuugccauaguugcguuugccuuaccuugugg

SEQ ID NO: 11993 - RNA, 300 nt, Mus musculus
acccagauucccagcacccauaugguggcucacaggggacugucacuccagaucuaggggagcuggugcccucuucuggcuucugcaggcaauagacacacaagcacgcacaggcaugcaaaauacccauacacacacacacauacaucuauguauguauguauguauguauguauguauguauguauguauguauguauacagguguauguguauaaauauagacaagacaaauuuuaaaaagcauaauaaaacaugaauccagaaaaaaaaaaaggccaguagugaaacaggccuggg

SEQ ID NO: 11994 - RNA, 300 nt, Mus musculus
cccaggccuguuucacuacuggccuuuuuuuuuuucuggauucauguuuuauuaugcuuuuuaaaauuugucuugucuauauuuauacacauacaccuguauacauacauacauacauacauacauacauacauacauacauacauacauagauguauguguguguguguauggguauuuugcaugccugugcgugcuugugugucuauugccugcagaagccagaagagggcaccagcuccccuagaucuggagugacaguccccugugagccaccauaugggugcugggaaucugggu

SEQ ID NO: 11995 - RNA, 1950 nt, Mus musculus
uacuuuuccguuugggaaggucaggauggaaaacaaaaucucaacaaauaccaagccuaaaguuaguaaucaugaugacacaucuaucuugcacaacacaggaaauaccaagaaagaaauguuacuucaaaaguuacacaucaagaaauaucacugguuuaucagcaaggagcuccuuguugugcacagcaacggcaggcgcugcagacaacucaaacaugcagauuaagaaccacaaagucaccguaaguaagacauauuccuucccauacauucucucuccguugggccagugugucagcacuaguaacugccucagugucuuuucuagucuguccuuggcaagcagcacccguacaacuucuguuucccuaugacuuuuaaugaaaagauucugacuucucccuaaagacuacuuggcaugacagaagcuucauuaauuaaaacaagagacaaauuauuuucauagcaccaucuuauccauaccccccaaaacccacauauauguguguguacacauacacacacacacacauauauauguguauacauauauacacacacauacacacucaugcaaugaaccaaauaacagcaaugaucuguggcuagguagcauuuuucagucagaaagcuuggcuuacaauuuuuaucuagucaguauuuuuucaagauuuccuucaucaaauauauuuacuucuaaugucuggaacaaucaaggcccauaacaggauuccugauccacuuuuuuaaaaggacuuuaagaaucucugucuagaaucaaaagccagccacuaagaaauaaucugaauacaacagugucuguuggcugggcuugcucaugcauuauaccaaugcugugaaauucaagcucugacgccaaacaggcugcacacugcaguuguuucccacuagauaaacucuuuacauucauaauguaacuuagacaccaugucuucagaauuccaaaucacaauuucauugucuuuaguaucuuaacccccuggcuucucccaguccuaguagcacacauggucuggucuuuucagacaggacaagcaaagcauacccuucuucccuucagagaccugagcuuucucgcaaagcccaacaugaaaagaccccauucuguaggagagaggccggccuugcuuuauaggcuucuuccucaagcccaccuccaugcugcguugaaaacacaaaaagaaguaacagggaaguuuccauacuggcgcaggagucaggucagaacuagaagcgagagggcugcuaccacgcaagccugcggugaagggaagagaggacucacacugucaauacaugucucuucuuauugucaaagccaacuaucucucuaguagaaugcggagaugugaaaaugguuaagaaugggaggaauaaaguaacaugauuuuaaacacacgcgcacacgcaugcacacauacacccacacacacacacacacaagcacacacgcacuuuuaaagaucucaauacuucaagaggccugagccuauuucacucuuggccaagagccuacccucccccccacccugcacacauucccacccucccaccccccccccaccagucacugcuauguuccucauacacacagcaaaaucccuuucccucccgauuauauaaaaaaaacuaaacauaacuuacuuucuuuaaauuauuuuuuaaaagucucuuaaagauuugacguuuaaauacuuccucucuucugauauguuuaacaccaaaagcauccacaaccgcuugauaugcccuccacauuuuaguucuggcaagaagagggaagauaacuacuccaaucaaccuaguuaggaugaagagaggccaagaguagaguguguucuucauccuucacagcuucgacauaaucccaccucucuaauaccagcacgaacuguagaugugaggcagcagaucgaauaacugagg

SEQ ID NO: 11996 - RNA, 1950 nt, Mus musculus
ccucaguuauucgaucugcugccucacaucuacaguucgugcugguauuagagaggugggauuaugucgaagcugugaaggaugaagaacacacucuacucuuggccucucuucauccuaacuagguugauuggaguaguuaucuucccucuucuugccagaacuaaaauguggagggcauaucaagcgguuguggaugcuuuugguguuaaacauaucagaagagaggaaguauuuaaacgucaaaucuuuaagagacuuuuaaaaaauaauuuaaagaaaguaaguuauguuuaguuuuuuuuauauaaucgggagggaaagggauuuugcuguguguaugaggaacauagcagugacugguggggggggggugggagggugggaaugugugcagggugggggggaggguaggcucuuggccaagagugaaauaggcucaggccucuugaaguauugagaucuuuaaaagugcgugugugcuuguguguguguguguguggguguaugugugcaugcgugugcgcguguguuuaaaaucauguuacuuuauuccucccauucuuaaccauuuucacaucuccgcauucuacuagagagauaguuggcuuugacaauaagaagagacauguauugacagugugaguccucucuucccuucaccgcaggcuugcgugguagcagcccucucgcuucuaguucugaccugacuccugcgccaguauggaaacuucccuguuacuucuuuuuguguuuucaacgcagcauggaggugggcuugaggaagaagccuauaaagcaaggccggccucucuccuacagaauggggucuuuucauguugggcuuugcgagaaagcucaggucucugaagggaagaaggguaugcuuugcuuguccugucugaaaagaccagaccaugugugcuacuaggacugggagaagccaggggguuaagauacuaaagacaaugaaauugugauuuggaauucugaagacauggugucuaaguuacauuaugaauguaaagaguuuaucuagugggaaacaacugcagugugcagccuguuuggcgucagagcuugaauuucacagcauugguauaaugcaugagcaagcccagccaacagacacuguuguauucagauuauuucuuaguggcuggcuuuugauucuagacagagauucuuaaaguccuuuuaaaaaaguggaucaggaauccuguuaugggccuugauuguuccagacauuagaaguaaauauauuugaugaaggaaaucuugaaaaaauacugacuagauaaaaauuguaagccaagcuuucugacugaaaaaugcuaccuagccacagaucauugcuguuauuugguucauugcaugaguguguauguguguguauauauguauacacauauauauguguguguguguguauguguacacacacauauauguggguuuugggggguauggauaagauggugcuaugaaaauaauuugucucuuguuuuaauuaaugaagcuucugucaugccaaguagucuuuagggagaagucagaaucuuuucauuaaaagucauagggaaacagaaguuguacgggugcugcuugccaaggacagacuagaaaagacacugaggcaguuacuagugcugacacacuggcccaacggagagagaauguaugggaaggaauaugucuuacuuacggugacuuugugguucuuaaucugcauguuugaguugucugcagcgccugccguugcugugcacaacaaggagcuccuugcugauaaaccagugauauuucuugauguguaacuuuugaaguaacauuucuuucuugguauuuccuguguugugcaagauagaugugucaucaugauuacuaacuuuaggcuugguauuuguugagauuuuguuuuccauccugaccuucccaaacggaaaagua

SEQ ID NO: 11997 - RNA, 1030 nt, Mus musculus
ccggcugaaaccccuacccugacuacacagugguauucaaggaagaauucaugcaauuaucuggauaauuggagggagagagauggggagggagagggagagaauauagaagaaaaauaguuacucuuaaaacaaggaggucgggcuuacagauuugaacacugcugagaaaugaugagaucuguugaaguacucugaucucugauccaguuucauuuucauuuuggauacuagcuuggauucacuaugucugcauagaccugccuccucuaauauuguaauuaucacaaguaaguagauaauagauaauuauagggugucaauaauauuauuuuauaacuacauaagauaugauuagaguuaauguuagaggcuuuguuggaagcuggaggcaagguagagaggccuuaggaauuuuuuucuuuccuauuuuuaccugugugggaaucuccagaaaucccuaagacucuaaauucauccccuggauguuuuaagggaaagcucuaggaucuuaggguauauaaaauccaaagaccaagaugaggaaacacuaauuugauacucagccccucuuagccuagaggacaauggaagccccucuuaucucauuagaagacuuaguucccaguacaaguccacuaggguuugggagacuugguuggugugguccaugagagcaagacaggggcuuaucaaaaucaaguucauugucaaccccacauaggaacuaggcccagaaugaagcccucuuuuauccccaauuugucuuuccuggaguccacgccuuaacaauacuggagucaagacaaacgcccagcuggagcuagggaggucaaauuuaaggcagggaucagggaaagauuuuaaauuuugcuauuguuauuuuggaggguugagaaauccgaaggcuguaggaggaagaggggaagaaaugaucacagaagcagagagugaggugaaagagaguugagagaaaguaugagaccgugaguaagguagauauaaaacaaaaaggaguggcaggaauaac

SEQ ID NO: 11998 - RNA, 1030 nt, Mus musculus
guuauuccugccacuccuuuuuguuuuauaucuaccuuacucacggucucauacuuucucucaacucucuuucaccucacucucugcuucugugaucauuucuuccccucuuccuccuacagccuucggauuucucaacccuccaaaauaacaauagcaaaauuuaaaaucuuucccugaucccugccuuaaauuugaccucccuagcuccagcugggcguuugucuugacuccaguauuguuaaggcguggacuccaggaaagacaaauuggggauaaaagagggcuucauucugggccuaguuccuaugugggguugacaaugaacuugauuuugauaagccccugucuugcucucauggaccacaccaaccaagucucccaaacccuaguggacuuguacugggaacuaagucuucuaaugagauaagaggggcuuccauuguccucuaggcuaagaggggcugaguaucaaauuaguguuuccucaucuuggucuuuggauuuuauauacccuaagauccuagagcuuucccuuaaaacauccaggggaugaauuuagagucuuagggauuucuggagauucccacacagguaaaaauaggaaagaaaaaaauuccuaaggccucucuaccuugccuccagcuuccaacaaagccucuaacauuaacucuaaucauaucuuauguaguuauaaaauaauauuauugacacccuauaauuaucuauuaucuacuuacuugugauaauuacaauauuagaggaggcaggucuaugcagacauagugaauccaagcuaguauccaaaaugaaaaugaaacuggaucagagaucagaguacuucaacagaucucaucauuucucagcaguguucaaaucuguaagcccgaccuccuuguuuuaagaguaacuauuuuucuucuauauucucucccucucccuccccaucucucucccuccaauuauccagauaauugcaugaauucuuccuugaauaccacuguguagucaggguagggguuucagccgg

SEQ ID NO: 11999 - RNA, 835 nt, Mus musculus
cgggaagggaaggaaaagacugaaagaggcacgaagaagacagacaagggucagucuuugggcugacucugccuggcggguuugcagcagucugggugggcgggggcaccaugacaaagugaaggucaaguuagcaucguaccuuauaaggaaggcgucgguccuccauuucagccuuucucucuggaaggacuuagcgcuggcauuucuggucuuguaaacacaggacuuuuuuuuuuuuuuuuaagccuccuuucuuuauugagagugaauucugcagccccgggaagcuguggcuguggacugggaagucaacuaaugaagauggcaggaaacuuuucucuccuuuucugccucuggcuccacucccugccagcuggggcggcccccaucucuucugucuucuguaucuuucaccauugucucuaaaucugggcacgauuucuuuacucccugacuccccugcagacuuguaaaacccuuccauuccacagcagcaaaguggagaaggacuuuaagaauuggagagaaaauuaagcaucauaaagaaaacuucauuuacagcuuaauugucugucugaguauuacaguuuucuucugaaaacaaagcgauauauucgguaaggaggagugaggucacagggauggggagggccaguguagcgguagacuuggauuuauuuauuucucaauccugagguggaaaggaaagaacagaaggaggggagugagagagaagcauuuuaaccaugaaacuaccaaaggugggugcagcuggugagauuggaagcaacauucuagcugcacggaccugguacucaccccagccugggcc

SEQ ID NO: 12000 - RNA, 835 nt, Mus musculus
ggcccaggcuggggugaguaccagguccgugcagcuagaauguugcuuccaaucucaccagcugcacccaccuuugguaguuucaugguuaaaaugcuucucucucacuccccuccuucuguucuuuccuuuccaccucaggauugagaaauaaauaaauccaagucuaccgcuacacuggcccuccccaucccugugaccucacuccuccuuaccgaauauaucgcuuuguuuucagaagaaaacuguaauacucagacagacaauuaagcuguaaaugaaguuuucuuuaugaugcuuaauuuucucuccaauucuuaaaguccuucuccacuuugcugcuguggaauggaaggguuuuacaagucugcaggggagucagggaguaaagaaaucgugcccagauuuagagacaauggugaaagauacagaagacagaagagaugggggccgccccagcuggcagggaguggagccagaggcagaaaaggagagaaaaguuuccugccaucuucauuaguugacuucccaguccacagccacagcuucccggggcugcagaauucacucucaauaaagaaaggaggcuuaaaaaaaaaaaaaaaaguccuguguuuacaagaccagaaaugccagcgcuaaguccuuccagagagaaaggcugaaauggaggaccgacgccuuccuuauaagguacgaugcuaacuugaccuucacuuugucauggugcccccgcccacccagacugcugcaaacccgccaggcagagucagcccaaagacugacccuugucugucuucuucgugccucuuucagucuuuuccuucccuucccg

SEQ ID NO: 12001 - RNA, 176 nt, Mus musculus
gcacuugcccuuccccucccuccagacgccccccgcacccgcaagaagcgcugcccuuauucgaaauuccagauccgggaacuggagcgagaguuuuucuucaacguguacaucaacaaagagaagcggcugcagcugucccggaugcugaaccugacagaccgacaagugaaaau

SEQ ID NO: 12002 - RNA, 176 nt, Mus musculus
auuuucacuugucggucugucagguucagcauccgggacagcugcagccgcuucucuuuguugauguacacguugaagaaaaacucucgcuccaguucccggaucuggaauuucgaauaagggcagcgcuucuugcgggugcggggggcgucuggagggaggggaagggcaagugc

SEQ ID NO: 12003 - RNA, 1214 nt, Mus musculus
ccuaccgacagugagcagagagcugcagccgcccgagcccgcagccggcaccgcgcccccaccugcccagcccccagcccagcaguccagcccgggggagccggccagcuugggguucggucccggggggaggggaguuucggggauacccggcgggggagcgugauccaaggggagggggccgcggguuuucauguacccagcaugagcuccuacuucgucaacccccuguuuuccaaauacaaaggcggcgagucccuggaaccggccuauuacgacugccgguucccucagagcgugggcagaagccaugcgcugguguacgggcccggcggcuccgcgcccgguuuccagcacgccucgcaccacguccaagacuucuuccaccacggcaccuccggcaucuccaacucgggcuaccagcagaacccaugcucgcugagcugccacggagacgccuccaaauucuauggcuacgaggcgcuccccagacagucccuuuauggggcucagcaagaggcgagcguggugcaauaucccgacuguaaauccuccgccaacacuaacaguagcgaaggacaaggccacuuaaaucagaacucgucucccagccucauguuuccauggaugagaccccacggugagaagccuuuucucuuucccccuuggucucccgcgcuccggggucuuccccccucccucgccuccuuuuugucugcccuagcucgcuuuccuuccuggcuuugggggucucucccacuccacucccgugccuggguggguuccugggagauugaaaggcuuggcuggggguggagcguggggugccugagacauugugcuuguuggggugaaggugggggaaaggugacuugugggugcaaaggguuaaaaaucguuuucucuauuccuucugucucuccuucuucccaucuguaaagccaaaguuggggagauggcuggcaaggacacccuaaguaaacugagguuaucagucuuugggguugguagccaguuuucccaaagacauuucccaacgccagccaucccaagacagugaccagacuguugggugaaaaggagacccuuugcuaucucccccuagucagggagaggggcaagaccuccccucucccaaggacaagcauucugccucucuaggauugucacuucuuccccucagagaagcagccugaaggccacuaccccaacuu

SEQ ID NO: 12004 - RNA, 1214 nt, Mus musculus
aaguugggguaguggccuucaggcugcuucucugaggggaagaagugacaauccuagagaggcagaaugcuuguccuugggagaggggaggucuugccccucucccugacuagggggagauagcaaagggucuccuuuucacccaacagucuggucacugucuugggauggcuggcguugggaaaugucuuugggaaaacuggcuaccaaccccaaagacugauaaccucaguuuacuuaggguguccuugccagccaucuccccaacuuuggcuuuacagaugggaagaaggagagacagaaggaauagagaaaacgauuuuuaacccuuugcacccacaagucaccuuucccccaccuucaccccaacaagcacaaugucucaggcaccccacgcuccacccccagccaagccuuucaaucucccaggaacccacccaggcacgggaguggagugggagagacccccaaagccaggaaggaaagcgagcuagggcagacaaaaaggaggcgagggaggggggaagaccccggagcgcgggagaccaagggggaaagagaaaaggcuucucaccguggggucucauccauggaaacaugaggcugggagacgaguucugauuuaaguggccuuguccuucgcuacuguuaguguuggcggaggauuuacagucgggauauugcaccacgcucgccucuugcugagccccauaaagggacugucuggggagcgccucguagccauagaauuuggaggcgucuccguggcagcucagcgagcauggguucugcugguagcccgaguuggagaugccggaggugccgugguggaagaagucuuggacguggugcgaggcgugcuggaaaccgggcgcggagccgccgggcccguacaccagcgcauggcuucugcccacgcucugagggaaccggcagucguaauaggccgguuccagggacucgccgccuuuguauuuggaaaacaggggguugacgaaguaggagcucaugcuggguacaugaaaacccgcggcccccuccccuuggaucacgcucccccgccggguauccccgaaacuccccuccccccgggaccgaaccccaagcuggccggcucccccgggcuggacugcugggcugggggcugggcaggugggggcgcggugccggcugcgggcucgggcggcugcagcucucugcucacugucgguagg

SEQ ID NO: 12005 - RNA, 1059 nt, Mus musculus
uucugaguuugaggccagccuagucuacagagugaguuccaggacagccagggcuacacagagaaacccugccucaaaaagaaaaaaaaaaaaaaaaaaaaacaagaguaugaaaguggcaaggaagugaccaucuaacagaagaugggugugcuccuguggcuacucugcugaagccagggcccacggccccuugugaacaucacacucaguagggagaagauaaagaucuggcuuccucagagcaugcuccgcccuggaugagugaaggcaguaauggugacaccccgcauaugggaaagaagagcgcucgcccugcaacugagaucaaggaccccauucccucuguuggugucaaagcacagaucugcaauccuucuugccucaguaacaagcacuccugaggcccccgguucugugggccugucugauuaacuuacuagaaggagguccauacagagagaagccacagagcccugaaggucucuccagauccguccacuaaucauuacugcacucuuaguaauagucugcauccaaaucuaagcacuguguacuuccucucaagcuuucaauggcgccauacuauacucauaacaaaacucaacuucuuccucugaagggcugcccuguaacucaucugucaccagcuuugccuggcuaauggccucuguccacccuggguucacuuucuuuuuuucuuuuuucuuuuuuugguuuuucgagucagggauucucuguguagcccuggcugcccuggaacucacucuguagaccaggcuggccucgaacucagaaaucugccugccaagugcuaggauuaaaggccugcaccaccaccgcccggccacuuucuuuuucuuuacuggcuuuuuuucuucucacccuucuggccucuguugaaauccacccaccugggcacuguccuccacaauacuauuacguucaacucuacuucacuucuuuacaucacagcccaccacauacccccggguguucugauucuucaguggauuuauauugugcuugcugaccagaggcuguuaaguuccacagaga

SEQ ID NO: 12006 - RNA, 1059 nt, Mus musculus
ucucuguggaacuuaacagccucuggucagcaagcacaauauaaauccacugaagaaucagaacacccggggguauguggugggcugugauguaaagaagugaaguagaguugaacguaauaguauuguggaggacagugcccagguggguggauuucaacagaggccagaagggugagaagaaaaaaagccaguaaagaaaaagaaaguggccgggcggugguggugcaggccuuuaauccuagcacuuggcaggcagauuucugaguucgaggccagccuggucuacagagugaguuccagggcagccagggcuacacagagaaucccugacucgaaaaaccaaaaaaagaaaaaagaaaaaaagaaagugaacccaggguggacagaggccauuagccaggcaaagcuggugacagaugaguuacagggcagcccuucagaggaagaaguugaguuuuguuaugaguauaguauggcgccauugaaagcuugagaggaaguacacagugcuuagauuuggaugcagacuauuacuaagagugcaguaaugauuaguggacggaucuggagagaccuucagggcucuguggcuucucucuguauggaccuccuucuaguaaguuaaucagacaggcccacagaaccgggggccucaggagugcuuguuacugaggcaagaaggauugcagaucugugcuuugacaccaacagagggaaugggguccuugaucucaguugcagggcgagcgcucuucuuucccauaugcggggugucaccauuacugccuucacucauccagggcggagcaugcucugaggaagccagaucuuuaucuucucccuacugagugugauguucacaaggggccgugggcccuggcuucagcagaguagccacaggagcacacccaucuucuguuagauggucacuuccuugccacuuucauacucuuguuuuuuuuuuuuuuuuuuuuucuuuuugaggcaggguuucucuguguagcccuggcuguccuggaacucacucuguagacuaggcuggccucaaacucagaa

SEQ ID NO: 12007 - RNA, 380 nt, Mus musculus
agacacuaggaccggcucacccagcuccugcgcgggcuggaccaguccagguccucagagcaucccaggcacgcgccagcccugcuccuuguagagucucgggauccuaucgucaaccgggauguggggcgcggccgggauggggggugggcgggcacccacuuaccagcagcuccacgaggcugccgggucaauaagaaggaggcggcgaggagaggaggcggaggaccggaccggcucaagacugcagcaugagugagggccuucuggguccucccugucauuuaaacagccccucgugagucaccgcacggggcagugucggccugcggggcggggcaaccucugggagcaucaucagggaauuguguucaaguuga

SEQ ID NO: 12008 - RNA, 380 nt, Mus musculus
ucaacuugaacacaauucccugaugaugcucccagagguugccccgccccgcaggccgacacugccccgugcggugacucacgaggggcuguuuaaaugacagggaggacccagaaggcccucacucaugcugcagucuugagccgguccgguccuccgccuccucuccucgccgccuccuucuuauugacccggcagccucguggagcugcugguaagugggugcccgcccaccccccaucccggccgcgccccacaucccgguugacgauaggaucccgagacucuacaaggagcagggcuggcgcgugccugggaugcucugaggaccuggacugguccagcccgcgcaggagcugggugagccgguccuagugucu

SEQ ID NO: 12009 - RNA, 63 nt, Mus musculus
auaaguaaaaagaauguuuuuauuuuucucuuagacaauugauaguauauuuuacauuuaugg

SEQ ID NO: 12010 - RNA, 63 nt, Mus musculus
ccauaaauguaaaauauacuaucaauugucuaagagaaaaauaaaaacauucuuuuuacuuau

SEQ ID NO: 12011 - RNA, 4003 nt, Mus musculus
acaaauaguaaaggacuagcugauuuuauauucucuaaugccucuguaauuaacucaguaucacauuagcauaagaauaaauagauuaaugaggccaaagauaaagagcucuuaaauaaaaagcaguaucaguuaaauauuaaaagcaucucaacucaguagccaaguguuagauagcagcauaucaaaucacuguacagcugaauacuuuaaaauaccaacaaacaaaugaacaaaaaacccacacaugauuuguucuacccuccaaauguggauaauguucaaacuaaaacucaaauacagaaaaauuaaucaaugcuaauaugcaaaaaagauucuguauaaucuagcuauagaaauaucuuuauggcucaaaauuauaauuaaaaguacauguggauuucaauaauaguucagauauuacuagcauauccaauguuugcucauuuuggugcucccugaagagguuuuaacuuucuuccucucucccugcuucuccuaacucaggacucucaggaaugaacuauuacuaacuucucauuuuuggcugaagacuauuucucuuccaacuuagaaauacauuucaguucagagauuucuuuuucuuuuccuuuaaaaaucuuuuuuuuaaauauuuauuuuauguaugugaguacauacuguagcuauacagauaguugugagccuucaucugguuguugggaauugaauuuaggaccccugcucgcucuaguaaaccccgcuugcuccagucagguccgcucacucugguagacccccacucacucuggcccaaagauuuauuauuacaaaaaaguacacaguagcuucuucagacacaccaaaaaaagacaucagaucucauuaugagugguugugagccaccaugugauugcugggauuugaacucaggaccuucggaagagcagucagcgcucuuacccacugagccaucucaccagcccgagauuuccuuuucuuucauuguuuuaagaugucauuucauuguguucugccuuacauaguuuuacuuacaagaugcguuuuauuuuauguuuggcaucuuuauuuuugaaguaauaacacuucucugguuuucaguuugaguaccaggcuguugaggcacuaacuguaugcaugugugcaugagaaaucauacuugcacugaguucuggaucuguguauucauuucucuucuuaguuuugaaaauuuguguucagaauuuuaucaaaauugcuuccgguuuauuuuugauguuucuucuaggacaaccuauggaucauugugacgccucuguggaucacauauaagauagccugcauaucaaauauuuacauuacaauugauacaguagcagaauaucaauuaugaaguggcaauuaaauaguucuaugaucugggggaucauaacgugaagaacuguauuaaagggucacagcauuaggaauguugugaaccacuguucugggauuuuaauaaauauauaauguauaguuuuauauuuucccauagcuccuaaagcucuuuuuucucccuugccuuuuaaauugaauaauuuccacuagucaacauucaagauucauucaauuuuuuuguucaaggcaaaccacgggcuugcuuaaaguacagucccaagucuuuuuuuuuuuuuuuuuuuuuuuuuuuguccaucaaaagcacuagccauucuguauaauacugugcuuuuuuaguuucuagcauuuauauuucuauauuuaaguugcccauuuaugggcucaaaucugcagucuguucaaguccauuuuucccacuagagucauuauagaucuguagcugaucugacugauuauuuugacucaauuuaaaaaaagaaaaucacacuuuaaaacguguguaaauguguaaagcuuuguuucauguuauaacacaguagagacuguaguauuuuauaccuggaaacauucuugucuuuucuugcauugugccuuuauuguggagcguuugacuuaaaccaguuagaauguaagcugagguaggcaggugggguggaugucacaggaaacaaagagagguguggggaugaauaugaucacaauauauuguaugaaaucucaaugccccagaauauggggaaugaggcaggguggugaggcaggagugagugcguggguagggagcacccucauagaagcugagggaagggggaugggauagaggguuugcagaggggaaaccaggaacgaggauaacauuugaaauguaaauaaauaaaauaaccaauuuuaaaaaccuuaaaauuaauaagauuuguuuuuaaaagcuaaguuaugcugagcaugaguuuuguuuucucucaugaccaucaaucagcagguaggaauaggauauuucaucacuuaucacuuucugcaucuaccaacacaaauuuaacaauaaaauaauagacgcugauuuccaaauugguugauacuuuuauccacauuacugugugugauaagugaaucaaauaaaacuugacuggaauauuuucuuaguuaggguuuuacugcugugagcagacuccaugagcaaggcaagucuuauaaaggacaacauugaauuggggcuggcuuacagguucaguccauuaucaucaaggugggaacagggcaacaucuagguaggcaugaugcaggcagagcugagaguucuaccucuucaucugaaggcuccuaguggaagacugacuuccaggacacuagggugagggucuuaaacccacacccaccgugacacacccauuucaacaaggccacaccuaauagugcuacucucuaggcuaagaauauacaaaccaucacaaauauauaguagaaaaaucaaguuugaaguaaaguaagauaaauaaaaaugauuggcaaucuacuaguaaaccugugguauagcccccaaaugucuugcuguucugaauaagaagcuaagcuuuuuauuuuuugccauugcacauaugaaugcuacuaguuuaaccaguucacucuucugguaaucuuggaggaccugaugauaaaauaugguauaauucaugaacagcuuuuccuuuuguaagaaaaagguuaggaaaacaacauuagggggcuggcaagauggcucagugguuaagagggccgccugcucuuccgaagguccugaguucaaaucgcagcaaccacaugauggcucacaacaauccauaacgaaaucugaugcccucuucuggaguaucugaggacagcuacaguauacuuacauauaagaaauaaauaaaucuuaaaaaacaaaacaaaacaaaacauuaguaucuguauuuuccucucauucucagugucauacgcggccauugaguuuuaguuauaacggcuauacucagauugguucuuuguccaguugucaucagggaggcuuccuccagcagcagauaggagcaaaugcagagagccacagccagacauuaugcagaaagagagucuaaauugaagaucuccauuuggucccuccucuuggagauugggaaccacagagaagaggaggaaaaacgaggaguuagaaguaauggaagaugccaggaaaacauggcucaccaaaucaacuaaguaagacucacauggacucauagagacugaaaugccaagcacuggccucaugggucugcaacagguccucugaguauaugcuauugcuguuagcuugcugguuccuaacagugggagcagacaugucucugacucuuuugccugcuccaauuggguugcuuuuuuauccccaauaaugagagcuuuagccuuaucguguuguauuuuguuuuguccuguuaggcuguagucucuuagagaccuauucuuuuuggggugagagaggagaggaucugaggcugaggaaaaguguagagggaagggaaauugguugggaaguauuguaggagaaaagacuauauuuucaauuagaaagaaaaaaagagggaagggaggaaggaauuagugucaaauaaauuuauaagaaaaaagg

SEQ ID NO: 12012 - RNA, 4003 nt, Mus musculus
ccuuuuuucuuauaaauuuauuugacacuaauuccuuccucccuucccucuuuuuuucuuucuaauugaaaauauagucuuuucuccuacaauacuucccaaccaauuucccuucccucuacacuuuuccucagccucagauccucuccucucucaccccaaaaagaauaggucucuaagagacuacagccuaacaggacaaaacaaaauacaacacgauaaggcuaaagcucucauuauuggggauaaaaaagcaacccaauuggagcaggcaaaagagucagagacaugucugcucccacuguuaggaaccagcaagcuaacagcaauagcauauacucagaggaccuguugcagacccaugaggccagugcuuggcauuucagucucuaugaguccaugugagucuuacuuaguugauuuggugagccauguuuuccuggcaucuuccauuacuucuaacuccucguuuuuccuccucuucucugugguucccaaucuccaagaggagggaccaaauggagaucuucaauuuagacucucuuucugcauaaugucuggcuguggcucucugcauuugcuccuaucugcugcuggaggaagccucccugaugacaacuggacaaagaaccaaucugaguauagccguuauaacuaaaacucaauggccgcguaugacacugagaaugagaggaaaauacagauacuaauguuuuguuuuguuuuguuuuuuaagauuuauuuauuucuuauauguaaguauacuguagcuguccucagauacuccagaagagggcaucagauuucguuauggauuguugugagccaucaugugguugcugcgauuugaacucaggaccuucggaagagcaggcggcccucuuaaccacugagccaucuugccagcccccuaauguuguuuuccuaaccuuuuucuuacaaaaggaaaagcuguucaugaauuauaccauauuuuaucaucagguccuccaagauuaccagaagagugaacugguuaaacuaguagcauucauaugugcaauggcaaaaaauaaaaagcuuagcuucuuauucagaacagcaagacauuugggggcuauaccacagguuuacuaguagauugccaaucauuuuuauuuaucuuacuuuacuucaaacuugauuuuucuacuauauauuugugaugguuuguauauucuuagccuagagaguagcacuauuagguguggccuuguugaaaugggugugucacgguggguguggguuuaagacccucacccuaguguccuggaagucagucuuccacuaggagccuucagaugaagagguagaacucucagcucugccugcaucaugccuaccuagauguugcccuguucccaccuugaugauaauggacugaaccuguaagccagccccaauucaauguuguccuuuauaagacuugccuugcucauggagucugcucacagcaguaaaacccuaacuaagaaaauauuccagucaaguuuuauuugauucacuuaucacacacaguaauguggauaaaaguaucaaccaauuuggaaaucagcgucuauuauuuuauuguuaaauuuguguugguagaugcagaaagugauaagugaugaaauauccuauuccuaccugcugauugauggucaugagagaaaacaaaacucaugcucagcauaacuuagcuuuuaaaaacaaaucuuauuaauuuuaagguuuuuaaaauugguuauuuuauuuauuuacauuucaaauguuauccucguuccugguuuccccucugcaaacccucuaucccaucccccuucccucagcuucuaugagggugcucccuacccacgcacucacuccugccucaccacccugccucauuccccauauucuggggcauugagauuucauacaauauauugugaucauauucauccccacaccucucuuuguuuccugugacauccaccccaccugccuaccucagcuuacauucuaacugguuuaagucaaacgcuccacaauaaaggcacaaugcaagaaaagacaagaauguuuccagguauaaaauacuacagucucuacuguguuauaacaugaaacaaagcuuuacacauuuacacacguuuuaaagugugauuuucuuuuuuuaaauugagucaaaauaaucagucagaucagcuacagaucuauaaugacucuagugggaaaaauggacuugaacagacugcagauuugagcccauaaaugggcaacuuaaauauagaaauauaaaugcuagaaacuaaaaaagcacaguauuauacagaauggcuagugcuuuugauggacaaaaaaaaaaaaaaaaaaaaaaaaaaagacuugggacuguacuuuaagcaagcccgugguuugccuugaacaaaaaaauugaaugaaucuugaauguugacuaguggaaauuauucaauuuaaaaggcaagggagaaaaaagagcuuuaggagcuaugggaaaauauaaaacuauacauuauauauuuauuaaaaucccagaacagugguucacaacauuccuaaugcugugacccuuuaauacaguucuucacguuaugaucccccagaucauagaacuauuuaauugccacuucauaauugauauucugcuacuguaucaauuguaauguaaauauuugauaugcaggcuaucuuauaugugauccacagaggcgucacaaugauccauagguuguccuagaagaaacaucaaaaauaaaccggaagcaauuuugauaaaauucugaacacaaauuuucaaaacuaagaagagaaaugaauacacagauccagaacucagugcaaguaugauuucucaugcacacaugcauacaguuagugccucaacagccugguacucaaacugaaaaccagagaaguguuauuacuucaaaaauaaagaugccaaacauaaaauaaaacgcaucuuguaaguaaaacuauguaaggcagaacacaaugaaaugacaucuuaaaacaaugaaagaaaaggaaaucucgggcuggugagauggcucaguggguaagagcgcugacugcucuuccgaagguccugaguucaaaucccagcaaucacaugguggcucacaaccacucauaaugagaucugaugucuuuuuuuggugugucugaagaagcuacuguguacuuuuuuguaauaauaaaucuuugggccagagugagugggggucuaccagagugagcggaccugacuggagcaagcgggguuuacuagagcgagcagggguccuaaauucaauucccaacaaccagaugaaggcucacaacuaucuguauagcuacaguauguacucacauacauaaaauaaauauuuaaaaaaaagauuuuuaaaggaaaagaaaaagaaaucucugaacugaaauguauuucuaaguuggaagagaaauagucuucagccaaaaaugagaaguuaguaauaguucauuccugagaguccugaguuaggagaagcagggagagaggaagaaaguuaaaaccucuucagggagcaccaaaaugagcaaacauuggauaugcuaguaauaucugaacuauuauugaaauccacauguacuuuuaauuauaauuuugagccauaaagauauuucuauagcuagauuauacagaaucuuuuuugcauauuagcauugauuaauuuuucuguauuugaguuuuaguuugaacauuauccacauuuggaggguagaacaaaucauguguggguuuuuuguucauuuguuuguugguauuuuaaaguauucagcuguacagugauuugauaugcugcuaucuaacacuuggcuacugaguugagaugcuuuuaauauuuaacugauacugcuuuuuauuuaagagcucuuuaucuuuggccucauuaaucuauuuauucuuaugcuaaugugauacugaguuaauuacagaggcauuagagaauauaaaaucagcuaguccuuuacuauuugu

SEQ ID NO: 12013 - RNA, 767 nt, Mus musculus
cucuauagaggcuauaagcuuucaaucuguauguugaagaaguaugaaugcauaggagaaaguuaaugauaagacuuuaggaggguacuaauuuugguugucuuuuaagguacuuuagacuaagauuguauuuggacaggauaaacagauuaggugaagcaaaccuggcagaauuugcagaaguaacagugcagagcccugggcucuaauacuucaaggaguguuucuaaagauagaacagauaucacggaacccaacuggggcugggggccagcagccaauaacaacacccguaugcacuggaauucauuuaucuguaaaauaacgaggucuuccaggcuacagaaguaagucuugaacuauuugccuuaacuaauauuuacaaucaaagacaaaaagagagagcagguaguuauaauccaauaaacaaaagacccaaucaaugccuugacugaagagcacacaagaagagcaggcugguaauaguaggauagguaagucagauauggagaggaaauaaaggauuccaaggaccuucuaagcuuuccguggucugcuaugguugcucgaacuccugugcccacagaugccugggccugugugugcauguacugguaccugacgguuaaaauccagggaauccaaggaaaagccugucacuuguguugaugacagagaaaaaaaacaaaaacaaaaaacaaaaaaaaaaaaaaaaccaacaacaacaaaaauccccauucaauguaggggguuaaaucagagacuau

SEQ ID NO: 12014 - RNA, 767 nt, Mus musculus
auagucucugauuuaacccccuacauugaauggggauuuuuguuguuguugguuuuuuuuuuuuuuuuguuuuuuguuuuuguuuuuuuucucugucaucaacacaagugacaggcuuuuccuuggauucccuggauuuuaaccgucagguaccaguacaugcacacacaggcccaggcaucugugggcacaggaguucgagcaaccauagcagaccacggaaagcuuagaagguccuuggaauccuuuauuuccucuccauaucugacuuaccuauccuacuauuaccagccugcucuucuugugugcucuucagucaaggcauugauugggucuuuuguuuauuggauuauaacuaccugcucucucuuuuugucuuugauuguaaauauuaguuaaggcaaauaguucaagacuuacuucuguagccuggaagaccucguuauuuuacagauaaaugaauuccagugcauacggguguuguuauuggcugcuggcccccagccccaguuggguuccgugauaucuguucuaucuuuagaaacacuccuugaaguauuagagcccagggcucugcacuguuacuucugcaaauucugccagguuugcuucaccuaaucuguuuauccuguccaaauacaaucuuagucuaaaguaccuuaaaagacaaccaaaauuaguacccuccuaaagucuuaucauuaacuuucuccuaugcauucauacuucuucaacauacagauugaaagcuuauagccucuauagag

SEQ ID NO: 12015 - RNA, 1862 nt, Mus musculus
acuuuagaagaucacaguauuaggaagguugagaaccacugcuguaaauaaauaccuaacauuuaaguccucgacucuagacaacacccaccaccaccaccuuucuuuuugguuuuucaggacaggguuucucuguguauagcuuuggcuguccuggaauucacucuguagaucaggcugggcuugaacucacaagagauccacuugccugaggacuggaacuacagguguuugccacuaccaccuggcaaaaaucauuuggguaaacuucuuuugguuucuugagagaggguuuguuguaacccuggcugucccaaacuuguucuguagaccaggcuggucuugaauucagagauccaccugccuuugccauugcugggauuaaaggugugcugcccucugggcuuggacaacacacuuuuaugucagugcuuuuuaauacuauuaagagucuugguuuggcuucagguguaguagcaaagguuugguguacuucuuaggcuauugaagaugguaaagacaacaggcaaagcuuacaagaaaugguauacuguaccuagucuauaaaaggguuucucguuggauacauuaaccucguuuuuacaccuuggaaauuccaaugagaugauuauaaacaacacauucaaccuucuaaauaaguaaugcucaagcaauuagguaauugguaguauagugcguaauacugggaauccaauuauuuccccuaacaaaucucucuuuuacaaauuaauuagggcaacauuaccacaaagccaauaggaaaaaaguaaaaacccuaaccugcaaacacaaaucucuuaguugaacauuaagacuacuagccuuuaccuuaggaucaaaauauuaagucaaaagaauaaaacuccaaguauuggcaaauacuacauaagugguuuuuuuuucccccaucaaagaagucuaauuuagacuccaacaauuauuaacagcucaguuuuugaugguuaacauccguuccaucucacugcaguguaugaagaauagcacacauuaacguuuguuacgaaaauagaguuuauuaaaaacaucccuaugguuugaggggcuuuucaccguuaccuuaucuuaaauuaaaaaaaaaaaauagagagcacuucuaauuaggauuuguaaacuuuuaaaagucaaaacuuuuaaaaaguuacagcaaaaaaaggguaauauaucuucaguauuuuuuguuauuuuuuuggcuauuuuuaaauagaaggaaagcaaucaaauugcuuacaauccccaccaacuacugugggaugauguagcaggagcggauauuauacagcaucuguacaccucauguucuacacccaagugucacugucacauucugucacauccagucucuagcgaggaggcucugcugcugagccaggauccuucucggguccaacgggugagguaaccucagcaggcgacucuucaggcuuuaccaccguggccauggccucccccuuauuaaguucugagacagugucuaugguucccacuuggcuaaggggagguuccacagcuuuguuaccaccugcccugucugccaccucgugcuucuccuuucgauuuucuuccuucucucuacgggacucucuaucucuagaaucccugucucugucccgaugcccacuagagcgucuacuucucucuuccaagucucugugccugucccggucagggcuccuucuuccccacucucuccuuucacgguuacuauuaucucuaucgucauuacggcucccauaccguucccggucauuuuccacccuacuuccaaaagaucuucuuccaaaccuuucuuggucucuaccugaguugaacugcugccugcu

SEQ ID NO: 12016 - RNA, 1862 nt, Mus musculus
agcaggcagcaguucaacucagguagagaccaagaaagguuuggaagaagaucuuuuggaaguaggguggaaaaugaccgggaacgguaugggagccguaaugacgauagagauaauaguaaccgugaaaggagagaguggggaagaaggagcccugaccgggacaggcacagagacuuggaagagagaaguagacgcucuagugggcaucgggacagagacagggauucuagagauagagagucccguagagagaaggaagaaaaucgaaaggagaagcacgagguggcagacagggcaggugguaacaaagcuguggaaccuccccuuagccaagugggaaccauagacacugucucagaacuuaauaagggggaggccauggccacggugguaaagccugaagagucgccugcugagguuaccucacccguuggacccgagaaggauccuggcucagcagcagagccuccucgcuagagacuggaugugacagaaugugacagugacacuuggguguagaacaugagguguacagaugcuguauaauauccgcuccugcuacaucaucccacaguaguugguggggauuguaagcaauuugauugcuuuccuucuauuuaaaaauagccaaaaaaauaacaaaaaauacugaagauauauuacccuuuuuuugcuguaacuuuuuaaaaguuuugacuuuuaaaaguuuacaaauccuaauuagaagugcucucuauuuuuuuuuuuuaauuuaagauaagguaacggugaaaagccccucaaaccauagggauguuuuuaauaaacucuauuuucguaacaaacguuaaugugugcuauucuucauacacugcagugagauggaacggauguuaaccaucaaaaacugagcuguuaauaauuguuggagucuaaauuagacuucuuugaugggggaaaaaaaaaccacuuauguaguauuugccaauacuuggaguuuuauucuuuugacuuaauauuuugauccuaagguaaaggcuaguagucuuaauguucaacuaagagauuuguguuugcagguuaggguuuuuacuuuuuuccuauuggcuuugugguaauguugcccuaauuaauuuguaaaagagagauuuguuaggggaaauaauuggauucccaguauuacgcacuauacuaccaauuaccuaauugcuugagcauuacuuauuuagaagguugaauguguuguuuauaaucaucucauuggaauuuccaagguguaaaaacgagguuaauguauccaacgagaaacccuuuuauagacuagguacaguauaccauuucuuguaagcuuugccuguugucuuuaccaucuucaauagccuaagaaguacaccaaaccuuugcuacuacaccugaagccaaaccaagacucuuaauaguauuaaaaagcacugacauaaaaguguguuguccaagcccagagggcagcacaccuuuaaucccagcaauggcaaaggcagguggaucucugaauucaagaccagccuggucuacagaacaaguuugggacagccaggguuacaacaaacccucucucaagaaaccaaaagaaguuuacccaaaugauuuuugccaggugguaguggcaaacaccuguaguuccaguccucaggcaaguggaucucuugugaguucaagcccagccugaucuacagagugaauuccaggacagccaaagcuauacacagagaaacccuguccugaaaaaccaaaaagaaaggugguggugguggguguugucuagagucgaggacuuaaauguuagguauuuauuuacagcagugguucucaaccuuccuaauacugugaucuucuaaagu

SEQ ID NO: 12017 - RNA, 276 nt, Mus musculus
cccccaggccuagggagggguggagguggggacaggaaguguccuuuaggccagagucuuaaggccauaucuguauuucucaaaauucagccucccaggccacacaguuuagaaaucaugacaaaauaaagagacaagucaccagugauccugggucucuccguaucugguguuuuucaaagagcuuaacauuuuucguuuaucauuuuaaaaauuauuuuuaaaaaguuuaauuuuggccuuuucagccccagcaauugucuagugcagugaaag

SEQ ID NO: 12018 - RNA, 276 nt, Mus musculus
cuuucacugcacuagacaauugcuggggcugaaaaggccaaaauuaaacuuuuuaaaaauaauuuuuaaaaugauaaacgaaaaauguuaagcucuuugaaaaacaccagauacggagagacccaggaucacuggugacuugucucuuuauuuugucaugauuucuaaacuguguggccugggaggcugaauuuugagaaauacagauauggccuuaagacucuggccuaaaggacacuuccuguccccaccuccaccccucccuaggccuggggg

SEQ ID NO: 12019 - RNA, 1839 nt, Mus musculus
uuuuauguguuuugaguguuugucucauguguauaguaucugcaagaugucagaagauggugcuagauccccugaaacugcaguuaguauauggcuuuuaacugccauaugggugcugggaaccaaguccagucccucugcaagagcugaaguuuucuuaacuacugagccaucucucuagccacacauucucguuuuuuacaaauagaaaacgggaagaguaagacucauauccacccgcagagguuuauuuaaauaaaaguguucaugcauguaaaacagugggaacuaauaaaguggaucuguuuauucuuagauauaaagaacucugaaacaucaguugguuccauauaguaaauaaagugugcuauaguuguuuauuuuaaucaguucacaguuguugaugaguuuucaucuuuuuucuuuugguguguaguuuuguaaacucuagcacagguguuaacauucuuuuaaccccagucauaaacaaaucaugaugguuugaauacuaaaaauugccauaauuagcaguuaagccuuucuccuaucuguaauuacugauguccccuggcguauuuuucauuacuauguuuugacucuucugaagauguucacuaaaaagugaaaaaacacaaauggccaauaugucuuuacaaguguuccucuuccuuagcuaacaugaaaaugcaaacaacuuuugagaugccgucguauugcuguuaaaauaguauccuuaagaaaacaaacggcuagccaggcggagguagcacacaccuuuaaucccagcacuuguaggcagaggcagguggaucuccuguguucaaggccagccuggucuacagagugaguuucaggacuucuaagccuacauagagaaacccuaucuguaaaaaaagaaaaagaaagacaacaaauucuagugaagauguggggacagagaaacccucauucacucuugguaaagugaaaguugaugacauuauuuugggacuccauacggagguucuuaaauagauaggagcaaaacuaccguaugacccagcuuugcuaucccagaguguagaccucagggacucuauccuccuacagaguguagaccucagggacucucuauccuccuacagaggugcuugcacauacauaaagguauguugcugcauuauuuauaauuagcuggaaaauugaaccagcuaaauuaauagauaaugaaaauguagugugugugugugugugugugugugcacauguacauacauacauacauacauacaugcauacauacuuacauacauauauacaaugcaauucaguucagcucuaaaguaaaggaaagccgugaaguuugcaggaagauagauggauagcagacuaugaaagacaaaaccuuugugauuuccuucauguggauuaucguguuuaguguuucuauguauauaaagugggucuaagcugugaaaugagacccgucuguuaugugacaauacuuucccacacauccacucaccccagguagagagcccacagcagaccaaaccauagaugcuaauuaccagagucccacuugguaaaccaugaguuuaaugauuauuuuuuguuguuguuuuugguuuugguuuugguuuguuuguuuuuuuuuuuuuuuuuuuuuuuuuuuuuuuuuuuuuuuuuuuuugagacaggguuucuuuguguagcccuggcuguccuggaacuuagucuguagaccaggcuggccuugaacucagaaaucggccugccucugccucccaagcacugggauuaaaggcgugcgccaccacugcccggcaauuuuuuuuuuuuuuuuuuuuuuuuuuuuuu

SEQ ID NO: 12020 - RNA, 1839 nt, Mus musculus
aaaaaaaaaaaaaaaaaaaaaaaaaaaaaauugccgggcagugguggcgcacgccuuuaaucccagugcuugggaggcagaggcaggccgauuucugaguucaaggccagccuggucuacagacuaaguuccaggacagccagggcuacacaaagaaacccugucucaaaaaaaaaaaaaaaaaaaaaaaaaaaaaaaaaaaaaaaaaaaaacaaacaaaccaaaaccaaaaccaaaaacaacaacaaaaaauaaucauuaaacucaugguuuaccaagugggacucugguaauuagcaucuaugguuuggucugcugugggcucucuaccuggggugaguggaugugugggaaaguauugucacauaacagacgggucucauuucacagcuuagacccacuuuauauacauagaaacacuaaacacgauaauccacaugaaggaaaucacaaagguuuugucuuucauagucugcuauccaucuaucuuccugcaaacuucacggcuuuccuuuacuuuagagcugaacugaauugcauuguauauauguauguaaguauguaugcauguauguauguauguauguauguacaugugcacacacacacacacacacacacacuacauuuucauuaucuauuaauuuagcugguucaauuuuccagcuaauuauaaauaaugcagcaacauaccuuuauguaugugcaagcaccucuguaggaggauagagagucccugaggucuacacucuguaggaggauagagucccugaggucuacacucugggauagcaaagcugggucauacgguaguuuugcuccuaucuauuuaagaaccuccguauggagucccaaaauaaugucaucaacuuucacuuuaccaagagugaaugaggguuucucuguccccacaucuucacuagaauuuguugucuuucuuuuucuuuuuuuacagauaggguuucucuauguaggcuuagaaguccugaaacucacucuguagaccaggcuggccuugaacacaggagauccaccugccucugccuacaagugcugggauuaaaggugugugcuaccuccgccuggcuagccguuuguuuucuuaaggauacuauuuuaacagcaauacgacggcaucucaaaaguuguuugcauuuucauguuagcuaaggaagaggaacacuuguaaagacauauuggccauuuguguuuuuucacuuuuuagugaacaucuucagaagagucaaaacauaguaaugaaaaauacgccaggggacaucaguaauuacagauaggagaaaggcuuaacugcuaauuauggcaauuuuuaguauucaaaccaucaugauuuguuuaugacugggguuaaaagaauguuaacaccugugcuagaguuuacaaaacuacacaccaaaagaaaaaagaugaaaacucaucaacaacugugaacugauuaaaauaaacaacuauagcacacuuuauuuacuauauggaaccaacugauguuucagaguucuuuauaucuaagaauaaacagauccacuuuauuaguucccacuguuuuacaugcaugaacacuuuuauuuaaauaaaccucugcggguggauaugagucuuacucuucccguuuucuauuuguaaaaaacgagaauguguggcuagagagauggcucaguaguuaagaaaacuucagcucuugcagagggacuggacuugguucccagcacccauauggcaguuaaaagccauauacuaacugcaguuucaggggaucuagcaccaucuucugacaucuugcagauacuauacacaugagacaaacacucaaaacacauaaaa

SEQ ID NO: 12021 - RNA, 3234 nt, Mus musculus
aacuaauuugauauguacugaaaaaaugucuuuaccuuuaugauuuaauuaauauguuaacuaguccacauuccucagacagcuaaaaguauugaucuguugacuucugagcacuguccuaugcauguaagaucuucagcuuagaacccccagaauaaaucaguuauaguaaguggugcccacgugcagcucuccagguggugguguauguuaauugacucagaagaaaauuucacacaaaaaaaaguucuuuauauuuuaaagaaguucaaaauucagguaaacuuucuugauacaaauaagaauucauuuuagagcaggcuuuccucuuaacucagagcgcugccugccucugccaccugagugcugguauuaaagauguauaccaccacugccuggcagccacgcuacuccuaauucuaagaagaaaccuuuuucuaguccucuguguguguuugacuucugauuccacucuugcaacucuugcaguguucucuaagaugcuccugcggaugauucucacagaucucuguuuauaugcccaccagguucugauaaccgggccagcggacacccccuaugcaaauggcugcuuugaguuugauguauauuuuccucaagauuauccuagcucaccuccucuagugaaccuagaaacaacugggggucauagugugcgcuucaaucccaaccuuuacaaugauggcaagguaagguggcugcggucuuuguuucaaggucacacacugaucugaagguuguuugugauucaaauaaaaguuggugugguuagauauuuuuuucuucauuauuaguuuccucuauaugcauagacagaucacuuugaaaauaggagagaagaaacugaaaagggcgaaacaagagcuuccacaaaucaguaaugcucagaauacagcauacccagugucuggcguggauauuaaagcaggaauacucagcagggaauuuacuacuagaaugcuauuaaacuagccaaaauuacauugaaaugaugauuuuucuuuuaaauuuucaauguaauuuuggauaguuuaauugaauucuaguaguaaauuccaugcuaaguauuacugcuuuaaaauucaugagaaggcaucuguagagacuggagagauggcucaguagucaggagcacugucugcuuuccagaaaaccugccucccuccucuggccuccauaggcaccaggcacacacauaaacaaccugaguugagucccugaccccucauaaugauagagaccagacucuucaaacuguccccugacaccaugcaugccuacacacaccgacaaagaaauacauuucacugaaagcuuguggguuuuuaaaaaguaugauguuucauuaaaauauguuauguaggacuagugacauaguuuauugauagcgugcuuacuuacacaaagccuugguuuuaaucucuucuaaugcauugacuggggauggugcugccucccuuuuaucaccacuauagcaauggaggcaggaggguuagaaacucagggucaucuuccacuacauggcuaguugagggccagccugaguuacauaagcaaccuuguaucaaccaacaacaaaaaaagauauauguuaucuaugcagauauggauguaaucuguguggaguuuuccuuaugaagaaacuauaaucccacaaggguuuggaucauaucugaagaugcagugggcuuuuacagacuuagauacacuuugacaugagagcauaauguuuuguuuccagcugagacaguuugcuuuaaauucuguucaauugugucuuuucuucuuaagguuuguuuaagcauccugaauacauggcauggaagaccagaagagaaguggaacccucagacaucaagcuuuuugcaaguaaacaaaguuucucugacagauuuacuuacacccuaagagcuguguauguugggggagggaaucagugacuaaaauaaacauagaaaacuguuuuaaaggcaggaaauaauaguuuaaagucucaaguuuugagguaagauaaacagccuugucaaguucaagucuuuucuuagguucuuaaagugcaguaugcugcaggaagguaauugggucugucuccuguuuugugaguagaauuuaauacacuguugguaccacccacuucuucauguaugaugugguccuaguuacaguuuuuacuuaacugaugccuaaaauuaaugcccuggaauucauaaaauuuaagaguuguaguuuacuaucaggguauuugauauauaagauuuaaaaaucuugaaagcuugcauuucuguaagugagugcauaaaaucuauuguauaaagccaguggcgcaugccuuuaaucccagcacucgggaggcagaggcaggcggauuucugaguucgaggccagccuggucuacaaagugaguuucaggacagccaggacuacacagagaaacccugucucgaaaaaccaaaaaaaaaaaaagaaaaaucuuuuguauaauaucucauuucugcucauguuuuuacuuuauaauaaauaacucagagccucagcuaaagguagaguguacguguaucgagguauguguuuacuagaguacuuguuuguuuaggaagcacagacacaguacuuaguugugguuguuauauaauaccuugaauucacauguacaauuuagugcuucaaaaauuaucaccagguaauccuacuaaaaguggaccuauccuaaaagguuauuuucuuuaaugcuaguuuguguuagauaagagaugugaaaauaaauucucuuuagaggacuuaacugguuuaacuugaguaaaguaggaagcuuuuuuaaaaaaagauuauugguuauuuuauuuauuuacauaaaucugcaacccccaccccaucccccuagccucuaugagggugcuuccccacccacccuccccacccuggcauuccccuacucuggggcaucgagcuuccacaggaccaagggccuccccucccauugaugucagauaaggccauucucugcuacuuaugcaauuggagcccugggaacucugggugcuccaguuaauugauauuauuguucuuccuauuauugaagguugcaaacuccuucagcuccuucauuccuuccccuagcacuuccacugggguccccaugcucagugcaaugguuggcugcgagcauccacaucugucuuggucagacacuggcagagccucucagggcacagc

SEQ ID NO: 12022 - RNA, 3234 nt, Mus musculus
gcugugcccugagaggcucugccagugucugaccaagacagauguggaugcucgcagccaaccauugcacugagcauggggaccccaguggaagugcuaggggaaggaaugaaggagcugaaggaguuugcaaccuucaauaauaggaagaacaauaauaucaauuaacuggagcacccagaguucccagggcuccaauugcauaaguagcagagaauggccuuaucugacaucaaugggaggggaggcccuugguccuguggaagcucgaugccccagaguaggggaaugccaggguggggaggguggguggggaagcacccucauagaggcuagggggaugggguggggguugcagauuuauguaaauaaauaaaauaaccaauaaucuuuuuuuaaaaaagcuuccuacuuuacucaaguuaaaccaguuaaguccucuaaagagaauuuauuuucacaucucuuaucuaacacaaacuagcauuaaagaaaauaaccuuuuaggauagguccacuuuuaguaggauuaccuggugauaauuuuugaagcacuaaauuguacaugugaauucaagguauuauauaacaaccacaacuaaguacugugucugugcuuccuaaacaaacaaguacucuaguaaacacauaccucgauacacguacacucuaccuuuagcugaggcucugaguuauuuauuauaaaguaaaaacaugagcagaaaugagauauuauacaaaagauuuuucuuuuuuuuuuuuugguuuuucgagacaggguuucucuguguaguccuggcuguccugaaacucacuuuguagaccaggcuggccucgaacucagaaauccgccugccucugccucccgagugcugggauuaaaggcaugcgccacuggcuuuauacaauagauuuuaugcacucacuuacagaaaugcaagcuuucaagauuuuuaaaucuuauauaucaaauacccugauaguaaacuacaacucuuaaauuuuaugaauuccagggcauuaauuuuaggcaucaguuaaguaaaaacuguaacuaggaccacaucauacaugaagaagugggugguaccaacaguguauuaaauucuacucacaaaacaggagacagacccaauuaccuuccugcagcauacugcacuuuaagaaccuaagaaaagacuugaacuugacaaggcuguuuaucuuaccucaaaacuugagacuuuaaacuauuauuuccugccuuuaaaacaguuuucuauguuuauuuuagucacugauucccucccccaacauacacagcucuuaggguguaaguaaaucugucagagaaacuuuguuuacuugcaaaaagcuugaugucugaggguuccacuucucuucuggucuuccaugccauguauucaggaugcuuaaacaaaccuuaagaagaaaagacacaauugaacagaauuuaaagcaaacugucucagcuggaaacaaaacauuaugcucucaugucaaaguguaucuaagucuguaaaagcccacugcaucuucagauaugauccaaacccuugugggauuauaguuucuucauaaggaaaacuccacacagauuacauccauaucugcauagauaacauauaucuuuuuuuguuguugguugauacaagguugcuuauguaacucaggcuggcccucaacuagccauguaguggaagaugacccugaguuucuaacccuccugccuccauugcuauaguggugauaaaagggaggcagcaccauccccagucaaugcauuagaagagauuaaaaccaaggcuuuguguaaguaagcacgcuaucaauaaacuaugucacuaguccuacauaacauauuuuaaugaaacaucauacuuuuuaaaaacccacaagcuuucagugaaauguauuucuuugucgguguguguaggcaugcauggugucaggggacaguuugaagagucuggucucuaucauuaugaggggucagggacucaacucagguuguuuaugugugugccuggugccuauggaggccagaggagggaggcagguuuucuggaaagcagacagugcuccugacuacugagccaucucuccagucucuacagaugccuucucaugaauuuuaaagcaguaauacuuagcauggaauuuacuacuagaauucaauuaaacuauccaaaauuacauugaaaauuuaaaagaaaaaucaucauuucaauguaauuuuggcuaguuuaauagcauucuaguaguaaauucccugcugaguauuccugcuuuaauauccacgccagacacuggguaugcuguauucugagcauuacugauuuguggaagcucuuguuucgcccuuuucaguuucuucucuccuauuuucaaagugaucugucuaugcauauagaggaaacuaauaaugaagaaaaaaauaucuaaccacaccaacuuuuauuugaaucacaaacaaccuucagaucagugugugaccuugaaacaaagaccgcagccaccuuaccuugccaucauuguaaagguugggauugaagcgcacacuaugacccccaguuguuucuagguucacuagaggaggugagcuaggauaaucuugaggaaaauauacaucaaacucaaagcagccauuugcauaggggguguccgcuggcccgguuaucagaaccuggugggcauauaaacagagaucugugagaaucauccgcaggagcaucuuagagaacacugcaagaguugcaagaguggaaucagaagucaaacacacacagaggacuagaaaaagguuucuucuuagaauuaggaguagcguggcugccaggcaguggugguauacaucuuuaauaccagcacucagguggcagaggcaggcagcgcucugaguuaagaggaaagccugcucuaaaaugaauucuuauuuguaucaagaaaguuuaccugaauuuugaacuucuuuaaaauauaaagaacuuuuuuuugugugaaauuuucuucugagucaauuaacauacaccaccaccuggagagcugcacgugggcaccacuuacuauaacugauuuauucuggggguucuaagcugaagaucuuacaugcauaggacagugcucagaagucaacagaucaauacuuuuagcugucugaggaauguggacuaguuaacauauuaauuaaaucauaaagguaaagacauuuuuucaguacauaucaaauuaguu

SEQ ID NO: 12023 - RNA, 1149 nt, Mus musculus
caggccauucagcuacauaaaaucaagcuaauacgucaugaaguaagguucaaaugugucauuacauuucaaaaaagauuuuccuuuauuuaaacacauuuacagcaugcagguuaacuuaaaauuauaugucauuuucccaaaccaacuauguuuaaauguaacccuaaacacugaaaauaaaacaacauauuccacagguagaccuagacucuccucuguuaccucaaaucaaacugagaauugcaaauaaauucaguuaugcauaguauuuaguuuccuuaaauuaggcaaauaauuuaauugaucaccaugaauaaauacuauucuuauuucauugaguuucucuucugaaccaauuaucaauacuacucagaggaacauuaauauauccagucacaaaaaaagacacugcaaauuaaaauauuuucaauauucuaggugauuaaaaauguccauuuugugugaaugcuauauuuaauggccuaucauugcaaaaaagaguucaguucacugaaaagaaauuugugaaauucuuaguauacuuuaugaaagguugaaauuauaaauagaaaagaaacauuuaagauuaaaaaaaacuaacaauguguuuucuuaacaacaugcuaguuacaauucauuguguguuauacaagcaccgauacccaugauacaucuuaaaacuucuauacucagacaaaggagaauuuuuuuuccauuaugaaaacugccagaaaagcaaauuuucauuuggaacgaauguccuuuagaugcagccagaugccucgcagagacagcgaugagcacaggagccauacacgucacuaaccacgacuuacaccucgcugcaucacgcucucuucaauuuguggagugcuucuuucaaucauaaaagcaacacaaucauuaaaggcugcagacuacaacagcaaagauuuugacuguuaaaaaaauaaauaaauuuauuuuucaaaucaaaauuauuauaaaaguggaaauuacaauaguuaaggaaauagaaaaauaagccaauuaugaucugagucuucugacuauggcuccaaauuuaauaauacaaauaucuguauauaaaacuuuuccaaagauucugccagccagauucuaacccagaacuucaaaagcuugucu

SEQ ID NO: 12024 - RNA, 1149 nt, Mus musculus
agacaagcuuuugaaguucuggguuagaaucuggcuggcagaaucuuuggaaaaguuuuauauacagauauuuguauuauuaaauuuggagccauagucagaagacucagaucauaauuggcuuauuuuucuauuuccuuaacuauuguaauuuccacuuuuauaauaauuuugauuugaaaaauaaauuuauuuauuuuuuuaacagucaaaaucuuugcuguuguagucugcagccuuuaaugauuguguugcuuuuaugauugaaagaagcacuccacaaauugaagagagcgugaugcagcgagguguaagucgugguuagugacguguauggcuccugugcucaucgcugucucugcgaggcaucuggcugcaucuaaaggacauucguuccaaaugaaaauuugcuuuucuggcaguuuucauaauggaaaaaaaauucuccuuugucugaguauagaaguuuuaagauguaucauggguaucggugcuuguauaacacacaaugaauuguaacuagcauguuguuaagaaaacacauuguuaguuuuuuuuaaucuuaaauguuucuuuucuauuuauaauuucaaccuuucauaaaguauacuaagaauuucacaaauuucuuuucagugaacugaacucuuuuuugcaaugauaggccauuaaauauagcauucacacaaaauggacauuuuuaaucaccuagaauauugaaaauauuuuaauuugcagugucuuuuuuugugacuggauauauuaauguuccucugaguaguauugauaauugguucagaagagaaacucaaugaaauaagaauaguauuuauucauggugaucaauuaaauuauuugccuaauuuaaggaaacuaaauacuaugcauaacugaauuuauuugcaauucucaguuugauuugagguaacagaggagagucuaggucuaccuguggaauauguuguuuuauuuucaguguuuaggguuacauuuaaacauaguugguuugggaaaaugacauauaauuuuaaguuaaccugcaugcuguaaauguguuuaaauaaaggaaaaucuuuuuugaaauguaaugacacauuugaaccuuacuucaugacguauuagcuugauuuuauguagcugaauggccug

SEQ ID NO: 12025 - RNA, 1194 nt, Mus musculus
auuacaacacagaucaauaccaacaucaauaaaguauuacauaugagaugaagucaugguuaacauuuuugucaaaacuguauuuauuuugagaugacaguuuuugauugcacauuuaaaucuauuuauaaacaaaaguucucaaaaggaauaaaguucccugcccacaaacaaaucacaaaaggauacaagaugguuuacuaggaccuauaaaucucaaaugccauucagucagacauguuggagggcauuucuuaguauaaacagguucuuggagaacucuacauguuuuuuuggaacaaguccuggcuugggcauugcuaacccugcagcaguguacacacaaagcagcuucuaaugacacaccaucaguaaaaguagucauuuuuguauugcuuaccgaagaaguuucuaguaaaaguggcaccagaggaucuguggccuugacauauacaaacucaguaagaagcucuaacaaguagcaugggguauggcuuguugaagucaucagcagugugagcacacgccucacugacuuccuugucucuaauggagcugucagguagcuugcuucugggagggcauucuggugcugcucugugcucugcauucaguaaggcugaacuguuauuccuauuauaggcuggaguuuucuuucuacgcauagagcugagggguucuuagcccuaagcuaaguucuuuccccaguucugcuccaggcuaugcuuccuauuuccuccuauuaacaaggauaggcaucaucuguagcuugcuuuucagaagaccauucauguuuguaagaacugccaaggcucagucuugagauauccacuccacugaggaccaggacauagugguuuauaacacagaaacaguauuuaaggaaagaaugugcucugauuccuacuggcuaacuuagcuccucaccuggcugaagucccaggugggcuucaguuucucaaucacugaagacauacacacuuucucucacuauucuuagaauucauuuacucaucaccccuaaaaccugcucaauuuuacuguuuugaggcagaauaugauuacauagacuaggaggccagccucacaaucaugauucaguauugccacucugaaaacacuguccaaucuuauaccaccauaauuaaaaaaauauagcaggaaggcagacaguauuuguucuauguacauaua

SEQ ID NO: 12026 - RNA, 1194 nt, Mus musculus
uauauguacauagaacaaauacugucugccuuccugcuauauuuuuuuaauuauggugguauaagauuggacaguguuuucagaguggcaauacugaaucaugauugugaggcuggccuccuagucuauguaaucauauucugccucaaaacaguaaaauugagcagguuuuaggggugaugaguaaaugaauucuaagaauagugagagaaaguguguaugucuucagugauugagaaacugaagcccaccugggacuucagccaggugaggagcuaaguuagccaguaggaaucagagcacauucuuuccuuaaauacuguuucuguguuauaaaccacuauguccugguccucaguggaguggauaucucaagacugagccuuggcaguucuuacaaacaugaauggucuucugaaaagcaagcuacagaugaugccuauccuuguuaauaggaggaaauaggaagcauagccuggagcagaacuggggaaagaacuuagcuuagggcuaagaaccccucagcucuaugcguagaaagaaaacuccagccuauaauaggaauaacaguucagccuuacugaaugcagagcacagagcagcaccagaaugcccucccagaagcaagcuaccugacagcuccauuagagacaaggaagucagugaggcgugugcucacacugcugaugacuucaacaagccauaccccaugcuacuuguuagagcuucuuacugaguuuguauaugucaaggccacagauccucuggugccacuuuuacuagaaacuucuucgguaagcaauacaaaaaugacuacuuuuacugauggugugucauuagaagcugcuuuguguguacacugcugcaggguuagcaaugcccaagccaggacuuguuccaaaaaaacauguagaguucuccaagaaccuguuuauacuaagaaaugcccuccaacaugucugacugaauggcauuugagauuuauagguccuaguaaaccaucuuguauccuuuugugauuuguuugugggcagggaacuuuauuccuuuugagaacuuuuguuuauaaauagauuuaaaugugcaaucaaaaacugucaucucaaaauaaauacaguuuugacaaaaauguuaaccaugacuucaucucauauguaauacuuuauugauguugguauugaucuguguuguaau

SEQ ID NO: 12027 - RNA, 131 nt, Mus musculus
ugccaucuguuaccuuagcacuccugugggaagguggggaagacagcauaagccugcaugcugcugcucauguaaccuggccugugcagccgugcaccuacaaaggacccugccccaaacauggugagggc

SEQ ID NO: 12028 - RNA, 131 nt, Mus musculus
gcccucaccauguuuggggcaggguccuuuguaggugcacggcugcacaggccagguuacaugagcagcagcaugcaggcuuaugcugucuuccccaccuucccacaggagugcuaagguaacagauggca

SEQ ID NO: 12029 - RNA, 831 nt, Mus musculus
acgcuguuggugcacaaaguguucccugguuucuccaucaaggcuuuugacuaugagaaagccuacagccugcagcggcccaaugaccacgaguucaugcagcaaccauggacggguuucaccgugcagaucagcuuugugaagggcuggggccagugcuacacccgccaguucaucagcagcugcccgugcuggcuggaggucaucuucaacagccgguagucggucgugugguggggagaagaggacagggcggaucgugagccgagcaggccaccguucaaacuacuugcugcuaaccuuucccgagugauugcuuuucaugcaaacucuuugguugguguuguuauugccauucauuguugguuuuguuuuguucuguucugguuuguuuuuuuuuuuuuuuccuccuccuuucucgucauccgugugucccgcuugucuuguucuuugagaaauuagcuuauggugcggauuuuuguuggguuguguguguguguuuuguuuuuguuuugagguggugggugugguuggcaggacacccccuccccccauauacgaagacaggaaacgagagucagcacugccaagcauggugugugaaagugggcaccaccuucccuuuggaucagcguuucgguuguccgugcguagggguguacccgagcgacagaugggggaagugcuuuuuuguguguguguucuuuauggaugcccccggcugagaggcucauagugccaagcugugugucucucuagccuuuuggacacgcucgguggggcagaggcaguaccugggcagacuggcagcaggugccaagcucugcucca

SEQ ID NO: 12030 - RNA, 831 nt, Mus musculus
uggagcagagcuuggcaccugcugccagucugcccagguacugccucugccccaccgagcguguccaaaaggcuagagagacacacagcuuggcacuaugagccucucagccgggggcauccauaaagaacacacacacaaaaaagcacuucccccaucugucgcucggguacaccccuacgcacggacaaccgaaacgcugauccaaagggaagguggugcccacuuucacacaccaugcuuggcagugcugacucucguuuccugucuucguauauggggggaggggguguccugccaaccacacccaccaccucaaaacaaaaacaaaacacacacacacaacccaacaaaaauccgcaccauaagcuaauuucucaaagaacaagacaagcgggacacacggaugacgagaaaggaggaggaaaaaaaaaaaaaaacaaaccagaacagaacaaaacaaaaccaacaaugaauggcaauaacaacaccaaccaaagaguuugcaugaaaagcaaucacucgggaaagguuagcagcaaguaguuugaacgguggccugcucggcucacgauccgcccuguccucuucuccccaccacacgaccgacuaccggcuguugaagaugaccuccagccagcacgggcagcugcugaugaacuggcggguguagcacuggccccagcccuucacaaagcugaucugcacggugaaacccguccaugguugcugcaugaacucguggucauugggccgcugcaggcuguaggcuuucucauagucaaaagccuugauggagaaaccagggaacacuuugugcaccaacagcgu

SEQ ID NO: 12031 - RNA, 605 nt, Mus musculus
cagucagguuagguuaagccacugguggaaaacggaauaagauaccuuauuguuguacaggaagaaaaucaagacgacuugggacaguugaauacucacacgaguaaccaggaaacuagagaagaguugagguaggagguaggaccgcccucaccauauagcaaagcuccaacugcagcacuuggccuggaacugacauagaaacccaccagccgcugccugguggcugugacauagaaacccaccagccgcugccugguggcugugacauagaaacauaccagcugcugccugguggcugugacuugaguuauguguagcaacaagaggcuuccuacccacacaucacuccuuacaaaguccagauagaaccaaaaaaaaaaaaaaaaaaaagcacgagauucaaaggauaguguugaauuagaccaagcuuucugagcucaucauaagaugcagaaaaaaauaccaauaaacaaguacaucuguauauuuaaaaugcucaacagcaaagugucauaaacuauaaaagucagagaggaccagaaguguuugcaacacaaaugguuacuuuccuuaauauguaaagaacacuuuaaaucaauaag

SEQ ID NO: 12032 - RNA, 605 nt, Mus musculus
cuuauugauuuaaaguguucuuuacauauuaaggaaaguaaccauuuguguugcaaacacuucugguccucucugacuuuuauaguuuaugacacuuugcuguugagcauuuuaaauauacagauguacuuguuuauugguauuuuuuucugcaucuuaugaugagcucagaaagcuuggucuaauucaacacuauccuuugaaucucgugcuuuuuuuuuuuuuuuuuuuugguucuaucuggacuuuguaaggagugauguguggguaggaagccucuuguugcuacacauaacucaagucacagccaccaggcagcagcugguauguuucuaugucacagccaccaggcagcggcugguggguuucuaugucacagccaccaggcagcggcugguggguuucuaugucaguuccaggccaagugcugcaguuggagcuuugcuauauggugagggcgguccuaccuccuaccucaacucuucucuaguuuccugguuacucgugugaguauucaacugucccaagucgucuugauuuucuuccuguacaacaauaagguaucuuauuccguuuuccaccaguggcuuaaccuaaccugacug

SEQ ID NO: 12033 - RNA, 479 nt, Mus musculus
caguguugcuagaaacagcucaguuguucccccgagcaggacuggguagucuaaauguggcuacagcucuguuggcccaacagucccaagugcaagacaagguguggcaagucugcaugcuaccacaccaugcgcugucuggaaagcaagaggucaccuacacauuugcaguuuuaacaugaacaaguaucacuuuaaacauucuguguguauaaggggcaaaaucuggagggaacgcgcugugggguuacacagucagcagaggggacaguacacuggucaccagagugaaaggaagcccaacauaaccugcuguggaggaagaggcugccagacugaagcuggccccaccauccagugucugacucucugggacccugggaggcaaggacgagacagagggagcucacaccuguucccugggcacuugguggccuuagaggacagaguacccuuaaucuagagagugguguaggagu

SEQ ID NO: 12034 - RNA, 479 nt, Mus musculus
acuccuacaccacucucuagauuaaggguacucuguccucuaaggccaccaagugcccagggaacaggugugagcucccucugucucguccuugccucccagggucccagagagucagacacuggaugguggggccagcuucagucuggcagccucuuccuccacagcagguuauguugggcuuccuuucacucuggugaccaguguacuguccccucugcugacuguguaaccccacagcgcguucccuccagauuuugccccuuauacacacagaauguuuaaagugauacuuguucauguuaaaacugcaaauguguaggugaccucuugcuuuccagacagcgcauggugugguagcaugcagacuugccacaccuugucuugcacuugggacuguugggccaacagagcuguagccacauuuagacuacccaguccugcucgggggaacaacugagcuguuucuagcaacacug

SEQ ID NO: 12035 - RNA, 3139 nt, Mus musculus
cauuaucccaugacucagugucaugucugcagccauugucagcucacagugagcagcccuucccucccagagaguugacaagcugcucagaccagaccugcucuaacugcuuccauggugcagugcaucuaggccuaacuauaugaaggcaaagugacagaggucgagaauguaacagccaugacaauucuaagaagcuucaaucucaaaccuuuauuuugcuguaaaggggaggaaaaugguuaguggguuuguacacugaacacuuuaguacagagaagcgugugcgaccaaccugcaguuacagcuuucuucacauuuccccauuccacacagcuguuccaaugagcgaucuugcccuggucacaccacuuuuaagcacacucacaaaacaaccacauauacaggguuuucacaaauaugcaaauaaacaggguuuucagaaccaauuuuuacaaaguguuaucuaguaagaugacccagggcccagucucuuuuauuucccaaacugcuuugacugacaguuuaacagcuuccccucugcucagggaugguuuuuaagcaccauucaagccaaacccacaauggauguauucaguggcaaagcacucaugagguuucuacaagcaucacaaugaucucauagcaagcgcaagacccuguccccuugucacaaugacugauuugaaagguuaaauaagcaaacccuguugucuucuggccaauuccagaaauucaagauguguuuugaaggcauggcucacacauuaaauuccuguauguguuguauaaggcaugacucccauaugaaauuccuuuagauagcagcauuggaauucuuaaucacacaguaugacagaauuucaauagagacccagaagagucugccaaccuccccauacuaugguuucagagcccacaacgggaggcguuuacaagccccuccccagcuucacuucuuggcaaucagcuuccccccaccaggcuccaccccuguggccugccuaggucaggguagugacaaccaucuauugagcaacuaagaaaagcuuuucaaugucacccuuccccauucaacagugaagcaaaacaauuuugcucuuccccuuguaggauuuugguauuuuccaagcaacugcaucucaaaguagugccaccugcagggauuuaccaucagccuuuagauuuucaugugaacuauuuaguucccaaacuguuauucccaucaacccacgguuccaggcacaauccucacccgcaccccgacuccuucaacccaccaaugccaagcugagcccugcuuucucccacaagucccauaucuggugccaaaaguauuauucccaagcuugauccauaacucagguuucaccuuggaaggccauuguuucaggacacugucaucugagcagggcugugaacccaggccagccugguauacacagccaggcccuaagucauaaaagcuaaugaacaaaaggggccagaaccacuguugccacucaaccacccaguaucaaauccacacccugggagagaccauucccagggaccacuucgggcccacggaucccuuuuaguccagaagacgucccaaagcccaaauuagauacggcaucuaccaagucggcagaauuuguggcuaacuugcgccuucccacuguuaaaccacaaacccuacccauuuuacaaccagcuccaucuaaggaagauuccuccacaccagucauuuacaacccaacagcuuuccccaacacccacaaguuuucaguuaagaaucccucugaccaaugcagaggcaggcaggcugcagaagcagggaaggugggcgaggucacuggggucccgaucuacagugcagcacgcugcgcagacguuaaaguguccuacaccuuacgcaaucuucucgaggccaaguucgcagcacagaacuacaaaggcuggauggaggcuuguuuagaagaugcagcagucgaacgccucuacccccaugaaaaagggugccugcugccauucaugcauccgcaaagaaugaugcucccagaacaagacauucaucuggaacauucacagccgacggccccuccggcuggaagcaccugcccacccccuacaagcugacuucaacgauggccuccugagcacagggcuuccugagaaaggccuggacccagggcagggacgcgcuuccuaagccucuggaauucacuguguaggcgucaaccgaggccgcugucuccuccagggugagcccuccugcacugcuacgacucacacuggcaggggcuccauaucuccuggugccaucugcuugccauggugaacacuauagugauaaaccacguccaugaagcauuugggugaccggaaacauggcugugagcccaccccaggguccacacucacgucccgcccucugugaaucaacaccaucccuccccgcccagucaggguguccuccaccuuuaccaaaaugccgugcccaagacuccagcaccgacucuacauccuccacaggcuuaccggacgacccaggggcaagguuuuaagugaccccuuaaccucagagugaggggcaagaguagggaagagugagaccacagaagaggaagcacggaaccuaggcaaaguccagagagggcacugcuaucugaaaaauaaaguugugauuaauguggccccaagacuugcgccuucaaucuccaugguccccgccuggcagaccugacaguaaaaacaacuugucucugcagccuccuccggccuccccucgcaccccgaagugggugcagacaggccacacccaaauuacauaccacccugggccagagcuguccgcccagcgaagcuaaguccaccuuccauaagaccaggccucauccccagguggguucacaaccccuuaucuggaaaaaaaggggucugcugguuuugucaagaucaaaggcgaccuccacuacgcaccuaguccugccccacugccuguccucuaugauuuccggggccuucaagggcccccaguccacccgucuccaucaacugcugcucugccacucaaguuaggacacugcccccauguaggccugugaaacuugugcccuccuggacgucaagugccagcagacagcagggauagccu

SEQ ID NO: 12036 - RNA, 3139 nt, Mus musculus
aggcuaucccugcugucugcuggcacuugacguccaggagggcacaaguuucacaggccuacaugggggcaguguccuaacuugaguggcagagcagcaguugauggagacggguggacugggggcccuugaaggccccggaaaucauagaggacaggcaguggggcaggacuaggugcguaguggaggucgccuuugaucuugacaaaaccagcagaccccuuuuuuuccagauaagggguugugaacccaccuggggaugaggccuggucuuauggaagguggacuuagcuucgcugggcggacagcucuggcccagggugguauguaauuuggguguggccugucugcacccacuucggggugcgaggggaggccggaggaggcugcagagacaaguuguuuuuacugucaggucugccaggcggggaccauggagauugaaggcgcaagucuuggggccacauuaaucacaacuuuauuuuucagauagcagugcccucucuggacuuugccuagguuccgugcuuccucuucuguggucucacucuucccuacucuugccccucacucugagguuaaggggucacuuaaaaccuugccccugggucguccgguaagccuguggaggauguagagucggugcuggagucuugggcacggcauuuugguaaagguggaggacacccugacugggcggggagggaugguguugauucacagagggcgggacgugaguguggacccuggggugggcucacagccauguuuccggucacccaaaugcuucauggacgugguuuaucacuauaguguucaccauggcaagcagauggcaccaggagauauggagccccugccagugugagucguagcagugcaggagggcucacccuggaggagacagcggccucgguugacgccuacacagugaauuccagaggcuuaggaagcgcgucccugcccuggguccaggccuuucucaggaagcccugugcucaggaggccaucguugaagucagcuuguagggggugggcaggugcuuccagccggaggggccgucggcugugaauguuccagaugaaugucuuguucugggagcaucauucuuugcggaugcaugaauggcagcaggcacccuuuuucauggggguagaggcguucgacugcugcaucuucuaaacaagccuccauccagccuuuguaguucugugcugcgaacuuggccucgagaagauugcguaagguguaggacacuuuaacgucugcgcagcgugcugcacuguagaucgggaccccagugaccucgcccaccuucccugcuucugcagccugccugccucugcauuggucagagggauucuuaacugaaaacuuguggguguuggggaaagcuguuggguuguaaaugacugguguggaggaaucuuccuuagauggagcugguuguaaaauggguaggguuugugguuuaacagugggaaggcgcaaguuagccacaaauucugccgacuugguagaugccguaucuaauuugggcuuugggacgucuucuggacuaaaagggauccgugggcccgaaguggucccugggaauggucucucccaggguguggauuugauacugggugguugaguggcaacagugguucuggccccuuuuguucauuagcuuuuaugacuuagggccuggcuguguauaccaggcuggccuggguucacagcccugcucagaugacaguguccugaaacaauggccuuccaaggugaaaccugaguuauggaucaagcuugggaauaauacuuuuggcaccagauaugggacuugugggagaaagcagggcucagcuuggcauugguggguugaaggagucggggugcgggugaggauugugccuggaaccguggguugaugggaauaacaguuugggaacuaaauaguucacaugaaaaucuaaaggcugaugguaaaucccugcagguggcacuacuuugagaugcaguugcuuggaaaauaccaaaauccuacaaggggaagagcaaaauuguuuugcuucacuguugaauggggaagggugacauugaaaagcuuuucuuaguugcucaauagaugguugucacuacccugaccuaggcaggccacagggguggagccugguggggggaagcugauugccaagaagugaagcuggggaggggcuuguaaacgccucccguugugggcucugaaaccauaguauggggagguuggcagacucuucugggucucuauugaaauucugucauacugugugauuaagaauuccaaugcugcuaucuaaaggaauuucauaugggagucaugccuuauacaacacauacaggaauuuaaugugugagccaugccuucaaaacacaucuugaauuucuggaauuggccagaagacaacaggguuugcuuauuuaaccuuucaaaucagucauugugacaaggggacagggucuugcgcuugcuaugagaucauugugaugcuuguagaaaccucaugagugcuuugccacugaauacauccauuguggguuuggcuugaauggugcuuaaaaaccaucccugagcagaggggaagcuguuaaacugucagucaaagcaguuugggaaauaaaagagacugggcccugggucaucuuacuagauaacacuuuguaaaaauugguucugaaaacccuguuuauuugcauauuugugaaaacccuguauaugugguuguuuugugagugugcuuaaaaguggugugaccagggcaagaucgcucauuggaacagcuguguggaauggggaaaugugaagaaagcuguaacugcagguuggucgcacacgcuucucuguacuaaaguguucaguguacaaacccacuaaccauuuuccuccccuuuacagcaaaauaaagguuugagauugaagcuucuuagaauugucauggcuguuacauucucgaccucugucacuuugccuucauauaguuaggccuagaugcacugcaccauggaagcaguuagagcaggucuggucugagcagcuugucaacucucugggagggaagggcugcucacugugagcugacaauggcugcagacaugacacugagucaugggauaaug

SEQ ID NO: 12037 - RNA, 754 nt, Mus musculus
cggugccuuuuagacuucuccaauggcccuuagauccuccugccacuugggugaccugauauuaguuaccuaacaaucauaguccccaaaucucugacaucacccacuagacaccagcagacacagccaagggggcuuagguguggccagguaugaugguggggaacagcuaccaacuggaaacagguugggacucagaacggaacaagagaugguacugguggugucccugacaggaaagcggaaauuuuggggcuuuuaauuuccccuaaguucccacaacauuucauuguugcucaacacugccccucuuccuuacaaaggguauuuccgauuucacuuccuccaaacucaucuagccagaaagcugcaacuuuuuaccccauuccgcagcuggcaccgccuuggugaaaacuccccgcuaggucacgucaauuguuuccauugccgugucccucucccaucagucugaguggagucccagcgcacucuuccuccuuccuuaccgauauuccucuucccgguguccuguacucccucggcuuucccuauucccgcuguccugucccucuccagagucgcuaaaagaccaaagggugaggcucccgaugcuuuugggaguuccuagccagcggaaacacugcaguuggggagcgcagcugaaguacuuggggguguccggaagcccacacgugcuagauggugcucagacuuaguacaucucgacgccagacucuggcacccgcgaccgcca

SEQ ID NO: 12038 - RNA, 754 nt, Mus musculus
uggcggucgcgggugccagagucuggcgucgagauguacuaagucugagcaccaucuagcacgugugggcuuccggacacccccaaguacuucagcugcgcuccccaacugcaguguuuccgcuggcuaggaacucccaaaagcaucgggagccucacccuuuggucuuuuagcgacucuggagagggacaggacagcgggaauagggaaagccgagggaguacaggacaccgggaagaggaauaucgguaaggaaggaggaagagugcgcugggacuccacucagacugaugggagagggacacggcaauggaaacaauugacgugaccuagcggggaguuuucaccaaggcggugccagcugcggaaugggguaaaaaguugcagcuuucuggcuagaugaguuuggaggaagugaaaucggaaauacccuuuguaaggaagaggggcaguguugagcaacaaugaaauguugugggaacuuaggggaaauuaaaagccccaaaauuuccgcuuuccugucagggacaccaccaguaccaucucuuguuccguucugagucccaaccuguuuccaguugguagcuguuccccaccaucauaccuggccacaccuaagcccccuuggcugugucugcuggugucuagugggugaugucagagauuuggggacuaugauuguuagguaacuaauaucaggucacccaaguggcaggaggaucuaagggccauuggagaagucuaaaaggcaccg

SEQ ID NO: 12039 - RNA, 157 nt, Mus musculus
guuaacugaaagaucuuuauugauggaauguauuucuacauuaauaucacaaaccacacugcaauaaauaacuccuaugucagagcuacucuguuugugaggaucaauuccuggaaguggcauugcuggguuggaguggcuguguuugccaaaguga

SEQ ID NO: 12040 - RNA, 157 nt, Mus musculus
ucacuuuggcaaacacagccacuccaacccagcaaugccacuuccaggaauugauccucacaaacagaguagcucugacauaggaguuauuuauugcagugugguuugugauauuaauguagaaauacauuccaucaauaaagaucuuucaguuaac

SEQ ID NO: 12041 - RNA, 974 nt, Mus musculus
cccuucccaccacucacugccaagucucccgagacaaacacacauauaaauagagcgauauauauuuuuauuucucagaacugucacauuuugcugagcucauaacagaagugagcaaauagugcugucguccucuguaauaaauccuaucacucagagcagcuucaucucccugucuucccaggcucccaggacucagauaugaauacacaugcucuucuguccuuaaauuacaucuguacuaaccugauauagucuccaggccucccuuuucugggcaacaugguagaauucuugggccagaggaaucuccgucaacuguuuaucuuucugagcaauuauuugcuacuugagaaaaaaaaaagaaguuacuaguuuaaauaaaaaauaaaaauacagauuaaaaaaauuguacuaguuaguuuguauugucaacuugacacaaucuagaguuaccugggaagaggaaaucugaacuacugaggaauuguccacaagagauugucuugacugaugauuaaugugggaggauuaagcccacugugggcagcaccauuccuaggcaggaggaucgggcuguaaaagaaaucuagcuuaguaugagccagugagugagacagcaagcaacacuccuccaugguuuugguucaauucccuguccugacucuccucaacauaggacuacgaacuggaaguacagaugaaauaaauccucucuuccccuaaauugcuuucgguugaguguuuuaucauagcaacagaaaagcaaacuagaauaagaaugauaucaaauacauuagucugagggagaaagaagaagaagaagaggaagaggaagagggaggaagagggaggaagaggaagagagagaaagaagaagaagaagaagaagaagaagaagaagaagaagaagaagaagaagaagaagaagaagaagaagaagaagaagaagaagaagaagaagaagaagaaga

SEQ ID NO: 12042 - RNA, 974 nt, Mus musculus
ucuucuucuucuucuucuucuucuucuucuucuucuucuucuucuucuucuucuucuucuucuucuucuucuucuucuucuucuucuucuucuucuucuucuuucucucucuuccucuuccucccucuuccucccucuuccucuuccucuucuucuucuucuuucucccucagacuaauguauuugauaucauucuuauucuaguuugcuuuucuguugcuaugauaaaacacucaaccgaaagcaauuuaggggaagagaggauuuauuucaucuguacuuccaguucguaguccuauguugaggagagucaggacagggaauugaaccaaaaccauggaggaguguugcuugcugucucacucacuggcucauacuaagcuagauuucuuuuacagcccgauccuccugccuaggaauggugcugcccacagugggcuuaauccucccacauuaaucaucagucaagacaaucucuuguggacaauuccucaguaguucagauuuccucuucccagguaacucuagauugugucaaguugacaauacaaacuaacuaguacaauuuuuuuaaucuguauuuuuauuuuuuauuuaaacuaguaacuucuuuuuuuuuucucaaguagcaaauaauugcucagaaagauaaacaguugacggagauuccucuggcccaagaauucuaccauguugcccagaaaagggaggccuggagacuauaucagguuaguacagauguaauuuaaggacagaagagcauguguauucauaucugaguccugggagccugggaagacagggagaugaagcugcucugagugauaggauuuauuacagaggacgacagcacuauuugcucacuucuguuaugagcucagcaaaaugugacaguucugagaaauaaaaauauauaucgcucuauuuauauguguguuugucucgggagacuuggcagugaguggugggaaggg

SEQ ID NO: 12043 - RNA, 382 nt, Mus musculus
ucuccaaccgcgccgccgugccggagcacgggggcgcuccggaagccgagcggcugcgacuaccugagcgcgaggugaccaaggaacacggugacccgggggacaccuggaaggauuauugcacgcuggucacuaucgccaagagcuuguuggaccucaacaaauaccgacccauccagacccccucggugugcagcgacagucuggagagucccgaugaggauauaggauccgacagcgacgugaccaccgaaucugggucgaguccuucccacagcccggaggagagacaggauucuggcagcgcgcccagcccacucucccuccuccacucuggaguggcuucgaaggggaaacacgccuccgaaaagaggcacaagug

SEQ ID NO: 12044 - RNA, 382 nt, Mus musculus
cacuugugccucuuuucggaggcguguuuccccuucgaagccacuccagaguggaggagggagagugggcugggcgcgcugccagaauccugucucuccuccgggcugugggaaggacucgacccagauucgguggucacgucgcugucggauccuauauccucaucgggacucuccagacugucgcugcacaccgagggggucuggaugggucgguauuuguugagguccaacaagcucuuggcgauagugaccagcgugcaauaauccuuccaggugucccccgggucaccguguuccuuggucaccucgcgcucagguagucgcagccgcucggcuuccggagcgcccccgugcuccggcacggcggcgcgguuggaga

SEQ ID NO: 12045 - RNA, 707 nt, Mus musculus
uuaagucuccaguugcccugacuuggccuuguggaugagcgcuuuuccuuuccauuuggauaucgagguuuccuggcaccauuuguugaaaagaccauuuucccuuuuguucagucuuagaguccuuaucaaaggugcagugaggugugugggguuguugggguggggugcuuggugucucuguaagguucucuucuguuccauugaucucugccuugcuucuauccaaauagugugcuaucuugguugcuguaccuauacauuauacuuagaaaccagguaguauuaaugcaguguuguuuucuguuugauugcguucacucuuugguccuuuggauucucuaugaauuuuaagauuguucuguaaaugucuaugaaaaaaaucauuggaauuuuaauagggauuauauugauaguaugcacauuuaaacaaugucagcucguuguccaugaacaugggauaucuuugcauuugugccaugcucagggucuuacaguuucagugucaccugguuaguuacacuuauauacuaguuuacuuuuggaugcuuuuuauaaauaggauugcuuucuuaaguucuuuuucaguuuguuuuuaguguaaagaaacauugguuuugugcuuaguuuuuaugucuuguaaccuuauuggcuuuguguacuuauuuuuaguuguggaaucuuuaggguuuucuguauugcacuuc

SEQ ID NO: 12046 - RNA, 707 nt, Mus musculus
gaagugcaauacagaaaacccuaaagauuccacaacuaaaaauaaguacacaaagccaauaagguuacaagacauaaaaacuaagcacaaaaccaauguuucuuuacacuaaaaacaaacugaaaaagaacuuaagaaagcaauccuauuuauaaaaagcauccaaaaguaaacuaguauauaaguguaacuaaccaggugacacugaaacuguaagacccugagcauggcacaaaugcaaagauaucccauguucauggacaacgagcugacauuguuuaaaugugcauacuaucaauauaaucccuauuaaaauuccaaugauuuuuuucauagacauuuacagaacaaucuuaaaauucauagagaauccaaaggaccaaagagugaacgcaaucaaacagaaaacaacacugcauuaauacuaccugguuucuaaguauaauguauagguacagcaaccaagauagcacacuauuuggauagaagcaaggcagagaucaauggaacagaagagaaccuuacagagacaccaagcaccccaccccaacaaccccacacaccucacugcaccuuugauaaggacucuaagacugaacaaaagggaaaauggucuuuucaacaaauggugccaggaaaccucgauauccaaauggaaaggaaaagcgcucauccacaaggccaagucagggcaacuggagacuuaa

SEQ ID NO: 12047 - RNA, 627 nt, Mus musculus
ugccuuuaccuuaaguuauuucauggaaaagaauuuuguguauuuuuacuuuucugguuuugauagugugggcuguuaccucacuauuguuuaauaguacuuuacuaucaguacaauuuauucuuauuuggccaagguucuaugaaucuuaugugauuggaaaauauuuggaaaccacaaauaucaaaaauauuugguacuuauaguguuaaggcugaaaaaucacuguugcauuugagauccucugguagucgauuguugcauagcaaaagggcucuuuuguuuaaacauuacuuuuuuuuuuuuuuuuagaaaguuuccuauaaugaauguaucagucaggccauuucucuauaggcuugaggaucccuugagcuuuuguugauguuccuucuuuggguauuauuuacccagauuccuuaaaauguuccacugaagucugucuuggcuguguuuuccauuaugaguagguuauaaacuuuauaaaauuacaguuuugguaguuuuuauuauguucuaucuuguaaccuuuaauaggcauugacugaaaucucugugcuucuuauuuuaaaaaaaaaaacuuaauuuuaaaagcagauuuagguuuucaacaaaauuaggcagcaa

SEQ ID NO: 12048 - RNA, 627 nt, Mus musculus
uugcugccuaauuuuguugaaaaccuaaaucugcuuuuaaaauuaaguuuuuuuuuuuaaaauaagaagcacagagauuucagucaaugccuauuaaagguuacaagauagaacauaauaaaaacuaccaaaacuguaauuuuauaaaguuuauaaccuacucauaauggaaaacacagccaagacagacuucaguggaacauuuuaaggaaucuggguaaauaauacccaaagaaggaacaucaacaaaagcucaagggauccucaagccuauagagaaauggccugacugauacauucauuauaggaaacuuucuaaaaaaaaaaaaaaaaguaauguuuaaacaaaagagcccuuuugcuaugcaacaaucgacuaccagaggaucucaaaugcaacagugauuuuucagccuuaacacuauaaguaccaaauauuuuugauauuugugguuuccaaauauuuuccaaucacauaagauucauagaaccuuggccaaauaagaauaaauuguacugauaguaaaguacuauuaaacaauagugagguaacagcccacacuaucaaaaccagaaaaguaaaaauacacaaaauucuuuuccaugaaauaacuuaagguaaaggca

SEQ ID NO: 12049 - RNA, 2076 nt, Mus musculus
ggagcugaacugucuucuaagacugaguagccggagcucagcacccgaacagacuuguuauguaagggcaaggugagcucaccgggaaacauuucuggcagaggagugucacacuguuggagggacaagcagucaggccugaggcuugcucauuccuaaggggguggcuuuucuagagaggcucaggcuuugcuggugagggagagaguccaguuucucccucccccgcaaauuccuuccucuggauucaacuggaccuuguggggagagagagagagagaggacaaugcuugaguguugaguagcaagagcguugcagggaggcccagggcucuguccuguuguguguggguggauguuuggaccucucugguaugguggaucaaacccaaucuugagaccuuuuaggaagauaacacaagagcauccaucuggaauggacauccuacaagauccucugcagguaccccugguucuggagcccagggagucugagcuccucugguuacaucaucucuauucugcagaagaggcugagacggguuggacaagacacacaccaggugcugcucaggguaagguaccuuggaggugcauagaagccagagucaguccacugagcccuuuuggauggagaagcagauguguccgugggacaugaugcccuggauggaguccccugucucuucucucaguucaaaugcagaugccucuggggaacugaaccccuucuaucccugggcauauauuuucuguaaugcccccaugucuuguagcuaugccgccgggaucucuagcuagugugacuugugguugcacgguacccagcaacuacccccauucuguuucugucaccuggagccuaccaaugcuuucuccaucucugcugcugcuguuauugucuucacagcaacccggggcagauacuggggagacucaaaggagaaucgccauuuugaaaacgaacaaacugcuccagagaagcaguguggcucacugcgcuaucccccaggucagaucagcuccuagcucagcuuccaaugaaucuauccagcucucuguccccaaagccuuccuaaagccacaucugcuuccuuguuccacuguuggguuuucuuggucuuuuuccaacgcccacugaacaaaggagucacagcaaaccuguccuguguccccaaacccacccuacacuguaagcacaucagaucaccugcuucucuacuccacauuuuuccugccucagugacuucccucgagccguguccaccgcuuagugugccuguucuuucucagcguguccaaaucuaacgcaagccgccaagcccagcucacaugcugccacagccucuuaaagccucugcuuuuaucuucccuggugcuucuaagccauucuaccccaaucuaguuuuuaguuuccucaggggucugggaguaccuucagaaacccagaccgauuggaaugucgaguaguucacuuuuuccuacaaccuuggggaacaacuuggacugucccacugucccugcuauaaagcugggauaucaccugcuuuucugggcugggugaggauuaagcaaaaacacccagcccuauaaugccucaaguacagacugggagacuaaugagguaaugauugugagaggcaccaagucggaccagguguggcuggaucugcugaguccaggaaacucaauguuucucauuuaucuccucuccaaaugccugacucccaccuagggaaauuaggugugugugugugugugugugugugugugggugcaugugcgcgugcgugugcgugugugugcgcgcguguguccuugccuaucuggaacuuaugaucugacucuuucuucugaguuugggauuacggguagguaccacccaugcccaguuugcuguugugcuuaaaggcugcuaagcuuuggagucauaggcaaccuguugcaccagcagccugcugggccccacccugaaccuucugaaucagauuuccgucggugagugaggccaaggaagcugcauuuaaaaaugagauagauugacuguauuuguggguaugaguacuuugucugcaa

SEQ ID NO: 12050 - RNA, 2076 nt, Mus musculus
uugcagacaaaguacucauacccacaaauacagucaaucuaucucauuuuuaaaugcagcuuccuuggccucacucaccgacggaaaucugauucagaagguucaggguggggcccagcaggcugcuggugcaacagguugccuaugacuccaaagcuuagcagccuuuaagcacaacagcaaacugggcaugggugguaccuacccguaaucccaaacucagaagaaagagucagaucauaaguuccagauaggcaaggacacacgcgcgcacacacacgcacacgcacgcgcacaugcacccacacacacacacacacacacacacacaccuaauuucccuaggugggagucaggcauuuggagaggagauaaaugagaaacauugaguuuccuggacucagcagauccagccacaccugguccgacuuggugccucucacaaucauuaccucauuagucucccagucuguacuugaggcauuauagggcuggguguuuuugcuuaauccucacccagcccagaaaagcaggugauaucccagcuuuauagcagggacagugggacaguccaaguuguuccccaagguuguaggaaaaagugaacuacucgacauuccaaucggucuggguuucugaagguacucccagaccccugaggaaacuaaaaacuagauugggguagaauggcuuagaagcaccagggaagauaaaagcagaggcuuuaagaggcuguggcagcaugugagcugggcuuggcggcuugcguuagauuuggacacgcugagaaagaacaggcacacuaagcgguggacacggcucgagggaagucacugaggcaggaaaaauguggaguagagaagcaggugaucugaugugcuuacaguguaggguggguuuggggacacaggacagguuugcugugacuccuuuguucagugggcguuggaaaaagaccaagaaaacccaacaguggaacaaggaagcagauguggcuuuaggaaggcuuuggggacagagagcuggauagauucauuggaagcugagcuaggagcugaucugaccugggggauagcgcagugagccacacugcuucucuggagcaguuuguucguuuucaaaauggcgauucuccuuugagucuccccaguaucugccccggguugcugugaagacaauaacagcagcagcagagauggagaaagcauugguaggcuccaggugacagaaacagaauggggguaguugcuggguaccgugcaaccacaagucacacuagcuagagaucccggcggcauagcuacaagacaugggggcauuacagaaaauauaugcccagggauagaagggguucaguuccccagaggcaucugcauuugaacugagagaagagacaggggacuccauccagggcaucaugucccacggacacaucugcuucuccauccaaaagggcucaguggacugacucuggcuucuaugcaccuccaagguaccuuacccugagcagcaccuggugugugucuuguccaacccgucucagccucuucugcagaauagagaugauguaaccagaggagcucagacucccugggcuccagaaccagggguaccugcagaggaucuuguaggauguccauuccagauggaugcucuuguguuaucuuccuaaaaggucucaagauuggguuugauccaccauaccagagagguccaaacauccacccacacacaacaggacagagcccugggccucccugcaacgcucuugcuacucaacacucaagcauuguccucucucucucucucuccccacaagguccaguugaauccagaggaaggaauuugcgggggagggagaaacuggacucucucccucaccagcaaagccugagccucucuagaaaagccacccccuuaggaaugagcaagccucaggccugacugcuugucccuccaacagugugacacuccucugccagaaauguuucccggugagcucaccuugcccuuacauaacaagucuguucgggugcugagcuccggcuacucagucuuagaagacaguucagcucc

SEQ ID NO: 12051 - RNA, 4343 nt, Mus musculus
uagcaagcaccuuuaccaacugaaccuucucagccuaucuuucuuuguuucuucuuucuuauuuuucuuaccuuauugccaugcauaaaauuucaguauuguauuuaaaaagaguguggcuuguauacauuuuguuuuaguuauuuauuuuuuacaagaagcucuuuuagucucuccucauucagaauuaugcugauuauacgcuuacuguguccuuugucagguugagaugugauccuccuguuccuaauuucuuccaggcuuauaucugaguccuguuccacauuuaucaagauuauccugggauauuuaucuuugauccuauuuauguacuguguuacauuauucauuuguguacauugacccauccugacacaccaagaaugaaaacaaguuaaccauggcuuauuauuuuuauaugcuguuuaauucaguuugaaauacuuuguuggggauuuuugugucuauguucaucaaagcuguuggccuguagcuuguuuguuugcuuuuuuuuuuuuuucugauguguccucaucggguuuugguguauaucuagauaacacugaccucaguuugaacacaagcuucuuuaaccacaguaagauggaacacagggucccccaauggaggagcuagagaaagcacccaaggagcugaaggggucugcaacccuauaggcgggacaacaauaugaacuaaccaguacccccagagcucgugucucuagcugcuuauguagcagaagauggccuagucggccaucacuggaaagagaggccccuuggucuuacaaacuuuauaugccccaguacaggggaaugccagggccaaaaagugggaguggguggguaggggagcaggguggagggaggguauagggaaauuucgggauagcauuugaaauguauauaaagaaaauaucuaauaaaaaaaauuccaccagagaacucuuaaaccuggggggaaagaaaaaagaaaaaaagaaaaagaaauagacuucuucagggugcagugagcucagagugccacaugauggcagcaguuuaacaagccaauuauucauuuggguguagugaaaauaggaauuccuaggagaaauccuugaacaauuauaauaaauucuacacauagugaaacuguugugaaguguggagaugggcuacuaccauaucgaauaaaaguaaaacaaaauuauauucccuauauucuccuuuuuaagugucaauacucauguguaacugucuagacuuuucccuuuuguuuggugagagagauagacaagguaguccuaccuagucuagaacucauuauguagaccaagcuggcuuugaacucagagaucacucuguuucuuccuuaugggucugggauuaaagguguguaccacuacacuuagguuaucuuuagucuuaaaauauccaggugugugucagucuucuuacaggcuaauguaaaaauuucugaauauugaaaugaucaguaacuaacauuuuuaaucaaccaaauaguuuccugguacuacuccaaaccugugaagucagccuggaccccauucuguuguccaauuaucuaacagguauacaguuaauuagugaacacuugagaggguuaguagguguuagcaguaaguuaaaagaaacuaagaaaaucugauuggcacgagacauuaaaacugcaaagcuguaaaugccuuggaaguuuuauaauggggaaaggagggguagaagaacaaagacugauagacauuuuucuccauuuauuuauuuauuuauuuauucauucauucauucauuuuacaucccuauugcugcccccuaguucccccucauagaguccuucccccaccccuccccuucuccucugagaggguggggcccccuagguaucccuccccacccugacacaucaagucucugcagggcuaggugcaucccucucccacugaggccagauaaggcagcccaguuggcaaaggauuccagagauaggcaacagcuuuagggauagccucugcaccaguuguugggggacccacaugaagacugaacuguacaucugcuacauaacgugcuaggggccucaguccagcccauguaugcucuuugguuggugauucagucucugggagcccccaagguuccagguuaguugauucuguuggucuccuguggcauuccuguucccuucauuuccuucaauucuucccccaacucuuccauaagagucccccagcuccaguguuuggcugaggcucucugcaucuguuucagucagcuucuggguggagccucucagaggauaguugugcuaggcuucugucugcaagcauaacagaguaucauuaauagugucagggauuggugcuugcccauggaauggaucccauguugggcugauuauuggucggccauuucuugaggcucugcuccaucuuucucccugcauuucuuuuaaacgggacaggacuacagagugaaucucaaaauagccagggcugcacaguggaaccuugucuagaaaaaagccgaagaaaaaauuagauuuauuuauuuucauuuuauguauauggguguuuugcccauguguaugucuauacaccaugucacauggcaucaacagagcccagaagaaggcaucagauccccugcaacuggaguuacagauaguagugagccacaucugggugcugggaauugagccuaggucuucuguaagaguagccagugcucugaacaacugugccaucucucuaaccccaauuaauuaacuuuugcaacagaagcucacuuagaaaccuaguuuagccucaaauucuugacccuccuacguaaguuucuuuaguacguguuguguguguguguauuuguauguauauauaacacacacacacacacacacacacacacacacacacugugcugugguaguucuucuuauacuaauccccucuuuuccuuuccuuagcaugcaggucucaugauacaauccagcuauaaccugaagucuccaagcauggagcuaucuaaaauacuugggcuuaacaacucucccguuccuuuuuauguauacauuucugaccuuacacagaagcaagcuuuugcugagugcucuuuccacugagucaccuguucuuauuguagaugacuuuguuucagauuguucauuaggaaguaucagaugagagaacagaguuauaauaggguggaaagugucagcaaccuggaucucuguuacaguuugcauguagaauuccgcguaugggcucauguguuugaaaucuugcucuccagcuaguugugcuguuucagggagguuacggaaauucuugcaguuggagguugacuguaggaggugaaucucugggacuaggcuuauagcccaugcauacuuucuauccucuuucugcuucuugaucuauagagaugugagucaagcuccugacuuaauggagccucucaucaccuugucuacuuugccauaauggacuauauucauuccucaaacugugagccaaaauaaguccuuuuuucccuaaugugucuuuccaggcauuugguuccagaaaugggaaauguaaugaauauuguucagauuguacuguuuacuaacaaucuagguuuccuuuuguuugagguuuuuuccuacuccuuuuugagacaaugccuuacuauaguugcauagccuggaacucacuauguagacuagccugaccuuaaacuugcacuguuccucccgccucuggccacuacugucucccuuuuaaaaugcuuugaacaaccuuuugagauauuuuuaccuugauuuaguaguguugagaaauugacuuggccaggggaaagcgauuacuuaauauacgguuagcgugguaaagguagaauucgagcagaauucaauaacucuuugagagccuguguucuucacuguguucuacacugucuucagccuaacuucagaacuucaagcagcaguauguagaggcguuuuaaaaguuuuuuaccacaaaaacaaaacaaacaaacaaaaacaauaugugaaauaauacauaugcuaguuaacuguauuuaaccagucccauaguguguacaaaucaugaaacuagaagacgugcaauaugauguucauuugucaaacuaauuaauuuaaaaggugaauaacacguacuucuucaaggcgacugucuuacuuuaauacauuuaauaauguauuucugcuguuuuucugauuaccuucaauaucaucauguuuuuccugcaggagagaagccuuacaagugcaccugggauggcuguuccuggaaauuugcucgcucggaugagcuuacucgccauuuccguaagcacacg

SEQ ID NO: 12052 - RNA, 4343 nt, Mus musculus
cgugugcuuacggaaauggcgaguaagcucauccgagcgagcaaauuuccaggaacagccaucccaggugcacuuguaaggcuucucuccugcaggaaaaacaugaugauauugaagguaaucagaaaaacagcagaaauacauuauuaaauguauuaaaguaagacagucgccuugaagaaguacguguuauucaccuuuuaaauuaauuaguuugacaaaugaacaucauauugcacgucuucuaguuucaugauuuguacacacuaugggacugguuaaauacaguuaacuagcauauguauuauuucacauauuguuuuuguuuguuuguuuuguuuuugugguaaaaaacuuuuaaaacgccucuacauacugcugcuugaaguucugaaguuaggcugaagacaguguagaacacagugaagaacacaggcucucaaagaguuauugaauucugcucgaauucuaccuuuaccacgcuaaccguauauuaaguaaucgcuuuccccuggccaagucaauuucucaacacuacuaaaucaagguaaaaauaucucaaaagguuguucaaagcauuuuaaaagggagacaguaguggccagaggcgggaggaacagugcaaguuuaaggucaggcuagucuacauagugaguuccaggcuaugcaacuauaguaaggcauugucucaaaaaggaguaggaaaaaaccucaaacaaaaggaaaccuagauuguuaguaaacaguacaaucugaacaauauucauuacauuucccauuucuggaaccaaaugccuggaaagacacauuagggaaaaaaggacuuauuuuggcucacaguuugaggaaugaauauaguccauuauggcaaaguagacaaggugaugagaggcuccauuaagucaggagcuugacucacaucucuauagaucaagaagcagaaagaggauagaaaguaugcaugggcuauaagccuagucccagagauucaccuccuacagucaaccuccaacugcaagaauuuccguaaccucccugaaacagcacaacuagcuggagagcaagauuucaaacacaugagcccauacgcggaauucuacaugcaaacuguaacagagauccagguugcugacacuuuccacccuauuauaacucuguucucucaucugauacuuccuaaugaacaaucugaaacaaagucaucuacaauaagaacaggugacucaguggaaagagcacucagcaaaagcuugcuucuguguaaggucagaaauguauacauaaaaaggaacgggagaguuguuaagcccaaguauuuuagauagcuccaugcuuggagacuucagguuauagcuggauuguaucaugagaccugcaugcuaaggaaaggaaaagaggggauuaguauaagaagaacuaccacagcacaguguguguguguguguguguguguguguguguguguuauauauacauacaaauacacacacacacaacacguacuaaagaaacuuacguaggagggucaagaauuugaggcuaaacuagguuucuaagugagcuucuguugcaaaaguuaauuaauugggguuagagagauggcacaguuguucagagcacuggcuacucuuacagaagaccuaggcucaauucccagcacccagauguggcucacuacuaucuguaacuccaguugcaggggaucugaugccuucuucugggcucuguugaugccaugugacaugguguauagacauacacaugggcaaaacacccauauacauaaaaugaaaauaaauaaaucuaauuuuuucuucggcuuuuuucuagacaagguuccacugugcagcccuggcuauuuugagauucacucuguaguccugucccguuuaaaagaaaugcagggagaaagauggagcagagccucaagaaauggccgaccaauaaucagcccaacaugggauccauuccaugggcaagcaccaaucccugacacuauuaaugauacucuguuaugcuugcagacagaagccuagcacaacuauccucugagaggcuccacccagaagcugacugaaacagaugcagagagccucagccaaacacuggagcugggggacucuuauggaagaguugggggaagaauugaaggaaaugaagggaacaggaaugccacaggagaccaacagaaucaacuaaccuggaaccuugggggcucccagagacugaaucaccaaccaaagagcauacaugggcuggacugaggccccuagcacguuauguagcagauguacaguucagucuucaugugggucccccaacaacuggugcagaggcuaucccuaaagcuguugccuaucucuggaauccuuugccaacugggcugccuuaucuggccucagugggagagggaugcaccuagcccugcagagacuugaugugucaggguggggagggauaccuagggggccccacccucucagaggagaaggggaggggugggggaaggacucuaugagggggaacuagggggcagcaauagggauguaaaaugaaugaaugaaugaauaaauaaauaaauaaauaaauggagaaaaaugucuaucagucuuuguucuucuaccccuccuuuccccauuauaaaacuuccaaggcauuuacagcuuugcaguuuuaaugucucgugccaaucagauuuucuuaguuucuuuuaacuuacugcuaacaccuacuaacccucucaaguguucacuaauuaacuguauaccuguuagauaauuggacaacagaaugggguccaggcugacuucacagguuuggaguaguaccaggaaacuauuugguugauuaaaaauguuaguuacugaucauuucaauauucagaaauuuuuacauuagccuguaagaagacugacacacaccuggauauuuuaagacuaaagauaaccuaaguguagugguacacaccuuuaaucccagacccauaaggaagaaacagagugaucucugaguucaaagccagcuuggucuacauaaugaguucuagacuagguaggacuaccuugucuaucucucucaccaaacaaaagggaaaagucuagacaguuacacaugaguauugacacuuaaaaaggagaauauagggaauauaauuuuguuuuacuuuuauucgauaugguaguagcccaucuccacacuucacaacaguuucacuauguguagaauuuauuauaauuguucaaggauuucuccuaggaauuccuauuuucacuacacccaaaugaauaauuggcuuguuaaacugcugccaucauguggcacucugagcucacugcacccugaagaagucuauuucuuuuucuuuuuuucuuuuuucuuuccccccagguuuaagaguucucugguggaauuuuuuuuauuagauauuuucuuuauauacauuucaaaugcuaucccgaaauuucccuauacccucccuccacccugcuccccuacccacccacucccacuuuuuggcccuggcauuccccuguacuggggcauauaaaguuuguaagaccaaggggccucucuuuccagugauggccgacuaggccaucuucugcuacauaagcagcuagagacacgagcucuggggguacugguuaguucauauuguugucccgccuauaggguugcagaccccuucagcuccuugggugcuuucucuagcuccuccauugggggacccuguguuccaucuuacugugguuaaagaagcuuguguucaaacugaggucaguguuaucuagauauacaccaaaacccgaugaggacacaucagaaaaaaaaaaaaaagcaaacaaacaagcuacaggccaacagcuuugaugaacauagacacaaaaauccccaacaaaguauuucaaacugaauuaaacagcauauaaaaauaauaagccaugguuaacuuguuuucauucuuggugugucaggaugggucaauguacacaaaugaauaauguaacacaguacauaaauaggaucaaagauaaauaucccaggauaaucuugauaaauguggaacaggacucagauauaagccuggaagaaauuaggaacaggaggaucacaucucaaccugacaaaggacacaguaagcguauaaucagcauaauucugaaugaggagagacuaaaagagcuucuuguaaaaaauaaauaacuaaaacaaaauguauacaagccacacucuuuuuaaauacaauacugaaauuuuaugcauggcaauaagguaagaaaaauaagaaagaagaaacaaagaaagauaggcugagaagguucaguugguaaaggugcuugcua

SEQ ID NO: 12053 - RNA, 31376 nt, Mus musculus
agcacgccuccugacauguccagggcaucccuggccgggcccggccgcggcuaggagcagugggucuugguccgccccucugucccucagucccgccuggcccugaccugaccgggccugcuuuccgcucucggucaccugagggaaggaguuggggaagcggcgggugggucucggagagggagcauuggccccaggcuggaggaggcugaccccgcguccccgcccagcccgcgccuaugcgguacuugaaggauggcgaagaggucgcgcaggugggugccauccccucggacccggccuagcggcccugucucgacucuugcucucuguccuuuccugcugguccccacuuaggcccucucgagccuggggggcauagguuuuccuguucggugggugucccacacccgcuucggccgcgcuggccugagagcaucuaucauuauuagacuccaucauuauuagacgacuguguguaggacucucucuaacaaaugcucagguugcugcauugacggauucucccacagcucacgcccagacuucuaacuucucacagccacuuucagggagguuucuugccagguaaguuugcccacugucaggggauacgccacgccaggggaagcgguuguguuugccuggaugacuugaaaugggguucucuccucugacuuaaucgugccaaaucaaaacagaucuccuugacaaaccugggcgggcacgguucugggaaaucuugagaagggaauucgcuaaaucucccuugugcgcacugcucuucugagcuuuucuuuuucuuaguaucuucugaggacauuguuacguuguuacuaucgaguaaacuugauccuaaaccaaugugucuuaguuacuuuguaucucaaguauucauguuugauucugauuguaucggcauuguaacaaguaggacacaauguuguuguuguagaaagaugugcuaggaugucuuuaugcaccuaacuuuuauuuuaugcuauuguaauagcuacuccuaaauuguguggcauaaucagaugacaaaaaaaucuagugucucgauuuucaguauuaaggaaaccugaaaaguauuucucagaauuuccauuuaucuagauacacagcuucaaaaucuaagagucauauucccugagcugaaauuuaguacugagagucauucauugcagaguuugauuuaaaauaacuacgcauaaaauacuuggcuuuauucauauauucuucuauauguagguugguucugcagauaucaacauaaauuuaauuaugacauaauuacuuuauauaaaguggcugcagaauagauugaacauugaaguggaacaagugugcauauacgcauacacccacaggcacacuaccuuggucuuuuaucauuuuggaugagguaguuguagggguuuuuagcagcaccuuuaccuuuacucaguagaagacaguagcccuuuuuccuacagucaggacaaccaaaacuguuuacagauggugccacauaucucuggggggauggaaucuggaccaugcagguaagaacugcugaucuacaacuucaaagacauaacauucccaucuucauaaaagaugcagauuuaaagauaagauugcuggaguacugcuuuaggcuuuuugaguuuugaagucuaacaaugcuuuuaaaugauguguaaguuaauugagacaauauagaaugauguaaaaaaugauguaaaaaguuauaguucuggaguaauugugcugcagugaaacacuucucuggaaguauguagauagagggugugaugagagaucaccaucucuggucuguuucuuuggguuuucuucagugaguuccaggugcuguuaaauuucuuauauauuuaaauaugauuccuguauuagaagauaaugaaauguuugaggaugaaauaccuuauucauugggcuuucuucuuuggcugagaaucuuaguagauaugaauucaauauauaauagagaaacaaaggucuucagcauacaaacacugaggugaaugcaauaucuugcauaaggauaugggcauaaauauaguagacuuucucuauguuauuugggggaaaaaaacaccuaaaagcagaaaauguuuacccuaaauauaaaacaacugaacaauguugguucuuuuuagcuuucuaauggcugcagaguuuuucacuaagauuugcauauagaaaagguuauguaguuuugugacuuaaaauaguuuuagaauuuaauggggauuuuagugauacaauuuacagcuauuucuuauuaggauaucuauuaacaguauguauuugauuuuuaaauauucuauguauaguuucauuuuaugguaugugugugcucaugcaugagugcaugugugccuguguacaugcaguugugccagggugugaaagaugaaaggacaguuaucuggaaguucacugcugccauaguuguccugaggaucaaacccagguugacaggcuuggcagcaaacaccuacugagucaucuuuccugcccuaguuuagcuuuuaaaggccaauuaaaccccuagaaauaaguucacaauaauucugaugcuacaaagccuacuuacuaggcauagguuaagauauuuauacuuaagaugaccaaugauuaaauuaaaaugauaagaugaaagcuagguucuacauaggaaguuuuuuccuuagugguguguguauuuguguguguguagcaaauucauguuuguuucuagaaacaugacugaagugaaugaaugcaaaacuauaagaaauauuuuuaggaugauaaaggauauuuuuaggauuuuuuuuuugugucuuuaacuagcaauauuauuuuggggaaucagguaaaaucuauuucaguuucuuuucguuuauauaugggacuuggacuuuuuagucuguaagguagcuuauaguuuuaauccaaaucuuugaggacuuuugugaccauccuguucuguuuaaaaauaacauucucuaaaagaauuagaaauauuauccauuguuuuuguuuauggauaauuauauaguuuuuuuaaaaaaguauuuauuucaguguuuguaauauuaaugguucugauuaucugaagucaaacuuugucuuucucugauaaugcuaguuugcagucuagagguggaagccaauauuugcuauaugcaguacagcauauuaaccgcuggguggccugauuucacuuuguuaaaucaauuugauaaaugaacauaaauugagugcaguugaacugaaaauaauuaaauauacaguugcccugaccuuaaauugaccugaaauuaaagacuuuuuuuuuuuuuugagacaggcgcucacucacuaguacuggauagucuuaaauucacugucucacuauguagccugggcuggacuugaauuugugaaaaauccucuagaaucagucucccauguauuggaauuacagauauaagccacuaugaccagccuuguauuauuuuuuucuuaaagauuuuuuuauuuuauguauaugaguacacugucacugucuuuagacacaccagaagaggguauuagaacccauugcagauguuugugagccacuaugugguugcugagaauugaacucaggaccucuggaaggacagucaguacucuuuuuuuaauuaauuuauuuauuuuuaauuuauuuacauuucaaauguucaaccccuuaccugguuacccccucccagaaacucccuaucacaucuccccucccccugcuucuaugaggguguuccuccaccuauuuacccaaccacuccugccuccccauccuugauuccccuacacuggggcaucuaucaagccuucauaggaccaaggacuucuucucccauugaugcauggacaaggucacccuuugcuauauaugcagcuggagcuauguguacuucuugguuggugacuuaguccuuggaaacucuggaggggucugguugguugauauuguuguucuuccuaugggguugcagacuccuccagcucccucaguccuuucucuaccuccaucauuggggaaccugcacucagugcaaugguugacugcaacucuauauguguaaggcccuggcagggccucucaggagacagcuauaucaggcuccuuucagcaagcauuucuuagcauccacaauagugucgguguuuggugacuauaucuggcaugaauccccaggugggacagucucuggguggccuuuccuucagucucagucagugcucuuaaccacugagccaucucuccagcccaaccuucuauuuuuuuuuaaagaguuauuuauuuauuuuauguauaugaguacacuguagcuguacaaaugguuaugagccuucaugugguuguugggaauugaauuuuaggaucucugcuugcuccagucagcccagcucuggucaaccccacucgcucagucccugcucccucuggcccaaagauuuauuuauuauuauaaauaaguacacuguugcugucuucagacacaccaggagagggcaucagaucucauuacugaugguugugggccaccaugugguugcugagauuugaauucagguacuuugaaagagcagaccugcugagccaucuuacccgccuguuuuuuuuguuuuuuguuuuuuuuuaugauaaauauuugagacuugaggaaauuuggauuaaaaaugugaucaaguugagggaauuuuacuagaaauuucuaauuucucaaauuucagacuagagguuacuuuuucaguaaacaauauuuuucuuuguuuaauucaucuuuauuagguugucuguuagucuguauuucccccaaaaguuuuaucuuaaaaaccaaguuuaauuuguguauugauauauaaguaaaaucaugacuaucguauccuauuagcuuauaauaccccaacauguuaagauauuuuuuuguuguuucauaauccucuuuauuuacucauagaacaguuuucauugaaaauaauuugcuuauguauuaaaaauuuauagaauuaacauuuuccugguaaaguguggugguauauauacaucuguaauacuagcucuuaaagacaggaagggaguucauuaguucagugcagccuagguuacauagugaaguuaaggcuaccuugaaauaguaguauauuguuuuaaaaccaaacaaaacuaaaaagaaaacaacaacuaagccagcaacaucaacuuuuaaaaaauaauauuuuucuugacucuaaauaagaacaguaacagugacugaggaaaccaagcacuagauuggugagcuuuuaguuuuuaauuagaguaacauuuuauuacuucugcuguucucuagauuaauuauguuagaguagauauuauuuauuucggggcuggagagauggcucagcgguuaagagcacuaacugcucuuccagagguccugaguucaaaucccagccaccacaugguggcucacaaccaucuguaacaagaccugauucccucuucuggugucugaugacagcuacaguguacuuacauauaaaaaaauaaaauaaaucuuaaaaaaaagaaauuauuuauuucacuauaaaaguagaaaguucaaauuuauuaaaucauuacauauuacuagcacugauuucugcaauacaaaaaugccuucaaaugcuguaagacauugaaaaaugauuacaucugucuugguaguuucuaacuacuacuguuaagagguagaauaauuucauuguuaaauaugaaaguggaacuuuggcaaaguuacacaugaagacuaauccuuuucccuuaaaauuuuuuauagcuguguauguguuuagucaaauggauuugauaagucagaggaaauuagggguuccuacauaggguguauguauguauguguguauaaaaucuagagcuugauuuuugugagauugaauuuguauauugcauuuagauauuaaaagucauucguauauugcauuaagaauggccaaaucuucagacuugauauuugauaucagaaugaauuuuuaggaacuauauuuaguaaggcaaaaauaauuuugaauucuauuauauuagaccaucuauuuacaaaaugcugaaucacuuuuucuuaaagguagguaauauauucaucuuauaguugugcgaaguuagucuguuuaggguuauacaguuacaacuugaaccuuguucucauuuuagaauacacuuagguuaaucuuugguaacuuccaguuucuuaguaugcuuucuucaguuuuaaaaugugcucuauauauuaaggugguugaauagugaacuuuagcagucauucuugccaguguuguuuucagauggucauuacucuggcuacuuaguaucaucuaauucauuaucauggaggcuucauucuuuaaaaugucccucccuccuucccuuccuucccuccuuccuucuuucucaccccaccccccuuuuaccccauacaauucaggcucugagcuuguaauccaacuuauuuuuggagacaguguuucucacugaaccuauagcuugcugauuugccuucccccaauugccuuuacucaucauuuuuccuaggugcccuuccuuucccaaauagucucuuuuugcuuucauuucacaauauauuccaguaccaccuaauguucccgucauccccuuuaggacuuaauuuuguauacucugauuaauauugagauuguauuguuuauucugaguagcuucuuuagucaugucugcauauacagacucagugcuuuaaauaauuuaaauggcauacuuuagcuuacauauugcauucuuuuguagugaggacgaggaugaugaccuucaauaugcugaucaugauuaugaaguaccucaacaaaaaggacugaaaaaacucuggaacagaguaaaauggacaagagaugagguaguugccugggaagcuugacuagucucauaguuaucaguauuauagucacgaaaggaauuaugaaaacaaugugagaaaauuaucagcuuaguugugcauucuuuuuaaaaaaucaaugauaugaacaauuguuugauuuugggauugacugaaacaguguaauagaggaauuuguacaauagugacuuuaguucuucucaaaacaaguaccaaguaugacucaagaguaugagaauagggcuggugagauggcucaguggguaagagcacccgacugcucuuccgaagguccagaguucaaaucccagcaaccacaugguggcucacaaccauccauaacgagaucugacucccucuucuggaguaucugaagacagcuacaguguacuuacauauaaucaauaaauaaaucuuuaaaaaaaaaaagaguaugagaauaucaucuacauaccagggguggaggaaauauuucuaauuuuuauuccucucaauaggaugacaaguuaaagaaguugguugaacaacacggaacugaugauuggacucuaauugcuagucaucuucaaguacgugaaaugucaaguuguauuucuguuacaacauuucuuuauuuaaaccauuaguuuauauauucuauuuuucagaaaugugucuguauaguuugguuuucauccuuaaaacaucugguuaaauuauuuucugguauguuuguaguuguuuguuaaugguuuagaaaguaauuuuccaauucaggcugaguaccugaaauccaaaaauuggaaauuucuaaagugcuucaaaaucuacaacuuuuugaguacugauuuagagccacaguuuuacacuugacuuaauguaauacaucacaguaaaaaugccagguaugccugaaauguuacuauuauuagauuauguguauaagguagauaugaaacauagaugaguuucaucuauagacuucuguuccauccccaggacauauuauuuuaugcauauguacauauuuccagaucuccaaacugaaaucugaaacaauuuuagucucaaaaauuuuggauaauggcugcuuaacuuguaaagcauuuuuccaggggccuaaaagaacuuuuacuauaaaacaaaauggcauuaacuuuugguagaacuucaaaaauauuugugacaagugguuuuauuuuauuuugauuuuuguauguugguaauugaaccuagggccuuguaaacucagccaagcacuuuacuauugaucuauguccucaacugugauauaugugaaauuauuuugaagaacuuuacuauuaaaacauuuugacagcuaacaaauaaaaucaagaaaaaauuguuagguuucuuaucuaaugcauauguuuuuggguauuuuuauugauuuuuuuuuuugagaugaagucuuacauaguacuuacuuacuuacuggguagccuggaagucauuauguaaaucaggcuggccucaaacucauagauaucugcuuaccucuuucuccugagugauaggguuaaaguuguaaaguaucauaccuagcuauuuacauuuuuauuauuuuacaguauacuuguucaucauaccaauauucgcauauuauuggcauauaauuuuauaugcaauaugaaguacuucugcauguacucauuuguuucuuaagagcauugugaguuguuagauaaauuaccuaaauuuuaaauuucaguguugauucuuuuugguuucagaaacaagguuaccuuuggguuuuuguuuguuuauuuguuuucauauaaucauagaaucucucaguguaacaugaaaacugagaaugaaauaaugggagaaaacaaauuauagaguuagugcaaauuauauucaaaugucagcucuguuaauuuagagaaaauacuucuuuggccuuccgcuacuugcuucuauaguauugugagaauuacaaauauaaacaagguuggcacaguuccugacauuuagcauuuagucaguaaaagcaaacucaagggcuggagagauggcucagcaguuaagagcacugacugcucuucuaaagauccugaguucaaaucccagcauccacaugguggcucacaaccauccauaaugagaucugaugcccucuucuggggugucugaagacagcuacaguguacuuacauauaauaaauaaauaaaucuuuaaaaaaagcaaacaauuagaaguuauguauacuagauuuaaacuagagguuaaaauuuauuuuauuuauauaaguacacuguagcugucuucagauacaccagaagagggcuuuagaucccauuacagaugguugugagccaccaugugguugaugggaauugaacucaggaccucuggaagaacagucagugcucuuaaccacugagccaucucuccaacccccuccccucacccccaguuaauuuuuuuuuuuuuuuuugguuuuucgagacaggguuucucuguguaucccuggcuguccuggaauucacucuguagaccaggcuggccucgaacucagaaauucuccugccucugccucccaagugcuaggauuaaaggcaugcgccacuacgccuggcccccaguucauuuuuuaaagugucaauuuuuaaucuacuuaauugaaguauaauguauaucuucuaugaaaguguuucauguuuuauugguaauuugaaagguauaauuuauaaauauacuuucacuaccacauagagacuagugaugccuuuaagaugcuuguacuaaauugagcugcuaugcuuaaaaucuuauaucugcuucauauaguuuaauccugucauuuauuucucaauucuggauuaauuuuuuauggacuaugucuugcugcuugcuguauuauaaggauaguauagagguacaugucuuaauuucaaauauguuguuuuuaauuuguagccuaaaccuaugauuaauugaaagagcagaauugggauuuuaggcauguaaaauaagcauugcauauaauaguuugauauugaauauuuuuuugacuaauauuuguucauauggguauacuuaaauuugggcuaauuuacuuccuggagauauauagucaacaauaaaauuguccaaauuuuuucagaaucguucugauuuucagugccaacaucgauggcagaagguuuuaaauccagaauugauaaaggguccuuggacuaaggaagaagaucagaggguaauauauucauauucuuuugaaaaaauuuauuauuuauuuguguauauauguuuggggacauguauguguguuuauccuuaugccacagcucacauguagaggucaaaggauaauuugugggaacuaguucucuccuuccacccacugugugggucuuagagaucaaacuuggucaucagguuuaaugccaagugccauggagccauuccuugcuccuuguucauauucuuuauguucacuguacugauggauuagauuaauuuucuuauuaacaugguuuaacacaaaguaugauauguguguguguguguguguguaugcuaagguuggagguggacauacauguauugcaaacauaugugaggaggcuggaggacuggugguguuucuuaagacaguaucauucgggauuuauuuuuaugacaugggggcucucauuggucuuaagguugccaaguaggaguagguuggugggccugugagcauuauggaucugccccauugcugggauugcauguauaugccauuaugccuggcuuuuaaaaauguuguuucuggguauggaauucagguuuucaugcuugcaaggaaagcacuucaguaacugaaccauuuuccccagugcacacuuuaaguuuguugguucuguucuuuggaggcuauaagcauaagaauugaauguugaaugccuugaaauguagcuuuuucucuccuagggcaaggauaagugagacaauuuauaauaaguacuguccuuuuugagagcuucauuuacaaaaggaaaaauacuuuaaaguuuggcuuagcaacaugucaggcauaguuuccuaucaaaauuuaauuaacauuaaaaauaaauuuuaauuuuauuuucauauuuaauaacuugauauauuaggaaaucacucuuaauuuuuccucuugaccguaaugaaucucaugauuagacaaguaucaggacaucauguuuccagagggguuguaauaaaaaccaauuauuugugcaauaaaaguuguugaagaauagaagcaucugcucucuacuaggaauugcucuuuaauucuuacccuuagcuuuccuguugcuaaggugccuguggaauuaggacauccuuauacccauaagagcaaacaaacaaaaguuacuucauguggcucaggacugaucugacuuuucuuaaugggcgaugauaaguuuugaaaaugugaucuggggcuagugaagaggacaguugucuucugucuucuacauagucacugugguuuguauuugucuaacacucauacuuacaaaucauaaacaugcaaauaauaauaauaaaaaugauuaaguaaaauacaaugugagcucuguuaaaaagauauuuaauggcuggaucuaguacauugucuauaauucuagcuacucaguaggucuagauaggacauucauggcaaguuuaaggccuaccuggguaacuuagugagacccuguuuaaaaaucgaaaugaagaaaagggcugggaauauaauucaugguagaacacuuguuaaacauaccuaguacugggcaaaaaagaaaaaccaaaaagcuguaaucaaauaaucaaagcuguacauuuaaccuuuaagucuuauuuuuuaaaaauaugacaaguagacacauuucaagaaaauugugauagauguuaaacuuaauuaaucuaccaauacagagugagcauaauucuuugugauucaugugauacuugacugggucagaguagcagcgaaguaggugggccaaggagaugaacuguucuuuaaauuuuaguuaaacuaaaagcaaacaaaauauaggacaaauguacaaauguuacuucaguuacuucaaauuacuucagaauaauuaucuaugaguaauuagccccuugaacuuuuugaugcauuuuggguauugauuuuugaacucguugagugcugaaggauagcuauuauuaacauuaccuucugugaauuauaguuauagcugaaauuuaauccauguuuucuuuuuuuggucuuuugagacaggguuucucuguguagccuuggcuguccuggaacucacucuguagaccaggcuggccaccacgccuuaaguagaauucuuaauuuggaguuuuuuuucucuuuuuguuguuguuguugaggugcuucagaucaaaccuaggaccuuguauugggaauaaaagaaaaaccaaaauguuccguaaugaccccaaccuugacuuguuugaguuacauuuuaaaauucuuucauaguaauaguuuuucaaucuuugauuuugcuucuuagguuauugaauuaguucagaaauaugggccaaaaagguggucuuuaauugcaaaacauuuaaaaggaagaauaggcaagcagugcagagaaagauggcacaaucaccugaacccugaagugaagaagucuuccuggacagaagaagaagacaggaucauauaugaagcacacaagcgccugggaaaccguugggccgagauugcuaaguuacuuccuggaaggugcuuacauaaauaaguuucugugcuucaacaugaccuugacuaccuuacuauugaauauauuuucaaguauuuccuuucuauuauucacaauucaaguuuagucugcaugcuaugagcaaccauuuggguacauuuguaauuuugugguaaagaauauaauuuguacaauaaaaugguaaaaccuuuaagcuuugcaaacauuucaucuacuccacaagucauguuuauguguuauugcugguaaggcagaacuuguacagcugguggagugauaucuaaauuagagaucucuuucacauacugugcacaaggccaggggacuacaaguacuuugauugaaguaaauucuugugaaugcauguuacggaaacuuagcucuuaagcugugggaguagaauaugaaagcccauguagcugaaguguaguauucuccucugaagcagugacuaagugcauucuccacuguacuguucagacaccuucugacagccacuaggacugcagaucuuaucuuaggcaauuucauaucuuaacucagaauacauauccucaugcuucauagcuauagucucuauguaguacuuauaguaacuaauaugcuuuuauaugcauuccuuaaucuuuguauacuuuagaaauauguaaaggaaacauuaaugcuuuguuucauaggaaauuaagaugcaguauuauauuuucuuuuguccaaguuacuaucccugggcugugaacuucugauauauucaguauuuuaugcaccuuuuuacucuguguagaaccucacuuagugcuuuaacagaguggguuucuaguaaguguauauuuuaugcagaaugaaauuuauacuacaaauagcuuuagguucaucuuuauaaaaagaaccuugggcaaaaagggagcugaugaacucauuguuuaaaaauauaauauucugagaaauaguuaagaauauuugaaaucuguaacuuguacuuuucuuuuucuuccugucucuucuuaauggaauugaggauugaccccagggccucauucauuauagacaacuaaacaagcaugauuuuuuuuuuuuguuuuuuguuuuuuguuuuuuguuuuuguuuuuuggcaguuuggguuuuuuuucccauuuccuguugcaaggccuuuguacuugguaugccuuuuauccagaggcucuuucuuuuauuuuuuguuuuugagacaggcucuuacuauguuguccaggcuagccuugaauucccucaucuguuaccuucaggcagaugauccuacgccugccuuuuuuccuguucuuguacuggcagcucaucuccucuuugaggucucguggcuagagaucuuucugguccaccuauccagacuuaaccccacugcaaugauaaucuuguuuuuuauuucuuuguuuuugucuuucuucuguguuacuaugcuuucagugagaauuuaaccucggugacacaagggacuaaauacucaauuuuaccaguuguaaaaauaugucuuauaagccgggcugugguggcccacgccuuuaaucccagcacuugggaggcagaggcaggcggauuucugaguucgaggccagccuggucuacaaagugaguuccaggacagcuagggcuagacagagaaacccugucucgaaaaaccaaaaaaaaaaaaaaaagucuuauauauuuguucaaguuugugcuaaaauuuguagaauuccuuuccccuuuuaaaauuauauacuuucauuucuuaggacugauaauucuaucaaaaaucauuggaauucuaccaugcgaagaaaaguggaacaggagggcuauuuacaagauggaauaaaaucagagcggucuucaucaaaacuucaacacaaaccuugugcgacuauggaccauuugcaaacccagaaucaguuuuacauuccuguucaggcacauauuuuuaauaucuuuauuauuuaaaaacaaguucuuuaguugcuauaugggaacuauuggauuggguugggcuuuuuuuuuuuuuuuuuuuaggacaaguaaauuuuguuuuggggagugacauggauagacuuaaauuucuaaucugaaaaaguaagccauaauuuugacaaauauuuuaguacaaauuucacuugaaaguuuccuucuauaugugauuuccacauugagaaauauagugcgugcauauaauaguacucuuuaauucauuucauuuauggacauaaagaugugcuuuaacaucuaugucauuucuccuccaacauuguucuguguaauguaguauugccuaucucacagguguguacagagcagucuaaaggagaaguaguaaaacgaucauggaaacaguccuuugggaaacaguaaauagcugaucuuugaucuuguuacacugcucuuugccugagugauuuagccuucauuuagacagacucauuagagguuacccaaauucaaauucagggagcucucugucuuguccccuacaacacacauuuacccaccuguaagaaauauguuuagugaucuucauaagacuugcuuuccccugucuguauauguauuuauaguagacaguucuuaguucuuuuuacauaaaauguaaaaggcuguuaggaccaaguaguaucucacaaaagauagacuugggcacaguguuaaagucugcuuccuaagccucagguuucauuucauucuacuuuuuaugaacauuacuaaguucuuuuagacuuacuuuuaaaagaaacaaaguagucacaucuuaauuuauaaauaggaaaacaugggacuacagcaguguaguuaacugcugucauuugaccuuaaggauuuuaauguuuuguuuuuaaaacauuuucuuuaaaguuuuagauuucaauaguguaaacagcaagguuuugcuucugucuuagaaaaauuaccauuuaaaguuuuuuugacuuacagaaagauaauuuuaaaaauuacuuguugccaagggaguguuugacaaucucaaccacaguguguugaagaggauaaggguaguguuuaaaauauuaagaauuguuucccauuuaacaauuuugaaaacuuuauauaauuuaaauuuuaaacuauuaagaagauaauucuagccuggcaacuuuggcgcaugccuuuaaucccagcacuugggaggcagaggcaggcggauuucugaguucgaggccagccuggucuacagagagaguucuaggacagccagggcuacacagagaaacccugucucuaaaaacaaaaacaaaaacaaaaauggauaauuuaguuuuucuuaagaagugugaagaaaaaauauguugguuugaaauacuguggcaaauuuucauugaaaacuuugagaaaaauaaguuccuaaucuauuggagcuuccaaguugagcaauaacugauccuaauugaguauugucacagcuaaccucuagguuagagcucagauagaaugauuuuugcauuagaugaugauuuaggccaauauagaaaguagacagauuauacuuauuuguauuugauugccagauuuuuuuuuacaaacaucucauacauuuuauuagugccccuaaauuaaaauaaacuuuacaauuuuuauuaccaauguuuuaggaaugaggcagugauacuuagugugcugucagagugucuguuaggacuacaugccugacucugauugguuucuacuugaguaacagaaaaagcccucuuuucuuuuuuucuuagagauugauaguagguggugauaagaguaugaacacaauuuauuaucuucuguaggcauuaggggagcccucaaaagcugacuuuuuaaaacauaugguagaugauguugguaacagacaauuggcugauagaaccaggacuggaagccaaguguggugauauauaccuguaauuucagcacuggggaggugagggcaggaggaccaggacuuugagaccagucucagcuauauaguuagcuccagcuugcuugggcuucaagacaaaacccugucucauaaaaucaaaagacaaaaauacaaaucuaaauguagguuauuuccuacacuuaggguuuuaucaguagauucuaaggacagaugauacaauuauuaaauaaaaaacuauuguaguuaugaguuuucaaaguugcuagacaauauucagucuccagguuuuuguuuuguuguugguuuuuuguuuuguuuuguuuuucugauacaggagcucaacaucuagccuugagauuuuacagaguucugucugccucuaccucuuaagcauuaaaggcaugugccauccuucccaguguuccacuuuuaauggacauuuuaucacaaccuuucuugacaucagauucuuaaaaaaacguauaaccucuagcaauacuuuacuucuuguuucagaucccuggguaucaguaugugucgccugauggcaauuguguugaacauguucagacaucugccuuuauucagguaaggcuaauuuguaacagaaccacaaaggaagauaguaaccauguguugcuuaccuauaaucccaguuuuugagcugaggcaggaggauugccacaguucaaaacaagcagagcuacauagcaaguaucaggccagucagggguacagaauaagaagcaaaaacaauaaaagucuaacaaaugaaaaacaggaauccuggugauauguacagaccugugaucccagcacuugggaagaugaggcaggaagaugcugugcccucccuccacuaaaaacaaaacaaaacaaagcauuugacauaguuuuagauguugaauaguacucauuuccuuaucuauuaaacuaggauaaagaacauugcugaguuuuuuuuuuguguuuugucuuuuuaauuuuuguuuuuacuguaaguauuauuuaucuaaaggaaaauguauaaauggauuugaaaaauaaaagccauaaaaguaugaggugacuagcagcacuaguguggcaauuuguucacuuuuauagcuuaaaucauucaaacaguuccugaauuguauaaaacacuuuauaauacauuuaucuaaaauauugcagagguacauuuuugaaacauaguuaaugcaauauguuuuuaggauccccccugcuauucauuuguaaaaguauuauguagcccuggcuggccuuguaguugauauguagcccagauacucuuauaguccucugugguccuccuguuugcaccuuccuacuguagggauuacagcuguaugccaucaugcugcaugguuuuaggugaugcuggagacucgccugggcuucugcauacuagacaaauuacuaccugaauuauaucauuaccacuguuuuuugucuuuuuuuuuuuuuuuuuuugcuuuguugagauagggugcuaccauguagcccaaggauagcuuuaaacuugaaacccuccuuucuuucuguuuccagagugaaggaaugacaagugcacuaccauaccugaaauaaugcccccccccauuuaaauuuucccaguuuucuuuuacaaauuugaaaauauuuacaaguacccuuuuagauuccagaggaaaugugguauagauuaguaacauuuggauuuaguauuauuaagcuuuuuauaggcugaugaaaacacaaucuuaaagcaguugugauggugcuuguuuuucuuuuauuuaacuuauuuuagcaacccuuuguugaugaagauccugauaaagaaaaaaaaauaaaggagcucgaguugcuucuuaugucagccgagaaugaaguuagaaggaagaggcuuccaccuguaaggaacgaacuuacguguuugcauuugaugguuggaguccucacauggacgcgcucauucuuuucacuagcuguggaggacauuuucccauuuaauuugcaguuuugauguuuccagaguguugacaugguucuguauuaggauacuuuuuuuuuccuuaaaaaauguuucuuaaaucauaaaugacuuagaguaaaaucuuucauuuguauuuuuuuguguguguuauauuaggcuuuuaaaacuugguauuacauguaaggguggauuaaauugaaaagcuuguaaaauacauauagguauagagagauaaacucuaaauuauuuuuauuuucuuugaaaaauugucuuucaguuuauuuaggcuaugaaucaauaacuaauagcagaagggagcauuuggauuuacauucucuaaagaacuuuuucaaaagaagaaggcugauauggaugccuuugauuuagccagaauaacuaggaguauuaaauuaagauaagcgauauaacugcuaguagaauuaaacacguuaugcuagauggauuagagaaaaaaaagauguacauuuauacuuggauaagaauuucagaaguuuaaacugauaccugcagucuuuaucuuuagagauggguuuucuuagacugagccuacagcucaguggcagagaauuuaucuaauagauauuugaucuuggguucagucuuagcacucagaaaacuugcuuuuccucuucuugacuugcgacuuaaugagagggcaaaaauguugagaguuaugggaacuuaagguagcauuacucugagagaauaaagcgacauguucaguuauuaucacaaaacaacugguauuaucuuagaggaucuaagaggguauuuaaaugucauguuauaauaauuauuauaggugagauuuuacuauaggaaaggcaauuuuuguuuugaaacuauaaccuaucaguaaauaauaagaucgcaaaugugcauauuucaaugauaauuuuagcucuguuaaagaaaugacaaguaguccuuauuuguagaugacuaugucauauuuaagccauuuuggaaauuuuugggcugggauguagcucaguguuaggagccuuuuccuauguuugaggccuuucgcuuuguccccaaaugcuucaaaccaaaaccaaaacaaaacaaagucacguuuuaaaaauauuaaaaauguuaauuucuucauuuuauuuuauguguaugaguauuaucugcauguauaucuguguacugcauauaugaagugccagaggaggacagaagaaggucuuagguccccugaacugccauguaggugcugggaaucaaacccagguccuuuggaagugcagccaggguucucaacugcugagucaacuuuccaguccaguuugguuuuuaaaaaaguaauaguguuggggacauguuaggggggguaugagggauacagaaggggaauagcggguggaaaugaucaagguacauugugcacauguaugaaguuaucaaagaauaaauacuuuaaaacuaauaacaguaccuuagcucaggaugcaguauaucugucucauuuaauaacaaaacauacuagcucaaguaguuuacauuuuauauuaaaagagagaaauuugcugacuucuuuuuaaaacuugaugucaaaguauggcuaaaugggcuauuuuaaauccuagagggauguuacuuuagccuguaguauagacuucauacaaauuuauuuauuuuuuaaacagauguaugauaauaacuauuauuauuuuacugaauucuauuaugcuguacuuagcuauuucauguauauacuuggugauucucauauuaauuaauuaaaguagauggaauucauuagagauuaagguuaggucuguauaguugcaaugcugugguuuuucuguuugguccaguggcuuccauuuuuguuuguuugcuuguuuguuuauuuaaugcguauggguauuuugccugcaugugugucugcaucgugugugcagugcucguggagguuagaagagagaguaagauccuuggagacuggagguguggaugguucugagcucacaugugggugcugggaacugaacguugaauccuuggaacagcagcagaugcucuuguccacagagccaucugucaguccugaugcauuuuuaaacaguagaaaccauuuauugagugauuucuuuaaaaugggcaguauauucuuaagaauauuauugcuauaugcuauauuuaauguaaaauauaauuuaaaauuccucaugugcaccagccucauucugcacauaugacugcugguucccauacucauuugcuaaagauaaagaauacuuucauauuucagaaaguucuauugaauagugccauacgugcuacaaguuaucuuuccuucaugagucuucaagaucucauuauuauaagagcaggaaacgaggcuuccaagauaaguaaaaugccuuggucauauuucuaaaaagagaaagaaaacuaguauagccccugauaucagaguacuuaaucugcaaugagaucagagaugaggaauagaauaugguaggaugaaauaagucacuuaguuuuauaagaauugaggagaaauauguacuuuagauucacaguugggauauguucuuggaagaaguccuauuugaaccuaguuaaaacucaggaugacuaucuauuagcaagauagaugaauuaaggcaguauuguaaauagaagagaugaaaguauauugucagucacauggcauacuucuuaauaguuaaacugucucuuaaaucaagacuagcacuuuuuguggauaguggguuagggaauauucuagauaaaauaacaguuuguaaagagacucuccagagugaaagagaucauucauuggggaguuaaaaaugcuauagcuuuggggaguuaaaaaugcuauagcuuuguagucacauagaaggagaguuguaaguggacuuguggaaugaaguuuguaaagaaaaugaggccagguuuuaggucuuuguuauguuaagugguaauuuuauugagacagugacuuuauacuuaaaauuuauuuaggaaaucuagcuaaguuaugagauuuaguggaaacaaauuauauacuaauauugaagaaagacuguauuuggguacuauauauuuuuagcuaaaauaaugugaaguauguuauugaaauuuuucauuuagaaucuaaauuuaugccuacauugagaauagcaaauaauacucaaauuucuuuuguacuuuuagcaaccuggaagcuuuucuagcuggucugguaguuuccucauggaugauaguaugucuaacacacugaauaaucuggaggaacacacuacugaguuuuauagcauggaugaaaaucagacuguuucugcucagcagaauucacccacaaaguuccuagcuguagaagcaaaugccgugcugucuucucuacagaccaucccagaauucgcagaaacucuggaacuaauugaaucgguaaguuugaaguugugaaauuaauuaugugaucuaauguagaagcuuaguuuaaauauuuaauaaacauguaccaacuuaauguuaagcauugccuaauuuugaucucuuuuguaaagguuucuggcaaaaauauuaaagguuuaaguucuuaaguguguaucuuaaaaagauguuuuuauaauuaaaaacaauucauuguuuauuagauuacacaaauuacacaaauauauuaaaguguucgaaauuagggaaacuauaaagaggaaaauuaaaauccccuguacauuuagucuugaucauuugauguauauaaacacaaauauauaacucauguuauauuuuuaucuuuuacuuauauuaugagccugucuuugguuucucagcauacauauaauuuuuaaaaauuaauuaauuauuuuauuuauuucuuccugaauguugucccugaucuucccucucagaguucuuuuccccauucuaccuccccuuugccacuaagauauucauucuuuuuuuuuuuaagggauuuuuuuauuagauaauuucuucacuuacauuucaaaugcuauccccaaaucccccuauacccuccccccgcccugcugcccaacccauccacucccucuuccuggcccuggcauuccccuguacuggggcauaugaucuucccaauaccaagggccucuccucccauugaugacugacuaggccauccucugcuacguauguaacuagagacacagcucuggggguacugguuaguucauauuguuggcccuccuauaggguugcaggccccuuuagcuccuuggguacuuucucuagcuccuccauuggcagcccuguguuccauccaauagcugacugugagcauccacuucuguguuuuccaggcauuggcauagccucacaagagagagcuauguuagcguccugucaggaaaaucuuucuggcauaugcaauagugucuggguuuggugguuguauaugggauggguccccgggugggacagucucuggaugucuuuccuuccaucucagcuccaaacuuugucucuguaacucuauccauggguauuuuacauauaauuuuugagcaagaucuaacuguauauuccugucuggccugaaacucauuaugagaccaggcugucuuugaacuuacagaaaucugucugcuucuguuuccugagugcugggauuaaaguguguguccaugucuggaucuuaaauauauuucuuaaacaugaauuuuagaugcuuuauaguacuccuuuauaugaccgaaaggcaguugauuuacucaaugcaucauuguaauugugcauuuugaggguaucuagauuuucaguaucaccaacaaguaauacuaauagaggauguguuguugagucaugacaauuaugugcuuggcugaauggaauuucuaaaucaaaguauauguuccauauacauauuaccaaaugguuauagaguuucaugguguuuucuuguuaaauagaaugguuguaugauaaauuauuuuuuuuaauaauagccuaaaauaaucuguucuuuuuauguaaaauauucugauagaaaauuucagcuacugcauuagaugaaacauuaucuugguauuauaaaaaauuguaguauuuucuaaggugguuaugcuuaauuaaagaaagauguuuagacaaagcuugcuuuuacugguuaaaaaugaguagcuuuuuucuuugguuucucuguauagccuggcuguccuggaacucacucuguagaccaggcuggccucaaacucagaaaucugccugccucugcucccaagugcugggauuaaaagcaugggccaccacugccuggcuguaaauaacuuguuaaaaauuauuaucauguguuacuaaacuguuaagagcuuaacuuuauuaagaguucauuuuuuuguaggauccuguagcauggagugauguuaccaguuuugaucuuucugaugcugcugcuucuccugucaagucuacuccaguuaaauuaaugagaauucaacauaaugaaggagccauggaaugccaguuuaacgucagucuuguacuugaagggaaaaagaacagucguaaugguggagacagugaagcuauuccuuuaacauccccaaauguggucaaguuuagcacuccuccaaccauccucagaaagaagaaaagaauucgagugggucagucugcaggcagugagcuuggcgauggcucacuuagcgaaguugguaaugcagcacucaaacacacaccagugaaaacacuaccauuuucuccuucucagguacaaguguuuuacauuugccgauggugacuaaguuagaccuuuaguaucuuuaaaagcaauugacuguuuuuuuuuaaauccacaaaaauagauauguuuaauuguaugcaugagaaugguaaacccagaaagucagaaaggguaauauucgcaucacagcaccauagacuuucaagaguuaaaagggaaguuuccuuugucauguaguccuauuucucgauaagacugaggaaaacuggccccuaaaaaguaaaaugauuuauuugcccaaaggucucuaaugcagagcugagacuaagaucuaguaugacucuuugauucuugauuguucagcauauauuccugacaugguauaaagagaccuuaucagcaauuuagauuuucauuuauauguuaauuuuccucuuugacagucuuuggaagaaaugaagauagcaguuuacucuaagaaucucauguuuugauguccaagaccaucugcuuuaguccuuagugauguuccaaggagcagauguauacauuaggauuauuuuuuuauugggcacuuguuauauuccaggcugugugucucuucuuacagcaucuccuguuaaucuucuuucaaaugacauuggaagccaaagggaguaaguuuuaaaaugaagcaacuuguguuuugauauuuuaauuucuucccuguugcugagauaaaauauccugacaagcaauguaaggaggaaaggauagaauuauuuuagcccccaguuccaggugacaauguuguggaagucacagugguagaauuugagacagcugcgcaugucaauauccacuaugagugcgugcaugaauacaugcugcuguugcugcucagcuucguuucugaggcccuccagaaucugcuacuaggggaaugguucuuccacuuuuaggcugaguuuugccaccucauuuaacccaauuaagggccucacaagcuagcacaagcccauuucccagaugauucuagguuuugucaaguugacagcauuaaucaucacauaaauguuaaaagagaaguagggagcuuaaugaucaaauauggagaauucuggaauuuauugaagguuuguuuuaagguugggaaggugguagguaugguaguacauaauagcuacuguggucugaaaauguuugagauaauccaauuugcauggucuacaacguccuuuagcucucaaguucagaauuaucccagggaaaguuuccacuuccagagcuuuauauguuaguaguuuuuacugaagucgauucuaucuagaaagcaaguagaugauacuuauaucccaugacauuuggauuucauccugugaaagacuuugauauuuaauucuaggugaggugauucaaauauuaggagacaggagugauagagcuugaguagauugcacuuguaaguggcacucuugaagcaauuucuacuuccucauaucacuacugcuagucugcuagcuacaaaaguaaauuaggauuucauaguaguaugaaauguuaagucucauuguauaguuuagaaagugaucucauguauugucugcuuaaaguaucuggucugucuucuagacaggcaaguuugccuggcauuuaacuuucaauaaauaagcuaauuggugucuuuacagguaugcacauacacccagucuguuauucuauucugaguucaagauacucggagagaaaaaugcacuuggccuuauucacaguuguuuuuuucaauuauacucuuaucucagaccaggagauaguuguuguaacaacucucgauggcuucuguagaucaguacuugaugugcacugcuuuauauuuuugugcuauuagaaagcaugaccgaguuucuguaauguuuaguaugugcuuaucugcucaaagugcugggaggcagcagucaacagaacacaaaugucuugccuuuaugaagcuuaauuuccaagaaguagcauguaaauguaauauuacugauaaucuuuuccuaaaacaauagagaagucuuagcaguuugauauuuauacaggaacuuugauguucuaaaaauugucugaauucacuuccucauuuaguuuuuuaacacauguccuggaaaugaacaacuuaauauagaaaacccuuccuuuacaucaaccccaauuugugggcagaaaguucucauuacaacuccucuucagaaggaagcaacccccaaagaucaaaaagaaaauguaggguaagucuguauuaaauaauuauguuaggaaaaacuggaagcauguuagaaguaugucagcauuuuauucaaaugaaugguguauccauaaucuuuaguucuauaggauuuagaaguuuguaauuguuguuuuuaaagucacauccucuuguuucuguagaauacuggaaacuggcuaaauuuagcauaaaaauuuuauugcaagcaaaauauucuuaguacuuuuuucuaagucauuuuuucuuuaaaauuauacgaguauaaccgacucuagacaaccauacuuuagauagcucugugugaugcauuaaaaaucauaugucuggucuacagagugaguuccaggacagccagggcuacacagagaaacccugucuuggaaaaaaaaaacccaaaaaacaaacaaacaaacaacaacaacaaaucaugucuauauaaaaauauagcuuaugcuuuuuauggcuuugcuuuuguuaacauuuaugaccucacaugugacaauaauauaaauaucugaaugacugacuagauucagaacuccuacuauuagaagaucuauacugggcaccacaccaagaacuccuacuccuuuuaagaaugcacuugcugcucaggaaaaaaaauauggaccucuuaaaauugugguauguauacucuuuauucucaagcacuuuucuaguuuuaauuuaaaaaacuggguuuuaucauuuugaaauuuuuaguauuaaaaaaguguacauugaaauggaaacauuuuguuucuuaauuuauaaauaugaguuuguuuaaucuuccuuggucuuuagauaacccuuuacuuggcuuauuuuaaauuuuuauguucucguguuaacuagaagaaaacaguuguuaguggcaugcuuaauguuaaaacacguauguaguaguuuaguaguuucacuguaguagaauuaauauuuugacauaucuaaucucuuaaauaauguugcauaggaaacuaaugggucagggaaucuucuugaaguucaguuuuuucuucuauguacaagggagguggggaaggaauuucuggccguugccuuuuaaaaucuuuaaaaauaauuuagucccagccacuugccuuuuuggaagaagacauucgagaaguuuuaaaagaagaaacuggaacagauauauuccucaaagaggaagaugaaccugcuuauaaaagcugcaaacaggagguaaccuugaguauuguguaugcauuucuuuucagaguuaguuagaggcgggucuuuauguaauuuuggcugcccucaaacuuccaaacgcccgccaucacuuucugagaacggugauugcagaugugcuucccaucccagcucuuccaguauuguuguagucaguguuuaccauguuggagagacuuggcuauaaugugacccuguaaauuacuuuucuuagcacucugcaucugugaagaaggucagaaaaucccuugccuuagagagcugggacaaagaagaaccagggacucaacugcuaacugaagacauuucagacaugcagguuuguaaagaauucauauauguuuuuaaauggcugucuuaagucauaauuguucucauuucauauggauugcuuggccagauaauuuaaaagagaguuacagaaaauuuaggguuauuuugccuaguucagagagaaucuauuaucugugaagaauauaugauuuuuuuaaacuuguuuuauuuugagaaguuagauuuuuguaugauaucaaaaaguggagguucauaaagcuuuaaguuuuaguauuuuaugaaauuaccaaauauuacuauagcacuagaaauguauuuauguaauuaccaagcuauuacuauagaacuuagugagauguuauuauagagccagaugcuuccuaguagggcagugagcagggcuucuauuaccauucacucaguaguuucuugucucuguuuuugaauuaguuauuuuccucuuucuuuuuucucuuagucagaaaauauucuuacaacaucuuuauuaaugauaccauuauuggaaauacaugacaauaggugcaacuugacuccugaaaaacaagauauaaauucagccaacaaaacauauacacuuaauaaaaagagaccaaacccuaacccuuguaaagcugucaaauuggaaaagagucuucagguauggauucauaaauuucuugagugauuuuuguuauuguuuagucaaugaucacuuaaacuuacugaucacaaguuauccuuuuucuuuuaaaguugaaauugacaaguacaacaaagaaugacuauuuugucacugaaagcaggcuuggguuugagagagacucauucaucagugcacaugucgucuauacaacuggaacuguagucggagauuuuuuggcuauuuuguuuguuuuggguuuuuuuuuuuuuugcucauuuuuguuguuguuuugagacaggaucucaccucauuauguagcugagcuugaacucauauaugcagcuucagcuuccuaaauccuggggcacagacuuuugacaccaugccuggcccuucggugauucccuaauuuauuuuguguguguagauauuuaaauccacuucugauaaguaauuggaaacauuucagcaugauuuuguuuguauaauggcucccaauaaacuucguggauuaaaacuauaaaacaaaacaaaacaaaacaaaaucccccuauuccuguguguucaguaaauagaugaaaaugaaggcuagagaaauucuuauccuguuauuuuaggaguuuucccagagaggaaaauuagagaagaagauuucuucuuuaugccacacuauaugcagaguaaauucugacauuuaagcauuucuugaaaacaucuuuggcaaucagauauaguagcuacuugucugucuuaagcuauggcuuucagagagugacauaauacaugcccuuaguuguuuaaaauguuuuuaauucccgguguuuaguuaacuuagagcuccuuggaaaaguucacuauauaguagcucuuauauauuaauauaggaacuuuuauucuuuaauaaggaagaaaacaaagaaggugcacuccuuguucacauuuaacauuagaucuucccuuuaaguuagucugucucugucugucucugucucugucucugucucugucucugucucugucucugucucuuuuuuucuggcacuggaguccaaaccugggcucgcacaugcuagacaaauacucuaccaaugagcuacaucuccaacuccuuuuuuuguuuacaaaacuagagggcaaaaagggauuauuuuuuucccuauuauccauuugcuuuguggggaguuguugggaacaaaacuauuauacugucauuauaggccagugaacaguguacauaauuguaauaauuacacaaaauuaucauaaauauuuuaguauguauuuaaaauaaagcaucucauuuaaaaagauucaauguuaucaaaacauuuuuaaugcaauuacuuacaaaauuccuagacaaaacaauugauuuuuggaagucuaguuguauggauuggcaauguggcuuaguggguagagcugccaaaccugauggccuggguucaguucugcagcccacauggcagaaugagaggacuaacuuuugaaaguugucuugauuuccgcguauguuaugugcccccccuuugguauuuaauuuuacuaaucuucauaucucuauucaccuuuccuucauagucaaauugugaaugggaaacagugguauaugggaagacagaagaccaacuuaucaugacugaacaagcgagaagauaucugaguacuuacacagcuaccagcagcacaucaagagcucuaauacucuaacuguuacuaaagcugauaaaaugcccuaccccuuuacuguauuuuaugcuaaauuagguugcaaugaaauuugucucaauuaauucuuuuaaagguuuuaauacaucccuaaaaugguucacguuuuuuucuauauugaacaggcaaaaaacuaauaagcuacuuaaaguaagggguaggcaaauuuauuauuuauauguuuaagaaaugagaguuuuaaaauuuguuuuaaagaacaaaaugggaaaauaagcauguuucuggauauuccauaguaaauucucacauaauuucuuuacaggauauauguugcuacugucucaaggcuguagucuguuauaaacaaguuaaguaugugugaccucugaaagucuacauuuaggaagcacagaggcuuuaugaaguacuuuugcaugugugcugauuuacuaagacuaccauucauaaagaaacacagugggaaggagucucaaggaagcuagaaguugcacuacuaauuuugguauuuuucagaaacaaugaaauuaacuacaguguuaaggauauuuauuugugcauaguacuaaaaaugcauugaaaaugggcuuuuucuuacuaguaaagagucaguauuucuucauaagucucagaagagcugagaauuuuguugaauguauuguacaguauauaggagcaagaaaacuuuguaaauuggaaagaugucuguuuuuauaacuuauuuucauuuuuaaagcuuaaauguagauauuuauauauacagggugucuagaagccaguguuguuucuugccauuacagcuaacauaguaaacaauaacuuugacuuucaaguaugaaauaguuaaguuauagcugcaaagaauacaauaucuaaacuguaugucacaucuaccuaaauauugcacuauauccuuuaaaucauguugguuuuaaaguaguucuaaaauguacuaaauaauaauuuaauauuuucuuuuuaaauuauauuggagggucauauaaauuaaucuggugaauuguauauguguuugaaauuuucauuuuguuuaaa

SEQ ID NO: 12054 - RNA, 487630 nt, Mus musculus
gugauucaauuucguauauucagacuuuaaacacaggaugggaucacagaccugccaacagucagagaaagggaugcaaggagcaugguguauagauaaauacaaagauggaaacagagguaaaaccuucucacuucaagaaucucaaagcuaaucugcuccagaaucuaaaaccucuuguacagugcuaugauaccagugguaaaucccaugccugaccucuugggauggcuuacaaucaauauugcagacauuauuuuccuguguacagggucucuauaaaacauaaaugagauuuauguuuagacuugaauccucucccccaagauaccucauuauguauucacaaauauucuaacgucuuauaaaaacaguucuggucccaaacaauugaagucaauggacugcuaaaauuuucaaguguuugagggcgaaagccagauagaugcaaauucuacaauccacuuuggugcaaaucaccaaaccgugcucaacuguuugccuaguuuugcauccacuccuggagcuggggaaugagagcauucuuauuugccaccuacugacaaagcugacagacggugauguguauguguauguagucaggcucacagggagacaaaggagacacacuuugugacaccucagccaccuugaacaauggaggggucugcagauggccuugcugaucucccucuggcugaucugcucuaguucugucaaguaacucaaggacaaugguuuguucuuaaaguguuguaagauguaccuuguuuacaggacuuuauacuaauauuucagaucuacacauauuuaauaagaagacuaaguuuggggaugaaaaaaacaugagaaaacaaacuucugacaaaaaccguaaaugagaugcugaaaaacuaaaacaaacucaauuaaaaaaaaacaaauaaaccaaaaccaaaaccaaaacaaaccagacaagacccauggucaagacaaaaacacaccaaaugcgaagauuaaaagcaagauacucugguuguugcuacuccaaaccgaguuuugaucaucgcagggauaacuuucccugcauuguaagcagcuuguuaaugaaagcuugaaaaaaaaaugucccccaagucaaaaugucacucaaggccuggagucgcacauggugugugacgagcaagaaucaggccggugacaacagugagugugucugagucugcaaagcaacugccagaucuagggacggcacacucuggacacugucgucguuuggcugaggacgguugcaagaaagcuacuguagaaagaagagacuugaaauggguuggcuggccacagccacagagucacaguggcagaaagagggacuaucuaugccugcaggacucauugccacccggugaagacuuucauuccgaacuggaacagccaccguugcuagugggguugcugagcuuuuaccgaauccuggugccauauguggggacaaggcaagggacgcuugugggaucccacuggcuuauguguuugguagauaaugaggggucggggaggguaguaggggaggggaaaggcguuuggaaacaugcacucuagugaacuucuggcacaaaaaguaacuggcuugucucaucaauugcucauuaauauacaacaaccaaaaguaaucggggaauuguauauaauacugaaaggaaccaauaauaagagaaagguucaacucguccggcaguuacgcucuccaggugcaggagugcaccaggugcagcaaugcaugugaucucggugggacuuuccaagaaggcaauggcuuagcacuggcggggaggaugugucugagugugugagcacguguguacugcauggguuuucuccaaugaggaaccucuaaucacugucuagccugggaucauagaaacuagacaaagggaauacauuuugaugagcuguugaucuuacacacauacacaggcagcuuuguacgaacccacaucuaaacacacacaccccagagaaacaucguuguuagacucugagauguucacugugguuugggcugggaaugucaguagcacaguguccggaaacauugagccacugaagagaagaaaacacagucuggcucaaaggcuuggucccuaggacagguguacgcugcuccgaagccaaugcaggccuugcugggaguacuggaccagguguuccaugcugcugugcagggugacaggucccaugagcaaauccaggucauugaagaacucuaggagacagagagauguuugaggggggcuacacggaagucagggcuugcaugacuucagagacagucuauucauggcuucaagcauucuccacuguguauguggccuuucccuagaacaaaauaaagcccuacacccuaauacgugacuguuauuugcuauacuuguguucccaaauaaccgagguucuguuguuccaguuacauucuccugggaggaaaaagaugguuuucacucaaagucaauaugacugccucucuguuauuucccugucaacugucaugggcugagccuccgaaggagguccaaggaaugagucagucagugggcucuaggacagugggucagucaguggugugcacugaguggucaccucugcugaaguuaccuccuggaccagaguucucugucugcucgcuccuuuauuuuguaccuagguacuuucugggagcaguggggagcaguggggaggggagggcaggcagaugaaucacaggugcgaugaacagagacacauagaggucacugaguaacacucccugggaggaagcauccgagacgguguggucaaaguggcauccuucuaagaaggcaacagagguucagggaagauugcacacucaagggagugggaggaggaauccaggcacagggcagaggaggaaccggccagccugggugagcagagccagguuauacccuacccgucacugucaacaguagguaguucccagugguaagcuuacugaccacccacuaacauccuaaaaccucucccuucccaucuucuuaggcgccacaaauguagucucagaaaguacucacugcuccguugaagucuuauuacugugugagaggcagagaaugucugcgggagggcgggggagaggacagagguacuuaugcauacauguggcagucacagggcggcuuuugggauuugauuuucucuuucuacugugggcucugggagugaacuuggccugucaggcuuguacccacugagccuucuccgugaccccuauuacuucugucaccagcaaaacucuuuuaaagguaauuaauucacaacuguguguaagacauccucuugggaaauauaaagauauaagcacuaacauuuggguuuuuuuguuuuguuuuguuuuuuuguuuuuguuuuuugagacgggucuuauuuacauagcccaggcuagcuuggaacucccuuuguagcucaagcuggacucaacuuucuugaaaucuuccugcuucaacuucuugaguaccauggcucuaggauucuaccaccaagccuggcuagcagcuuagacaguaaagaacugcuaacacucauucauauauuuaauauuuuuggagccccaucuguguucuaggaacuaggucuuggcagggggguggugggggagaaacaaauuaaaaugaaauauagucuaugugcaagcucacugggaaaucccaugauuguacacguacaucugcgccugaaaugauaccugcgucuguguguaucugcaucuaauugaauccaccugcuuuuccacagcaaggguaaaagccggcccagguggcaggugccagccuuuucuuucuccuuuuguaaacugugaaauuugaucgccaaugccccucgggcauauuucccugugccugggcggguccccauucuccagggcuugugcacacaccucuguuuuccuuggccagguuaucagccaucucccaguagucauagcuguggaggaugcuguuggugaugcugacgugauuggccgccaucuggugaaugcgcugggggaugcugacgauggucgauggggacaggccgcuggagcuggagaggcugcccugagaccccacggagcuggcgggagaaggguugggagacaugggggaugggcuuccagugcuccuggaagaagagagguagaaaauccagaguggagagguugggagcaggccaggcagggagggcagccccucccuccagguaucgcgucaugcaaugcgugguuuaucugcauuuggggaaagugaacuuacuugccacuggacccccauggggauggggcuugggcagcuuucgaugaauucugcagggaaaugaaaauugguacagugaguggcacugguuaagugacagcagcauauuuucagucaacugugacaauaacuacuaagauucuguaggucagcgcagacucacugagaacagauggcggcagcggggaguuacaaucucggggcagacacuaguguguaugaaugugugugugcacaagugugcauauaugccuuuacacacaaauuuuaggcauggaauuagucauaacugcaaggguuuggugaacgaugagccaauccagaguuuguuuguuuguuuauuuuuaauuggaaauuagucuaaaucuucucaacagaguaggaacucuucccuucuccacaauaagcaagccuugcaccuaacuuuagagaucaucuacagaggcuuuugaaagaagugugucguuaaacccuauuguuuuaaauuacaaaguuuaaaauuauuucuuuuaaugcugggugugguggcacaugcuuuuaauuccaauacuccagagacaagcaggcagaucuuggaguuugacgccagccagagcuacagagaaacccugucucaaacaacaacaacaacaacaacaacaacaacaacaacaacuuauuucucuuaaaggaauaagagaauauucuuaaaguaauagcuucaaauguauuucuuuucuuuucuuuuuuugguuuuuucaagacaggguuucucuguauagcccuggcuguccuggaacucacuuuguagaccaggcuggccucgaacucagaaauccgccugccucugccucccaagugcugggauuaaaggcgugcgccaccacuguccggcuucacauguguuucuuaauggaaaauuuagaaauucuaacacuuauugguaccuuauuacuagcccaauuaauuguacugagauguccccucccccuuuggugguauugggcacugagcccaagguguuacaggaaagcucucugccgcucagcucuauccucagccccugacuuccagagguagucuggcuuggauauuacaucucaugggcuagguacuacaucaggcauuuaaagguucccuguguugggguguggcucagucacagacugcuuggcugguauaagaagcucccagguuuaauccaaggcaccacaacaaagcagaaacauauaagcaagcaagagaaagcaauuuaaaaaaaauuuaugugucugugugugaaguguguguguguguguguguguagggcugugugugagagcaugccauggguguguagaggucagaggacaccuugugggagucaguucuuuccuuuuaccaugugaguccugggggaauggaacucaaaucaucaggcagcuagaugccacgugucuagccucugaggcagcacaccagcccaaaccaaaaaguuuggaaaguguuuucuuaaccaagagaaauuggcaagugcagccagcgggcuuccugagagccugaccugccuucuuggguagucuacaccaggagggguuaggacaaugagggucccaccauuucuuccuuucagggacaagaaaccaugcccaccuaagaaggugcuuccggcagaaggagcuucgugaagugccuggccauccaguguuaguggggaagcuaccacuaugauaagaacuggcuuuucagguucuccgcaaguguagacacaggacagagucacagacugccacuuucacgugucucauggagaaagccgggaagaaaauaucaccuuaggggguucccucucuuuccugccagaacgguucugacgugccuagcugacgugaggcucuucaccugugucuccucacgucaacauuguggacaggagagcgcgacguggaagagggagagacgucugggggcugcaggcagcuucugaauggauggaagucuguaagccucacgacauggguagagacaaucucucccuagagacggacugcuaaagcauguuuuucacagccaaauuaucacgguagccugcaggcuccaggccccaagcuguauuuaaacgauccuuagaguguggcacaaagggcaccuaguagcuacaaaacuucaacaggaaggauaagguuuggagguccccugaaggcauguggucagaacugggagagagggacagaucugagauguccugucacaaagaugguggcagcaauuuaacaggugcaguguacagcaaaccacacuguacacuauuaauaguaaccugccacuugaaauauacuuaaaaacauacaaaugcccauaacuccuagaagagaaacugauuuucuguucccuucucuguccauuuuuguucauacuuucagacuggauacacacacugaaaacaauccuuuaaaagcuugccaggacucacugggaucacagaauuuaucuuacuccuuuuccaagcaucuucgguuuuacucuauauagcaauucaucccuuagauucugaucugaaagucacucucucugccuccucucccaugucuguuauguguguuugggacaggucucacuguauagaucugauuggccuggaacuugcagcgauccuccugccucugccuccugacaagccugccaggcuaucucauugcuccgcagcagucauuccauaugaacaauuagaaaauggcagugcaccagacacagaccagagcaucaccagaguagccugaccauccagcuggucucucagauguucaggaugucaauaaaugacuaaaaaagaugugugugugcgcgugcaugcacaugcgugcaugugucuguguguuuauauaugugugugcgugcauguguguauuuauauuuaugugucuguguauauguguauauauguguacauguuuguaugugugugucuguguguuuguauguguguaucuguguauguguuuguauguguguguauguauuuguguguguguguauguguaugcauguauguguaugugugugucuguguguuugugugcaugugugugcaugcaugugugugacaaaggagggguggagacaaggacgguguaaucucagacaaaugacauuuugaacaaaugauuaacuucagguacacuugcaacagcgcagcaaagaggugcucuucauuuguuuugauaguuuuguauucuucucaggaaaguaauugaauuuucugagauaaaaguugccauggcugugauucgaucugugucaccaccacacauugcuguugagggucucugagcuauaaggagccauuuccuauccuuaaaaaugacauuucaaucaaagauuaaaucagcuacaagagaugaacucagggcagugggucuaaguaguuacuucuaagaaucuacguggacauaaggaaucaggucugcucuaaggacagaucuauccccuagacauuggggacaaauuggacauucucuguuuagaggccauaaaaauaaggacaugaagacaggggaacaaguuaucugggcucucaaggcccauucuuggagcccugcaaaccacaagugugucauaaauggggugacucuggacaacagagauggcagguuuagccucaaggcaaugggugcaugaggccuuucagaggugccucugccagggagagagccuagcacaaggaggcauggugccuauuugcuaggcaguaccuugaaauagucgauaagugcuuuugaauauuuuacagcauggucucuuuugagucgaaacauccgccaguauaggagagccaggcaucgguaacugcaggggaagaagagaaacgugugucuuucacagcgaagcuccagaacaaauccugucauuucugacucaauauuuugaucacacuuauaccucuaaaauguuuccaucuuaaguauguguaugaguauuugauguuccuuuuguucaaaaaaacacgauucaagauuccaaggaggacccccauaccugcauuuaccaccagaugagguguaauaacagcuugaagagcucuuuguugggaacagggucaggccacucuccucuuccaccaccagagggcagugucuccccacuacagccugcgggagugcuagcacauucuacccugcuuuauggggcgagcuauuggccucgcagacgggacagcaauuucccagauucuaucaccucugcuuguuaacgcuuuacuagauuguaaucaguucaaauaaagugcauuacaaccacaacagaaauacuaaucugaggcuaguuacguuugcucauuuacuacaacguuuuguauaauuauuuauaaccuacauauauuccaacauuaauuauuaaucaccgucaauuuauuaaucucaucacgguacuucaauaaagaaaagggcauauuuagcauuuccugagacucauucuuuccuggugcuugacacggguaauucuuccccagcucagaucaggaauguguuacaaucacaaggcgcccaguauaacccgauccaccucuucuagcaccucaaacucccgaggaaaucacgucaaacggcucaagaucaucuugugucucccuugcgguuaggccaucugagauuccauuugcucuuccaucucacagauuagaccuagagcucagggaaccugcugagggcacacaccacuuggaauucacaggacaagagacuaagagaggggccguacaguuugagagauggguugaaguggcagagcagaugcuguggggagaguaaucacugcacagcccuuacugcuguaauccuaagugcagggagauuaauuacccauuagcuaguguggaagaaauuauuuuacuaccuaaguaaaaugagcguccccucgguucaguguauugauaacucuaauggauuguggguacucgugcauacugauucggcaugcagaguaacuuguccaugauuuugacugcauguaaaguguuaaguguaagaaaaauuccauuuagcacaguucacguucaaagaacugagguggggcccgcuguuuugacuucgcuuuugugugugggcacauguguguauauguaugugcucaugccuacccaugcauguguagaguccagagguccacacugggugucuguuguucaccugauuucucugagacagggggcugcugguuuugguuacccugaucgacuacugucaucauucucucccugugauguggucaaccgugaacucaggguaccuuaggggaaaguggucuggagguuccaggaagcacagggcagcucagcaccccauuugcagagcugggguuauacuuaccaaagcgcagcuaacuguuuguccucugguguggcauuggggccugaguggguuuuuagucucauagcauaccuuaaaaaaaaaaaagauaaaaaagcaaaggaauuaaauaguucuuucuggguaucaacagaaguuuuucuauggcucuccaccccacccucagguguucauucuuuccuuucuuuuuauguauaugugugugucuuuuuguguauauguguguacauguauguacauaugggaauguaugggugcggaugcccauggaggacagacugggugucggaucccccggagccuaagucacaaaguagcuuugaguuuugggauucaaacuuggguccucugcacagguaguggguguucuuaaccacugaacccaaccugaguacauccaucgguguacacagugcugacaagccugccuuaaaagcuagcugauggcauuacugugccaacuggaaagagauggcuuguaugaugugcuaccuucuguaccuuaaugacacagaaccaacucucaggagugcugcaagcucgagaagcauucacagauacgguaggcgucauuucugcauuucuaccacacugcgccacugaggauagagcugaagcucacccugguacuuggauguagugcucagauuugacuuugugaagcucuuggcauagcaagcggcuugcugaaaacggcugagaaaguaauccugcugcugcagaauuucuaaguuccgagagcagcccuuugcagcuuaccccagagcuugcccaggguagagcccugucugugugacugccguuugauggcaucgauguuuuacacugaugaggcacagacgucuuuaccucccuuuuuuaaagucauaguaucuugaauaccagacagugguguaaauuguguuucaaccaucaaaccauuuacaaagcucacucgaaggaacaguuuauuguggacacagcuacaaauguucuuccuccuggacaccccaagauucccuuuuccaccacgucuuuuuuauugaggaaguuccuucauucuuaaaaaaauuuuuuuuauuuaaguuuuuuuuuaauuaguuuacaaauaacuagguuguauucuggcacucuccaaauacaauuuguuuuuguuuuaucuccauuccaaccuuccauuaugcucugagaaccggagagggaagcaagagaugugggucaacuagagacacaugcuucuggugcccuuagccugacuccagcuugagcacuggaagguuguuuuuagacucccucugccccagugagaggagaccacugcuguccucggagguggucucagcacugacaacaugccuuugcuuuaugguuguuuucaggauuuggguuuuguagucccauguugucauggugugucuuggcaugucuugguaugucuuuaggguuauccuguuugggguuucuuggcuuuuugaaucugucuuuuguucagugauuuuuagccauuaugucuucugccccauucucuuuuccucucauucuggggcucuagugauaacacacacauacacacacaccacaugcacacacagaaacauaccacacacauacauacaccacacuacacacauaaaauacauacacacauacauacccccuaaccuccacacacacacacacacacacacacacacacacacacacacacacaccacauauauaacacauacacacacacacaugccacauacaaacauacauacauacauacacacagcacacacacauuacaugcacacacacgcacauacauacaugcaugcacauacaugcacacacacauacaugcaugcaugcacauacaugcacacacacgcacauacaugcacacacacgcacauacauacaugcaugcacaugcaugcacacacacaaaguuggaucuuuuguggucauguuugcuguaguuuguagugacuuggaaauucaugaguugggagugauucccaaccuaacaguacucaggggcaagaaucuuaagauggccgggcagugguggcacacgccuuuaaucccagcacucgggaggcagaagcaggcagauuucugaguucgaggccagccuggucuacagagugaguuccaggacagccagggcuacacagagacacccugucuugaaaaccaaacaaacaaaaaaagagagaaaagaaaaaaagagaaaaagaaagaaccguaagguggcuuuguccccugaauugauuaugauccuuugcucucuguagcccuggggagggaggacaucucucccuuguagagagaugccccugcccuggcucccaagugucuuuuagggagaggggagcuagguuugguggguaaggcacagauuuaaguggcaaaauagccacucugcuccuuuacaaaccccaucauggcagaguucauaacugguuacauuuuuaugggguacaauuugacaugugauacacauucacacuguauauugaugaaggcaagguaguuagcacaguaccuuuuuauucauuugccuuuuuuuuuuuuuuuuuuuggugagaauguuaaaccaaucaaccacccaacgucucuugaaguuccucugaaacacaccuuaccauuaacugcugucauccuuuagguaagagaacuuccccucaccuccacuuucuggguacugagggggugccacucauucugaacucugcucccucugggccaggugucauaucugcauccgguguguuugaucggcuuuguuguggcuaugauucaccuguccacuugacagcaugaugucuuuaagcaggacacaacacugaaguucacuguaggccccguggcaucagauauuuaaaaaucaaacugcacaccuggucugccuguaguuuuaauucacuguugcuuagcuauacacugacgguccgguccuucguugguuuccuuccgagaacugccuccuuaggucuacauuucagguuacuacugucauuucuucucaccacucucgagaaguaggaugagugaauacauuuauucaucugagugacaaggacuaaacccaguggcuugugcagcuaacuggucuaccacaaacuucaaucuccauuuucccuauugaccuuuuguuuucaagcaacuuauagaagaaaugaguucaacaccuaccacuuccuaucugagggacacagggucacauccccgcucacuuuggacaaccagggaggcuuugugcaagaggugcccugccacacauacgaagcaggaaggcaagccaagggagaguuguaagccccuccacauucuuauuuugggggaggaauguuuggaaauuggucugguguaguguauacaaaugcuaaauccugaaccccaagaucggguugcagucccacaagcaaauucucauguacacuagccccuguaauguaaaccuagcuccccaauuuaaaacuauugguuaaauaaaagugguuauaaccgauuaaugggagagaauagaggcugaugggguuucaguuauggcuuggggacauugcagguagggauauggaggagaggaagaggagaaagaaggagagagaaggagggggaaggggaaaaagaccgagagaauaaaaggucuccauuagacuugguggaccaggagcacuggcugaaugaaaugcccacagacagacugacagcagaacuaaccggggcaagacuaaaacagcaagcacuuggugagcacaagugagaaauuaacagucgagcauagagaaaaauagauuagggguaauuggcacaguaauugugcuaacgcugauuuuaaaaauccauagggggcuggugagauggcucaugggcuggugagauggcucaguggguuagagcacccgacugcucuuccgaagguccagaguucaaaucccagcaaccacaugguggcuaacaaccauccguaacaagaucugacucccucuucuggagugucugaagacagcuacaguguacuuacauauaauaaauaaaaaaaaaaaaaaaaaaaaaauccauaggacucugccucgauuauggggggcuuguugaguuguauuaauaaacuaauaguuauuaaauaaccuuuaaaaaccauguacaggggaacauuggcuccccauggcugcuagagccggccacaauucucuucuuaguaugugcguaugugcgccgcuucccaccccgccccgcccuugcuggaagcggggcuugccuaccugaugagcuccacugucuccgaguacaugguguagggagacuuggauuccauuggcccuuguuccauugcguuuccgcacucgaugaaggacaaggcagcuucggcauaguucagggccuucccgaacuucuccaccugacaaacagaauuggugaugugucccuucauaagagcuuuuuaaagggggaaauugccgcagaguuuaagaaacacaggcuucaagcucuaaaauuugagcugggggguuggggagggggaggaaggggaggaggaaggggaggaggaaggggaggaggaaggggaggagggugggcgguggggcgggagguagcucucucugccaaccauagcucauuuuccacagugucagguuccuguggucaacacagucugaaaauguuaugaggaaaauuccagacauauacagucguuuaguuuuuuuuuuuuaaaucauaguuuucuacuauaauuguucuacaugaucaguauuuacuagucacuguuaaugucuuucugugcuuuauugcauauuaaaaacauggaugcauaugagaaaugugcacacaaggcuuuggauaaucugcagcuucaaggaaugaugcgggagcuuggagcuugaagcccaucucccacagauagaagggagccaguacaaguccucuccaguucucucucagacugccaugaauuugaggcagguaaguaggagucaugugacugacagcugccagcacagcucagggcuaaguugcagauuucuguuuccuucuccccaguggucuggcaaaucuauccccacauggugcuaaccgugugccagaguuaaaaguucuggcucaguacauagaucuccauggcugucuuagagccuugauuacagccucauggguuauuuaugacuuuauauccccuggaugcucacccuccugggcuucauugcuaaggaggagggccucacuaaugauugaggacagaaacaaaggggggaucaacccaagguucagagcugaaaaccaaccacaagaacaacucuggggguuauccacauggucuacguuuaugcuaaccagcacaaacugcauagcaccgccaguuuggcugaacauaccuggcaaaauagggcucccuacaccugaugcagcagccacgggccggcuuuacagcccgaguucucccaagucuagaacucuguacugagguucuggcucuagacacugaaagcugcuccagaaaaccauguauucuugccuugcaaaaacaccucuguuuucccacgauuuauuaaucaaagaaaaauucauggacauucccuuuaacuacucucaauccccgccacuaaaaauaaauaaauaauuucccaaacuuucauuaacaaugauaacuuugaaaaaugaaugcagagcaaaacucuuguuaaaaaaucaauaauuuaauacauuauaagucaaaacaggcagcugggcgugguggcgcacaccuuuagucccagcacuugggagguagagagagguggagcgcuuaguucgaggccagccuggucuacagagugaguuccaggacagccagggcuacacagagaaacccugucuugaaaaaccaaaaccaaaaccaaaccaaaguaugauuuugcucagcaguggccaugcauguacacuuauuuccuuccuuuccuuuccuaauuuucaguacuauagaaagagugauccacacauuagcuucuuuggaugaccuaaacucugcacuugucugaggacaagagccauuccuugccauccucucuguguucugauauucgcugccuguauccacauuacccuagugcuccucagcaggugacaucaggugauaaccguggugggcagcaugaggcacaccgagaacgccucuuagggguuauguaucucgcucacuggagccauauucugaaagguaacugaaauggcgccuucaucuccagcccuccugacugaucuuguuaugaacuccaacgaggaagaaaacuagcauuucaagguagaaacaaacaaaucugaaagagauuugaucgugggccugagccaaggaacaaccagacagacuagccagagaguaaaaugcaaauuuaauuuguuccuaauagcuccacccacugacuccacugaugcuggcuaccacucaauccuuaagacaaaauugcaauauucauuuauccagggcuuucuuccaguuagacauugccgagugaagucauaauuuauugggcuaugagccuuugauuauauaaacauuuucccauuuagcaggcccagccauccuuguaauagauuuuauaauugcccuggcuauacugccccagugacgaagcugcagaacaaacaguuuggacuagcaagucuagaaagaaagggucuuaccauggcgucugcuuuauguuucauccgcuuggcuucucgcauaaaauaaucugcacuucgaggccuguaagaggagaacaucagaugccauuacugcuuaagugugagaucuaugggaacuacgcuuuccuuucauucaaacauaaagcgcaauuuaaaaaacucugcuuaauacggaaucaggccuacauuuugcacucucaaauuacagccuguacauaaaauacauuauuuuccuccuaaguuagcaauucagagcccacucaauacaugcagauagccuauauuuuuaguuauuuuaacgugauucucagugccuaauuuguggacaauuuuuuuuuuauuguauggauaagaaaaacguaaaaaaucuuauuuugcauaauaucuacagaaacccaccccccuuuaacuuaaaaucuguaaauauaucugaugauaauaucaugaauauguacgggugaauauuuauuuguucuugugagugugccauuuauauacagaaaugguaccuagaaucguaugcacauauauuuaauuaucucaaagccucacagugaaaugaaagaacugugaugcaguguguuuauguuccaguuguaauaaaguuaauuguaaaaugaugucuaccuuguaacaaugcagagacaccauguaucgucuggagugcugauuagcuugcuggugaacagaagcauuagacauguguaacauggaagcaauagccuuggccagggccaguucuucugggagaugaagguaauuugucccaagaccgacugcaugugcauaacgacccugagucacauagauaggaaagcuaugcagaggauggugccuuuaaaaaugcuuagucuaauagauuaauuuaaaaaauccuucacauccuuuagaugccaucagcauaaacuuuuuugcauuccguguguuaugcgaucaagaaacugaccuacucacaacuaccagucggggcuaugaugucagccgagacauuagucacggguugcuuaaccuguuaugauaugcuuaucuuaaacugucuuguuucagauucuaaugggucuuuuaccgcauugcaauaccagguagucagaacauuccuuuauucaaagagaucaguaugauaguaaacuguggguuaguacuacauuuaauuaacaaacuaagaaacaaaaucacaaucaaagcaaauaauuaguuuuggguaaaaaaaauuggaauaauaauaauaauaaugauaauaauaauaauagacucucaggaaucaaagggagggagcuuagaugaaauguccaacauguggagaaggaacuuguagaguccuccuccagaagaaagacagagcaucaaguggagggauggggcugucaucccucagucaaaaacccugguccagaauuguuccugucuaaaagaacugcagggacaaaaauggagaagagacugagagaaaggagguccagugaccggccuaacuuaggauccauuucaaggggaggauccacgcccugacacuauuacugaugcuauggugugcuaacagacaggagccuagcauggcugcccucugagaggcccaacaagcagcugaaagagucagaugcagauauuuacacccaaccaauggacagaaggcggggaucccugugguugaauagggaaaggcugaaagaagcuaaggaggaaggcgacuccauaggaagaccagcagucucaacaaaccuagacccccaagaucucucagacacugagccaccaaccaggcagcacacaccagcugagaugaggcuccccacacauagacagcagaggacugccuggucuggccucagugggagaagacucgucaaaaccucuagagacuugagaccccagggaguggggaggccuggugggaguguguguguguguguguggggggggggaagacaucuucuuggagucagggggaagggagaaugggacaaggaaccgugggaggguggacugggagggggacaacgacuggacuguaaaaaaaaguauuuuuuaaaaaagaaauuuaacacauauugucaggguuguggcaguauacugagacugacuuguuggucugcagcugcggaauucccugaaugcuacugucugucuggcagcaauggcuccuucaccauccuugcucccauccaguccaaagccugcuguucccuuuggugggucucugcuguggcuaaagguuuccuuccuuaagagggcccgcuccugacaccucugcuuuucuaguucauuucccggggaccccagcuccacuuggaugcuuuuucaguuggcuuagaagaaugcuccuccuucuuuggcuacagacugacuugguucaaacuuggccaauuuccacuguuacuacuugcuugcuucugcuuccaaacaaaccaauuuuagagcauguuuagauucacaguggaacugagcagaaauuauggcauuucugugcacucguugccccacacauguacagccuccuuuguuaccagcauccugaaguaaagugacaagccacuggugacccucugaagucuauggacuauguguaaucucuuuucuuuuucaaagucuuaguuugacuuuuuuuccuaaccuuuauuuuuugugaauggguacucugucuauacaccaugucuguauaucaugugcauguugcauaccccgagaucugaguuacagacaguuguaagcugccguguggcugcugggaauugaacccaggucuucuggaagaacaaccagagcucuuaaccccugagccaccucucuagccuccagggauauuucuugauggguuagauccugugaguuuggaacacugugccaugacacauaucugcuguuagggcacuagaggggcagagcuguugcucugauuggucauugccuucacaucccaacacauaauuagaacuugccggcagccaugcauagacugacucccgagcuucagaccccagugccgacagugugaggugaguuuaguuuucaucgguucucucugguugccagauguguccauacuucuuaccauuucucuucucuuuuuuaaaaacuuaauuaaaaaaauuauuuauauguaugugaguacacuauaguugucuucagacacacuacaagagggcaucagaucccauuacagaugguugugagccaccaugugguugcuuggauuugaacucaggaccucugaaagagcagccagugcucuuaaccgccaagccaucucuccagccccuauuccucuucucuuaaggaagaacauauaagcugguuuuuaucaagguuuuuggagcuguaacuccuccucccuuagagucaaucuggaaacuuacuccuugaccaguguuucuaaaauaugguuucuguuguguuaccaucuuguucuaaaaucaaacucuggggccucugaagucaaaucuuaguucaggcuagggauucaugagggacuuugggccacgucugcagguuccaucaguuuugauggccugccucccugguuugaagcucuguccuuccuuuucacugccuggaaugcugggaguuccgcucacucgcugagagcucacugaauccuaucaugaaccaaagguuauuccccuuggagucuggccacugucaggagcuauuagcauaggccuugcuucugacucuuucccaccacuacagagaacuugucugugcuauacucgguggcuaauuaauugccuuccaaguuuacggggcuauaguuacuucaugugugcagcuuggccacggguacauuucagcguugaccucuuuggucuuccccagccugcagucauccuugaauugcacugaauuucuucugagcuuagggaagaguguugccuucugagagggugcggcaucauaaaccaaugagccggagagugucuccauggcaacuugaaauucuccacaucauuaucugcucuacacuccaguaucuaaguuuggucauuuuguugcguguguccuguuucguagaccucaccacuaaaagauuuucauuuuaaaugcauuuuguucccaugaaaaaaaacugucuugaucauaagcuauggcaucuuagauuuuacagauuuucuaaguuacucuuagagauggcaggcgcugauaggcucuaauguguguucuucaaucaauguuguuuuuaucuguagcacaugaaugcaucuuucaaaccugauguggaguccgagucaucgacacacagcagugccuguggguaaguaacacauuuaauuuucugacuggauccuggcagcuacaacaguagccugccauguuaaagggaaacccggugccaucuauggaccauuuacaaacacgcucguuagaauccgcuuugcauauaauggagggcucacuauacuaagcacggaaaauugccugaagauuggcccauuuucuccucucaggugauuucugcugcuaugcucuuaaaccaggccauuauaaagccauugggaccaaugggacgucacucagacuguccggcguggcuguggacucacguuacucugaagauguuucuuuucgcagcuguauacaagucaguaggaaaaaugaaauuguccuuacaccugucagagguucagaaucuaauauaccaaagguucugaaauaaaacuaauggucucagugcagaauacauuuuucacccgaccugucuuuaagugggaaaaucuagagucuuuacacuucuauaauaauacccuguguguuauuuuucauaguguuuuaugacggucaugaacaggccaauaaacgugcaauuaaacacugcaaauggaagagcauccagcgcuccacagaaaucgggacuggcuaauggcagagccagagcucagucgugugcaccuuugugcuaauaggucaguguaacaaaagcgacuggugugcuugauccaaacaggacguuuccuuuucuuuucuuccaucagcaugaucugcagacacauagucuuggcccugagcggcagcggcgugcaaaggaccugacacaucggagcacaggagcuuuagagaggacuuggguuuuuuguucuccuuccuggcugagggagcagagagaugaauggccucccacagagaggcuggcacacugcuuucuguaauuccuaccucuuugaaaggccguccuuccauagagcaagccuguuuugugcaaaauggcagggaugagagcucacuguguuugaacaaaacagguuccugggcguggagcaaucgggaugauuugcuuagagaaacugaaaucuacaccagacagaggagcaacgauggcaucaaauagauuucucuuucuugcgauacccccuguaucauuuggcaugcccuaacuguguccuuggcuuucaggugcuuguuccaaaagaaggccgauggugcaagagguugaauguuuccuuuucacacacaagcuguuuguagugcuagcuuuacagagcugggugacaaacucagcuuccugcacgccaggcaaguguucucccgccugcucccuuccagucaucacuguuggugggggauguuaggagacuggggcucccagguguugcugucugcacacacccuguugaagcagcuagacaguguuuaagcaguaaagaucccuacgcagcuuuguucuuugauggauacugacuggaauccuaaggagcuuggaacuuggugucuccagaggggaagcacccuacgccgcaugcguuucugacaccacucagaguaccuuucucaggcugugcuggcuaaggcaggcaagguuugaaucauuuaagcaacuuuuauugagauggaaaaccauccaucucacugcuguucuucucugcguuggauguuucagcaaucgauuuuagcagggccugaagguuucaguaagagaaggauguauccuuuuccuuccauccgaccuuucuguuuuuccauccaucagaauaaaguagggacccaaccugaauaugcaauggaaacaguucccuaagaacaaaaaggugggguccagcuuugcugcagcaaggucucccucaggacagcagugcuguggaaagguccccagagugcccugccuaugacaauagggccuaugcagacauucuacuuguuuccuuugauuaagucaugcugugggagauucacccucucauaugcaggaaucuucccuuccucuauaaaauuaaaauccuuuuagcuaggagagugcgccauguaauuaccuuacacaugguaagccccagucccuuccugccauucacacuuaccaugcucacggccuucaguacugcguguuccagggagcccucauucagcucaggagggauagcuagcucugcuucugcuccuggcaucauggggacagaugggacauuugguagaugggcugggugcucuggucgugaccgccucuuccauggaaauacgggcagaggacaguacauccuucagagagcagcaggcagugcuggccuccagccccacuggcuucuaacacagcaauacggcuggcaggagccgggcuucauuccuagccaagccuuucaccauguagcuccaugaauucaguauuucuggacugaggcuucccaugccauaucucucucaauucuccccggccaaagcucccugucacuaauuacaacaccaaauaauacacagcucgcugcuuugcacuaauaagaccagcaucuaagcugcggguugaaccaagcaccgccgcuccuugauauaaauucucggauccugucuuuucaaagaaaagucuguuuuccaccuuccuccugaggcuguggaguaguaauugucccugcuuuucaugcuuuuguggaaugucaggggaggaggggcugucagacugcugcuagucugcgccugcagcuuaccaagagcaagccgaccuugauucagguucuaaaauaagagcuaaccccuucaguucauuugcauccucagagcacuaacugcugcuuaauugguaagaaacauaggaagugagguguggaaggcaugaaucuaagcgcucuuucaugcaaguuuaugggaaaagaaagaaagauggaaagauccaggcccuccccugggaaagguauuuauaagucagcuauauuuauucagcacccauucuugacagccugguggcuucaguugucugaauuguauguuuauucaaccauuaacaguauuuauaauacaaaaggaugaauuuccuuuuuuaaaaaaagcuaugugcaggggagucgucccccucuguggagaaggggagaaggguggaggaggucuggugagagccaggacccagaggagagggagaggggaagaugugacuggguugcaaaguaaauaacuaaaucaaggaaugaaacaaacuaacuaagccagaguguggcaccuguuacuuuuuggaucuuucuaguuguuuccuaucagcuucucaguggcucugcccuaaugaucuggcacccucccuuucuucuccuggcagcuuuucuguucaucucaggccccauugaugccccagugaagauaagccaaagaaaguggaaggggcugaggaccuucuugaccaggaagcugccagggcagaaaaugucagguaaaagaggaagaaaaggaagugagagaggaggaaaaggaagugagaggagggaaggaaaagaggaggaaaaaauccaaugggaaaggggagggcaggaaggguuuauuugcaucacucgccuagggaugguacugcccauagugggcugggcuccuacaccaacggacacucaagagaacgccccauaaacauagccucaggccauuucuuauggagacaguugcuuaacugagguuuccucuucccagaugugucaaguuagaacuaauuaugacagaagggaaggaagaacgggggaugugggaguacacaugaagggggaagaagaggaaaagcugaugggaacuaagauaaggaacuaagagggaagagaaggggcgggaagaggagcaggugugaccauagucacaguaguggugguuguauugguccaccaugggcuucucuccucugacucuggagaauaacagaaugaacucaucaguauauccuggcuguugccuguaccuggcacauaguaggugcuuuguauauagcagcuggguguguaagacauuuugcauguuaggugacuuuggucucucgagggacagcuauuuucauggcuuaaagggagagacaauguugguucuuggccuuucgaguuuuuagacucuucccacagcuuucuuaggccaguggcuguuucuguuguguguuuauuuuucuaacagagauugcaaaucauuuggggguaaguggacacuccucuccaugcagggggguguggaagagugcuuuuccauuucauucuaccauaucccuaagagaacaaacagucccagcacaggcaacagccagagcuacacggccugccaacaggcucagccucuucacugguacagacaaggaauauaacgagaaacauuuccacucauaaaaaguucuagaaacuucacauauugggcugcucuuucugacucagcccucuauuuugaccacuggggaagucauuaaacuuauuuucucauacauacuuguuuuuucuucuuaucuuuacuaugcuccccauaucaucuacuagaaauauuugguguuuugggcaccccagugccuaacacuucuguuaccagcuaugagucgaaaccacaaaugcuacgaucaccuuaauuaucacucuaauugugucuguuuucaaaaaugacuaaaauucacagggacaauuuccacacaaaguccgagagagaccaccugacugccgucccaagggccaaugagcucagcaaagggaaagcgacuaaagugggugcuggagcagcugaggggacgggaggggaaggcugcaugcagggagcuggcacgcaguuccaguaaccagaugaggaagggagaccucccucgcuccccagauucaguuaccuuagcacgugauuuuuaaaugacacaucuggcuuccaacccuagaacucugugcccugguuaauguauaaaagucuaauuaauacguaaaagauuacuacucgacuuaggucugacagagaagcaggcaacacauucuauacuugggugaggaugagggagggcugucaaacagugagcagggcugugaucccagcagggugccugggguuccccagauguugcugcuuguguggcaccccaaacgagggaggcagucaucacugguauuauugaucuuucugagaacgggcugggauaucuugagagcacguuauagucugacuuucagagggcuuuuggcuuauagucugucacugcaguugaacuguaagccaccggagggcaggaaucuccugccugcuguuucuggagacuucauuuauccugccacauguggacaugcauuguacugcaugcuuuugggucagcuaacaacugaaggcaggauucaagcugaacucaugaaacuccaccuucugccuccuugacaccugcuuucucccuggaacacuaaauuaucuucagucuccagagcauggcuggccagucuucuuacucaccuuccacuccuuucuccuugcgagcuggugcuggcuaugggagaugcauucagguuuuagcaguagaaguggacagaugaugugggguugguuguucuguaucaggccuguuuacgcuguuacaaagaacccacaucuugccagaaaacagcauucagggguaaaucaacauuauucuuuggccauccuaagaagcacuuuugguucuguaaaucugauaucccuuaauccauauccuuagaaauaagacucaccgggggcuggacagagagcugagcaguuaagaguauacccugcucuugcaaagggcuugcguuuggucucagaacccacauugggcgagcgauccacgaauacccacacucauggacacauacccagacagauacauacauaauuaaagaagaaauaggcccaucaguucaguuugccucaguuucuugaggccuugggugcuaaacccauuaucccuggugauccuguuuacccagggguggccacaaaguuagggcuuccuuugagaaggacauuuaagugaccguaucgugcaagggcaaauagccacaucaaaaaugggaggcagcgaucuuuuucuacguccuucccccucaccauauuaaaacuuacaugucaucgaagaucaguuucugucucuugcagucccuguggccauuggaaccuggagaccauggcuccgucuggggccgugacuugcuauggagggugccauuuucagaacuguugugagaugccuucuaaauaaaaaaugagacagaagccacugaggcauggcuacuuggccgagagagcgacagauaccuuuuaacccagagaauaucacucugcucuguacuagacaugauggugauuuuguuucaauaaagaaaaaguaacagguuguguauuuuuuuauccaaaauacuggggaccacaagugauuuuuuuugggagguagaacccaagucuaaguaugaaacucgucuguuuuucuccccacgcauguagugauuagauauacauuaaaacaauuguaugcuguauguuuuaaaacaguuuugugaaucuauccuaggaggaagucagguguggaaugacccgauugcagaauuagaauuauguugguguucagcaaguuucagaucuuggaacccuguggcuuagggaugcucagccugugcaugucuagggaucaagcugaggacuucugcaccguugucaauucuguucucacgguaauauaaaaaagggugucuuaugcuccuuccauggaugggagaaaagacuggguggguuaggcaacuuucucaaguucaaauaguaaccauggguggaggaccugggcuuguauuuuucccaauuuagauacauaacagaaucauauggaagccugcuaaaacagaucgcugacuuagcuucuccuuuaguagaucuaggguaggguuuaaggauucucucucucucccccccccucucucuguguuucccugucugugucucucugucugucucugucucugucucucuccagauaaggucuuaauauauaaaucugggcugauuuugaacuaccucagccugcugaaugcuaggaucacaggugugugcugcugccacaguccccgugagaaucuggauuucuaggcuagggacagaguggcgggcucaguuucacuggguuuauuuagaaagaaagggccuugacaaaccgugagguccccagcaaucgucugcagcugacucucagccuuuggcucuuuguuggaagacgcugaagucaacaacccguugccgugaggucggcuggaagaagucagguccucgcuggcguauuuguguuuacaugugucugagaguggcgaagugggcgaccggagcaucuuuucauuuuuguuuauugguauugccaagcugaaaagagaaacagcaacggagcgucccagucugcacagggaagagaggccgugcuucuuguacugcccagccucucacuuaacaucuguuggcaggaagaaguuucuugggaauuacuuuggagaagugacuuuauggcaccaggaucacaguaaacaauaaacagagcucaugcuugguuucuuuacuuuaucgggacgcccaguaaucuggagcuccugccaaugaaggacugagaagaguaacauguucacacucccagugcuccaucaaggggucuacaaauacugaauaagugagcuguuccucacgagccugaguagcugggaaaagccaagcaacagucaacagcaguaagcuguacucaguuucuuagaggauccccgccggccagcgacugagucuguaggauacagucacagaacaucagggugacuccaaggccugaagccaccuuccaaccacugagugucugaauucaccaggcaccgaucagaauaaacacacaacaaagcaacugguaccugaaaccacaauuucugauccucagcucuuacuuuuuaccuuaaagacgauugucuagucuuaaacagaauuucuccaaaucaaccaucagagaagacagacagacugacacuaaagucuuaccgugccuacgaugaugcuuccugcuggggagcuauguguuuugcauuaggaagaagaauuguuugugaaggaugugguaucccgaaagagucaaucacugcuaaccaaagaugcccauagagucaccuaauacaauuuacacaacagaacaguaaaaccaaugaagguuuagccggugacuccugggguuacgaugaguuaauuguauguguugguuaucagagcaaacaagccauuaagucacuucaaaagcaauuuccuuagcuaguagucacaguggggaccuuaagcacuauccucuaaauuaaacagcaaaguucuuuaacaucaugcaaauagaugcguguggagacagaauuucugguucuaaaaaguucucagucuauaacauguuauagacaacuguucugggugagucucaaguagugucugcugaagggaaggaugcugauguuaaggauagagguuggaaggccugaaagccaccguuucuugacaugggagugcaaaacccugcuucuaagcaucuauaauuuuacauucuuuaaugugucaugaagaacagacuaugacauuagguaucaucauggguauaucugauuguucccucuccgucuuugcgaguuuacacagaggaucuaagaagcauccucuggagagcucccugggugaucagcucuccucuccugagguggugaaacuuggcggaccugugagagaagcacaauccccagagcuucagggaccaccuuucccagcgagaccacuaccuguuugcucacauuguuucccuacuuaguuugcucacacuguauugcuagguguucccacucacaauuguguugcuacuuagugucagcaaagcaaucagauacagaggcucugccagacagugugagggcaagaauuuuaaacuccagguccacaacuuuggauggcagagaggguuccaugucaccaucccucucaaacaucucagcucucuuuggaacaucuccuuuaguuccaagcaagggcaaggauaggaagaacaguuaagcuggagucaaccuuagcaacacccgcacuugugccucagcagaaaccacugugcuuucuugaaauaccacaguuguugcagacaccuugaaauaucauuggugcucauagcuaugcagugguuauaacagucacuagauaggaagguuauuuaaugcacucacaaaugcacauaaaacauauugcacauuaaagagaaccauuucggggggcagggucccuccauucccauugcccuaguccuucagaaugcacagaggacugugggagcacugaggaucugcuuccuccugugcagggcuucagccuccucaaggugauccccacagcaccguggccugugcgccucugcucaccaaucucaucuuugacucucagcgcugcucuacaucuuccccaaccuuucaguuuacauuuuuaugugcugugcagaaccauuaaucuccucuuuaaagcccucuauguauagucagggagagcgagaggugucucagcagaggaacagcggggucugggcugaggugcuucuaaauggaaaagccucuaugacagaagcuaagcuacuugcuuuaaugaauaccugggaccuugccuugcuggaggaccauuuaucacagagggagguggugugugggggccugugcuguuccucuagaggaaucacuggguggcgguuugaccuuggaagcacacguccuuuuuaagucuacaauuugucuacgcccaacagcuuagguccaucaccugcagacucaaaguguggauuucccauguccuugggguuuuaugguuuuaugugcuuagcagcuacuauuaaaauacuagcuuguaacauuugguuaucacauugggggggggggaucaucucuggggaguacagagcucagagcugugcugccuggcugcuggucucugguuacacggaaggaccugccauagcugucagaagcagagccagaggcucgcacuuggaccuaaguauuaguuuuggauaaucugagggaccaaggccauagacucagaguagagcaaucaaaaggccccucagucuccuccacacagcggugacuuucagacucagcagccugccucagcucagcccuacccuccugggaacaggcuuaccuguugacguucacauugcagugauugccggacaagguguuauuaguggaggcggcgaggcgugaggcacucuccuuccuucccuggaccuucuuuaucucccuguagucaucuucguugucgcacuggaugauaauaagcagaagccauucagcuuuggguuuauacgugacuuagugaagggaaagauaucauguugugaucaaaauaugcgugaugaaggcugcuucguguucagcauugcagaccagaucuggucugaauuagcuuguggcgucacuaucccguaucccuuacugguaugagaauaagguauacgcggugugcucugcacaagcuuguuggaguaaccagggugagaaaccccagcucucccucuuuaaagccaugugugccuuuggugaacggcaagcaguggcuguugccuggugugcuuuacucccggccccgaacacuuuaaaguuccuuuugguaaaauagaaccuuuuuuggguucuugcugcacaaauguguuugacucugcagugucagggaacaauagaaauccacuccccaaagugcuacuccuggagagacaagagcuuaaucuaggguggcauccccagggcuguacggggguguuugccaggagaaaacccaagcauacaugccagagagaacuugacucuuuuuaguuaggacugugucaugcagccucugccauagagaacuucaaagcucacguuguuacaauggccccaugaggaguccaaagccaacuuuaaguccugggcugucaguuaugaagcaucaguagggggggacccagcugugccagucuguguaggguuagucaucugcccucuccagcccgcccauggaaaauggguggcauaggggacugugauguucucuacugaaggcuaguucccuuauucuuggcagacagggaguugacacauuugguccugcaagguaaaaggcacuuguggccaagccugaugaccugaguucaauuccugggacccauguugcggaaauaaacaacuaacucucacaaauucgucuuaugacccaggugugugugugugugugugaaagccuuugcguacguauuaagaacacaggaagaagcuaacccuuucuuuggugguccuucuuuuccaagguuuucaaguucuacuuuauagggauaagcuuuuuaauguuacuaugugaagaaagacaucuugugucugaaucauaaauucucuuggugauaauaaagaugacuguaaccaggagagacgaugccuuugacauauacccuuccaaaaugaggaaugccuucauuuuggccaggaggauugucgucugauaaacauuacuuccaagucaccuuauuuaaccagucuccccuucccccugcguucugccuggaucugaacacucaaucuuguccgaauaaucauuucuucaggccgggacagggcuuaaguauucacagcuaccaggugugaugguacuuccuuauugcguguguguaacaacuacuuaugcaguuauuggaggacacgcaacugcagacacccacaguccagaccagcagcuuauuaucugggaucuaccccucccccuccagugcaaagcgacacagagaacgacugcuccucccaacucuaggccuaccuugcguuuccucuuggauuuuggcaaagucuuuucagcaggagcgucuaaugcaugacuggcuggggcacuaucaguguccuuggccgaaggagcacucaaaaccccaggcuccugggacagguguucugggauccuggacaggagggucaggucaauuuugacccagagagaccugaccucaucgcuguccuuuagcggagauaguaguucauuccugccaaaggggaccagcguguagaacuguuccucuagcuccuuggcaaugucacuggugguccuggcguugauggagcccacagaagcccgggaggugcugcuguugcuguugcuguuguuguugcugcuggcggccuccuucagccgcugcucgcucccagugguggucggagccuuggacaggacguacuccucuugcucugacuccaggucugaguccgaggaggaagaggaagacgaagauucuguuucaauaaacuccuuggauuuggggacgauucugcucagcccccucgugcgccgcuucucacaggucacggaggagcgcagcuccuugcgguggccuguccuguuguuaccgcagggucugguuuuggggggcucuaggggucccaccacgcucgcccccagcgugucuggggccacuggcuccucaggccgguggcaguuggcaccguccccggcugagguccucucggugcgccgggugggcuucuugccugcugaccugcgggugggcgcaggcgcgcucuccgugggugcgcugggcaccgcgggcgggagggcagcugcggucacagccacagcagcggguggggacuucugcuuuacacuuuugcugccaggggccuuguuugcgguccucggccucugcuccuccuugcagguggucuugagcuccuugucccucaggcuggcuuggcagaucucaggaaguuucccgcagucuugcccuucaucuuucaccggcggcguguaguauugauuccuuuccgggccguggcuuucauuuuggaucagaauuggcggcuugugaggauuaacuuuguuuagccauuuauccagcugccacuuguuagaggacgcagguucggccugaaaacagaaaacccgggacaaacaacacagcuuuuauaacaggcucacuugaaaggggcccuggcuguuuugaucuugacauucucugcuaagcaaaagaaaauugaaugggcuggcaacaaacaaaauggaaacgcagguauguggggcagcgcucugcugguacagaggaugcccagcuggccccuggcuuuucuguauccgugaagcaguuucaaguccacuuaauaaaacaacaggaaagcaaugaaccuccccagcucaccccuagaacuucuaaguguuaaacaguuaguuauguguaugcagauauaucaauccauguauauuuacacacauacgcccaaauuugagauuaaaucugagauucuaugaauuuaacuggaagguccugaauauuaaaauauuuucucucucucucuuucucucucucucucucucucuccuucuuuccuuccuuccuuccuucuuuuuuuuacuuguuaucuuugggaaaaucauugaacccagaacucaggcccccucccccauuagcguauaauuuaugcagaaaagcagguaagccacagguauuaaaccacaaaagcagugacauugaagaugaugcccagugugcccuguaagcccugacagccugaguucgcccccagccugcuucugccagcucugccaugcucugcuaggaaugucuggacacaggagacucagaaaccauuccuggggacaguuuucuaacuuagagcaaauugugggugucacaguuuuaaaauuccgaccuauggaccagcucacacagagggugcacggaauucucuggaacagaauaggaaaggcuggguuggcaccccucccccaagaggucuacaguuuugagcugagucuguaaggauuuguguuccaaacagguuaaaaaugaagauuccacagagaauguugguuucuaauaaaagcucacuuuguaaugcaauaaaauaaacagaaauggugccuuuugagaagcauggaacuucagugacagauuucuaaucugugauugagaaugacaagggucaaacauuugaagaaucacagucauuuccuuaauguuucuguauggucucuucucucugaauccauggcauucaccacuccagggaccagaugcuagccuagaauagaggcucucagccuuccuaaugcuggcauccuuuaacgcaguuccucacgcuggggugacccccaaccauaaaauuauuuucauugcuacuucauaacugcaauuugcuacuguuaugauggccuuaggugaccccugggaaggggucguuucauccccaaaggggucaugagccacaggcugagaacuacuggccuagaacaagcuugucugucugagucaggacugucaccuaccuaucuaccuaucuuauucaucauuuaucuauuuaccgauuaucuaucuaucuaucaucaaucaaccuauuuacccaccuaucuaccuacccuacucaucauuugcugucugucuauucaccuaucacucaccugucaccaaucugucaaucaguuaucauugaauggugucccaggccuuacacauaccaggcaaacaacacuccgaucucuaccuccagccucuuagcuauguuucaaauuuuccagucaaaagcuuagaggcagaaucagucagguucuucucugugagacuauacauuucuauuauaaccucuuucauaucaagauuuauuuuucauaaugaggugcauauggacagcagagcugggucucuggcuguuguuacagaucuaaguggacaaggggagaguugugucugagacacgaggauacuagacaggcccacagaggugagggugcaagguucaggcuggugggaagccucugauaacaucaggggauggagcgagcaugucaccaaccacagcugugguugggagcagcgaccgacaccccacugcucauucuuagcagaugagaucagccuggucucccuuauucugaaugcucggggccaggaacucuuuggguuuuguguuauuuuuggauuuuggaauauuuguauauaauuaugagaucauuuagagauggaacccaagucuaaguguagaagucauuaaacuucauacauaccugauugugcaugugugcgugugaguguguguguuuguauguguguguucaugcguguacaugccuaagcguguuugcguacacaccacagcaugcacguggaagucagaaaccaccuccggugucaguaaucaucuuguuugacacaggcucucuggugucgucucugcugcccauggcuagcuggcuugccagcuugccagcuuucccccacggauuuuccugugucugcuucucaucucucugcagaaagccuaggguugcagacgugaguuacaaccaagccuggcuuucugugguucugggucucagcuccucacccucaugcagcaaacacuucacuugcagaacuaucccugccccuugguggucauuuugugcaguuuuaauguggacauacaaccgaguguucugcuguggaguuuuccaccaguggccucauggcagcacuuaguagguugcagauuuuagagcaucuggauucggguacucaagcuaauaccugaguguuaacuccgaguuuuacaugugauuuuuauuuuauuuuauuuuauuuuauuuuaguggcuucucaagagaaagggaagcagagcagccuguagagaugucugccugcuuuaggcugcaguggcagcaaaugggacaauaggaacagaacagcuucuugccaaggggaacuugcugcuguguuuggcuccccaggccccaccuccucaggcucucagcucuugugugaggcaaacacagcugcauaugggaagagucacgauggaacuucagagugggaccacugauagugaauuguagaauuucaugggcccauugccagacguacucuggggucauuuuuuuuuccccuuguacuucagagcugaaugaaucagugugaaguaucauuuucaacacagcacuaaaucacauucucuuccucaagggucuccaauaaccuccuauugccucuuagacaaaacccgaauucccagucuggcauucaagagccaucauccugggaucauuuaucauugcuagagcaucuacgcaugccucccgcuuugcauacaucauccaauuuaaucuuugcagauaagaaaugcuaccuguaacuuguggaugaggcuuagaggugcucugugagaugccaaggcugccugguuccuaguaacuucaugcuugccuaccagguguacagaacagguucuccacacaagcugccuccccuccuccagcacucucugaguagccuuauguaagggauuccaaccuuuuaagaaaugucaauccugaaccccaaaugagagagaguuuuagacagaauucuuggagaaaacaugacucccgcgaaacaugucuguuggccucuaccucaccaagcagcauagucuuucugguguuuguuccuggguuugugauuuguagcuucaacaucguguacacugcuuucaggcuaggaccugauccuuuuuaugccuugcaacaguuaugccaggccugggagcuuguggcgacgccucugcucucagaagaacugcauauaccucuguuccucaaagaugagagaggcgcgcuguagcugaagcucacaugguggguggaggggaggucauucuggccauggaaucucaaacaacaggucaucaggggaagacaaagccgagacuucaaauccuaucccacaaccgugugcugaggcacuacugagguuucugccugggguuugugucugucuccuggggguucacugccuugcaugcacagcuacagcucucuucccugguuggucuucugcaugauucauauacaaggucuccaagcacacccccaccuugucuacuucuuugcagcacacaccaccaugugccccugagaaaugugauuaacaagaggcugugcauccaucggcaugaggaacacacuccaugcuuccucugcugguuguaaagaagaaucuauaguguucuuuacuaacacauacuuucuguucaagucuuccuugaagaucugcauuggucagauccacuacggaagagccgcaagggaaaaaaaaagguuuagugcaauaucuaggucgggggcuauccaauauaaagacacagacuuaaccugcuuuauccaagaauucauaugaugugaccagagucuuucuauaaggacucuggcaacagaaacccugugugcucucagcguggcaaaggcaugaaaaaucagcuuccagccccgagaagcacuagugugaaugagccuauguccaaugccaggaaagucccugagagaaaaaccaacugaaaaaaaucaguccagcauaggccagcccagaggcgauucacagggagccaugugcaugcugacaagacuguccugugcaggcucggcaaccugcccuggggcaugcuucagggauucauaaaccaugaaguggcuuucagcaaccauguacauaaagaccaguucuuagguauagcaggguuuucccuguccaauuaauuuaauuauuuauacaacgagaagccugugauuagacagggaaaagggaggugaagaguugcagagacagagacggagauggaggagacaggcaggggagaagggagcaagauggaggacagauucaccauggcuuuaaauagccacagguagauauacuaucauauagggauagaauaauugggguaacuugucuaaucuagguaggagcuuguaucauuaucaauuggcucugaaauuauuagaauaauugggguaacuugucuaaucuagguaggcagcuuguaucauuaucaauuggcucugaaauuacugugugggcaucuuguaaauugagauuuuauuguuauauaaaucugaaugguuaauuauaaacuucaagaguuuugauuuuaccuguugcugguuauggugauaucuaaccuccaggcgggcaguuauugaauggggcucauguggaaaugacuugccaagggaacuuagcuguagcaauguggcccgccagcgcucaauguagcucagaaacuuguuggaccuuaggggccucaguggggcccacaggguuuucuaagcacugccacacuggaagaagacuuguacaucagcaucagaacaugaaugcaucugcaucugcuuccucuacuccugugaaaggguggucuggaaaagaagugagggccaaggcuguuugcuuugaggcaguguaagugggucugaggaguggaccaggcaguguggcuauccagagcuggucuaucaugagaggcuuguaauacagggcuccaugccgacaggcagacugggccagccaccuuuuaaggaagcagggucuuacugcuacuuagcacugugauguucaucuaccuacaaacucuuccuucauauaggccaugugucuacguuaaccuuggggaaagggcucaaaaaaauccaacucuuauuccaacaaauacaugccccuugccagcagaaagggacacugaguagugugcuuaaugcauuacucggugucugccuucucucuauacagagucagaaggaaguggagaccucacaugcucucuaagaacuuaaaaacuucagaggucccccucuuuagccagggaccccugagacuuucagaaagaaacggcaggaggcucuauccaucauccagaauuccaggcuugaugcuguuagaguguccugcuguucucaagcaaaacucuaggaaacccaggagccccaggagucaaauuucaaugugaaaccaagaauugucaccugugauuuuaaccagcaaagucacaaagauuuggaaccuggauaggaggcacuucauggaccccaugcccuucaguucacccucagcccgggcuccugcacuggccugggacccaguaccaucuucaucuacucuacucucccuccuucucuccuuucccccuucuggcaauggggauugaacccagggcuuugugcaugucaggcaaguacucuagcaaugguccuaacuccagcuuugucauuucuuaaauucuauauucugaacucucucaaaaaaauuauagcacaagguggacacuaauaaaguucacuuaccucauggauuuuguucucuuuaauuccuauauuuuuuccaucucaaauaacccccauggggauguuagcucugggcagacgggacacuuucuguuagguaacugcuacauucccaggccaacaccgaguacugugacugcuggucaacuaauguuuauuaaguggcuacagaauguauaaacgaauaaugagggagggaucguggcuuaguuucugggaagagccagguuaaaaugaaucgguuagugcugcugaggccuuugcucuuauguguauggagagaggcagacacagccgcaaggagagcugggcagacaggagaggacuuuguggggaggagagaaaacacuggguagaaggcucauuuuaggaugaauggaaagcuuugccuugaagcagagaggugcugacgaggaagggaggguguggggacauaaaacaaaagcuggcaggggugugaggaacccucugugagccuggaaccaagacguaacuauuuccauguguggcaccuggaugaugcccgguguggacgcucuacacagugcucuguucucacugcuggacuuuucaggaguaggucugcaccuuuaggaauuuggcccuuuggaugugugcaaagccuuucaccccacaaccuacagggaugucaacuguuuuuauauucucaguugggggggcgggcugguuuuauucacuauguagaaaucaaagcccgcccuuucagcuccacaggucuaaggaccggggucuccgcccucacccaagaaccucugggcucugaauuaucauuuauaucccccuuuccacuaaaaguagaagcagcaauguuuuuauugguaccuuauaauguuuuuauaugaggcaccuaaagcuucccuuuuagauaccgaucacagcuguaaaagguuucauuauuauuuguaggugguugcuaauuucccccauuauauuuucauaaagaaaauacacaauaaaggggguuuuauuaauauuuauagccccuguucuuuugauccgugacaaacugcagaaagguaauauucuaagcauacccgacgcguaaaacucuuuggccugugauuuacggguggucacacuucccaggcgacaaacuucucugccugguuauugccugggaugacccugagggggagagaccccagccauagguuauuuccugucagugauguuuauagcauguguggaaauuucuggaagccgaacaacuauuuuuuuagacaguaaaagcugaugcuuugcaugcgaaaggaggcagugucauccugagacagggaggagcggagcugagacccuaaggccagcagcuuguccaggcuggggacagcaggaggguggguaggcaggcaggaugaaagccagggcuggggacucaggccucgagucugcagccgcugccuaccucggggcuggagcagugcggaggcuugcugcccucgcucucgcuggagcuggagcugcucuccgucucggagucggagccggaagugcucucugagucgcuggaggagcugcugccgccgcugcugcugcugcugccgccgcccuugcuggauggcgccgaaccucuacaguuggucugcugaaccacggagcugccaguccaccaggccccccaagaaggaaagggaaagaaagccaaaugagcaaacaggaaacaccagcaggcugccauccuggcaaaggaaaggggaggcacagacugcacacaucugucaaacaggaccuggacucaggacaaccauccaaaccaucaaggcccagagcagccaaaaucagacaaaauuagacccagaaauaaaacugagagcgaacagugcccacucgcuauugggcacugguuugaugcguggcuacuuagagggagguggugugguacucucggcuuauuucaagguugcgcuguucguucugagaacggcuuuucaaaugcgccucuacucuaaaaacccauacagauucgagggacucccaagaccucagaauauuuugcaaaccgucaaaaauaacucuguuuuugcuuuagaggaaaaugucuaauggcaaggaaacugcagaaaggccacaggguucuguugugagccuucauggcugcuggaagauuccacagauguggcgacugucaaaaguuagacaucuugcuucucuccguuuuuccauuguagaguccagugcuguggucguuauggaugcuggcauggugugugaacaguagcuuugcaguccuucacaaagagccgaugaucuuucacaacauuaaaaaaaaaucacuccuauaacagguagaaauggcauccucggcugacaccugauaauuacacacgugcuagaaucugccauguugucccuguauuuucaacaggaaaauucgauccacacuuuuucaaaugguagcucaccagccacaaaaauucagguaucacauauccaucaaggaguacauaagucaaaaagaaaacguuagugugcucgcacauucauugaaacauucacggaugcgucccucuuagcuuaaauucuaacucagaaaaugcuggucaccuuugaaguacugaguuagcaaagaguuguuggccacuucccaacugugaccacggcuucaacagggcugacuuccacggaggaugugucuuuggagcuccuuacgguuuauggucucgagugccaaggagacggagcauggcucaggaccccuucacccaucccuuagaucucagaaugucgucuaaggguaaucucagaggagaucugggaggagggaaacacuucagucucugcuucucuuacugaagccacaggaaagaagagucuuggggacucuggcaaugaaaagcaccuuucugaaugagggacuuaggggaaaguggaguucaaacauaaacaacuccauugguuuucacuccuuccugccaaagucacgcaucguacguccacacauacuaucugcccgaauccuucaacaucagacaauugcaggcucacaccuugucucggcugcacagguuuuuauuuucauccuguuauuggugucuggcauugaggaaagaucuuagauuuugagauggagaggagaaggaauaguucauaaaauauaucuuuuuccucaggaugaaaaucuaccuccuaguuggcugaaugaagugggguggggcuuguauucagcugacaugacaucugggaucugcacuaauagguuuuuuuuuuuuuugauuggcccacuaaaacacugggacagacagacagacagucagacagacacacacacacacacacacgcacacacacacacacacacacacacacacacacacacacacgacacgugggaccaugcuaccagacaggcaucagaacugguaagguugaauaagcucaauuccagggacucucagagauuugagaacgguaggaauggagccauucccuaacugucucuguaccuggucuggaugaccagaucuaggucuaaugagggaucuagacagucuugagccuucccuuccuggguauuccuuucccacaaaagguauauaauuccuaggucacccugaauaaguguauauguuuacauccaccaucaaauaaagcaauauguacaagcaaggaucgucccagagaacugcuucauuaaggaucgcagcagggaagacuuuuucucuuccagccccuccaguacacuuggcccuugcucccaaucagacuggauucugcucaucccggguuccaucggaacccucccucaugugacccucccuccccacaccucugccuggugcguaggcacccugagggaaagaguagacuucagaccccugguucccaacucccucucccagugguaugcagguacccagaguggagauugggaaccgcuguggacuucccauuucaacuuugcccugccuccuucuagugcuucccacccccaguaccucuucccaguagagagauaggaugcaguaugacagaggcacacccagagacacacacucagacacagacacauacacacacacacauaguuagacacccagagacacacccagacacacacacacauacccacagagacacacacacucagacacaugcgcagacuuauacauagagagacauacagacacacauacacauauacucagacacaugcacauacacacagacauagacacacacacacacacgcagacacacacacacagacgcgcacacacacacaaccaucaaaagcaacaaaacuacaagcaaaguuacacaugguccggaagcguuuuccuuauaagaggauguggaaagcagagagcaaacaaagauggacuccuuaccaugcucuaaagcagugacuuucaaccuguggaucaugcuuuggggggagggggccaaaccacucuuucacagggguccccuaagaccaucagaaaacauggauacuuaagauuuacaacaguagcaaaauuaguuaugaaauagcuggggguuccuacaacugaggaacuguaguaaaggcagcaccaggaaggcucuagggugagguuugcugaaggcuaggaaauaaagaugaacaaagauuauuuugaucgguuuuauaaaauuauggucagugcacucaauaaaugcacauugugaauccaaaauagcccugcucaagugcagccgaggucucagugugugggugggacuccuuguggccugcaccgcacggggaggggcugucguuugagaagagagguuuucauuucuggggaugugccauuuacacagccacagacugccucccucugucacuaccccuucuucauguaugagacacgccagccaggacgaugcaagcacaaucagugaucugaaauagguuggcagaaaagccucgcacaucucugucucucuacccugaauaaacaaacacauuuuaaauggaauuuuuacuggcauaacuaauuuuuuuucuuuaaaaacaucugggagaaccaaggggacagauauuuuuucacaccuggcuuguaagaucugagagacucauaauacgucugagaucaugagugaagacucagacagcccuuuuaugauggguauuggcuccagaguuuggauuuaauggugaggugagacggcacuauguacucaguaggaacugcacgugaaauguucaaucugaaucuuucccugggcuugugacuuguccucuggagaugcuggguaucagcagcgacguuaucacaaggggacacagccgagaaucuucagucgguaguguucauagacuuaauauguuaacaaucuacacugcuuccaacuuaagaugaauuuaucuggauguaaucccagaggaagcaaaagagcauuugguauucauguuccucugaucugaagagagaaugcauagccaaaaaaaaccccaacuaugucugggcggagcuuagcaggacucagcuggcugucaggcugagagaucuauccaugaucuauucaucuaauccuguuccacaaagagagcucugcugaguggccuuugcaagcaucccuggggaacaacuggucacccaggccagcugccagugacuuuucuggcccugagugcaugcagcugcuuugccuagucugggcugacaguggggguggggugggguagggggagaugacagcaaaagggauggucacucacuccuacagaugaucacucaaagaaauggcucagaauaguaaggaagguuucagagucacagauucaggggaauaaaaaaaucagaaaaaccuuccugaaaggucaccacaggcuuacacuuaaaauuccccaaaugagccggguggugguggcgcacgccuuuaaucccagcacuugggaggcagaggcaggcagguuucugaguucgaggccagccuggucuacagagugaguuccaggacagccagagcuauacagagaaacccugucuugaacaacccccccaaacccccaaaugaaaaggccaguacauaccuugaugcuauguuuaucagggauacuuugaaaaguagacuaauaggcccaaacuuggcaaauuuggaucuccaagcauccaucuacaagcugggcaggugugaugguuuaccuguagucucagcacaugggagacagagcugguauccucuagcaagcuaacuggauuagccaaaagcauccucuagguuuagugagacacuccuuuucaauaaauaaaguaagauaaagagccaaggaagcuaccugacgucagccuugacccccaacacaccacagagacaaaccaaacgaagccccuccaaauuaaaagcaaagucuuuaggucacaaaagcuuagcacagcuuggcacaguuggguauccacaggcaauuacagaaugaauaacuaaauggaacccgccccccaucacugauuuaauugauguugacaaaccagaucucauuuuucacaaaguuuuaagaucuccugucucgagguaacacaaaugugagaggacuuuaguaccucuuguuguuuuccaauuuucaacauuucuuucuuucagaaauauguuuuaaaauguauuauaaauuccauuuacuauaacucaagcaagcuucccaguagaguuuguuucugucuucuauugauuucauaaacuggucugcugguguucugagugucugcacucaaauauuucaaaugcaccuuugagagaugcccagcuuuauucugggggauguauuugccaaaucccugccuuagucgacacugacacaucccuucuagaaucuggcccaggcugagucuaaauacaggccauaaaagaaaagaugcugaauggaaagaacacauccuggcucucacaguuaagacucaaggucucucaugccugccugaauaaaugcccccaagcugucacagcuucgcagggacaaaugacaaggcagggauuucugaugucuccugggauggugacacacgugcuguaaacacuuaguaccuuaguuuucucaaggauuccauaacaacucaacaaacaugccauuucccagccaccaccagggccugggugauggcaguccuucagugguagcaucuccacggagagcagcugaucuagagcuuccucauaucagaagugagaggugcaagcaggccaaggcacuucacuggagaaagaauucccuucccagauccaaacugauggcacuguaguuuuaucccaaaucuuguuuguuuuccuuccccgagaagcuacuucuguauuuuacauggcuugugaugcuccucacgcuuggcucauuaucacgucuccaguuccauuucaauguggcugucccuguaccaugaccacuguccauuuuuucaccaucuaaggugugagcuaugcacaugcuacacgcugugucagaaguccuuguucccucucuucugguuauuccuuuuacuauucucugaggaacaagacacaaugauaccucucccguugagcuuccccuaaugccccggauguaaccaacgcuuucuucucugguuuucucuggcacauuguucacugaacuccugaccacucugaugauuggaaucauuagaucaccugggccauauaagaagaucuaccauaaacaaaucucaaauaaacguagcuaugaaguagcucaagagauguauaccccaacccccauaguuuguuuguuucugauacuuugaggaugccuagguuuccauuuguacacaggcugaaaauugaaaagcuaacauagcaagcaagcagcacagaacgagugacauacgcaggcagguugccuauuguccagugguauaauccuggaccuugggcucuccaguggggaaguugugaggcuggagagucuugcauagcuuaauguguccccauccccacaauaucucugauauauagaugugagaguccaguagauauaagguguuuagacuuucuggaggauguccccagucccaaugguuauaucaguucuccugguuugaaaauacugguacuaaucugaaguuuuaacaacagguuucacugcaucguaggccaccuauaggccagggcacaggacugagaaucacagcugauaucuggucaguacucugaaagugugaguggcucuaguuagagaggacagacugauagacacucagcuaugauuucaccagggauucggacaagcaggcaaucacaacgaacuaaugcucauggccugccuuuuaaaaaaagauuuauucuuauuuauuuauucauuguauguauguauguaugauuuguguguguucugucugaugugggugcugagaaccaagcucuuagcucuuccguuuaacuacugggacaucuaucucuccagccucugacuuccaaaaaaacaaaaaaaaauugcauuuugagcugauuagugagucacuggaaacuguaaaaauagcagugaucuuccauguguccuuugcccaguuuuccccagugguuauacuuuagguaauaagauggaucaaaauaucaaaccagaaaauggcaauggcacagcgugggugcagcucuggguuguauaaaacuagaaaauggcaauggcacaaugcacauacagcucuggguuguaucacaugcuuggauuccugccaacacauggaggcgccaucgcuaaacucuauuucagaaccauagcuucuucucugccuuugccagagcugagcugauuccugacaaacauugaucuguucucaccucuaaaacucuguuguuuuguaaauuauacacuucauguagucuaauucccuuuaaaaauaagauuucuuccaauaagcuuaccuauguguauauuacuuuaaaaauacaaucgccacauauucugagacccauccaaguuacugaguagauauacugaguaguauucucuuacacgcguucgcgacuggccaggaaagacgcaacaaaccggaaucuucugcggcaaagcuuuauugcuuacaucuucaggagccagagagcaagagagcaagagagagaauggcgaaaccccgucccuuuuuaaggagaauuauccuccgccuaggacgugucacucccugauuggcugcagcccaucggccgaguugucgucacggggaaggcagagcacauggaguggagaacuaccuuuggcacaugcgcagauuauuuguuuaccacuuagaacacaggaugucagcgccaucuugcaacggcgaaugugagggcggcuucccacaguauuccauggucauuuaaccauucacccauggagggacauuuugguuguuucuaguaucaugccauuaaaaauaaacuugcuaucaauguuuuuguauaggguccugugcagauguaaauauccauuucucugugacuuaugucaaggaaugugaugacuaaguuguaugacaauugucauucuuucaacuacuugaacacuuaaaaaauucuuuuuauuuuguuuuuuugccugcagauauguauguaugugccccaugcacauguuugguggccuuagaggccagaagaaggcaugggauucccuggaacuggaauuacagaugcuuguuagcugccaugugggugcugggaaucaaaccuggauccucugaaagaacagucagugcuccuaaccacugaaucaugucucaagaucuugaauacuuuuauauuuauuuucuauuuaugcuguuauuuggugcuaaccuuucaugagaauugaguuguucaucacuacaucauguugugcucagccugugggaauucauuuugcuuuuaaguugacauuacuuggcacuaauauggcuaucucuuucucucuuuuuugguuaauuuuuaucucuuuuaaauuaaauaaccuaauagcuguauauccuuauggauugcaugaugacguuucaauacaugcauccacuauguaauauucaaaucagguaaugguauuucuaauguugcuucaauaaucagaugcaacuuucaaaguuuacaagaugaaacgugggauuaaaaggacuaaaauucauuauauagaugccugaaauguaugugaacaacauuuuaaagaaaaauaauaaauauauaagaauaccaaggggaaggaacauuucuuguaauuaugcuucuauauaaauauguucuguuuucuggauaugucaaggucccuuccucacugaaggcccucuuucagcagucuuuagccuuuaggguaguuguggugguuuuccuuaagaagugugucugcuauuccugaaggauuucucuguuugcagaaugacagauggaugguuuucuugguuuagcacuuaaaugauguguaacuuucuugauaucuccagguuucagaguccagugucaccgaaauggcuugaacuguggcccugacaugccuaguauuugccucucacugcuuaaaaaagaaucuauguauccauccauccauccaucuauccauucauccauccaucuuugaagacagggucucauguagcccaggcagaccucaggcuuauuuuauagcuauggaggaugacuuugaucuucgguccuucugccucugacuccugagugcugggauuacaggcaugugccaccucugcagguuuauauggugcuggggugugaacccaggcuucgcacaugcuaggcaaacuuuggacauacuguggccagcugccucaucuuccugcuuccauagcuacagcuaaucaucucucuacuguaccuccccugcuaccaauggacgacuguucccucaaauuaugagcuaagaugaaccuuccuuucuuaaggucauuuugucacaugcuuuguccagcagugagaacaguaacucaugugccuccaccuggauuucuuuggcuucauccuacaugggguuuguuuagcuauuggaacuuauagguuuauauuuguuuuguaaaaauugaaaaauuuuaaauauuuauuuuauuuugagcacuuucugaaaguuuuuuuucagccccacacccuuucuccacucuuuuuggaacccucaugacacauauguauauguacacauauguccagguuuuaugauccuauuacaaacuuccugaguugaaagcuaacaccugggauggucaugucaccccucagcauaucacacgaucagcaccgucuucauuguuaacuuucuaaauguaugcucaugaacagcuuuuaggucuaaucuuagaucaaguauuuacucagagauugcuuuuucacuaugggauguuguuauaucgagguuuaaaaaaaggauaggauggggaugugggucagcaugagagaaugcggagccuggaggauacccugggagcucuuguggaagaacauaaaagaggugacaugcagcggcagguagaauggcuccuguacaauggguggaaacuggguauggcuuggguggaggugaaagccauaaaguagacuuauauagcacugcccaggucccaaagggguccacaaccuucugcugcccuuagggaggguuaaaaauugacggcaaagaaauucagcaauacagacagccauaaacuuggacauuaaucgugcuauuggagcagcugggaugaugaugaugaugaugaugauuauuauuauuauuauuauacacaagccaccaaguccagagauguggcucaggccauggagccacaugcauaguccugcugagaauuugaggcuguguccauaugccagcgggggaagaucuugggggcuaaggcuugaccaguaguuucagauaccagagaacagagaugucaccucugggucccuggucaugccuggguuuguuuucuucauaacgcucugcucuugcaggugagucgggcaccagggcuuaggaaucugccucagcagugccucuaaagcauucuugaguuuaagagccucagguucauggcaccucuaucugacuacugauauguguuaagaaacacauguucuuguguucugggguagccccauguuguuacugugucuggaaugguccugcguuuucgcaggcuuuucuuuuuagaacguggugagggauauugucgucauccugaugaacccagacacaaaagcuauggcuuggugcucugcauuacauuauauacuuuuuacuuucaucuggguaaaugaccauauguagccuagccaagaagaaaggcaugcuacaaagaaaggggaaaauacaauaaugugcaaacauuccuuggcucucuccccaaacauuccugggcuuguugaugguuuuuauggauaauguacuauauuaaauauacuauuccucuuaaaguucuaaaugccuuuuguguuugaauauccauuucuuuuuauagaugugggagaauuucaaugauaauuucacugucuaacuucugagugccucaauacuuauuucaguaauuucugcuucuugucacucauccagggaguaacaugacuaguagcuuaccccaaccccccuucccuucaaucuuuacaaauauuccacgacugcauuugcgaauucagagaccuuuaccucucacuuugggagggaguauuuuauuuuauuuuauuuuauuuuaacuauuauccuugcuugugucacagagguaacauugaguucagcaucuugaacugaagucucccauuauccuccauaaggcaaacugauuaugauacacugauaagguuucuaauguuuuaaacauuaaaagaaauucaugugaaagauagcuaugcuucuuuuggaaccuauaaacauguuuggaacacauaaacauucuaaaacauguuuuggaauguauaaaauaauauuuacacaguaaggucugucucagaagucuccauguaacuguuucugugacuauguugagucugcuggcccugcuuucaggagggugugcccucaagagggggucccuggacuuacuacuuggaagaaggcaugacagacauacuuugaacugugauucaagaugggggaagggccuuggaggaaguugggcuagccccugcauaccucaucucugagugcccugggcuggcuaaggccaggacaccuucucaugacuuacuugacaaggugagugcugcauucucuuucugucuuaggaacuauuugagagacagggccaagaagcagcagcugucuguagugacacaccuuugcacccuuuggauuuggugauguguuaaaaaagugucuuugucuacagugacaauucaugggagaacucaguauucugacuggugacaagaacugugauguagccugggaccugcguggugucaagagagcggggaccugcuaguacaacuuguccccuggcagggaaggcugaggaugugugugaucccaggugugcgggugagaggccacgcuaguaggggugagagaggaggccaugcuaaaggccugggcugggucacacuccagcuguccagagccagugguguuccgcaugaacagacaagcuuagcacguuucauuugaccuacucuuaagaacagcauggcugucugccuuuauccacccauuuguccccaauuucguuacuguuaaaagagcagccacggaaugucuccaaguccacugcucacuccucagccaccugcagacaaugaggugcugagagagagucugggcugugguaauuuacugcucuccccuucucuccaacuguucucugggauguacccuggaucuguuuguagaagaaaacucaugcugaaggacauauucaagagccacgaguccugucagccccaugcccagucaaauaguucaugaagacaagggcugucccuugagaugcagcucuggugcccuucagcaaccgcaacauuuacagccaugucccauuagauacucugccacuccugacuuauuuauaggguucugaaauucauuucuguauguuuuaagcuccugaaguagugcagccccagacugcugccccaugggaacacuagaauccagguggugguaaaaacuuacccaagcuuguugacuccauuuuaaaaagcagcuucacucagacacgguuacuccuaccaccugcuuguuauuuuucucuucuaacuuauuuucuacuccuucgaauagcgagcaugcuuacauucauaagguuauuuaaaagcauuuucaagcccuucucuugacucuuucaauaaaccuaugacuuagguaggaaagccagcucuagggcaggguggaggaucaagggucuguuccaggucauuguuaguaguagacagaggcuagaaccuggccuuggcuucuagcaccaugugcugucugaggaguggauuagucccugaaaaugggaacuaaucaguggcuuuucuggccccauuuggggauauuuaaauaauuuugccauguaggaaggacuggcacacaggcuuuagaaucagaccugaauggacuuuugccuacuuugcuuaauggcugggugacuuuggggaaauugauaguuaucucugagccagauauuucaugagaaugaaagggguaauaauugaacaaucuuuauaggguugcuagguagcccaaaugagaaaacacugaguguucuuagcacggaaccuagcauauaauuaauguuauccuuuauuuuuaaacauagcuaauauuaucacgguagccuaagaaagaccaagcagcccuuucuauaguuuaccuggauucuuuauuaaaauuauuuucauuuugauuguuuugguguuagggauuggaucuggggccuccagagcuaaugaaaaugccgucuaucaaugaacuacaucccuggccugaguugagccaguacuuacuuacccacacuguccaucugguauuuccguggaauuccaccaugccugaucaggaaggggccgacaugaauaacuagcauggcgugaaugucagcaacaccugcccaaugagccugugacggggccucucagggucuccucuaggacauuccaggauguccuagugcaaagccuggcagcuucaaucaagggcaaagggggccacgagaguccugggaaauggcagugccugguucuuucucugaaaugaagguuggcagcugaaaacccuccuccucacuuaagcucugaaaauaaaccaauuccacaucucugcuguguuuuaaagcaaagccagcaccugagugccaccagccugugacguuuaauuuauaucucacucaggggcacaggauuuaaggacggggagcuuugggggaaugucaggggaauccacgcacagaaucugagauccagacuuguagcugaauccgcucaagcugugcucuugguaguugucgcaaacggagcuggguuuguucccugggugaggauauuccugcuacucagguaggucugugggaagugccaucuagggccuagucaaagaugaggucacucagaugacagacuguaucuggaaauagggaucagggaccacaaccaaauaagaaaagcacaguggagacagacauguuucaaaaccagaggccccaaggggaguguuugcaggacucaucaguucugagacccaguggcucagcccuggaaacagaggcuucucuguguuucucaaggcugccccaggcuuguguguaggcuggaaccaccacacauaguaggcagugcacaggaaggaagcucuggccuggcuucucauuaagccuaccaccucuucuguaucacuugcuugaauucuuguaggaccaugaaagucagccugguuccugguugagcuaagguuggaaaccccagcgacccugaggaacggcagguguuuugccugguucccagauacuaggcuccuggcacgaggcugcagcacuccauagauuuguggccaucagucacauaagggaaacgccccaagucccuucacagguagaggaugugugaccuguggacacguagccuuaagacagaucuccauuuuaaugagguaccuaaaggucuggagacuuagccaauuaggcuuuccuuuccagacacuccucucugcaaaagguauuuaaccucagacccacccugagaacugggguacgguuuuaccuauccauuuucugccacgacaauaaaugccuuaaaaccauggacugccucuuuucauugggaucuuccauggguugccauagaguccugucuaaucuccugugcaaggccucucugugcucccagccacaaccaccaugccaagccaggcacccaccaacaagccaaggacaauucccacagaacccagccggagcucuccccuuuuccucaauauaagucaucacccaucugcucagaacagccccgguuccuguggucccacagcauggguuccaaggccaggagcuugguucccagugagccaauguucugaaguguagcgugguggugauuuggucacggggcugcugcacucugaagugauuaagccaugcuugaagggcuggguuaggucuuucaagagaguauuguuauaaaagaacacauuuggccucucuggucucuugguuccucauuaccacacaggcccuuccugcuccuucaucuacuauguuguaacagaguuggaggauaucugcuagaugccagcaccaugcuguuuggaauuuccagugaccagaaccaugagacgaauaaaguauaaagcccagaaauucuguuauagcaacagcaaacagaucaagacaagagccgacaggguaagcuugaugggccaucuugguuaagaucccagcagagccauuuggucaagagucuacauggcugggucauagggccagcuguucuaauaauacuucacugugaguuucaacuuccuuaucuuuuaaaagaagggcuugaaguaugugaucuuuucuucuaguagacuuggagcaaugcauaguuacauaguuaauuauuccuauacauaguuacuuauuccuaaagcugacagauccuagaauuucuaucuaccaguuaagauuaaguucauuuuaaacuccuuuccuauugcccagguaggcugaugaguagcugggugugggugugggggggaggggagggagaauggucagagaccacugcaguggggguugcagccacucacuacaguuaauagaagaagacuauacaaugcuuccuuguaacucuuccuauauuugccuauaggaguaucaugcaacauuuuggccuaugccauuaaguugcuggcuucacugccucuaguagccuagauaaaaacugacauucccacuacuaauaaguacaguuggcccuauguacaugggcauuccacauccagagauccaaucaaucauaggacacuucacauccauagauccaaucacaggacaccccacauccagagauccaaccaaucacagggcacuucacauccacagauccauccaaucacaggguacuccacauccauagauccagccaaucacaggaaaguucuaucacauacucuguugugaccugagggaucugagaauuagcagguguagguuucugcaaaggcauccugaagucagucccuaugggggcugacggauggcagugcucugccucccagauguaggcaacgugucuuuaggaucugaggcugggcuuuuggacacucagcuucaccaucacagagaaugcaagcaacaugguuuucagaaaugacacugcuccaugcgaaucaaaauuccauaaagcucucaccccagccccaccuucucugaugaagcccuucuagcagggcugagccugcuuuccagugaacugugcucagaggcaggaaacacagugccagcccucgguugagcaggugacuccgaagcauggagacaguccucguguacgggaaacuccaugggaaacuuagcuuugauauucucaucagaauuucucucuuuaaagggguguucccuccucaaugaaagagagguaagcuggagccucccaggaguuaggucauuaauuagacacuagcacacagaacacuguguaccuggguuggcaucugggagcaaaauguauuugagaucuuggaaugacaaagagauaaaaauuuuaaagaaauacuucauuaagauuuuaaaacacuaaaaggcaggcuguuccuaaugacaggccaaucaauacacccaccaucguccucaucccuguagugagaauggcuaccacuacucagaacaaaauguaaauuugagccccuuauccaaauggcaggaggaaggcucacauuacacccacgaggacauaagucugccucuugcauugucucucaguuggcauaacauuuuuauuuguuacuucauguugugcucuauggcugccauaaaggcacugugaccuucacauggggaugcaccaggcuccuagguuaggcuggggagaagcucaaucccacccagucacccacuggacaagccaucaugcagacagcuuguagcaggacauugcugccaugccugggcacaggugugugggugcccugccaucccgucacaccuuuaugagagugaugacaggagggacggggaaggcuggguggggucaggagccugggcaggggagcugcuggcugagagggacgucaugugacaagaggugacuugccuugaaauaugcuccaccacugcacuggaucugacaaaucaaagacagagcuacuaagaacuucaacaugucaaccacggagcacuaguaaggucugucucuguguguguguguauguguggguaguuggauagauagaugucugaugaagaguccuguaagaaugcacagguaucuagcuguucuuggugaagccagagguuucuucuguguuugucuuucuuuaaaagccaugccccugagaucccaaccuuccaaacagcccaggucccaucuaacaccuuccagcuacccaucugcccgaacgccucuggcugcucacuaaggcagagagggagagacucucccuacuuggaaacaguuucagaagcucaaaagaagcucuguggagacagggcuugaaauaagcuggcucccauguaauuaaaauaauuaugaaugaaaauuacuacuuuaguaauugcuuuauauuauauuuacuacaguuuccauugugugacuuaucucauuaauuacugcuggaaaaaguuagccaaugaauaauuaauacuaugugauauccaagggaguaaucguguuuaagaaacagaguuugagagugagcaucauccacagcccuacuaaugaggaccccucagagucaaaccacgacuugugaguaagagccucugcuuauaaccugccgugacuagaggucaacagaaacucucuuuauccugaacacaacuggaaacaggucugaaauucucaggggcgucugcuuuaucagaagcagcccucugcauggcuaacuugggaaacauacaaaucagaguagcucucaaaaugaacauggaucagcaguagccuacguuccaaacaaaucgagagucuaguguuuccuaucagagcagguguuggcggaggagagaggccaggaggccaggagccucaaccugcagccuccagcagguuccauauguacuucauacauauauaugcaccacacacacacacacacacacacacacacacacacacacacacacacagagagagagagagagagagagagagagagagagagagagagagagaaucaauaggauaagccagaacuacaauguuuauucuauuaguucuucaguugugguuuugacuggggcuggcaauggaucccagagccucagacucaccaaauguaugcucucauguggagccaccccucccccuuuucuucaaagaggggaaucagcuauaaaagaaauaauggaagaacgggccauucucaucgcuucaagaucccaaacuuuuuucuuucuuucuuucuuuuuuuuuuaagccaagcauuuacuauuucacuuuauguuuagaaauuguguguaugcgugugggugugcacguauuagugcccacagaggcuauuggauccauugaggcugagucauagguacuugugagcaccuaguauaggugcugggagcugagcucaguccucuggaugggcuguaugcacucucaccugcagagccaucuccccagccccuugauuuuuccuaugugauuugauggcauuggaauucaaacuuggguugcgugggauugccagaugaaaugcaggacaccuacugagacuuacuagguacagucugcauaguaggcaacuuuaaagaagccauuuauaccaugagauuauccauuguucauggauacucugucuacuuuaggucuauggcauuucuugcccaucccaggucaaagcauaugugcacacucaucaaacagagagcaggggauggagaugacugagagaggaagaugaaucacacccagaaacugcaucauuacuaacugccaccgucugugggucguauggcaggguuugaggugggaugacaggccagaggauuaauuacaguuaaucacagacagggaaaguccagggaccugggagacucguccuucaaguugcuggagcuguauuuuaaaagcaauuuaacaccauccuuugugggggauggaagaauagucagaagauggaagcaucacagugguaaaauauugugaguccacuccgaagccauaagauucgggguuaaugggcuucucucagaacuuccgcauuugcagggagccuuacgugaccauuuuccuacugacauaaaagcuguuuguggcuugaugacugaaauacccucuggcuauuucugacuucugaaggggucacaggaagaggccagagugucuauaaagaagaguccagacagcuguggcucugcccaggugugcagaaugcuguuacuuagggguucugcaggcaugauggcuggcacagccccaccuaccuuaagcuacaaucugcagugcuuguacaguaagacaaggggaguugcaaucuuauuggcaaugaugcuggaauuuaauaagaucucacuguaaucuuuuacugaaaagaaagcuaguucugcaaacccaggcuccauuucgcaggcucgcgcuucuugugggauuuuauucguauacuacaaaaagguaauaauuccuuuggaaagcaagccacccccuuuacagcauauguauuuauuugugugcugaggauugaacccaggucuugcaccugcuacgcauuagcacuuuaucucugagcuauaccacaggccacgcucuacuauugcaacagaugcagcuugccuuuaaaaauguggugugcaggcaugccguuaguuugucuguucacugagaauugaaacaguguauaggguggugucuugcucuguucugaaugcuguaagaaauaucaccgucugaguggcuuaaauaagauacuccguucuugcaguuaugaaggcugugaaguccaaggccaaggugccgacacacucauuuguuggugagaacucuuucuggcaugcccacagccuccucagcgugccuacacaacuucuucccuguguaugcuuuuuaauaucaugggagcuugugcccuuacuugaaucuaauuaccuuccaaagcucucaccccuaauacuaugagacugugcguuaggacuuuaauggaagacucugcaggguugugggggcacaugagaccucaccacagauucagggacuuguaaggccaucaaaccagguuucacugcugacccuuuuggaggcuacuucauggcugggcaccccagagagacccccaguagaggaccuucugggcauacucaucaccaggugaagggaagagccugcugacacgugauaggaaucaccgagaagcucacaaaggcaaccuuggcacaggagagcugauaaccaaguaaacccuacuguggugucagaaaacagaaggccaucuauagaagccacuaaggaccugucacagccaugcagaguuaaggacaugaucuucacuguucccuugagaagugaaccacaguacuagaggacaguuuuuuuuuuuuuuuuuuuuuuuuuuuuuuuguuguuuguuuuuaaacuugagaagucaucauacuucagcagucguaccacugggaaugucacagucaaggcacgagggcuccgauuucucuacagccuugccaacaguuggugcacguuuugaaaaaccaagcacuccucaugcugugucaucucacacugguuuacccagcagaggagaugccgucuuaaacuuacacgagagcagaggcaugagucugggugcacggaguuacauguggcuacuacaucuuucagaaccacagaagccaagggugcugagcuucaugagacacacacaccacagucuccggagggauccagguccaguucuugucuaucauuugccagcuccugaucuccuugacugcugcuaccuuuaaguaaggaaaacaugcuggacagucuccagguaaccaauauggcuucaguuggaagauuaaagucucccuggagguggggcuuaaaugagcuggagcuucauguaauuaagagaauucuggauggaaauagccaguuuagugacuucuuuuccacgacgcuauuuacuaugacugcuacuuugaaccuucucuaauuacuuauaguuagguugcuccuagcuuggagguaaagaauuaagagcagaggaggagcaggugcucgacucugccuuuuaucgccaguuaagacuaagcuguuuagguggugcugcuagguagcggcccuguuacuaggaaacaaguuuuggucagcuuuagcuuuacaaagcucaccccuacgcaggcacgcacgcaggcacgcacgcaggcacgcacgcacgcacgcacaauaaucucucccaaugucugcaacacuguugcaagguggacagagggaguugcuacucuucccucugacaaagcucucuucccccuccaauaaucucucgcaaugucugacacacuguugcaagguggacagagggaguugcgaccuuccccucugccagggcgggaaaagccaccgagaaaucaagucagucaucaguauccaggcuacacaucaggcugugccggaugugcccagauuugacguguauuuccugaaacuugucaccuguggaaagcugcuugaucucacaggggugaguaccaccgaaggacaaguguggauggauggccaaaaaaggagggcugacuaugggaaggguaucuaagcugaagcuugggaagguuuccaaguagguuggaggaaguggcaggauggagucagggaagggaaagcauuccaggcugaaggaauacgguguguguguguguguguguguguguguguguguguguguggcuacguaugaaagaaugaauaguucuguggcuaaaucacaaaaugggccuaugacagagccaaggcuugaaagggaccuaggaaacaauguuggcugagcucuuauuacugaccugagauauccaaggagcuaugggguuuccaccacucugaagcuucgccucauuuugcuagggcaagaaaguuggcauggcuggucuccaaagcaaugauacaugggugugugcacauuuagaaaacaugauguauauuugaauacaauuucuuuccuuucagaguaccagugaauagauccuaggucuccagccagcuggaagaagaaaauucuccaaggaauagaaaucuuaggaaacaguacuggcuugcaucuucuuccuccccuaucuaaaucugucugaguccaaccaauuccccuuucaaaugcuucgucaucuucuacuuuaagcuuagagcaugggaagauagcugacauuccugcaccugcuugcuuggauguaacaaggcuaggagaggcacguuguaccacauaaaucuccagcugacuauaucuucuggggcagagaauggagcagcccucguccccgugugaagcacccaggcauguguugugugugauucaaggagagcugaaauaugcauuguuuuaagagauuaaguaggguggagaggaacccgaaccccgggcaaccagccuguggugaggcagaccuucccaguccagggccacauauccccugcaaacuguggacccaguaggcaccaccccuuucuguguccauuaacuuuggguggcaagugacucaacaauuugaagcuucaguuucccauaugcaagauuuggacacuaaugcaugccgcagaaggcugucuguugaugacauggcauggugacaggaaggugcccacgcauaggcccugagacauucagccaguauggccccccaggaggucagagguaaccuaccauccagagagggagaguuaacaaugugcuuugugcccaucuuuucuugcacacaggaacucguguccuuucacaauuacauaaaauagcuaggacagugacucaaagaaaaccuggcgcuccuucguaugcucucuccagugacuaacaccucaauuugcagugcucauggagugguguuauuugccuuggcuccucuuaggucuaggaucaggcaagcugaacaggggagacuugucuccauugaaagaugaagagcugugaccucaaguggcucgcugacucccuggcugugaacagggggaacaaagccaagaagaggcaguguuggggagcggcagggucuccgacucagcccaggcaggucuucagaaagcacuauuugauuugcuacaccagggccagcaagcaggcugaccuggccugugauauuuaacaggggccauggccuugguuaagcaagccuguuucaacguuuuagcugaacugacuacagugagcacagucacacuggauugauucccucucucacgaugagagggauaaagagcagaauacuaugcaaaagaagacagaauaauuguagugaguccaaggggcaaggccgagaaauguacuuggaauuugguagaucagaugguuguucuaaaacaucuggaauauacucugcgugguguauccugaagggacauaugcugcccagagacuguauguugcuugccagggugaggacaugauguggcugccagacacuggccuaagaaccagcacagggcagggagcugggcaaagugagaaaggucaggcugucccagccaucgggagcacauuaaccuucccuggcagcagggcacuguaguggcuccaaaucacagucaucaaaggcuagcuagcuagugcaaacagccagcgcucggccaaggcugucucagcaaaggaugaaaaagagcagguccuugggaggggaggacuuggacaggggcaggcccugaguucagaguagcagcuggcuggacagucaggucucauggcugugugauuuucaaguucagagagacacuuggccaaaggacaguucuggagaagguccugugugccaggccaguaaagccagagaagaagacucugugggcuuggagauguaaaacaaaaucaagccaaaggcacugggccaugauuuaaauaaauaaacucccguuauaaagagcuagguaguuugaguuuugaacaagacacaaaugcaaaccaaugaccucagacuaucaaauggcuaacauaccguuccagauguuucucuaacuggcuugcuguggccccagcagguucagaaaaccaccugugcacuuaggauguaacauuuaaaaagcuuuucuuguuagauauauaauuggugaguugggaagauagcugaguuggucaagugcuugccagguaagccucaaggugugaauucaaaucccagcacccaugcaaaaaaagucaggaguagcucuuaucucagcaccggggaggcaggggaaucaacccagaggcugggcagucagccaagacaaacagaaucccaggcuggugagagauucucaucgcuaaacaagagguagacagcucaugagguuguccccuggccuccacacacacgugaacccacacccccauauaauauguuacucuguggucucuuuugguuuuaucucaauuucccagagcaaggucacugagacugauagcacaggccgaaguucaaggcaggcagcaacuguauguugccauacucacuaguggucaguuuaaacauucuaaaauaacuggcccaguaacuaccaauuaguaacucguucucggcgggacaguaagucuguaaucaaagcaguuugucaacaagguacaggcaaaagucucuuucagaaauauauaauuguaaaaagucucuauuuuucauuagauagcugugacacagaaaacaugcuaaucacacaauagcuuccccccgccccagcuuuugcacugaagugccacauguacuguuuugugucaaguuaaauaagaaauaaauaggcuacaaacauuagacauacagaacauccacuagccuugguuuagaagggacaaccccaaggguguuaaaaggcacaggauaugcugaccaagugacaaagacuaagcaaaaaauaauguauaggacugggauuuaaacuuagcaaaugucugaggauguauuugauaggaagaggacgcagugucggaugacaauguguagaaaugaguaguguggucuaacugcccuggcacugaggcgugaggaccuggcucccucugcucccuuugcacaguccucagagcacagugaugcaccugaacaagggugacaauugguuguguuacuucacagucacaguggcugggggaguaggagagggguuggcucugcucuauccccagugcagaaggcuggggucacuucuaacucuaucugagaaugagguacacagugcuuuggugggaaccuuggaaccucaaacccaggagaggacaccgaucgccugcccuauggaggagaaaaggccacguuggucaaaacucuuggagcaccaacgcuuuccccaaauucccaacucgacaaugcuuucugacucaguuccuuuucagagucugugguguauaugugugugugugugugugugugugugugguguguacccaauacaguaaaaccaauuguuucucauauaccuuacacacauauucugaagguaacuugagaugauguuuuagccacgcacagaccagguuuccuaauaaacaaucuuccacuugugguguuaaaccggugcuccagaaguucugguguuaaacuggugcuccagaaguucuggcucuuggagcauuuugcaacugagaauuuuuggauuagggaucucaggcuguaucuacagaacuguucauuuucuuuguuaagcuauagauuuuuuaaauuacuauuauguaagguccauaauaccuauuuuaaccauucuccacacaucugcucagugguaucaagugcagucaugcugccgcauggacgucaucaccacauuauucucuuuaaagaagacaaaguuacgucacccaugagcuggggcucucagcaauuguggacauuaacuaaaagcguuaaagcacuuucacccagaggacccuccuugcuaaccccucccuggacagacaucugguggcaagucuguauuaauucucaagcauucucaaacccacuaaaccaccguaaagggcaauuaguggcuuuauacaauccguuauuuauuuacucagaagacuaacuucuuccuuggcucucuucuguugugugaauacaugccugggaccuuuuaaacuguguauuauuuaccugauaggacucaaugguuucucuggagccauuucauuuuauuguggaaauuaguacuggguuggggggaauguuaaagcagaguucuagacucucuagccugugcacuagccucuuguuaaugucguguuaaugcagcugacugggcuaauagccacccgagggccgugagggacaauuauguggcuuccaucuagaagggcggguggagggucucccuuugugaguacugauggauggauaucacaggacccuguuauagaccagagagacuuagcauuuauggcucuguacauggccccacacagugguuuucaaauaaugaggauuaccuuacucugggaagagcuucaguaaaugacccagaggagccuuccagauagcugaagugagagggugguagagacacaagcugaggccaggucccccucagagguacaagcagaccucaucuaggauccuggcuuugguguuuuaggagagaaaaaggcuagaucagcguuuaagauguaaacaguaaauaaguaaauaaauaaagauuaguagaagaagacaucuuccuuugggagacagagcaguugaagaaagugcugcucugugucucagaccccguggagcugcuucuagucccucccuccccacagggcagagccacucucuggauacccugaagccugacccuguucauacagauaguccuugugcuccacuccuggucacgggcacugaugaaguuuuccuucaugucacagcuaaaaugcccaucggguccccuuuucugacugcuccacauacccuaccaaggucaccgauucccccacggcuugaugggggcuuuccuugcugaaguggcugaaagcaucagcccuggggucggagaguuugucccaggggucugagauguggagggaaguugcucgagucuauuaauagaaagccaggugcacucaguaggauuuuuagggacagcaguuuuaggacacgaaaggaagugggauccuauugacggcagccccucuguauggcccuaauguugaaucuuuucuuccuugcugagauggcugugguccucaggaugcugacacacaacuguuccaagaggaacacugugcaugcugacacaccggaccauccucucuuugccgaaugccaggcuccuugggagugggagccacaaaugauggaucuugguauguugauccuugaauggugccuuacccaguguucagguucagaacuguaaauguucaccaaauacguuaguagacaagaaggggacauuuuaagucuugccaugauacaaaucacugcaaugagaguggggauggggcuacagcuguggggguggggcugcacucaucaccugaccucacuuggugccagaaacuuucugaugagacugcaggaucuucucccugucccuggguucuuaacuuacucuacucuaacuuaagcauugagcaguuuacugagacugucuugcuuacccuuggacugauuuugcuauuauuaauuguucagugucucucuuguuuuauccauguaauagcugaucaugucgcuugacucucaagcaggcugguaccugccugaacucccaauggugagucccucugcaucaacuucuuuucaaggcacucuaucacugacauggaguuagauucagaaaaucauuuuuuacuuuaagcccagaguugccucuguaaccacaaaccacugguuugguucggcauucauucauucauguaugcaugcauucauucauacauguauucauucauucauucaugcacucaugcauucauuaauccaugcauucauucacucauuugugcauucauucauucauauauguauucauucauucaugcaugcagucauauauucauucauuuagccauccaauaauuucuucccuaucccugccaggcaaccucccagggauaaaaagaugucuacagcagcaagaucgaggaugcgaaagguggccaagccuacgguggaggucucugaccauuuccaagccaguaucgacugagaggauggcagaguguacaguuggaccuguguuugaucacagcuaggccacuugcuuccauguggccccugguugagucacaacauguacccaugguuugguuuguucaucguuuuguuuuguuuuguuuuaagguuccacguaccucucaggacuguucugaagauuuaaaaaaaaugauacaguuucuaaagaguaacacuacccuuuggagacaaacuagagaacaggggcuauaggcucggccaguagcgaccuguugcuuuaacacugugagcgcugugaguuuaaaacuuccuuaaaaaugucccaucucuucuuuuugaugcuuagagaaaggaucccuugagccagccagcuagcucagcaggugacagcaccugccauuaggacugaugaccagagucauugugcucuaggucucuaagagguaaggagaggacccuucucaaauugaggaccuuccucaaauugcccucugaccuucccagacacccaguggcacaaguguugcccauuauaagugaaaaaauguaaaauguuuuuagaagggaucaguuagcagugccuagcagcugcagaccucccucacacccaccggacugagcagaacagagccuaaggguagguacacuugugaguugguggccgucgccagugcacuacacgcccuugguuccucugaagcuggccuguuggacuggagugggcagcaaaaagaagcuggagccccugcugagccagccagcaccucaccucacccccaauacguguuugaucuugucucuggacacagaccauuucacacucggcucuguagauagaggugaagcucccuuaauuguaggcuauuugucaucgacuucauuuccaucuauucuuccccauggaaaauaggacuccaugcaugagauuuaucugagaaaggggaaaacagagagccaaguucagaagaccucucuccauaccccugccuccugcuggcggaggcccugagaagcagcacuucucauagggugcacuucaucccgcauugcaccccaucgagcgcauggugcucggcaagucuccguggaauaaaugaauaaaucugaggcaguuguuuggauuucaauauaaauggaucuuggaccugagaaucugccagaugggcagacagguuauagucuggugaugugucuccaaagcuauaaaaauguagccauggcugggaguugcacgcugacauuucagaaaaugauuauaugcacaauuuaagcacucggccguuccugcccuccaagugccgcugcuucacggcugcgcugauacuagcuuucuugcgccuuccucucuccuuuccuuuucuuuucuuucuuucuuuuuuuuuuuuuuuugagucaagugaauuuuuuccucagccccucauauuucuaacagagugugauuuauucauaccaaauuaugcuccauuuuuauaaagccugaguugcugcaaaugaugcugagguuccacagaaaauauuaauuccugaucuggugcuauaaagcaugccugcucuccgugcagaggcucugucgccccaagacagauggaagcagucuggggguaugauuaacuucuuaguccuggcaaucuccucccgcuccucuggccgcagacuuccagauugaccuccagcuccucugcaaaugagcagucgcucagauugaugaaucacacgcaucccucuucugaucagggcugucugcuauuuacuacuuacagagagaacuuaaucacagucagggcuccucgcaggcugcacacacauccugccccucucagagcccuugcauauucuccacgguucugauaacaaggcggcuucugcagugcagagucucccaucuuuguaaaggaaccaggcauccauuucuuccccucccuccccacguccauuaaguacaacugcccauaugaagaaaaagcacuuagauuauaaagauagagccccgugcaaagucaucuccauuaauuggcuuauuuaucuccucaaaaaacugucaccucuuccugcccuggcugcuuguuguuuucauccuuuggggacaccaauggggcucgaacuuaucaaaaauacaaaaaauacaaaaaaucaaaucaaaucaaaucaaaucaaauaaaaaaccacaaacccacagucagguaucgagaagaaccaaacucguacugccccaucuucccagaacaggucgauccugucaucucaggguguaucuggugagcuggcuggagucccgcuucucauuuugccuaguguacucuucuauggcuauguagacugcacuauaaacaaagcccacugcucuggucaguauaugaggcgaguuucgaaguuaggcaacggaugcauuauagcuuuuauuuuccaggacuguuuacugaucaugagacuucccaaacuucagagcccaugucccggguguuaagcuccagugugccaguguacuguggauagagacaggccaggacuguguguaucugagaaaguuagacaaggacuagugaguggcccagcgggcagaggggcuugccacuaaagccccucugcccgcugagaucucugagaucuaaguggagaaggccgauucuugcacguugucuucugaucuugagacauaagcacgcacacaugcaccuguacacacacacacacacacacacacacacacacacacacacaguguaagacaucuuuuaaauaagcuacaagaaaggguuucugcaaugaagaaaugauguuugaagagacagaugcuucucugcccaacuccagaaaucacaaacuuagagaacacgucaggccugagcauguuuggucuuuuggauaaaaaggggagugccauguaacuguuauggaacuuuauagacagaaaugagaacaggcuagaagacggaguugaggaagccagaggaauccugugaucugaugucugauagauugugaugauuuacacugucagccugacgggauuaagaauuauguagaagagccuugagggacagcggaauuuagguuaacagagaugggaggacccaccuuaacugugugcggcaugguucugcaggcugggggcgcccagagcaaagagaaaggaggaagugaaggacgguucauugcuacccaauuccugacugaggacauaaugugacuggcugucccaaguuccugucaugaugaccuucacagaaugccaaggaacugugagcccacaugaacccuuccuuccuuaaguugcagauauuuugucacugccacagugacuaauggauuuuucccaugcucugaguagcugccccggguagcccacggcugggaugaucaguuucauugcaaaucuguaguuauucugacagacagaaucguaaccaaaucauaccaugauauggacccaaggcacaaugauauuuuuuucuaaagauauugguuuacucaaaauauuaaguaacaggauagaaaaagauaccugccgugugagccguuacuauccucuaauuaaaaacaaaacaaaaacaaaacuagaaaauaaugaauuagugaauccaaaaaauucaguaggugcuuuuaaguccugaguuugaagaagagcuuuuacaauucauuuuucuuuauuuugaaaacaggaucucaccauguagcccuggcuggccuagaacucacuaugagagcuggguauggugcucgccuuucaucccagcacuugggaggcaaaggcaggugaaucacugugaguucaaggccagccugcuccacacagcaacauccaagccagucaaguuacacagugaaccaucucuaagugacuccagaugcucucaccuaugcccugauaaugaaaacagaauguguccugagugggaggaaguggcacaauucucgaugagcuaaacaagccaaccauaagaucucaaguuugcccaaggcacauaccaucacauacacauaccuuagagggguguccagccuagggccacgaguugcaugugcuuaaaaauggcuaccaacugcaacccaacaccaaacccagaagucacuuaagaaaugucuucauuguaacucagucauuugguucuugaacacagauuuugucauaauggugugucacagugucaaaaagcucgucacucaaguggcuaggcucugaauuaaugcagacagagagaaacaaggagaaggcagcuccccacaaaggcgucgccagagcagugcaguaguuugugcuaucaccuggaagugagccgaguuccucuaauucugaauaaaaaccuucuggauagaagaggggaauggccuuuuauauuggggaagaaagcaauggugacaccggggcccuggcuucugggcacugcgcuggccugacagguucuagugagaauauucaaaagaggucaaagggguccucauuaagaucuauccacaauggcuucccagggcuaagucacugagagagacuuuugauuguguccugccugguuucugaugcagccaaucugaucuuagaugguaugcccauuuucuuaacauacggcgguuugauuuauucugacagaggcugccaugaugcuucucaggguaacauacacgguuuuucaucgaaaggguguaaaugggugguuugugguuuaucaacaggguuuugaaacacugcacuaaugugauaucacaagcuucucaugacccccccagaaaggacguacuguauguacaguaauggccauucugggaaccuggauuucccuugcuuuucaaagcauucgaccaaaagacucuuacguucaaagagaagacaaaaagaagaaagaaauauauguaggaagagcuugauugggucacagugugagucuggacccuuggucccucugaccaaagggcccagaagcacugcccgauucggagacugucacuggcgaaaggcucuugguugaaauaagcuuccucagguucaggcccccacaggaagugcuuucaacucgugugcucucuguaagucaccuacgugaggagccgcaccugggaggagugcuggacugaucugguucagucagcaauugcucauucauucugaagggaaguccgaaggaagggagggcaaaggcuggcuagacaauccugaugugugugccagucaccucaggggcaucucugacugagucugacacugucgagauagagagauaugucggggguucaucugacugcugacagagcacaggugugccugugugcccgcucucucacccacucucgcccuugcccucuuucucccugccucuccuuuucucuuucucucucucucugccucugugugucucucucucccucucugucgcugucucuuucucugucucuuucucucacacacacacucgcauacacagacacacacacacacagacacagacacagacacacacacacacacacagacacagacacagacacacagacacacacacacacacacacacaugucauggucuguucuaggugugaguuccaguuuaugcuuuuucuucaggguuaugacuccuugagucauacaaggcaggacaaacaacggagggcauacgaaguccgguggaugagcaacaggcaaagguacagggaguagggcaggagagcacgaguggguggcuuguacgcguacggcucaagagaaaaucuuaucggaagacagaguccucugggugaaccaauauggaaagagcgaagaaaacaccucaaaguaaagagauacuuauuggugagaaaugagcuuggcucucagccaauuccaaaguucagaauuuaccacaccacucaggccuuccccgcuaagauucuugucucuuguuucacggcacaacaagggauucuucauacuuuaugugaaauacaacaagccaaguuuugcgguaauaaacuccaugcacgcaugacaaauccaagcacgcugaauguuuaacaucccaguucgcagauucuuuagggacaaaauccgauuaugaauuauaugccacaauaaauagggcucaauguuucauaaagcaauuuauaguucauaaaaaugacaaaauguaccugucagcuagagcgcggagagcuguucucugggcugccugcuggaagaaaagggagagauguuuauuuaauauucugacuuuuaaauuaugcgcucaaucaacacuuaaaaaaaaguaucucacacacaugcacauuuuugucaagcagccaaaguuuaaacuguuagcaacacaguggagagcccugcuaugucaugaaagcaagcuucuucguaaagggugcugcaguaacacaauuuuuccagcagggggcgacugugggggcaagugcuacauacuucucccuggcaguguggggcagguuucaggaagcauggccaagaccugagccauuuuuuucuaccaccuaaaauaaaauuuccauuguuauauaaauauccuuauuuccuguaagauaaaaaccaaacaaacccuuauucuucuaacuucuuguguagaucgguguugguacgucuuuauguugugugucugcggcugugcacgugugggcacaccuguggaugugugugcagaggcuaaggagggcacuggcucucuuccuccauugaugccugucauauucccuugggucaaggucccucacugaacccaaagcucuccauuuugaggagacuggcuagccaucaaauucccagcauccgauuguuucugccccaccccaacgcugaugucauaggcacaugauuggcuuuuuguauuuuuuuuuuuauguguuagagguccgaauccagguccccaaguuugcauagcauguacuaugaccacagagccaucuugcuagccacuaaagauagaauuuaauuacuuuuuauuguuuucuuucagauuuauuuauuuauuuagaucuauuuauuuauuuauuauuugaaaaccugaucguugacuggacaaucacaaaauauuauaggauuauugauacuuuuagacacaauaaugaaguugugacagugguuuuguuuguuucuuuuaagaguguuuuuuggccacccagggacaugguuuguuuggucgcgugcuugcuguguguauaaaccuaagcaguauuguuuggacccccagcacuucugcaaagacaugcacauaugcguaucuuaagcccagcgcuggggagcagaggucagugugcuucuggaguguacuccucagguggacuaucccagccgaugagcuccauccagauucagggacagacccugauuaaaaaaaaaaaaaaaccaaaaaaacaaggaaaaaauacuccaaaacugaaauguagcaagcacaccaacuaaugcaccagccaccuaugcuuaagucuuaucuuaaacauaguuccaacuguuggugacacuuggcacacuucaaacugacccucgaguggaaugggcugccaucaaaaccuacagcugacaucuccaugcuuaaauagcccugauccugccugugguuaauaggacuuaucccgugcucgcuacugacucucccuuggcccuguauguccucacucugacuucaggacagcuucuagcaagucugcagcugccuuaaccucuucuuagccacccuguauuugguacauguauaaucugagaguugauauuaguaauugagacuggaaaaaaggaacuugagauugcuagugguuaccuagugggcaaaauuagcaaauuguagccaaugaaacagcuguauuuugaaauuucuggcuaccccauaaguucuaacaaugcagaaagauaacaaaaaauagcauggagggcagcugagggagacacaucacauguaggagcacccgaacauguguguacacccccgugugaaucaggaggggcaggacuaaagauccagucugaacuuaaagucaaacgacucuuuucuccagucuccauggauuccccuugcugacuucugugccuggucauccauagugaguguugaugcacgguugcugguuggaaagagauucagagaauacaggaagacaauguaaagcagggagcggcugcagccacggaguugccugugaacggccgcauuccacagaggagugcugcuaauagauccuguuggucagcucuacauaaguggggugggaucaagggcaacuucccuuuagcaaagccaaaggaugcuggucuuagagaucgggcacucucuauccauccauccauccaugucuuccugucagucuucacucuuccaguccgucugugaggagugucaccacacggccaacgcagugggacucaguacaaaagcccacccuccugguuuuuucaaaugcuugguuucugacugugcuuuucacugaagcuccucuuuauuaugaauaaauccucuacagagaucauucauuaagaaagccaaugagaauguacuaaacauuuaaaaucacuccuccaggaaaaaaaaauagcuaugguguuaaaguaaaaugcuauguccucuaccuaggcaagagcugacuaugaagagauucuguugcuuauucuccuaauuuaaaaaaugaauuuuaaggcuggaaaauaaugaaagaaauaaacaucaggauugaagagucaagaaaaaaaugacuuaggugacucgcgauugaaacccgaaagacuagcugagaacuagauggacugcccaguucugccccucuaagaucucuaccacggugacauucuccucuccuaaucgcucaucagcuucuccucugauuuggcggcagcacagucacuugagaggguuaagagagaucuucucucaucuuuccugagugcauuauucauucaugaaugacgcugaagcucaagucuauaagacaaaacaaguuuucugccagaaauagucauuuuccaggcuccucucaagagaugacaucuuuucuacuucuuuacuuuaacaagguuggugcuugguaacauaaucagcagauauuccgcuccaacgcgugcuaaaugaauuacaagucacaaucuguuauugaaaggcaaucaaagaggaaauuaaaugcccuuuuguaauugggucuggcacagggcaaguccauagacacugggugggacuguaagguaaaaaggaaggaaggggcuagagguccacagaagcccagagacguguaguuucuugauggaaauagaauuuaugccuggauagcuaugcaauuuacucugaacuaccuacuaugugcaggcacuggguuugguguacgugauaggaggagcagaugaagguugucauuauaguccucugagucuggagguggggcagacaggaaaggcccacaggcacacaacaguuagcaucacaauggcugugguugaggggacagcaugccuugaaguggaacagugaaaugaccaaugguuacagaaagcucagccagugugggauaacaaggccugaagagaaacuuaugaguccagacgaacgaacggggaagggaaaaggagagccauuagaccagaaggaugggggagggaagaggagagccauuagaccagaaggaugggggagggaagaggaaaaccaugaguccagagggaugggggagggaaaaggagagccauuagaccaaagaagcaagggugguggaggaggaagggcuagauguagaggaaaagcugcagcaggcuuaguuccugacucacuguggcacagcucgauggggcacugggaccauggcagagccagaugaggccaaugucaaggucuacagaggucaagugcaggcuuguggagguacaggacaacuggaagucauuagagacuuugcacagacagaagcuaagcaaagugugcauguaugugcuguguaacuuccuguaaaucuauaagaaaguaauggggauuggugauagucuauuuucaaauaucacucuagcuucuguuuuguaugaugaauguguuugcguaaggaagaacuaccugugagguuauuacaaugagaaauauucgacaauggagagagcagucuguacuucgacuugagggaacugucucugguaggacacgcagaucaggacagggaaggugucagcaucagauucacgccugggcaccugguguggauggagacgauugggggagauguggggcuggggguauaggaguggucaagguggaguaggucuugugccauuagguucaaguugccuauggauguuuaauagagaugauggaugacaucuggaaauauuagcugaaguuguuaaaaaacaaaucaaacaaagacaccaauaaaaagguggugagagagcucaguuggugugagcacgaggaccuguuagaguccuagagcccauguuacacaggaaggaggugggggacgaggaggacaaaugggagagggaggagggggagaaggaaugggagggggagaagggggaggagggggaaugggagggggaggaggaggaaugggagagggaggagggggaggagggggaaugggagggggaggaggaggaaugggagagggaggagggggaggagggggaaugggagggggaggaggaggaaugggagggggaagagcgggagaaaggggggaggaggaggaggaggaggaggaggaggaggaggaaugggaggaagaaaggauacuggcacacauuuuuaaccccagccugagaagcaggggacaggcagauucccuagggcugacuauucagccauccuaucuuaaucugcaaauuucaaauacaaucaaaaagguuuuuuguuuauuuuuuuaaaauaaaggugaaucucacacauaugcacacacacaugaaaacacaugcaugcauacccucuccucuccacaaaauacccacagcagucauaaaaucgacuuaagguucugggccaagacuuugcuguugcucugaaggaagcucucucuguguuucccuuggaaagcaugagcacugugcaugucuagguucaagccuugugcucagcaggcugccucugcacccuguucugcacuggggucaggcagagccacugaggacaauaucauguaaccucugcguaagagcacuuugggcgcuaaccagacagcagugggagaaaggaggaaagaaaucccuccuuggcugggcauccugggcugccugguuguucuaauaaagacagcucuguguggguacugcuugcucuuuauaaaacccacauugaauaggcuccuaagggcaggcagaauuucagaggugacagaacucaucaguaaagaaagcccacggcugaacggggggcaccagaggacaaaccaccaaccuuccugacggcagaggagaaccgacauuuguaagguuuucuggcucgucccaagcacuugccccugauuuggaucccaccuaagcucugaggucuagcucccuccugaauugcuucuuuaaaucccaacuuuccuuggggaccuccuccccaaacucugggucgguaacaggaguuagguuccacgcaucacuggggagcacgccauugggcaggguagcgguuaaacuccagcuuccccugcucccuuuaagaugacacaaggcagaggucuuagaggaugucaacaggggacuucugggcacaacugagucuccugaugguuaagggaggcacauugacuuucguuaagcaucuccagggcauuuuacucccuggagacacucucugaaccaccccuauggcucuuguggggucuggagcuauuucccuuacagacuuagggucugcuguucaacuacgagagcaugcgaucuuauccugagcucauccacuacucuggcgcauugugacaggacuggguaaggaaggccaagccuggcuguguuaggugugaguggcuccaaaggccauugggauuaaccuaauggauacacgcugcucuggauaauggagagccaaauccaccugcccucaggauugagaggaggcuuuugugacgguggcagacauaggauaaagcccuggcaagacaacugcgccuucagaggggagagagucugcacgugccaccaugugucagccugugaguucacaccuucaggagagcaaccauguaagcguaugauaccuagagcuggcugagguucuaggacagagucagggguaggguaugccuugacaguucugguucuucacacugggagguuaaaucuggaauauggaugcugacaccaagacacagauuuaaauuagaugcugauucaccuucuacaaaguucucuggccucuaggccucaccagaguaggcaaguccauucucuagaauccagagauauacaccauggggguggggugggguggggugggggaaggaacauagucaguuacugguaaugagucggaaauucuacauuguugugcuugggcuauguauacgaucucuggguuugcauaacgcugauguugguagaaaaacaaaagcugauauaacuguguaagcuauggacuaccugguuaauuaggcuugaguuggggacagaucaaguguccccguccccagggugaauuacgugugcaguaacuaugcuugauguuccaaguacuuugccagaugcaaguguuggcuaaauccuacgugaucugccauagcugugaccuccucaucugggcuuuggucacuuagugcuccugaaacuuauuccacauggcaacuuaaaugcagccacaacuugagcaagguccaaacggggauaucuuauugauaacuaauuuaaauacauauccaaaguuuucauugacacaucacacacacacacacacacacacacacacacacacacacacacauacacacacacacacacacacacacacacacacacacacacacggucacaguggugugaucugucaacacgugcauaauguuaauggucagaucaggguaauggaaucuucucgaucucaaacauuuaucauuuccuaucaucagggauauucaaaaccuuuacuagccaauuugaaauaugugaguaacugcugucacgcauagucagcccccuuuacugugcuggggaacaucugaagucauugggcuuguccaagugcacccuaaucccauguccugccaucuuuccacccuuccccccacagucuuccuaccuacuggacucuggugcaaugacucccugaggcucucuuugcucuagcaggcaggcacuaggaugagucauuucucacucugugacuuuccaagugccuccagagcuauuacaaagguccccuuugcuaccuuaguaagaugcuuugguggaauuuccuuaaguucccacugggcuugguggguggucgguaacugugaacgcagacucuacacauguuacuuuguuuuuauaugaagaccacacaaggaaagcgaaauaaauaucucgguagcuuuguuuuaacugaaaucugugacugaagaccccauaucugagucuggcuuuacaucucauccaaacguuucuacuaaaaauuacccaagguuugaagguaaaaauagccuugugccagucaggcagacuaucccacuuguacuuccuaaaccgauuacgcaagaggaagcagaaacaaccccaagcuuguuauuaguaucuggauguucacuggcuauaugaacacagcuccacaaccguggugugcaagcacacacucuucuuacaacugccuugaaccuuuaaaagcgaagccuaacuugaagaaagauaaacccagagacagugcugacccaaccuccccaggggaagucuggccuacaggaccuccugcgauucaguuguggcaaugauuguacaaaacaccaaauaggaggcuuuucuaucaaauacuauaaaacgugaguuuaggaccaggaauuaaaauuuuuuuucucuuucucacccgguaagacuuuuaugcaaacguuuuaaccauuuucacucagugagaaauuuguuuacaccaaggucuaaugcucugauauucuagacauuugauagccucgagcagcgacgcuuuucugcuucgggcaggagccacucuccccuuccuccuucaugucuuauaaggcaauucuaauugaauaagacugggaggucagaccuagccaauggggaaaagacacagucaacaccugagacaccuuuucggucucaggguguguuuguguccuuccaagcagaucuucuuagcaagagugaagauuguuauuuccagacacuucaguuggaaugccggugucuuucuuugcuaucccaaacauauuucuaacaauuugggggcucugucugggaaccuaccucaccugagggugugccuugaaaccaguuuuaacaacugucugaucuguuucuuagagacgguuuuguuccauucagcauaacuugugggauacagagcuguucuggauagaacuggagagggccaaggacccuugaaugguuugcucuaugcuucuccaggcugagagucuccugagaagagccauguuuacaagguaacuaguugcacauacacggggaaaaauuaggaucacaaaaauaagaacaaaacuuugcaaaagcuuaucuggacgucauccucagggggagagacaugauagcacacaccgaccaaggacacucuaaacgcugacacuuccugagaaacuaaugaagaaaacaaacaacccccccaaacuccacaucaucagagucacaggacagagggucaccccucccaguuaaaggaauguucucuggagaggggaauccacuuuccuugccaacugacaguccugcugaaaguuaggucagagaagacugguccaucggcucugucucucugaguucccgaaauggaggauccaggagggugguacugacaucugauauuaacaaaaccuugccuuaguuaaaaaaaaaaaagcuccuugugugaacuauacuauuuuagcaaagaucaugguuuccugucuguguuaaucauuuuuuucuuauauucaucggaccaucuuuuaauuuuuauacaauuuauauaaaucucucacuuuucagauuucuguuugccaacauauauucuccagcuuaggcuuacacaaaccucaccugagcuccaaagccucuaaacaucagggaacagcacacggggcuucacacauuuguggacagugacguuuaagucacccauaucaguuuuggaaauuacggcugauuagauggaaagagaagaauuugacucccccucuccaccccccacacguggcuuuuguaaauguuuauaugagaugagaauaaaauuuuguuuguaagguggaauuagggcugauaaccaaggccacccuccugcugagcugauagugacugacaguucagaugugcgcucacuccuagacaggcucaacaaagcucugagaggcaagugucuccaauuguaguuauuguguuuccauucagaagggaaacuaacuaucaaauugagcacucagguauaugauuacaaggcuagaaacaaaaccaaaugcaagccacuauucuuucaucgccuguguuccugcugcguucaaaauauguaauauguagguuuuuguuuuuguuuuuugcauaguucuucgaaaaugagguacuuucuggcacugaaaauuuacuuaaaguuuuugugguuaaauuaucauaacaaauauuacuaauguguaacucaucuuaagcaauuugccagcagcuugcaugggucuguggagcuuaguagguauuuaagacuauucugagaaugauuuaugcaaaaauugcauagcucuuguuuggauacaaauaacaucucuuauacaguucauuucucaugaaagagaaacuugauuuuggagcugcgccccccaaaccugguccugauuacugcuucaacuccuguuuauauaauucuacacaguuuuggcaggauucaagagcacauaccaggguguuggcuuuuaugaaucucccgagaugcgaaugucacgcugacuggaugaacucuggccacagaucccagacaugcacaaugacucuauuuauuccgacuuggcugccuggaugcagauugacucuguguguaauaaauuuucacagccccaagaaccuccacaucaaccaagccaaggcugagaagacaaacacaccuaguggaacugggcugcguuucacccaguuauucugucagagcucacugaugggugacaugcgcugucaaugccuuuaagguuuuucccuucugguguucucaaaacccugcucucuguuacaaaguugccauauuaaacaaaacaaggguuggggggagauggacagaaaucugcuuuuaauaguuuaccccacacugcuaugaguccucagaggccucuacgggacagggcugagaacugugacuaguuguuugccacuucaacagagaccacaugaaacgcaauggcucuugucucauccggcacucagcggggacucaccuguagucuggacauacuagaggcaugagguuuuagcuucucccugacagacaagauuauuacucucugcauuauaaauaagaaaauaauugccucuuuagcuugcagauuuauguuaaugacacagauaucuauuaaauuaauuguacgcucuccaaauauugauuggggauuaaaagguaacuuuccuucauuguguugagaaaucaauuaggccaauagagaaauuccccucuacagauuaaauccaaugaucacugccuguaaaguuaaaacagucaguuuaaguggauaaacuacacccauuuaaagagaaaaaugcacuuauauaauuaaaacgaaaaggcugcccagucuguguggauaaugugauuacucggagcugcaggcagacaucgccguucaguguggauggcugcucccucgauagcugucccugagcuacggauuugucauggugcuugcagcugacacugucucagcuacagcuugccaaaagucuccagcauuuguccuuuuccucuugccucagcugugaugacucuaccuagaaauuugcucagucucacuuccuaaaccgucccagacucaagagggugagauggccacuuugacuaaauggucagacacccguguguguuccuccuccccccacacccaucaggcugacggugccuccacauauuguuucacccaguuuccuucacauuuucccagggaacaacuaaacauuggaaucugugacauacacauccaaacaagaaaugucguucucuggucugcucgaaccucaccgaguggaagcagucugaugacagcuugcuuucauuucaaaggugucacaaccaacuuaucaaguaaacagaaguacaauucuggugccuuugcgaggggacagugaggagauccggucucucggcuucggggacuccagccugagauggcuuacagaacuuacauucuaauagugcucggcaugaugaguguguaaggaaugguguagaguccucagcgagucaaggcuauaugugaauguaugguugcuuuaugauauugagccuuauacuuuuuuuccugucauucauucaauguuugggauuuaguaaugggcaacaaaggcaggacaaagaucaucucagcuucuggacacuaguaggaacuguaggaacgggucucaauuuaagacagcgcccugugauuauuuaugcaucuguucaacagacagagugucuacugagccagccagucucuguccucagggaucuuccagcuuuguuuauaggagcaguuaccguuaaaagugaauacauacaguauaguugaaauuagggugagguccaggagaaagaguaauauuacugagcaaaaggacauuccagagucucucugaggacgugaaaugaugcuguaccuucgggaugcacuggugucaaccaggcaagacacacagcagaagccuuuggaugcucugcggcagcugggcauggcuuguuggaggagcugaaggagggcccacgaaugcggaagugcugggaaguugggagagaaggggaggcaugaacaaggccagacugcagguuagugggggccaugcugggaccccugcauuucuuuccaggugggagaggaaauucauuucagauuuuagauuaaaaaaaaaaugauuugggagccagagagcuagcuggguuaagagcacuugcuguucuuguacaggaccaguguuugguucccagcacacauacugggcagcaugcaagugccugcuaacuccaguucuaggggauaugaugccccuccuggccucgucagguacugcaugcaugaagugcacauauaagcaucgagauacacacauaaaugaaacuucaaaaaaaaaaaguaaugauuugaucugauguacauuuuuaaaagaucacugaggacaaacuauauuauagaugucagagaacaaggugacaguucccacaagcugguuuaaacuacucaggaugggaagggguugauguacuaauauuuaauuuuggaaguuaaauuuauagaaggcagagaagaaaagaguguuugaaugaggaacgagguguuaucaagacuggauccuguggguuuaggcuugaacagugggcaucugggcaugcuaggucugaaaaagggaacaaccacaagacaaacauauuugaguaacaggggguggcagaacccagaaguucaguuuggcauggcuugaguuuggaauguuugugagacaaucaaauagaaaacuuaaguaugucuguauuuugguagagugcuuugaguugagacugcauagaaguugccauuauagaaaaacugaaggucucuggggguggggaggggacaugaggaugcccaaagacaagaacuagaaaguaaaaaguaggaaggaauccuuucagacucuaauaccugguggagacugagcacuuggcaaaacacuagaaggagcaugguggggggagagggaaggggcacaggugaggggggagagguacaggugagauggugaagggcacagguugggggaggggaacagguaagugggggagggguacaggugaaagggugaaggacacaggugagggggaagggaggagcacaggcaaggggcagggaaaggcauuggugagguggggaggggcacaggugagggagaggggcacacugcaaugucacuuuucugguaaggcaagggaugaagagacagguauuuggguauuuggguacuggugguuucugaguagcagaaugugaugcgagagucauccuuaggggaaaggcagaacaaagaacgaguuccaaagcugcagaggaaaugggacaaacuuuugauaggacuggcagcacgcucuugugacaggagggaaggaggucaacccaggaggaagaugagaccagauguagcaggcagaugaggucagccacggggcucagcauggagaugaggaacuacaggacaggacucggcucuuucccaaccuuaggagcacugagcaccugagcagcugagggaugacaagcgucacaagucugaggucugucugggcuacugugggacacucuuacgcacugccacagaaccccagauguuagaguuagauuccauguuugucaaguuuucgacggaaguaacuauaggcuauuaauggagaagaagcauaagacggcagugucuauacaacgcaauacaaaugccuccaucaaaggcuguauaaagugaugagcauguguguguguguguguacaugugugugagugaauacauauucaugcauguauguuuguaugugugugcgugugcacacuugugcauauguguauguguguacaccugugugugugcacauguguguguaugugugcacucgugcgugugcuugugugcauguguguaugagcauguguguguguauucauauauuuguaugccugugcauucauguguguuugugcguguaugucugugugugcaugugugcguguguguaggccagagauccauguuggguaucauccaccuucacccgacugugggaguaacauggccucaugauccuggauuguauaccuccggugugagcccaaauaaaccuuccuugagcugcuccugaaggcguuugucacaguagcaggaagagcaagggacguagggacuucuaacuucacaaguggagcacugaaggacucugugguuggauagcugggccaaugcugcugagcgccucagcagcugagcagggaccuggagccugcaguaauguuucaguggucaucuuuccucaacucagcuucugucuucuaagagaauaauggcgguugggagguaagccagaaaaaauguguguuaaaugcaccagagugggagguugacagucggcaaccugaggcucuuagggacaucuuuucuucuucuucuucuuguccuuguccuuguccuucuccuccuccuccuucuucuuuuuuaaggugaucacacaggccagcuggaccaauauuuauaaagacaaccagguaguuucucagggaaggaaaaaaacugcaaagguuuuuugaaaagauuuuugggaaggaggcgaucucugguuauaccuggaaacaaaugugucaucgucucauggugucagagaaauaaaauguguuucauauacauguagacuacaugcuuucaggggaagucuuaucguuagucuuuuucuaaaaguagggaaauuccuccaaggcucggggagcaccggggaagacagggaggaaagaauaucaagcuggacgucagggaguaggcggucaagcacuaccuuccggguguaagcuaccagucacaaacccacgauccugcagcagcuacaguagccuaagcugggaaggcaugagaacgggccugccaacagccaaucauggguuaggaagaacucaaggggccccauccuuucccugaugaacugguggcaagggauggacucuagggugaaggggacauuaucacugucuucagcugagucaaaaagugagcucgccauggugcaaggcagaauaaacagaauacaguaucuacaugcauagaccugucgguaaaaagagugggggagucacaauuuugugacuauacaagaguauacuuuggacccaaauagaacaacuuaaucuaauuaauguugacaauuuaacuuaaauuaucauauguaaaccccacugucuggagucuuguuaaugaguuagggaaauacuguauaaaaaucauuuauuccgagugcuccuuguacaaaaggaguaagacacacacuagggucuggucgaaaagcaagaauaaacaguccgacauguguauucauaguacagugucgcccguguagacuggaaagccgacagcaaagcaaaugauuuguuugccuuuagaggacgugauagcucagcguugauaacgaguuucuuaaauugcguuuucacuggaaguacuuccugcagauaguucugggaauguuuuagcccgugaauccuuuuccuaauagaaaccauacacagauugcaugcuugagaaggcuuagcccauuugguaccuagcugagccucucaguggcuuaaaacacacacacagaggaaaucauuuucuucuuagucgcucgcacagaugagaaaacaaaauuagaaaugaauuucuacuguggcugcugaggugucugacugccggcguuagacaccuagaaacaaaucaucccacugcuaaaggccuccaagcuugaggccccuucugcccggcuaaccacccuuuccugggacucucucgguuugccaaccagguccccagguucccggaguccuggcucaucugugugccuuaguuugucucacaaagaggagcacgucuucccugcccccagcccacgcuccacugacuuuggccucccgucuauaaacauuauuuguauuugcaugucuagacagcaaaucacgugcgcaacacuucacgguaccuuugaaucaaguucaccauuucaaaaauccauugacuggcacaugcauuuagcccaacauaugaagaugacauaaaaaagagaacucuuaaauugucuuccuaaccuguccuguucauccaaacccaacaguguagcugguggggcagaugaaggaaguggaggggaaucugucucuagugcucuugaaaucugcuuuaaaguaaaaacguuuccccgagaugcagaagcgaacgugaugaaugcuaagcggguauuuuuucaccuuaacugacugaucagaagacuauuuauagccccccugacugaugucucaagcuggugaaucaacagccagggagacuauuugcagcgcguuuaucauuucagacaaacagccgagacugugccugauuauuuuuuauucaucaucuuugagcaccucuguguucauuccuucucacuguuaauaacgucuguauaaggcuucucaauauuuaaugcuacggccuccuugcugcaugcuaauguguguaaggucacaugcuugaucucgagaaggccaguuaucuuugccagaagaagaaggaagaggaggacgaagacgaggaggaggaggaggaggaggaggaggaggaggaggagggggagggggagggggaggaggagaaggagaaaaaggaggaggaggaggagaaggaggaggaggagaaggaggaggaggaggaggggggagggaagggggaggaggaggagaaggaggaggagaaggaggaggaggagagggagggggagggggagggggaggggaggaggaggaggagaaggaggagagagaggagaaggaggagacgaagaagaagaagaagaagaaggaggaggaggugaaggaggaggaggaagaagaagaagaagaagaagaagaagaagaagaggaggaggaggaggaggaggaaggaaggaaggaaagaaagaaggggagagggaggaaggaucuguuucugagggaagucugauucuauuaguuuuguuagaaacaugauuguuggucuaugccauuaaaaacaaaagucacagacugaaauccuuuaaugggaacugagcucaagacauuucaacagacuggaccaacacacagaaauccaucaauggcaguacaguguccaguauggaagaccagcuugguucagugucuguguccauucauuugugccucaucuacacaugagaaagucuuaccugcucacccucuucgucaucacugcuuagcuuaaggucgucuuccagaguucugaaagggacaaagagauucggacacuuagagccaaagucuuucaauacugaaacaucaucuuucaggucuguguuuaaguucuauucacacccuuauacuauaugugguuucucucugauguaccuagggaagaacagagagucacaucacaaacauuaacccuccugacaaucucaggaugagauggccuccuuccgaguuggcaguuuuagaaaaacagaaccaaacaggggcugcucccugggaaguuuaaauuccccaagugcuuguucaaugauuuccaggcuuuggagcccagcuggguccuccggccugcugggggaugcucaugguaaagacagaggaagggcaagcagaauucugcuaagagucaugcagccauuagucuugagucacaugacauucauacaggcccucugacagcccaagggcuggagaaguugucuccuccaugaucuucugaguacaaggcaaugaacagcaggacacuucugaagagucuacaagggcccuuuccacaggucaccagccaccaccaugcauccugacacaagcagcgaguccaugaaggccaaugguggacagagaaaagggaauauguauccuaacguucuuagcgggaagaacgguucuuaucagugcugcuuugaucaguucuucagcauagcaauuuucagaguuguccauugccaagggaaucuugcucagacaugcacuuucuaaaauguguucugggcacacagaauggcucugccucagagcagggagaguccacuggcacagaguccagggcuucagacacugguuuggaagcugucaagcucuugugcuuaaagaccucaaugucuuccuugaagucaaccaaauaugcuuauggccauaagggucgguuauaggccuaucauaggaagauaccuuuauaguaaaugcuauuucagugacuuuguggguaaacugugguugucagggcauaggaucaguucuuccugaagagucuacauuuucggguaggugacuuauggugcccauguuggagauccugauuuagguuccacgagacuaagaaauaaauuuguuucuuuauuugaucaauauaauuuggaguaacaacugcaauugaacaugugcacguuugggccauugucuccugugcauggggcagaaggaggcauuuauauugcauuagguauucuaggugcucuaggcaaaacugaaagccacaggaggaugugaguugguuacauguaaauccaaugcauacugaaggggcuagaacauccacaguuuuuauagaaggggccagagcauccacagauuuuauagaagggaccagagcgcccacagauuuuacuguaugggcuagaauguccaaagauuuuggacucagagaaagguccuagaacccaaucccccauggacaucaagggacaacuguacuuuugacaaugaggcaauagggcuucuaaaugucuaaguaacccauauggauaaauaaauugagauacaaagaugucacaaggaagucugcaacuaggccaaguacucuugcucaggccuucuuccaauguugcuacuuugugacuacagugggguaagaugcuuuagcuucuaaaagaaggcagaaaucaagucugccagcccaguauuuagggaggucugcccuuuggagucaguggugggucacacaguagaauggggugcagugacuaaaucuaugacacagacaggauguggguaugugugccugugugcaagggcacguagcagggucugcguaucacagaggucaauuggcaggaguugucucuuucuaccauguggguucuaggguuugaacucagaauaucaggcuugguuacaagcuuacucucugagccagaccaagacaacaacuucuuaucauuaccauaacaugauacuacuaaguacaggggucagcauguuugaagauacuggcuaacgagcuccuccuuccacagaaggagagaggguucagcagaggcagaucugucugguguuggccacacacggacuguucccuuucuggaagugagggguaagccaacaauugcugacauguacugacuccugcagucacugaguagaacacacaccaccgcagaaugcacagugccuucuagggccguuuccuauccacuugccauuggaggcagcugugucauuacauccacgucucagugcuuccgaaucuucacgcucuggcucgguaauccuaccauaggcaccuacuccauuugucagcaaacucagcgcucucacaagaaagacuuggcuacaaucuuugcaacuuaacauuugacuaccuaacuuccucucucuuuuuaaaaucagauuaaagguuuauuuauuuauuuucuaugacuaugucacugacuucagacacaccagaagagggcauccggaucccauuacagaugguugugagccagcaugugguugcuagaucuuaacggcugagccaucucuccagucccaagcaucauugucuuugaggagcaugagaaacagcuacacuguagccacgccuacuuucuugcaaucucagagcagaaacaacagcccauaacaggugcacaacgcucucuacuuagcuccauccugcugaggagcugcugacccacacagcaagugccuccuccuuaggguguaccgacacugcuccauggagcagagccuuuaauuggcuugauuuccuggucacacuugccauuucaggcucugcaaagacaccucagucuuuuauuuaaaguucauuucauuuugcucccuauuaacggcuuuaaaaacaaaucugaguuuuaaucgcaccauuugauuuucagauuuguuucuacagcaggagcugccaccaucuccaccugccugagaucugacuaugaauucauuaugccuaugucuguucggagacaguuuguaugaaucuucaugaaauagauuuacauaugcaaauauccauucuagaaacuaguauuucacaauggccuguaucuuagaguuuacguagaagugauaaaacgcaaccaaaagcaacuaaaggaggagagguuuuaucucaucuuacagcuuguagaccaucacacagagaagucaggccagagacucaagguaggaagcuagaggcaguaacagaugcagaggcuauggaagagugcugcuuacuggcuugcuuccuguggccugcuuaguguacuuucaaauaucaucugggauuaccaaccuugggaugguaccuccuauagugagcuacaucuucccacaucaaucauaaaucaagaaaaugcccaaaagacuuucccacaggccaaucagguggggacacuuucuccaugaagacuucuacuucccaaacaacucuaacuuguguuaaguugacauaaaaccauuuaguaccacuugcaauuaauaacugcugggaaugagaaaaaucuauuuucucuaauggagugcccugugaugucucaacacacacucugggguaggccacaugcccgggaauaguugaccaacaaaaaaagaacucaauuugugcuugugauuuuuucauuuguuuguuuuuugguuuggugugguuuuaucuuacagacauguacacacacacacacacacgcacacacacacaccacaccuuaaaacuucccacauaggaaaguauuuaguuaaaucucucccucuguccuugcccccauucaugacaaccuccccaguuaccagugauuguaguuucuccaugcauuagaaagucaauguagauacuaaacauuggauaaguguauguauccacacauuaacaaaacaaccacaugcaaugacugcgauguuagcuggagucucacagucugccccggaugcaccaaucuccgugaucucugccucugucugcuuccucccuuacacaaugccugcucuggaguguacugcucuggugacuggccuuuauggucuuuauuggacagcgcagggcagaggugaugggaaagcauguggagaccagguaacuucuguuggaugcuggguguuugcuuuguuacucaccuugcuugcucugauaaagcaagccaucaugguaugacugcuuuauggagaauggcugccacuggcugauaacaacaagcaaccaaggcucugagcccaacggccuauaaggaacugaauccggucaguauccacaguggugagcuuggagguagaucuuucuccagucaagauguggggagaccacaguccugguugguauugugugguauuugcagcccaugauagacacugagcuagaggacccagcuaagccacucucagauucuucacccaugaaacaaaaacauaaaggauauuacccugagcuucuaaguugaggguuauuucuuaagcauuacauuagcagauuguauagugaauauuuagugugucucuucuugaagacuguuacuagugacuugagguaagccuuuguagccaucauucaagccauucaacagaagaaauaagugagacauuuucuaauagugauauuaagaguaaguaggugagccgggagugguggcgcacgccuuuaaucccagcauucgggaggcagaggcaggcggauuucugaguucgaggccagccuggucuacaaagugaacuccaggauagucagggcuauacagagaaacccugucucgaaaaaccaaaaaaaaaaaaaaaaaaaaaaguauaaguaggugagauuuuauuugugucaauaugauauuucuguaucauagcauauauauuuuaagugcucaacagguacauguagguauuagguaacacuuccauuauuuuuuucagaaggugagggugcucaaauucccagcaugcccucugucucucuuccagcucucuuacacuuacugauagggugcuuggggcaggccuguggaagugacaacguugaaaacuguguagcagcugagagaggagcagaaggcacauuuccacugacuauucccuuugggugugagcauccuggugcucacagugucugagucaaauaugucagcagcucaucuugguauuaacccagugagucuaugccugacacaccacaauguaugcucugauaucacagaagcgccuggaaauagaaaccaacacaacuaccacaagggucggcaggaagugcaggcuuuggacaacgaauuuaggggcauguccuagacacccagggcaguaggcagccuugugaacacaucuuguacaauucugagcaccuggcaagggagucugcacacuucuuaccugagcuugaucccucuucacucugggguguaauaaaggcgcacaguaaagcacugagguuauuuguaauucucugcuuuuuggcuguguauuuccaagugugucuuugguugcucuuuucacuuggaauuagaauucuugucgcuggagcugggaggcaggagcaaaucgguuugaaaagaggauagggacacggggcccucuuuucuugagcaccccauauuucuucccaacaagugccacaugccauuugugugcuuaugaacagaugaagaaacuccaucuuuuccauuuagggcaaugcagaggauagugauuaaggucgcauugcccgaacacauuagacuuuaaaaucgcuucuuccugaagaaauuacaggaaggggggggggggagugggcuacguacucuauuguuucuaucaaaagacaacaggggcuuagaaacaacacuuuaacaggaaaugcuuucuccauaaugugauuuuaaaauucuuaucuuuguuacacugacuucuagaaaaugagucuccaagcugguauuccuggucuuaaaguguugaguuucuaaagacaaguggauacaaacacagcguguguaagaauaugacccuuuccuuggcagacaacagagcagagcucagagguccaggcuagggauauaaaaugcucucggccauacagauccaacgauggacaccucuuuacuggauccuugcugaagaggaaccuguacuuaaucauagggcuagacauacauaaauuuuucuagcucuagucuuugauguugaauauuaacuacugucaguuaauuaauaagcuugauuccuguucuguuugcuaaugaucugcuuaauugguaccuccugaaaguaagggugucuugacguuaagaaggucauauauacuuaggauaagguuugcucuuugggcuugaaaugccagcgucugcauuuuguuguuucugacaugugaagagagucccuaaugaaaggauuuguuggaacagguaagcugguagaacuaggaaggagggaaaaccauaaucucucagugaacaaauucacacuuuaagcuauaucacagcuucugagaacaccaugacacuauaucacagcuucugagaaugccaugauacagccacuguuaagcuaugucacagcuucugagaacaccaugacacagccacuacuuagcuaugucacagcuuuugagaacgccaugacacagccacgguuaagcuugacugcacacuggacccauuugggaauuuuuaaaacuacugaugcuggcuucuacuguucccacaugcucugacuuaacagaucugaagugcaagcugggugugcagacuucaaaguucccuuggugacucuaaacuguagcaaggguuaagagccacugugaacaggaugacauugacugcaucagaagaccuaaaggucagcuccugaccuugcauaauguccaugccucuaagguuuaguuuuuccauuaacaaaaugggauagaugacagucaagauucaaaagagacaauguagguaaaaguguuaagucaacuccacagccuuucaggggugcgcagugaaggaucaguguagacugcggugcuucuaaacauacugauucgagggccacaucccucaagguucuggcuucgcuggacuggccacaagcaucaauauuuuugauaaguuacaguguucaauccauuaguugaaacccaaucaccagcgcugcguggcaugaagaugggagaucauugagaggugauaguuaugaaugagaacagggccaucaccauuggaaggugauaguuaugaaugagaauagggcuaucaucaaugggaggugauaguuaugaaugagaagagggcuaucaugaaugggauuucuucccuuacaaaggaucccagagcugggcaugcagcacagugguaaacugcuuguguaucaugaacaagacgcuagguucaaccuccaguucuuagaagcaccauaccaacaagccaagugcucaaagagaucuaucuuacgaggccucgaccaacaggugcaaccugcgaccuagagagugcacaccuaucagaugccccucuagugccuugcccuuggacugccuagccugucguuguuuauaaccuaccuagucuaauauucuuucuaagauauucuguuacaaaagucuaaaccgacugagcacacgcauccuacagaaugcauccacacuugagacucacggucuuaauuccuaccggauaaccaucucacuuuuguacagacgcuaccacuaacucacugacagacaaauggcucauucuguacacaauuuugugaacaacuagcacaccaugcauauuggaauuguauauugacucaccugucucuaccuuucccucaccuucuguuuaaauaaucgaauauuugaauaagcauguauuauggcucgggaugccauaauacacgccucagugguggggaacuugcuuagcacacaacgccccucaguuccauuccucuggcauuuuuauuuuuauuuuuuuaauuuuuuugagacaggguuucucuguauaguccuggcuguccuggaacucacuuuguagaccaggcuggccucgaacucagaaauccgccugccucugccucccgaguucugggauuaaaggcgugugccaccaugcccgccuuuucucguaaggaagaaaaggacaaugcuguguuuccucagagccuaggauacgcaugaccucaucauuaccaacuaauuagcugagagacugugauguaauuuagaauucugcaagaguaguuuucaggaauuacagguggcacaggagaaucugcauuaucuccuggccugcucuucagcuucugggacaacacagagauuacuuggaauaccacaucuucagcauguggagccucauggucauuccuucugugucacaagggccagaggccuugggacuacaauucccaaaagccuacauuugcaugguuuuuauuuaggugucaccacugagagguacuuggaaggugccuggaaggucagagacuaaccaccacuguugcucccagggcagagaagcagcuguaucagcuguagcacauggcugcugugacuucugcaguagcucccagcaucccugugaaaaaauaccugcaggcaccauaggcaucugagauuaucguuagcagguuucugcagucccuugcauuuauugcuucucugaaaaugacucucugauuaccaacuucggcccauuggcucccugaccuaagguuuccuagcccaccugaugaguuuggaagcuacuaauucuucauguuagugucuuccugcuugcaaugccuacaguggcuucucuugucuagaucaaacucugaccugcuuguauaauaaccaggaagaggucggcagcagggagccugaugcacucuuuauaucccuaaucuaccucccacugguuaugugcccuuguccaaagaaccuaagacugcucugccucaguuuccugaucuauaaggcaguaaacugaauccauuucccuucuagaaaugcugugaggauuacucggggacaaacgaagcacauuauugugcguacgacacacaguggccacucauaaucacuggaaauucugacagguauuuuaucagccacuccauauuaacacuguaauggcuacaauuuaggcccauuuuuauuguuucuagcacagaucauagacugcuaauuuauuccccauuuccaaagagcacauuuuaggagcuaaaagcaucaaguugcagaagucucugucuuccaaauggcucacuguugauuggggucagucagaaaagaaacccuuugaggugaugaauauguugucuucuuuccuuggcaggcaaucauggcccugcucuccuuccuuguaggcuuacucucuggcuugugagggcucaguguucugcaauccucuucugugucugcuuacaaauucucugguauccuuuccagccugcccuuaagugagccauguaucaaaggagaucucuugcuucuguagggucauggcaggcacacaguccacucaccauacaggcgauaucgauguuaacucugcugggagagucaccggcuauaaugguuuggguaagaaauguucccuaugggugguguguggaaauacuugguccuuggcuggcagugccaugggaagcugagaaacuccugggacaaggcuagcagaaggccuuuagagcaggcccuacugauguaaccauuacucugcuucugguucccccugcuucuugauauucaagaugggaaggaacaauagcauccagcucccacggcccaucccuacuaggauacauuguauucguuuauuccuuaaauugucugucaggauuucuggcauaacaacaaaaaaguaacuaauacauccaugucgugaggaaaguucugauagcuaaggccuaaaguuauaaaaauaaggcuuuccaaucccugaacccacuuaauuuguauguuccccagcucuaucuugagaauaccucccuguuuuggauauucaugaggccauuuacauuucauaaaaugcucacuguggugacacagaccuguaaucccagcacuugguagaggcagggacaggggcaaaggacagagggaggggagcagaagguacggggagggggaggggcagggggaaggggagggggaggggcaggggaagggggcaggggcagggggcagaggcagaccugaggaucaggaguuuaaggaaauccuuuacuaucuagcauuuuuugaggccagcuugggcuacaagagauacugucucaaaauaccaaucaaccaacaaaucaaccaagauccauggaagcaguccaacaacuuuguccuauucuguggggagucugugcugggaacgggucuggaacuggauucugcugagacacacccagccaacggucuagguccuagacuacagacccucaggacuuuuugcuucuuacgacuuggcagcuuuuacaugauccacuaauccucucugcugcaauguaauaagcuugucauuuaaauguaaagaggagaaaaagacuuucaugcuccauauuaaggaaaaugcaucccauuagccauucauuggacuuggagauugguauaugauccucuaacuaaggcauucgcaugaauucggcuuuaauguuaacacucuuguaauauguugcauauuaugucugauacuuccagacuuuuucauuaugaaaguaauccagguggccugaauauauaaaacuacaauuugaaaaaaagaaaagaaaaaaaaaaaacccucaucuacagaaggacuaauucagcacuuaaaaaaaaagagaauagacuugaaaaugaggucagcuauauuaaauguccuaagcccaguaucagauauauacagcuggcucuugccaaaggaaguaugauagcucagucaacaggaaucacucuccagcaucuuuugaaggugggguguuagcuuauggaaaaagagaacacaucaaacaaucuguguaaauauagaaacuguuccaucuauuacagacaagguucuuacuacaggguuggaagcagggcuuccccagaccgguugaagccuccuuaauucgcaccucaagguucugcaccagcuauguuggguuuaagcagaacacagcuacagcaggagucauuuguuacccaucccacauuuuuauauauccaucuguuggacuuccagagugcugagaagaaucuuaaguggcaggagaauaagucaggcagaagauuuucggugggcaguuggaucucugggacggaucccgacaguggaauagcaccacugcugcugcuuaggaaaagcaucgggcaguuuugaugaacacggccaucaugcuggaaggcaaggcgugaauccugccuacgugggucuguuccgugauggagggcagggagcaggaaguaaaacagacagggucacaguucagaaaugcuuaucuaucccuguuuuugaugagucgagaaucuugagaaauacauuuugauuaaaacagcagaaaaccaauugcuuuaaggccaauuuuaagcaauaucuaugggugaagcuugucuuugaaaacacuuuucauuuuaggcacacuuuguacccucuaggacucagggcuucagcuagcauauuucuuucugaaugucgacccuguggccuagcaugagucuccuuccugcccauggcuacacauuucucuaagcccuauaccauuggcccugguugugagaaaucacauugcaucuugaggggcuacucacauucugccacauucuaacaggucucuaaguuuuuugcaaccuacaauuguagaaaauaugaauaaauaaagcccuagcaacagccacagugauccuggaggaaugacggcccuggggcuuuucagcugcagugugaacuccgaggguggacaagugaaucugugucuuaucucauugcagaagagcucuuagccaggacccugagggccugauggggaugcagagaugggcaugccugauugauggcaugcaacauuaccucucauggguccuuagcacagaagcuugccuugcugagagcacagcgucacuggcuucuaccugacaucgguacuggccuugauauaccuauauacugaggcagggucucagucucagcucacagauucagcuagcuuagcuauccaccuuguucuggggauuccuuguccccgccuccugagcucugggacuggcagggaaagcugccacacagaugcccaacaccugaguacacgucccugugcuucuguggcaagcaauguucaugcugagcccugccccuggcuccaucgagaguuccuugaauguucuaaguguagaguacuagacucagaauacguagaaggcucuagaagauccugaaguacaauagcuguauggcaaagacaaguauucuuaacagaaauucccuuccugcuguaaccucucugcugucaccuacauuuacauuuuaaacaaauaguuaaauguauaugaacgaggauuuuguagauaugguacuuuuuuuuacuuugggguacugcaaauugaaucuagggccugcccccccccccaccaucccgagcuacacacacauccacucuuguauucauugguuccguucggccagggacaggcugcagaagugcucccuaaacagaacuguacucugggucagcaggagaagcggguuugucugaugaucuggagcaggggcagcggcgcggcauuuuaagucagagagcgcagagggagugcuugcucacugucaucccugacugcugcuuucagaacugugccccaugccagaggcugugggcauuugccugcaugacauucugaagugaggauccagcaaccagcagggacaagucggggcuuaaggagaaaacucauguuggaaacuagcgggucaccuguuguuacuucaaaacaaacauuugcaaguuuuggauuucuagggaaguuuugaagacgguacagaaacacauagaguucuacagccacagugauaccuguuaggaugcccugucuucagggcaguaugagugugagcaucagaagcaaccacugguuuuucaguuagcaguauucaaaggaaugauaugcuaaucaacacauuacugauaagcacuguguuuuacccuauaggcucaugugcucugagcgugguuaacaucaauagagcuacgccaagauggccguugacacaggugcguuaguuacaucccugacaggacuguucacacucaguaccgauuuccauuacugucuagaucuaauguugacuauaauuugccacagaugagcuaguauugacauaucaacuuaagucuacaccuauuuucaaaguuuuuacuuguuaccuaauggucccccaccuugggauaggggugggcaguauguuucucucuaacugagauguccucaaacucacccugccucagccuccuaagugcugagcucacacagguaagcccuagcucuuggaucuaauguucccuuucuguccugagcucacacagguaagccauagcucagaaugguauaucuagucaucuugccuugguagaauccucuuaauugugauggcuucuugaacguggguuuuuaacguuuugacuguccugaggagaggggcuguauauuuaacacaaugcuccacaucuggcuuaugugcugguuuucuuuugucuacacguagagagagagagcaugaccucagagguaaacugccauucuucccacaucuuaucgagagcagcauguggucagcgugucuuagcacuugauggugagcuucacuacagcagggcuggugucuaucaggguuuuucacuuccuuaagucuaagcucccaugccuccucaguccgcagagaagacccugagcaagauucauacagaaggagacagagaugcaucaccccuugagggcugguuccuacauaaauuauuuagaauucuuccauguaaggugucugucuauuucuacacccgcuucccuauaucacuccuacaucaauaugcgacccccccuuauguguguguguuuuguuuuucuaguggugaaggauuccagagcaucaugcacgcucggcaagggcucuaccaccagcccauucccaagccucuuuuauauuuaauuucuaugauagcuuuuaaaacaacgcuagccaauuguuuccaaaaaucgcauucagaaguuccagaucccugagccagucaguguguagagaauaagagaccagagaguacucagccuuaaaugauacauaucguaccucucuagggguggggguggggcuaagggucagggauuuucccagaacagggaguggaaagaucguaaaagccagagaugauagacaacuccaagggaaccaugcuuuccagacacaacagggcgguugugcauuuggguccucggauauuaugggagcgugggcaagaccuaggcaagcucaggucagacaaaguucuaguggugguggugggggggugggaaaguggcacaaaaaucacaccauuagcugaagagcauuuuauagauguugggggagggcgagucaguuuuauuuaaugaugugaccaaccucugaugggcugacaacacuccaggguaggcuccacucacgagaguagguguacaccacagacgacuccauaggaaaaaagaacacucagugcugggcggguauggaagugagaguggagaucaaagggguugauaauggugacuaugacaaagauucccugugugacaucuccaaagaauugauaaaaaugugauuuuaaugaguaccagaacaaucuuugcugccuuuggaagaugcaggaagggggccuggaggaaccaagcugccugguguuaugagaaguauuggcuacagaugcaaacaaaacagcugucauuaccccuacagaagugcugaaaaucauggccaaagccuucagauuuuagacaagaggagcagauuucuuuucaaaucacaguuauccacacauccaugcacacacacuuaggcuguugaggaccucagcugucacaucaaauggacaugugcuugcccugcuuggucacuuggccauucuuuaggugucacgagcuuugcaguuucugcagcaauccuggucuccucuccuuaucugagacuucccauucuccucagugcaucuacuccuucuggccacgccccggaaguuuccauccccuugcugggccaauuuugaccucuucugucucuuuaugucuccgugucuauucccagauaugacagcaggaccuucacuaacugccggcuucacgggccagugacacuggcuuugguuucccgaggcuacagccauuaguuuauauucuguggcuuccuccgaaaagugcggagcauagaauaaccacacaaucaacauucguugacugugcaauuaaccuguacuuagaagugcuuucaccuugauucuccugaaauuggaaccccuuaccugcuuacuuaaaaucaaccaucacuucugaguguggaacucagcagcacagcccucucuccuuccugcagacaacacagccccuagaggugccugucccauucccccagaucacauguccccucucuuugugacagcuucuucuccucucuccuugcuucuagucauuccucugggucuaguucucauuguucuacaguccgggugaaaucuaaccgcacaucacucagcuucuggccucagcucacugccgccgaagccugguguccacccuuggccuacaccggaacuggugcaagcuuuucacggcucuucuccucaggaucuggucagguguucccccgucugaggucugccuccucuuucuccuuaucucagaggaugcccaaagggcacaucucccugcucagcgaccugaauuaaucucccucuacuguacacaugucucuuaguacaccuggcacccuauacuguaauuauuuguccuccagcccgcugagccguaacugucugcaucuuccuccucauuucugugucucuggugcuugggagcuuuggagcuuugucugccacaccuggauaaaauggagcuggggauccacaagaaaggaagacucggguugcagacaccuacuuaaggagccagaacuaaccccauguaaaagccugcucuacuuugaggccauuucuauggaguaaguaccaauaaaauugccaaauaugaccuuaugaugagauuuaugcaguaacugcugccacacaccaaucagagagagccagcucccugcagcacccaaagggccaaugaauuuccaagguaauuuguguggauuucuauguccuaauaaaauucccuagacauaucuuggccuuugccuauauaaucccaggguguguuccuagucuuuauuccugaacacaaauaacuucaucauagacuucacucuuuuggggggguuugauuuccacauggcacuagcauuuuuaaaaacaauauauguauucuuuuaacuucccacauacacauuauguauuuuguauacuccucuccacugccucauauacccuaaggauaucagacaagacauggaacagaacuugacccaggauuccaaacggaauggaacacuauuagagucuaccuuacugagcuagaaacaauggcaguaaauuacacaagcccaucuaaagggccuuggaacagggaggauuucacugaugguuaugaaguagaaacugaucaacuguaucaacuuuaaaaacagugcgugguugggcagaucugucuacaguguucauggcaaggguuuuuuguuuguuuuuuuuguuuuguuuuuuucuuccccagacacugccaagagcuccaggacccugugggcugugcaacaguuaugaaguagcucccccaaggccgaaugauugugcacuacuguugaacgcaucacaggaacaccugggcauguaaagaaauuugacuuuaauaaaauauauccugauuaaaacucuccuaguacaacauaagacuuuguaggaagaaguuuauuuuuucaggcuuuauauaugguggaguuuccuucuuucuacccucugaggaguguugggagagaggaggcuaacugccagggagugacuaagucauuagauauuuaauucaugccuaguguucagggaaggacuccccgccugacagugccuaacaggaugugcaacauggaaagccugaaggacauuucucaaguacuuccucagggaucccaccaagggcugguacucagccucaagaaccagcaguagugcccauaaauguggugagguuggaauagcuuggcucuagcacagugagguguggcaaccuuggcuacccuggugugcauccucccuauuuuuagaucaaggcuucucccguucauauccaaagaggacuuaacuauggagggacccauucccagggucaagcucuaccugcuaagcuuggcucuaguccuuacugagcuccacugugggcaugaugcccuacuaugugcagagacacaggauggugcauucugcucgucucuugggcuugccccuucauccagcagcaugcucuuuauucuuacacuugaauacccuuaguggcagaguuagaagagguuacugguuuguggagguagaagauggggcugugugugggacccaugagugauauacacaggaugacuucaggaggaguuuggggaguucuccaggagaggagaggagcagacuccagucugauaauauaccccaagggcccagccuauacaucucucuucuaugcuauacagacagacaccagcaccuccaacccaagcuuucccucugcuucccauccccucaagcuggucccugauauguuucccgucucccucaaacuccuucaggaucaagaccaugcauugaacacucaaauccuuuagggguggcaugguuucaggcaccaggucggugacgaggagagucaauguaaaagcuuugagcuauaggcucuggcagguggcucuggcauggcugagcccauuuuuaugaacgucaaucauagcuccagccacgcuggauccaccacucauaccucagccugguccucugcaggacauguaguucuaggcaccaugucagcuuauuauuugacuuauuuuccaagaguuuagcaugggccccagacagugcaggaacucaacagccgggccaauccccaaccaaaucaaugugaacucauagaccgcuuugaauccacauagaaaggaacaucucucucucucucucucucucucucucucucucucucucucuguguguguguaugugugagcucaauucuauuuucuauaucugugugcugaaaagcaaggacagugucagaaaaaaaauaauaagcaggauguggccaacucuaaauggcauauggaaauggcccacacauuaaaaccuuaaucaguuuacuaccuagagcaacuauaauuguuuucuguuuaaaaaaaaugauaguuuuuagaagucaaggugauuuuaaguaaggacaguugaaagggugauuuacaguaugacagaacuagggaguguuacugcuuugaugcaagcaagggcuuagucacccaaggcuccauagugacaggggauggagguaucacccauggcuuaguggaaaugcauaugcaaggcacaggguuccaccaucaucccaccaauaacugugaaguccaggcaaauggacucacauuccgccaucuugacucugagauccaagguccucuaucuuuccuuauaacaaaacaaaacaaaaacaacucaaacaaacaaaaauaaacauccccaaaacacuaaaauacaaaacaaaacaaaaacccaaacaacaucaaccuauaaaaccaaacaacaaacaaacaaacacaacaacaacaaaaacaaaacccccaaacucuucaacuaaacaucauuaaaaacauuuuagguaguacaaaggcucggacaauuauuuuguauucuuucuuugcacucaaagguuggcaaagaagaaaaguaccuagacagucccuuuuauuucccacacauuacagcuuuggcuaaaucauccuacauaaaaacccagucuuuuucuguguucaauuuacauuuucacuccugaacaguuugcuguaacauucuagccaggaaauuagagagggauauuuuggacuuucaaaggauuuuaaggacuuaaaaauaaaauucugacuaagaaagagacaugcuuacuccaguagcuggccagcagauguaaagcagaggacacauugguacgccaugauuagcaacccacagaggcagccagaggaauuuagcaugcaagccuaugggaggggaggugggugucugauggugcugaggcucucaagagcauagagugggcugugaugugauucaguuggcacagugcuugcagagucugaaguccuuggcucuuaucuguagcagcacacaaaguagacaaggcagugcacacuuguagucccagcacuuggaagguggaggcaggauaauugagaucacccuuggcuacacauggaguucuaggacuagcuugggauagaugagcuacugguucaagacaaaacaaacaaacaaacaaacaaacaaacaaacaaacaagugagcagacaagcauccccagggaugccuggcaaucaccuggacguaagauagguuggcuucuauggucucuucucugucuguucaaaugcugaccaauuuuugggaacaaugcuaucuggcagaaacauaauucgagcuuccuauaaagguuuaaauuucuagcaggcauguuaaaagaaaaaaaaagugauauuaauuugaagauagccagcugagucuauggguucuagaucugagaguucaaccuaccaugaauaguaaauuaaaaaaauaugcaucuuuacugaaaauggaugggcauuuuccuaugucccuaaucucuacacagcauuauaaagcuauuuauggugucuuuacauugaaugaggugucauagacacuuuauuugacacuuacacaaggauguauagcacuucuaagugaacacaaauaccauuuucuaaagguuugagcacagguagauuuugguacccuggagccaauaaccauugauaauaaauaugcguauauauuuacauauauauuuuauuuaaccucacagagaauauacuacuacuuuagcauguaauaaaaaggauccauguuaugauuauauuuucuucauaugacaaguuucgcaucuuggucugaucucagcucagacugcccauuuuaaaagagcaucuuagguagcccagguuggccgggaacugaaugacucuuuggugacacugaacuuccucuggaugucugggauuccaggcaggccuaugugccaaugcucgaggugaugaaaugcugaagacagaacuggggcuuucuaugcacugggcuggcuuccuaccaacugagccucgacuauagacugugcacuguaggugcuuaacagccaccuguaguugguggcucucuguuggacagcacacaugcccagcuagaccaggccuuccuaucuugggggcccaggucccacguucuccuucucacuaggggaauuucacaccaauggcuccaguugcuaacagcuugauucaguuccuucguuagcuuuccuaugaccagggguguccugccagggaccuccgucuaugugcagggacacauucuucuccugagagagccugaaugugcacgcuuaagcuggaaggaaaaauaaccuggggaaugucuuucugacucugugugaggcuccacacaggauggaggaggcagggaugccucugaacucccuuuucucugcuguaagugaacauggcucgucucaacuguguuaacaaauagauuucuucaacuccagagcccaguagcucaguauccuacuuaucccuucuuuuucuucauuuuuuuauguguccaugugaggauuugcagcuccuuauacauuuuacugucaugccaggagggaagaaacaaagacauuggaauauauuaccugugaggaucuaggugaucagcuaccguguuguaguuugcagcucagagaacucucagaaucugggggggaaugacuuggaggagcaccccaggccaugcgggaaggcuuuaggaaaugcucauagccagcuccuuugagagggauggcagugccccuuagaaugacagccucggaccacagucagcuguucacacccuuccuuugucagggcaccagacaaaacugauuauuuuucugcugaaagguauggauaaaagccuagauaaacugccuguaaaguuccccugacagaagagcucauacagccuuugcugcgugaacgagcugcaggaagcaucaucaucaugucgcuuuauucacaucuagcuccucaagcacgcugugugguugcugcagggucuguaagcagaaagaugcaaccacugcaccucagauggacaggaugcaauugcgggcagagggcgggauaucuacccuuugugccuguccgcaucuuuacauugcauguguguguauucaugugugcagaugugugugccuggguauguacaugcacauggaggccauggguccacaugaagcaucuuuccaugaucucucucaauuuauguuuuuaagacagggucucucacuggccuagaacucaucaaguagguaggcuagcaaggugccagggaucccucugacuccaccuccccagcacugggcuuauaagcacaagccaucacaucuggcuuuuuacaugggcucuggggucuaccuugggagcucacaucugaaagguaagcacuuugcugacagagcccucuccccaccauuuauuccaaaugggcaacacacuguguuuuuagaaggguuuuggggaucagaacaagaggaaaaugggugcugacccaggaacaucuuuuagggccugauaaguguuaugagcguagaguuagcggaucugcuucucugaauucuguuaaccagagaaagacauaccuccucgugguuucuuuacacugugaacaauaaaccagccccaucucccaggguauuguuagagacaacacaauggagguggaggagccauuaagagcacuguuguaugcaaaugaguacauuugaaaaagaaaugucacucugcggauuuaggguugucugaaucaugaagguucacaccaaauccaacuucaagugugugugugucuucuggggacauggauacagaguucuaugcuacuccugaccuuaacuagaaguuucaagaacugaaccacgacuacccuucuucucagcaugaaguuccaaucucaucugugcagcaaacaguaucuaggcaaacaucuugcgucaucccuucgcaauguuuuucccaguggcugauuugugguuuuugauguucauuccucagccugcaggaucgcuacccaucucccaacccgucucucuaagggagucuugugacuaaggaagguaucuucagaacacagacugacagucugccugacucaugcuuuggaaaaguggguaucagggcgcuaaaguguuguugccauaacacuggcagugguuggaaauuccucaucaaguuugccuccaagccuguugauucuggcuaagcgcucuagcaaaaaagugagccaaggccuuuaagucauuugggagauaugacaggcuuggguguuugguaauaagacaauggaaaacuuugguauccauacagaaacugcagcaauugcuuuuauuaguuuaagcaccugauuguuuacauauuuacccauugauuuauaaaguucccauagcucaucuccaucauuucuaaggagagaucacuccauagugcugacagauucacauuagcagucucuaaguaggcagaacuuaauuuugauucugaguuuggagaaaccuggcaauauguuuucaacuaggugauaacuguucuaguuaauugaaagagcugaaauauaacauuugaauuuggacuauagacuauaaaugcuuccacgucaggcuaccaaguuauauacaaaacauggacauauaaugaaggggccacgugcuuucuuaaacaagacacauuuaguaacagugucaaaauuacauccuauuaccuguguuauuuaaagugagagaaaaagugugccaccuucugaugaauguuagucuuuccccuagaucugcauuaauuauagagucuguguuuacaggaaaagaucucugagggauuucgaacugagauuaagcuugugucugagucacaagaccuacagaggucuuccacuagccugaggucuguguuaaugggaacucugcucucugcucuucauuccauaagcauggguaagaggcagggucacagucauaggcagugggacugucaucuacaacagugcuggccucuauggagccacccuuuagagucaccacaaagccgccucucuguucagagcuguuccuaggcaacagacgagaaacaggcaaguacaggauucuacucagcuccacucugcuccucaugggacuccuacgauacaggacaagcuuccugcauggagugccugcuugaguuugugagggaagcagcugacuuuugcaaguaaccuucauggcuucugaacaagcaccugccccgacaacccagacauuuagguugcccucagcaaccugcaagcaggaucugccuuaccugggugcgcucugggcucagauacucauuuaaaaccucagcaacgguggcaagacgaagguauggagagaaugaaacucaugaaguacguguauauaggcauauaugcauuauguguacagauauguaaauaaauuauauauauguauauaauuuaugugucuauguguguccccacguguaaggaggaagcgcacgugugugugcaggcaucaucaucagaaggccccagauguuuuguagcuggaauuauagaugguugucagauaucugacacagaugcuuaggaaccaggcucagguccccuggaagaccucagcaagcauucuaaacuaagccaucucuccagccccuagagaggcuuaaaacauauucacacuuugguuuuuauuacuuauuaaauuuucauuucgaguccaucgucagcuugguuuaagaggauguacaccaacugaacagaacacaaggagaagaaaacaaagggccagggucuggggaauuccaagaccuaugaugguguucuaauggauacucagagcuguguugccaaaagucaacguguugucuccugguggggcauaaggguggagcaagggcaaaaugaccaggcaaucugucugcugagcuggggcgagccuucauuucaggaagacguugccugaccuuaagaaacccagccgcgugcuuugagaacuugaaggccccaaugcauuucauuggcuccugggccauuuuaugacaggugcugauggucagccugccgaggauggguaaaggagaacagagacagaagcagagacaggagcugcaucugagugugucagaugugggcacgcacccaagaugacggugggcagggacagcuaauauucacuaguacuucagccgaggccacaggugacagacagcacacaaacagcauguggcuguguagacagagagccauggacauacccaguaaacaaaaaggaacagugaaaauuuaacaauacccugaagccugauacacgaggagacuuggagauucuggcuacauucuuaccggguauccucauuaucagagacuaggacuagaaggaaacacacagaaagacaacaacuacuucuuuaggcucacucgugugagacacagcuuagacacagauuugugcgaagcuaccaugagaugcacagggaugucuugaaccccacccccacucugccaauagguaugccuuugcuuuccacuccgaauguuacaccuggcuggcagauacaauacgaaugcgcuggaucaccgaaucacauguacgcaugcgaugccaguaucugccauuacugugcugaaaccaggaaauggccacugggaccccaagagugugcauucaggucucagugguuacacaugcguguggaugauagcacuguggagaugugugacagucuacuccccuaaggcacuggccucacagucucuacaaaguccuuucagucacacuuggcagccacuccuacccuaaccaacggucaccgcgauucugucuaaaucuucauacucuagguauugcucggaugcucucaacauugagaauggaggaauucuucagagacuguacucugacucggcccagguuccuucagacguccaauucaucauguguuucaacaguucauacuuuuuacugccaacuaauauauaacgcugugaacauggaguugguuuccaguuugggacuuuuacaaauaaaacugcuaugaaccuucauguacaaguugcgugaaaauaaaaucucauuucucugggauguaugcccaagagugugacuucugguccauuuuuagccauaaaaagaauugccaaacuugucucuuuuuuggcaaugguuauaguguuuuacguuugcagcagggcugugcuuacugauccagguccucuucauccuugccaacaugugcaguugguguagucuuuauuuuagccaaugugaucguguaacaauaacuuauugaggcuuuugaguuacauuuuguacaaggcucagggaugcucgccgucucuccccugcuucuguaucugucuucuguguaacuugaagguuuguuucuuuaacgcucaaguguuugggggcucuuuaugugcaccaggugcacauaacuguacugagaaauagauuaaggugcaugggagcagguuauaugcauguaauaugcaguuuuaagggauucugauauccuucguggggccuggaaccacccugcccucagacauuuagaggugacgguaucuuuguuuuacugugaguaaauucaucauauaaugguagagggagagaccgagcugguuaguagaacccaagcaggccuugccauagggaaaugggauagaaucucacuugagaaacaagagaaaaugucacagggaaaucaggagaagccacucuggguacagagaauggcacacccacaagagcagaggagguuuauguggguacacauuaagaguaauagcaagcuuauuaauuuuuuuggugcuucguuugugggguugggaguaagggcaggaaguaguaaaugaggucagaaaaaugaauagggagcuagggguuguagcuuagugaugucuccagcacuguguaaagaaagaugacgaaacaaauaaccaggggaagaguauggaggauccugaaggccaggcuagaaaucucaggaguccaguuaccgaccaucauagaggagacaguagaaucacaacuauccuuuacuuaaguuaauuugggccuauagccuuacccugcugcaugcacccagucucaugugauauaaguucauuuggcaggaucauacagacaaggaacuaggaagcuguuggugggagaucaaguuuccauagagcacaaaggaugaaacagaaaagccuugcuauccagcagccugggacaccaaaagggucccagcacucgggcggcagagacaggcagauuucugaguucgaggccagccuggucuacagagugaguuccaggacagccagggcuacacagagaaacccugucucgaaaaaccaaaagagagagagagagagagagagagagagagagagagagagagcccuagagaagcuauacaaacgaaaccugaugggacagauggaacuagaggcugagacucagaaagaggcuaucauuuugguuugggaugguguucuagcugauguucuauugcugugaagagacaccaugaccgaagcaauucuuauaaaagagaguauuuaacugggggccgaguuuuagaggcuuagucuauucucaucaugguaggagucuggugggagggaggaugacaacaggcagguguggugcuggagaaguagcugagagcuaauccugauucacaguguguguuugugugacagagagacagagaaacagagagagacaaagagagacagagagagacugagauucugccaugugcuuuugaaaccucaaagcuuaccuuuauugauacccuucccccaacaaggccacaucuccuaauccuguauuucuaucaacaaguuccacucccuagugacuaaaugcucaccuauaugagccaugguggcauucuuagccacagaaccacagguggugauguuaguaggcaauauaagaagagcuggcggggggaguggguaacacggagaagaaugcgagaugaauuguguggagucucaguggauggcuggaaaggccgguuagaagggucgggaagaugcccaauuugaugcgaacaaugucugaacaaagguugacagaacaggaauacugagaucauggucuuacuacagucucccgucugccaugguauuuugucccacaguggcagaugcucauagucagucaaaguccaaaacucggagacagaaaacucuagauacaacucauaguuaguuaguuaguuuguuuuuucugagacaagguuucucuguauagcccuggcuguccuggaacucacucuguagaccaggcugcccuggaacucagaaacuugccucugccuccugagugcugggauuaaaggcgugcgccaccacgccuggccaacucacaauuuuuaauuguguucugcucugucuuacuuggaugggaaccauccauuugcccuagguauccaagcugcacaaguuccuuggucugcagaccuuuuacaguuaacuuggcuaccagacucaaugcaguaaguacagcauuggcauauucgguggcagagggggcugacagcauucacacgacuuacuuuaugucacacuguuagaacugcucugauuuuaucauuagcuguugcugcuaaucucuuacugugccaauguuucaaguuaaauuuugccauagauagguauguacuggaaagacaguguacacaaagugcgguucgacuugcggauucuggaacccgccaagaaucccgggacacaucccugagaauaaggaggacuuuuauaguguggaugauguugaaguguuagaggucuugucuucaggaugguaccauugagaaaugguggaccaucuaagaagugagccucaguaggaagaauugaggaagaagggguggcgguugugggugagggcagagaugcugccucuggaagaagaugccuaucccugggaguaaugaaagucugaucuguauccuugacucccuguuuccugccucacuuccucuauccuguccucuugccacagugauucgcccugaagcaccaccccaacuccagagcuggacaguuguuaggaacaugucccucaagcuacagcuaaacacacccgucucucaggaagucagccuacugcagcugcccuguaggaaggagucgacugauaacacagugguugaucggugugacuguuuuuauucuauuuggguaaaaucucaaucuauggaaggagguucuccaggaaacaagacagaggccugggagggagggaagggaugaggucaagagauccugaggggaccagacaugucuucuuuugagaugagaagaaagccaggcuaggagaagcugaagcugacgagaacagaaguccagaaugaggcuccaagugcauuguguggauggaaagcaaacccucuguugcugaaaagaauuccguucuguuaggacgcugguggaguccuuauguaccuaauuaucacaaucacccaggaaaguuaaaaaccacagauuucuuggcccaagcucagccucacugaaugagucucucucugguggaggagggccagagccuugugcuuaagugucuuccauaauuaagguaaucaagccaggcagagaaccuccugaauuccaacauucuuugcuucuguuccuuuuccccucucccuacucuaauuuugguaggauugaagaauaaaccugcuuacagcaugcucucugccacugagcuacauauauuaccccagcuaccuuguccuccgucuccuugucucucugucuguccauuuauccgucagcagauuucacuguggcauuuucgugccuuuucccuuuuuauuuuuauguccuguguuuuacccccuccuacccuccaggucuucuuuaaagcuucuucucuccuucuaguuuccuggccccuacccauauucacuccaacacauagacacagacacauagacauacagguacacacacaugcacacggagauauacacagagauacacauacacucacccacacagagacacacacauacauggacagacacagacacauacauaugcacacacauacacacaugcacagacauauacauacauacaccucccacacacacacaugcaugcacacacacccacauacacaugcacauacacagagacacaaauuagaagacaggaucugcacaagauagagggaugugguaaucgucuuucugggucuggggugcuucaguauaauacuuuccauacauauucacuuuccugcagauuucucaauuuuauuuuucuuuauggcuuaagaaauauaauauaggacucgagccccgggcuaccuugccagcagagucuugcccaacacccgcaagggcccacacgggacuccccacgggauccuaagaccucuggugagugaaacacagcgccugccccaauccaaucgcgcggaaccugagacugcgguacauagggaagcaggcuacccgggcuugaucuggggcacaaaccccuuccacuccacucgagccccgggcuaccuugccagcggagucgccugacacccgcaagggcccacacaggauuccacacgagauccuaagaccucuagugaguggaacacaacuucugccaggagucugguucgaacaccagauaucuggguaccugcccugcaagaagagagcuugccugcagagaauacucugcccacugaaacuaaggagagugcuacccuccaggucugcuuauagaggcuaacagagucaccugaagaacaagcucuuaacagugacaacuaaaacagcuagcuucagagauuaccagauggcgaaaggcaaacguaagaauccuacuaacagaaaucaagaccacucaccaucaucagaacgcagcacucccaccccaccuaguccugggcaccccaacacaaccgaaaaucuagacccagauuuaaaaacauuucucaugaugaugauagaggacaucaagaaggacuuucauaagucacuuaaagaauuacaggagagcacugcuaaagaguuacaggcccuuaaagaaaagcaggaaaacacagccaaacagguagaaaucauuaaagaaaaacaggaaaacacauccaaacaggugauggaaaugaacaaaaccauacuagaacuaaaaggggaaguagacacaauaaagaaaacccaaagcgaggcaacacuggagauagaaacccuaggaaagagaucuggaaccauagaugcgagcaucagcaacagaauacaagaaauggaagagagaaucucaggugcagaagauuccauagagaacaucgacacaacagucaaagaaaauacaaaaugcaaaaggauccuaacucaaaacauccagguaaugcaggacacaaugagaagaccaaagcuacagauaauaggaauugaugagaaugaagauuuuuaacuuaaagggccagcuaauaucuucaacaaaauaauagaagaaaacuucccaaacauaaaaaaagagauguccaugaucauacaagaagccuacagaacuccaaauagacuggaccagaaaagaaauuccucccgacacauaauaaucagaacaacaaaugcacuaaauaaagauagaauauuaaaagcaguaagggagaaaggucaaguaacauauaaaggaaggccuaucagaauuacaccagacuuuucaccagagacuaugaaagccagaagagccuggacagauguuauacagacacuaagagaacacaaaugccagcccaggcuacuauacccggccaaacucucaauuaccauagauggagaaaccaaaguauuccacgacaaaaacaaauucacacaauaucuuuccacaaaucuagcccuucaaaggauaauaacagaaaagaagcaauacaaggacggaaaucacgcccuagaacaaccaagaaaguaaucauucaacaaaccaaaaagaagacagccacaagaacagaaugccaacucuaacaacaaaaauaaaaggaagcaacaauuacuuuuccuuaauaucucuuaauaucaauggacucaauuccccaauaaaaagacauagacuaacagacuggcuacacaaacaggacccaacauucugcugcuuacaggaaacccaacucagggaaaaagacagacacuaccucagagugaaaggcuggaaaacaauuuuccaagcaaauggacugaagaaacaagcuggaguagccauuuuaauauuggauaaaaucaacuuccaacccaaaguuaucaaaaaagacaaggagggacacuucauacucaucaaagguaaaauccuccaagaggaacucucaauucugaauaucuaugcaccaaaugcaagggcagccacauucauuagagacacuuuaguaaagcucaaagcauacauugcaccucacacaauaauagugggagacuucaacacaccacuuucuucaaaggacagaucguggaaacagaaacuaaacagggacacagugaaacuaacagaaguuaugaaacaaauggaccugacagauaucuacagaacauuuuauccuaaaacaaaaggauauaccuucuucucagcaccucaugggaccuucuccaaaauugaccauauaauuggucacaaaacaggccucaauagauacaaaaauauugaaauugucccauguauccuaucagaccaccauggccuaagacugauguucaauaacaacauaaauaauggaaagccaacauucacguggaaacugaauaacacucuucucaaugauaccuuggucaaggaaggaauaaagaaagaaauuaaagacuuuuuagaguuuaaugaaaaugaagccacaacguacccaaaccuaugggacacaaugaaagcauuucuaagagggaaacucauagcucugagugccuccaaaaagaaacgggagacagcacauacuagcagcuugacaacacaucuaaaagcccuagaaaaaaaggaagcaaauucacccaagaggaguagacggcaggaaauaaucaaacucaggggugaaaucaaccaaguggaaacaagaagaacuauucaaagaauuaaccaaacgaggaguugguucuuugagaaaaucaagaagauagauaaacccuuagcuagacucacuaaagggcacagggacaaaauccuaauuaacaaaaucagaaaugaaaagggagacauaacaacagauccugaagaaauccaaaacaccaucagauccuucuacaaaaggcuauacucaacaaaacuggaaaaccuggacgaaauggacaaauuucuggacagauaccagguaccaaaguugaaucaggaucaaguugaucaucuaaacagucccauaucaccuaaagaaauagaagcaguuauuaauagucucccaaccaaaaaaagcccaggacuagauggguuuagugcagaguucuaucagaccuucaaagaagaucuaauuccaguucugcacaaacuauuucacaaaauagaaguagaagguacucuacccaacucauuuuaugaagccacuauuacucugauaccuaaaccacagaaagauucaacaaagauagagaacuucagaccaauuucucuuaugaauaucgaugcaaaaauccucaauaaaauucucgcuaaccgaauccaagaacacauuaaagcaaucauccauccugaccaaguagguuuuauuccagggaugcagggaugguuuaauauacgaaaauccauccaauggaggagcuagagaaaguacccaaggagcuaaagggaucugcaacccuauagguggaauaacauuaugaacuaaccaguaccccggagcucuugacucuagcugcauauguaucaaaagauggccuagucggccaucacuggaaagagaggcccauuggacuugcaaacucuauaugccccaguacaggggaacaccagggccaaaaagggggagugggugggcaggggaguggggguggguggauaugggggacuuuugguauagcauuggaaauguaaugagcuaaauaccuaauaaaaaauggaaaaaaaagaaauauaauauauaauucuauuauauauuuaccacauuuuaacuauccacucaucaucugaugggugucuaagcugauuuccuuuccuuuuuugcuucuuuuuauuuugagaaagaaugucacuuaguugccuugagcucauuacauagcccugguuggccuugaacacgcaauucccuugucucaguagcuuuaguaguuggcaugacgggauuggaguuagucaugauuuuuuuuuuuauugugaauacauaucacauuacaggagcaggaaauaauauaccuguuguuugagaugggauuuuucuacguuuaggcuggugucuuaacuccuagacucaaagcaauccuccugccuuagccuccugaggcaggaaggccaaaagcaugugccaccacugacaucuugauuaauuuugauuugauuuguuaauauuucauuuuauuuuauuguauuucauuuuauuccauucaguguauauguguguguguguguggggguggggugggguacaugaauggcuaugugcaccugugugagagagagcagaagucagaggcugaagguggguaucuuccacucuccaccuuauuuuggggacaggaucacucuuacugaacuugaacuuggggcucacucuucuggcuacccuggauaaccagugagcuccagggaucuucccacuucaguguaucucaccaguaggcuaccacaccugguuuuuauauggguccugagaauuugaacucaggcccucaagcuggacugcaagcaccauacccacccagccaucucccuaugccgcaauaguuucaaagguuaucggaggucugggauacagccuguuuaugaugcauagccaagagguuggauggaggaacuccucuuuggucggggcacaaccaggugccacgagaacuggucaucggcucaccagacaacguuuuuggacaucucucccuucaaaacuguacuuguuucuugccgacugccacaggcuagccacguggcucccugucccugagguuuccaucuaucucuggcugucaggagagagacuggcuucgggaacuuguugaagucuuuaguggcaugcaggcagaauggcucgguucuuuaucugaaccagucacaccauuacuuuaaaagagcuuguaagguguaggccaagaggaaaggcagaagagacaggaugguuuuuauuuuagaaauuagaaggcaucuuaucuggaaggccuauaaagaauuugguccaucucauguaucaucagccuuuucuucucccagcuaagaugaagaagccaagucuuagaaacaggaggccccugugcaguugccuggcuuuaggaaucugcaagugaagcccuugaaaaacaucuccaacacgcagacucuugucucucacacuaaauaaaaacaugauccaaugccgaggccacaauccuaaugcugccauguguuaaacuguaguucauggcacagacagaaaccauccaccuuuccccucacauuauuagcacgcgcaacagccagcacaaaccggcaggccgagcuucacccagagcugcccgugcuugcaagacugaagauaaccaguaacaugaaaugacucuuacccuguuuaaggcuugauccagcuguggcuuagcaggucagaaccuagcacacgugauuuaaauaacgcgcuacacauuccaaccauccuucuccccgacucacaguuacaccuccaucucccaggaacagcgucaagucugugacgugcccaggaugaaggcaagagguuucuugguuagaguacuuugucugguuagagauaaaggacaagcaaacagucccgagcugucaguuaauauuuuuaacccgaaagaaagaaaaauccaucuucucgcuucacagccaaucuguguuuuucaaacagugcagauuccucuccauaucaagugucagaucaguuucugcuuuuuagcacaagacaaauaaaaaguuauccacgaaguuucaagggcaucuuagaaaugagagcugaaguuuaguaccuuuccuugcuauccaauuggcagagcaucuugcaagaaagacaaaaccugcaauuaauaaaccgagucccaggguuucaggaucuucacauuccacuuccucccuuccuggauaaguggagccgcacagauacaaagaacagucucucucucucucucucucucucucucucucucucucucucucucucucucccucccucccucccucccucccucucccucccucccucccucccucccucccucccucucucugcccccuggcccggccaauauucaggcucaagacuccaugaaacagauauuuuccauucuaugaccucaguuuuaggaauucguuuuuuuuuuuuuuuuuuuuuuuugcuucuucuucuccagaaucuaguuauuuuacuuggcagcuuuccagcuuucauucuuucuuucugucucuuucucucccucucuuccacucuccacuuaucauucauuccuauucaucagugcuuugaagacacucgagucaagagucucgaugugaugucugcaggguguuagaauuaguaagugaaacuaaugggauuucccacuaaauuugaauuuuauguaaacaacaaauaauauuuuuuugcauauguaugcccuaaauauugcacagaacacacacugaaaauuauuccuugucuaucugaaauucaaauugaacugggugccuuguauuuuaucuggcaucucuacucagagguugaagagaggcaucuauuuacaccucccagaggaggggaacuuuccuacagaccuuccuccugaauguuccuggccucgaaagcuuuccacagcuucccuuuauuuuaacuguggccuacgugcuggauugcgagcuccccagggcagagagcagcauggcaugggcaggguccaucggaggcacuagggucucgcacagcaccacccaaggucagcauuugcacaaaugccucccagguaacaacagaccccagugcugcucccagccaugcaagcugggucugagcugaugauuuauucaagcacugagcaucaguuuggaaucuucucugcucaguucuuguucagaggcacuuggcacgaucaguaacagugacgauuaaaaacucugguuauuuagagacaugucaauauucaucgucuuacgaauaugcugaagucuagugaccaggacaggucaucuacagagguguccugaaaagcauggcuccaggagucaaaccaggccgaauccuggcucaaucacaaaccucucacgcauggaugccugugcuuugcccaugucauuucuacacucuugggguggggaccuucucagcacacuaaaaaggggggcgaggggcacaagauagggaagacuccccauuuuugaagauggcuuuaaaaaaaagaaauuuugucuuguggucaaaugaaugauuuuuccucaaaucuauaaauauuuuccaucuguauuuucuauguuuacugauuugaaaaauauuuccagaguauauaguuucugaaauuuuuaucauauuggucuaagaagcaaaaguuuaugguuauuauuucuacucaauuauugccuauuuuucuuguuuuacuucuaauauucuauuuauuccuggagauucaaaacaaacacacacauaaaaccaccccaauauuccuucuguccucuaugcccuuaaauauaagugauccaguagauauaaucagucuuguaauuuuugggucaaacaaaucuccaagugagaucacucaguggcucugcgucuuucugaaauuacucccuuucuguugcuauaacgaaauaccccagcuggaaaaccuuucaacgcuuagaggcuggcuuggguccaauuccuagagggcucugguguuggguuggcuuuggugaggaccuggaggcagaaggugcuaacguaagaaucagucacaucacaaaacuaaaagccagagagguucaggagucaggcucaggguuuacaaugcccaagaaaccagcaaccccaaggaacugaagacucuacgccaggcuccaucucuuauguuaaaugucccuuagcucacuucuguauagccacaccggacauccagccucacagagcacauccaaaccacuggacaugccuggagaccacuucaggugucaauucccguuuguauuuuuaauguaauccagugcccauggacaaagugcguucgaaaucccugaaggcuagggauggcuccguggauaaggacccaggcugcuuuuccagugguuuccagcacacauaccguggcuuacaacugcauguuacuccagcuccaggagaucugacgcccucuuauggccuuucugggcacugcaugcacauggugccgagacauacaugcugguaaacacgcauacggacaguaaaacgacaaaacaaaauccaacaacacuggucugucuauugcauguguacaugugcucgcugggcuacuacuucuucuucuauaaaauggaggugcuaugucuacucugugaagauucugagcuaccucaccccccuugcagcuucaguucacauucguuuaaauaacacaacugguccgugcacuuagcauaaguaugccaacuuguggucacuaaauacucgcuuuuauugccugaaugcuugaaauuccauacaguccuuauuuuuuaaauaugcaaaguauugaaaaagaaaacaaccuaaaaaggugaguguacguaggcauguguguaaaauuucagucaucugcccuaaccauguacuucagccaugucagacuagagguggaaguggguaauucucuauggcagaacccuagcugcagcggccaaugcauuuuacauucucugugagaucugggaggcauggcuucacugugguggccugugccagcagcagaggcccucugaggugagcaggugggcugaggcugggaacccacuugcugggaggagaauuccagacuucugcuuaguucugcccacacuguaggcucccgcagggcaggcacuaaggccuggggcccggcuuuccuuguauccucacaggcccuccagaggccuuucucuugucaguaggugggagaugaagacugaaagagcuuuuuagggaacuaucagcccuuuguuuagaaauggcauuucuuccuuaaggacugcucuucucuucagaggucuccagugccaggccacagaccuaaagcagugccugucagcggcuuuagagccgggcaaccagccagacuccuggugcugcugccgccaacugugaagccucagggagccugcucagugcuuggugauacagugguaauguaccucaucagacugcccuguggacugaaugcaacaauguauccaguugagcgccuggcacagaacagguauuuaaucuggggaaauaucucaggugccagguguacagauaggauaccagugauaaggggcaaggguggauucaguuuguaaccacuucagcugugcauuucagagguucccaucuuagacuguguggaagagagaacacauucagcucacagugauagacaguaagagaaagugcacaaaaugcccagugaauguguuccaaucauugcuggguucuucuaccaauuuauuuacucguacaaggacuuuggcacuguguaaauacaauguucugaaugcaggggaggcuccuacaaacaagcacggagaggaagcuguggggaaggcagggcugugccaggagaaaacaaaaccaauccauuaaugucagacgauauuuacuguugguaacagucaguaaaugugguaacaagaaacagauuccuucuacagccaaaggucuccuccaaaaaaagggggaaagaaguuagcaucugcuaaggucacugagaacacagagcaacugaaguuugccaggacaggcucugugcacuggaagggcucaugccuucuucuagaacuuguggguugcaacuccauucuuggucaaacgacccuuucaugggggacccuuaagaucaccggaaaacacaaauauuuacauuaugauccccaacaguagcaaaauuacaguuaugcaguagcaauggaaauaauuuugugguugggggaucaccauagcaugaagaacuguauuaaagggucacagcaguaggaagguugagaaccacagcucuagagaccacccacuguaagcacaagcucaucacuagcuguguaucuggucuuuuuaggggucacuagaaacuuccuccuaccguaaaacagggcccgagcagcuccaucacaagcccgugagacuauccuacaaucuucuggguuucaauucuuuaacugaaaacuauguggguccgaugaagauacuuuugaguccccugggguuggguuuuagggcuguguucaggcccauccuguuccagcucugugcagagcaagggcucgggagauggcccaauggauaaaguacuugugcaagugugagaggcuaagcuguaauacccagaacucaggccaagcgggaugcaggagcagacaucuguaaucucagcgcaccuagugcgagauaggaggcagguucaggagaaucccuggaagucuucuaaggaaaccaagucuuuacaagcuggccagccuugcauaggcagaggcaaacaacaacagggaagagaaguacgaggcucuagagaaucaaacagaggacaugggaauggacgccuccauuuugcuagaggcuucucuaccagcccuugggucaagccuccaaccagguguaggaucacagaagacauagucuuguucuagaagggcaaaccuuauuggcauuccuacaugaacaggagaguugaaccaaggugaucuaacacccgaccucccucuugggcaaaauggacaacaacccuggcaucuuuucuccuccaccagccauguugacuaagccgugcacgcaggcugcucauggcagucucugagagaugcccccucauuccuucacagaccugcaucuaccuugggcuucuguaugaugucugagggggucugggaguacuuauuuuucauccuugguauuugagagugggggaagcaggaccuggccagccuuuuccagcaagggcuguuucguuagcuuucucagcuuucuagcuaacaggaucuuggcgaaucacuuacacagauacagagaagaggucuccagggacagacaccuaauaagcuaaaagaucggacauaauucaucauuuuacacacguauugccacagccaaaauaaauacuaccaugguuucaaguuucucagugaaaaacaaaaucuuuuuucuuuucuuuucuuuucuuuuuuuuuucccugaggggaaaccauuuuccaauagacuuugaucaacuuccagaugcuauuagcugaccaguuuguguaacccgauuauuauaugcauauguaucaaugacacguuucuugauacauugaacaaucauuuccuccguaccuaacauuuuuaagguaauucugcuaugagcauggaaaauugccauccuugaacaagcuaccccuucuggcucaacagcaugcugcacacaggcacgcaggcucagucagacugacucuucccuagucagcgaugcccacagcaggccagauguuuguaagggaagucguggaagcauuggucuuuggcuucuacaggccaugcaugcucucugaagugaggcaaagccuuugcauacaguccugccccguggaggcucggggaaggguuuguucugggcaucacccauggacuacacugauaacagaucuuucuuuucuuaguccuggccucacuggaaaaccuuuuuaaaaaacguuguacuaguuugucuuuaauuccuuucauuguuucuaaguucucuacuuguuuuaaaggacaaauuaagcuucuaauaaagcucugaauggccacagagacugggcuguuuuggggcuuuuauucaccauaaauauucgucuaauggcaauaacggugaguuauuggguaccagcuugguaaugggcauuuuccauacauuaccuuuggaagaaggaacauuucauggguugcugcaauuuaguccagcuuauaauaacuuccaacuccuuuuacuguacaauguaggcaacuggacgggccauucuccuucugucucauuuugguuauuauuauuuuuucuucuuaggaguuuaacccuuuuguuuaaucccaucauguugacugaugaaggccauuuauaaucuucauucucucaaggcacacuuacucuggccaacugaggggcauccacaaauguaaaggggcacucucuugggguuuugucuucaagcccgugccgugaccuuugacuugagaguacauuccucauggcuagcaggccuccaaaaaggccagcucagcaaucagccuaacugugggcuuugcagggucuuggacaucuccaucuggccauuauuccuuggagggcuaucuaguaguaaucuggucucgucuucagguauuacaguaaggcuuguucuucccaggauggcugccaucucugaaggagcaccaguggcccugagacagcagcaauggauacuggcuaugaacuucgcuccuaugacugaggucuaggcuucagguccugucuucaccacuuaauguauuaacagcagaggaagaugguuaccaucgcuacauaaugucacugccacuugcccgguguugucagccauuuuuauucgacucauaaaaaugaggacguggcuguguuccacuguggcucuguguuucccuuggacgaguauaauaagugacacaaacccuuucaucugcuuaguguccauuugcauaucuucucuaguaucuuugaggauuuugcccacuuuaaaccauuuguuguuuauuuauggacuuucccagaguuccuuauauauacuggguacaucauuugccagauuauagacuacagaaguauccuucaaacuuuuggcuugcccuuuccuucugaugaaauagguuucuuuugauacagguaaauuuaugaggauuuuucuuucuguugucugauuuuauaauuucucuagagaacaucuauuuucaggcagugaaggugcugccuuuuaacuuucccugaaauucugucaucucgguuuuauacugaggucuagcaccugucucugcagcugaaugaaacaggagacucagccccucacucgcuacccugguauuguuuggugaaaggcuuucuuuuccagccagccugcuuugcuacguguguagaaaggcaacugugcccauggcuguccuaugcccacagcuguccuuggacuccugucuucuuccacugcugugucuacuuuaagccagugcuacacagucuuguugcuuuaagucacugcuacaccuucuuguugcuuuaagccagugccacacagucuuguuguuuuaagccaaugcuacacggucuuguugcuuugaagauuaaguuuugaaauuggguauuuauucggggaugcccuugcucuucaccaagacucuaucugucuagguucucugcuuuuggguuacuuucccccuuaauauuuauguguguuauuuccuuuucuuguccuauaggacugacuagaaucucuaguaggaugcuggacagguguaacaaccacauacaguauugaugauuuuagaaggaaaacauuuggaccacuacuuuuaaaugugccacuagaagcaggucuuaauuuuuuauauaucccugucaucagauuaaagguuucccaauagucauaguuagcucauuuaaaaaaaaaaucacguaugggacuuaacauuuuuaucauguacuuuuucuguacccaguuagaucaauuuuuuguucauuuaucaauauaccaucauauauauaaagcaauauauauaauacauauauauauaaacaauauauuaacauacguguguguguauguauuauauucauuuuucaagacaggguuucuuucuguagcucuagcuguccuggaacucacucugaagauaagggugaccucaaauucagagaugugccugucuaccucugcuuccugagugcuaggauuaaagguguguaccacccuugcccagaauguucauuuuuaauguuaaagcaaacauauacuuuuguaguaaaucuuaccaagucauaguaaauuuuauucuuuuuaaaaacacccaauuggguauguuaauaccuuaaguauuuugcaaaauguuuuauaacucgauuauaacuuucuuuuuaagauuuaaggcugguuauggugucaggguuacacuggucucaaaaaaugaauuucuuuuuuucucuuuuacuuacugaaucugugggaugcuaacacuucauugauaguguuuuacuggugauaaacauuuuuucaaaguuuuacuuauuuauuuuaugugaauacacuguagcugucuuccgacacaccagaagagggcaucagauuucauuagagaugguugugagccaccaugugguugcugggaauugaacucaggaccucuggaagaacagucagugcucuuaaccucugagccuucucuccagccccaacauuucuuauuuagaaauauaacaauuaguaguaaacugccugacucuggaagaauuuuccguuugugaaagguuugauugugaauuuaauuauuuaauaauaccaauacagcauuuagauuuugagacaauuaucaucauucuaauuccuuuucaagaaaacuaucugaucuaaauugucaaauuacuucccaaggagugggucgcaguaucuacucacugcuaauuacagauucacaggagcugcuuccuuucauggauuaugauggcaauuuauguuuucucuccuuuugcuaggucaaucuugccaaucugcuaauuuugcucauccuuaaaaaacauuuguacuaauuaucuuuauuguuuggugaucucuauuauuuuuauuauauauguuuuacuauuuaucuuagguuaguuucuucuuuuugaaauuuuuaucaaaauuuggcuaacauauaggauaacaaauguauuucauuauuguuucuaucuucauuuaagaacccuauuuauuuuuagaugcaugugcauggauagauguggguacacgcacaugaguacuggugcccacaggggccugagugcuggguuccccuggaguuggaguuacaggugguuuugagccaccuuggugugggugcccggaacugaagcuggauccucugaaggagcaguauguguucuuaaucaucccucuuuuccuaaggucuugacauagaaaccagucacuggugucagccuuggccuuccccccagaaggauauaaaaguauaaauuccagcucuccucacccuuucagugaguuccagguauuuccaucgacugcuccuucccuuccugcucagacacagcugcauccuaacugcacgugagaagugcucuuuaacgcaaagcuuauuuggaaaugcuacugagauuuaaauaagacgcuaucacuccugacguagaauacaauugcuuugugugaucguggagcacgagcuacggcguuuucgcagucuuaaguuucuugguauuucauuuccauggcucaaaaucgggccagccuggacuggugucucugugccucgggaaagccugcauuugcacuucuuggugaugcacaguacacacauuuaaggcagaguggcugcucagguacauacauuccacagacccuaauaguuuacuuauuuuucuacuaguuacuauaggaagauguguuuaaaaaucuaccuaugaugcuagucuagucaguuuuugucaugacuuuugagucggccaguaauacauacuuaugaacaucauaucuuccuccuuagcacuaggaaaugaccuuuuuccaauaccuuauaacgaccauguccuuugucuuagagacuauuuggcagcaguauuaagacauuugcucuaguuuccuugcauuuguuauauaaauaguugugugguuuuuuuuuuuuuuuuuugucucgaggcuuccauuuaucuguaugcuuauacuugaaguguggauuuuuuagacaauaugcaguugugacuuuauagccagcaugguauuuucccuguaaaguggagguuuuaauguauuuacauuuaacacagugacuugggccagauucacauuugcuggcuuccuauuggucauugcugccggauucacauuugcuggcucccuaugggucacugcugccggauucacauuugcuggcucccuauuggccacuggggccagauucacauuugcuggcuuccuauuggucauugcugccggauucacauuugcuggcucccuaugggucacugcugccggauucacauuugcuggcucccuauuggccacuggggccagauucacauuugcuggcucccuauuggucacugcugccggauucacauuugcuggcucccuauuggcgaccgggaccagauucacauuugcuggcucccuauucgugucuccuguuuccauuccuguuccuuccgcucugucgccaugucuguuaaucuaguuuuuaaauuucugcaguuacuuucuggcuggugaaacucugcucagcacagucuguaauaucccugggcacacacuacggagauuuauuuuacagucucaguugagguucccucuucuccagugucucuagacugugucaaguucucauacuacgagccagcacagcacugaucccuugaagcuggaauuacgggcugugaggugccugaccugagcgcugggaaccaaaccccggucucugcaagagcaguaugugcuuuuaccacuaaacgucucuccagccccaagagugacuuuacucucaaagcuugcuccuucugggcgcagggaaauggaaguuuaaucaacaccucuauguuggugagauuugaauucccaacuccaggcaggagcugaagucucugcuccuuucagcuuucuaguuauggcucguccuacugugcucaucagcauccccccaaauuaggagccauuaaagcacccgugggguugagauacaggauuggggugggggugggggaaucgcuuacuccuuuaugaaaugucugccccuaauggccacacacguucacaacugcagacuuuauccucugaccucucaggccacugcaagugugguuuuugucccugagucccugcugcuccuuguggauggccaaguguccccaaggaaggggccauacaagggcucacccaauccacuuugcuuccuuccuggauuaaacuuucuauacuuugcuuuaaauuguuagccuccagucuugcccauccuugggaguggaauccgucuaccgugagcuuuucuaucgcugauguaacugaaacucuuucaccggguauuuaugguuuuguuugugucuaaauaguaaaugguuccuuucaucuucuugaauucuuagcucauuaauccugaaggaaaucucagguauuucccccauuccuuuguccuaucauacacagcacacuuacagcccagcauaauuaacagcgaggaggggaggcgcuuccuuagaaagucugcuuugccucccgaccgacgcuacuuguuuauccagacaggauuugccguguauuugugguuuucagcuggucuggagaccaggguuggucuugaaccugcaaugauccuccuguuucugucuccccagugcugggacugcaagugugucccgccauaccuuggccaacugcaggccacagcuuauguccgcucagcccccauggaacucauaacuucccaucuaucuuucucaagcuugcucccuuugccccacccucugacagcucuccaccgugugucuguuaaauucugaugccugagcauucauguuucaaagccaccaucacugaagggcuacaggggacagaaauguccucucccugacaaguccucacggugaccuucuaacuuuaguacugugcugguuauuuuuauggagcugugacaaaacagcucaaagacacaauuuaaagaagggagauguuuauucuggugcacaguucagaggguucagcccacaguuucacccugugagcuuuggcagugucucaggacagcgggggcaagugggugagaaggcgcucaccucacaguggacaggaaguagacaaagggacagaagggaccaagaauaagagauucucagugauucccucauugugaguugcuaagucccagagcuuauguccccaaauaucuccagauagugucagcuggaggugaccaaggguucaaaaccagaaccugcgggggacauuuucuuuucagaccagaacuaauagcucagaaugugaccuugugcugagaacguauccucagagaaguaauccuguucaaaugaagccaucggggugacaucuaaaguuaacaaguuaggccuuaauuggcauggcuggugucuuuacagaaggagacccagagaaaggugugugugaaaaggacauggcgugaaggcacgcagagaggacggacggccucgugcagccgagagugaggaagucaggccaggaacucagggagacgucccuuacaacugucagagggaacugaccuccccaacucuuuccuuugggacuuggugcucuccaaaacugugggaaaugcauuucucuauuggguuaagucaucuagucugugauauuuuauaacaguagcccauaaugggcaugccucuccaacaaaaaguuguucaacgucuuaaauuuuccuuccaauucacacccgacuuugucucaagacuauacguuccuaagauagguuuugacuucaccuuuaaauacgacagccuuucugacccucagauuucucauacauagugugucauguggggagagugucccugcuuauaccuguaaacucaaaugagggauauaugcauauauuuguguauuggguaugcaugugcuuguguauguaagcacaguaaguauauacauagacacgaauaggccuauauaauauugcauacaaaaaugucuaaggcacgggagucuuaaguuccccaccacaguguuccucuugccugaguguaacagaaggucaggaaagcgcuccaagagacuccaggcccacagugccccucuuuuaagagagccuuguaaacccagcucucuguuuccugugacuugaguggcaaccaugacacagacgacagaggaagguagaggggguaccgaggaacugauaccaccagagggcuuaaacuuaaugccuugcauaaccuacuuaauuuuuauacauuagaagaaauaaggcucuggggaaggagcggaaaccaacauuucagggaguggauguuauagaaauauaacggaaggaagaggggaucacuagcagcacgucaaauugcaugagucaggcuggugucuggugagugagacuuuaaaauauguaaaguuaaguacaacauucugaugguuucccaacacauuuccgaugcucuuuuuaucugucugugaaacgagacagaugaaaauuuguuaggcauuucaaagacugcugcuuucauaauaaucaauccucuuaucaaagaaugacugaaacacaacuagcuuaccaacggcuuacccucuagcuguauacauuuuuaucuaguccaaaugguaagcaaaaugacuaacuucuucagagacucuacccuuuccaguucuuuagagugccuccagauggcauuaaaacucuuuccccauuauauucugaggcacaauuuaaaauuagcaacauuuaaucauuuaggacugucauguuuauuauuucugagaaaacacaaggaaagccaucagaacuuuaaagggauaucccgaggaacacaaccuauagagauacaacauccagccacuuuguggaaggcagagccauucuauagacggaaagagaucucggacaaaauaagaacaugacacgauacuguagacuaugacugcaaaugagggacacuucauguaccacugagaacacugauccagaaacagagacaaucacaaagucacuucuauaauaaaacauguuccagucuucaaaaguaauaaaauuaaacauuuuaaugcagaagccuaugauagaucaugauuaaacagucaguguugguuugugcuucagugguguugagcauugguauaugagaugaugaugaugaugauaacaauaauuaauaacauuauuauuugacacugggcauggacucaguggccuggaacucaccaaguaggcuagaauggcuggcugcugagccccacggaucugccuaacacugccuucccaguguugggauaauaagcauacgcuuguaccacaugccccagcaaguguuuaacugacugagcucugguaccugaauuagauaucauauuaaccauuaaaaacauacuuauguucuuucaagucugagggaaaaaagauuguaauguaagaaggagggacagguaccuucuaagugucuuuucucaucuuuaaaaaacgcuuuacuuaaagacaucaaugaacucuugggaucucggugauauuuauaguuggguuugucacauauuucggaggugggacugcggauggcaggcaggcuuuuuaagggacuugggcacuucacaguauguggcaugcaggacagaaugucccccaagcacaugugaaaaguucugcaaaucuuaugucaguguuaaaagucuccagccaaauuuuaaagggcucaucuccauucuccccagcacucucuagucuaauuauauuucuacuuuauaaagaggaacauuugcauuugcaagaucccuuuucuaugcuaaagcaggaaaaaccucaaaaugcgucuguacccgaaagcauuuaaaaaggcauuaucaugaaaagagagaucugugggccuccuuuccacucugauuaccacuauuacacgauacuugcacuguuucauuuuauaaggcauauuaaagaacagucaucucagagaggaacuggaaagacacuuacgaaguguucgaugcgccauugucuggacucccuggcuccgcaucagcuuucucuuaaaaaaacaaaaaaaaaacaaaaaacaccaacaucaguuucagaguuuuuaagauguaagacuaaacauacuucuaugcuccuauuaacaagcuuucaaagugugcagcaggaggcuuuuaaacaucuuuuauuguuugagaaccgaaugugaaaaaaaaaaaaaaaaaaaaaaaaacgguuucgcuuuggcaauacaauugcccaggcacggggcccugagaagguaccaaggagcuauuugcaaacaagcagagacauggagugcagaccgugccagaagaugaauaucuuacaauggaaucaguuucucuccacuauguuuuacagaaaguugaaggaaaugaacucauuagcgcugcacauccaaggcaugcucaacuuugaucccuucugcuaacacgagccaaacggggucaggcugaauuagaaccuggagagaauuucacaaaaccgugaugccauugucaugagauguuuaagaauuuuauccccuggacaacucuggcagcagguuuuggggcucccaauaaaagcagaacacgauauaaaccagaaaucccuucugaccaucggagaggcaagugaaugaacauuucuaugcgacguggcuauuggauuuaguuuuaggaguuuggaagcaguccagauucuuuucaaacaggcauaagguaauacuuaauccuggaccaacgggcaguuugaaaugugcacccucauuuuguaaggagcucuucugguuuucuggcaauggaagggaagggcugcucaugcuaugguauugcuacagagggcucuacagcgccaacccaacaggaaggguugaggugcaggagauaagccaguggcagcagcuaagcuuccuuacauucaugguaggccuaacaccucccagcauccuuugcuucugcuuagccccuucuacccaaacacuggacggugauaucacuugucuucuauccacccuggcuuguggucauaucgcuuugggaacaaccuucuggaauacacaaugaacuuaucuguccaaacugagcucaaaagccuacucuguagcugcuugaaggagauuaaacaauuuugaggaagaaaagacaaguuauauacacaaagcucagauuuaacuguggugucuauauugugcuagaacacucagaagaggcagccagccacucaguccaaaucccauucauuaagaaggaaaaaaaaagccacaauaccuacgugacuaguuggugcccaacccaggugaaacauguucagauaaaagcaaacacgacagacuggcuugcucuaacacaccgaguuuuacauuacauugcaucuucugggcggaacugugguaugcucauuuaggagacauguaaggacuggucaaggggccuguaugcuggaaaacaaccuaauuuagcccuuuccagauuccuauucccagaaccaccaccauuccugccaaaaucccaaaauacaaccguggcaccuguguuauguaagauagaauuaaagguuuaaugcuuauauacauggacucuccucccucccccaaguuuagagaaauggguuacuguucccagggaacagcugccaacaguaacacugaggcaccaucacaguggaggauaucagacaggaucagcaguacuagacaguaaacauucccaacuguuccagucagaaaacagggaaucauuagaagauaaagaaagaccucgaucgggcaucuccgugaauguuuuaccuugaccaauaauccugccaaggagccaggcugagaggauccagguuggauugcacaugggguccagggacuggagguguuguggacuggcuucagcaugggcacaaagccgcagcucauuaucucugcucuuagcagcauuuauguuguggcaacagggcaaacagaagagguuuggacgaauaggagagauaacauggggccaaaugggacaugcacaggagaaguccgauaguggguguucucggcaaccucggugccaaagggacuggcacuuucuggggagaagcaaggcccagauugagacaggaauugcaguuucuuuucauuuuucuuuuucuugucuuuuuuuuuugggggggggggggagagggagcaucaagcaaauuaaacccccaacgucuuugagaauuuaggugaugcaauuucugaagucaauuugaaauguucagggcacgagcuacugagaaucaucaccgcuucaaccaggccuccagggaaagcgacaaagggcagucagaaagccucaggaucaggaguuugcagguggcugcuugugccccacagaaaggacucaugggagucaccuuacauuagcucuuggaugccaccacucucuuugggggggaaucugcauugcucauuaaaaaguaaggcagaagauguacaggucggucauuuugcacaggggaauagaauuucagagaggaaagagggaaaugagucacagaaagcaucgugcagauaucugugaaaaugcauccggauauaugcaaauguauauaaagauauuaaucuaucuaucacgugugugugugugugugugugugugugugugugugccccaugagggugaggcaugcauaccauagcaaguaugucugaggacaaucucugggaguugguucucuccuaucaucucgguuguaugguagaucucaggcacugaauacaggucaccaggcuugguaagaaacacuuuuauucacugagucaucuaucuaucuaucuaucuaucuaucuaucuauccauccauccaucuaucaucuaucuaccuaccuauuaucuauaaucuaugcaucuauuaacuauaaucucucuauuaucuagauuaucuauacacauagauagucuauuaucuacagauuaucuaugucuauagauaaucucuauguaucuauuacuuauagauauuaucuaugaaucuacuaucuauaaucuguuaucuauagauuauuucucuaucauuucuauauaucuuccuuccuucuccacugauccacccaccuaucauauauuauguauguaugauacacguuuucagugucacaaaugccuucugaugcagucacuaaaauggaaguaaaugggccgagugcagcuuagaacuuuuaagguacagucacuauagagauggguagaguugaggcaugaaacagaucgaucacccagcgggucauuuaaaacaugauaaagcuuccuuuauaagugauuacacacacugagggcuccugugugccugguauucugccugguagagguaaagauaaaaaauaaucugauucccauuccuuucgagauagcgagugcccugcuggguuucaugggaacaaccuuccugacaaagaagaguuuggaaagggaaccaaaucgacccguggaguccauggcuuucuaugcccuguuguuguucugguuugaugucuuagcuuuuuauuuuggacauguagucggcuggagagggaggaagggaaggucugagaggacuggggguggggcaggaugaaaacgcucaaaacacacuguaugaaaaguuuaaaaauaaugaaaaagcacaauauacagcaaaugccagcgggugagcggcaucuagcaagacugugauaaacugugccuugguuuugaauuuuuuaacugaaauguuaccaaaauuacuaaaauacuggaaaagguucgcacccccaccccaauagacacgcaguaugcugagauuucucucaaaagaagacucagccauccugugacacuucccacaauuguagucacguguaguucaagugcauuugggcaagcagcagugacuucacccgcuucuguuacuuguuacccugcaauuacuacucuaaacaauguaucugccuuagauaacaucuacucccauucauguaauaaacucucccuccguaauuuucccuaauucagucuuuacuuuuagcauuucguguauguauucaugacuguaaguauauuuaaucuuuaauuucucacauuaaaaacaaagucaaagauuuaucuccuccaaagaaaagacagaacauaaucuucuacuucuugacuaaucugcuucuuuuaagaauaauucuguguuuuuauuucaugugugugaauguuuugccugcuugcacaucugugcaucaaaggagugagguggcucuagggaaaagugcaucagcucucuuggaaguggauaaggacaguuguuagcugcugcgugggugcugggaacaagcaaguguucuuacggcugagcccccuccgcagcuccucagcuucuguuuuuauacaaagcacauugaggaggcucacucacggcuccuuuccucccucccuuucuuucucagcucuaagcagcuagaucucuccuuuuacgcuguuaaaauuuaaaauagucauauucuguucaaucauaaucauuaacaaaccaccguuguuaauacaaauuaaggaauuauuggauuugcuuauaggucaauuagagaaauuacaaagcaaucaugagcacuuagagucuaauaugaguauuagauaauaacgaacagggcagugagggcugacccaugcagaaggaggucaacgcuugcgaauuugugccaaaugcuugucacucuuucauuccacugcuccaugggucaguuaugcucaaguaaaggccaggccaaucuuccuaaaagauugcuaaacaguaugugaauuuacuuuauuuaauuuaugugaauuaaugcacauaaaaugcauagguaaaugauuugggaacaguaaaaaguuuuuaaaaauuaaaaugaacuauggaaacaccuuccaggugggaaacaaacaguaacgaauggucuagauccuccagagggccuccaguggguucaauccucuuuccugaccugcugucaaguagcuagaaagaagauucuaguucaaccuuccugcuccuuucuggauagauagaccaccagggacacauucccuggucauugcgguuucucacuuuauacgaauggaacuguacugcaguuccaugguccucugagucuugcuguugacgcucaagagcaggcuucuuauaaucggccaccaggaugugcauagccucuugcuacagagguguucugugagcuucugaccuacaguauuagccucagugggacuccaguucccauggacucaugguccgucacccaccuucccuggcuacuuucauuaugaagcuuugcuuucaauacugauacaacaagguucaaacuucguucugccuguaaagucuuaccacacucaucuuuugcucuauaaauucgaggcccagcuugcagacuuccauauaugcggaaguuugaaacuugaugggcacuguaccgaaucuacaguucaauguguaaagaaugcuaaccuguaccuucaaaugcccaucccugaugcuaggucaccuguaauguuucucaauaguuuguuaaaacuucuuaauuaauucuaaucauccaucugugggguuuucaguguucuaucaauauauugaugaucgcaccgcuccgggaaauaaguucggggauuugcacccuaaugaacacuuuucccuuuucuuaguuuacggcugcgaucaaggauucuaccccaccgggcccauuugaacuggcgcuuuugcugaagcuuuagagggugagagaaauaccugaaaagaaucggauaaagauucuuccuuccaaccuuggguaaccguuccugggaaacacuuggucuuccauucccaacuuaauugacauuuuuccuugaauuacauauauugaauuuuaucaaguauuuucucagugucuuagauuaaacauauuuucuuuucauaauuaccacagagaauuacauaaguauuugaacagaaucugauuuugaauuacuaggacaaguaggacuucuuaauuauuacacuuugaaauguauuuuauacuuugcuagauuuaauuagcaaacauagucuuaggaugcuuguguacuaggaucauuaagaaauugguuuacacguuuucuuucuuguauggaucuuguaaaguuuugauaccacgguuaugcuggcccuagcgaacggggaauggcugcccuuccuacgaggaucuccaaaagugggugccagcucauuccuguguuugguggaauccuugguagaaagcaaccagcuuuagcaugugcaaaaugauuuuacauuuaaaaaugacugagccauuuuuuaaauaaaauuuuuaaauaauuuuuuaaauaaaugguuguagguaggacugcucaggcuagguguguaaaauuuuuauauaaaauacauaauuucuaaaauuagauaauuauaaacauauacuaugauaacauuaauuucauguaguuuugccuuugguuacaugggauuuugaaauaaaauauuucacuuaacuaucuguggacagccgcaccagggagccaggagggugcugcaucuccugggauuccaugggguugugagcuggaauggcucucuggucuucugcaagagugguacccagccuuaacugugaggcccucucucuacccaccuagaguuuucaguugauuuaauaaguuccuucagcuaacugcagcuauauguccacgguuugcugauuuccauggcuacgcuugugagaucagcuugggcguuucuuucuuauaaacaaaauguauuaaaggguacgcaaaccuuucccucuuuugugucuggcagugaagugcacaugcgggcuucuuuccauuuaccucgucauggaccuuuggguuagagguccauguggauaauucucagcugccaugugccccucccuauuugggaauuccagucaggugugugguaaucuucccugccucaucuuuuaaauuccacggucugcuuuuggccgcccuaagcugcauucuucauaauuucuuacguucaguuuccucuuuucucaagauugauuuauuuauguauaggagagcucuauuugcauauaugccugcaugacagaagagggccucagaucccacuacagaugguugugagccaccaugugguugcugggaauugaacucacucaggaccucuggaagaguaaccagugcucuuaaccacuaaaccaucucucuagccccaaguucagaguuuugauucauuaguauuuuuuuuuucucaacaauuuucagucugauauuaaaccuccccaaggaaaauuuaauuuauuuuuuuuuuuaauuuauagaaaugugucuuaacauuucuucuuuugcucuuuacccuaccuuccaucuuuucuucuauaucuguaagauagcucacauuauggccuuuacaauucuaaugucagaauucuguuuuuacugaauauguguacaguguuuauuucccuuuuacacaaaguguuuuuuacacaaaguguuuuuuacacaaauuguguaccacuaaauauuuuuuugcaggggggagggggaugcuauuuagucgagguuuauuuuuugacccuuuuuuccugguguucccaaugaacuggaccuuggugcugaauuuuuuaauuuuugguuuucuuagccuucuuugaucuuucccaucugugcaucagaaaaaacaaugagggguucgauuguauaugccagauuuggggcugcaaccacugcuuauugguuuuuauugauccuauuuuuaacucucgccgucauuuaugcagcacccacuuguuuuuuacagugaucucuugcucuuuucuaugaccacgucgcucacaggucuuccugcagacuccugcacuugugccucugauuuccuugccuuggaugacacagcucucugaggccuugccuccucucagggcucacugcuguucacucuuuugagcaacacagugaucaacucuagggagguguccauuucugcaucagaacacugauggagcuuucuagaacacccgugccuugggaaagaaggguugauguacaagacagggauguugccaagaacuucacaagagaagacagaccuguagaugagccgagagcccaauacccucccuucuuguucccuaagaaaaguaggaguaauuuacuuugggugagcagaauuuuugguuaaucaccuugcugagaaaaguugcuccccuuucccaucacgggauuaaucccacuucuuggaucuagcgucaucuuagagucuacucuguuucuuucuaggagagcuagccaacuguucaucuuuaaagcaaauauuacuguaguuuggguuuucugagcauuuugaaaggaaaaugaaaugggaaguuuaugugugacuagcucgguuggggaauauaggaugacacguguggaauaggccagguauccaucaugaccacccaugccuguuucacuguguuuccauggagaccuagagcccacccaggggcucccaagggcucuuuucccauuccaacacguacucucuguugauucuucugugugaacuguaauuuggcugcuaaggcugugugucagaaggggcccaucuuucuguucacaagguaucacucuuuucuguacucgggguggcugcugacuuagucucguuucuguagugucauggucauugaguaaggauuccaaaggggaggggaggaagcacuuaagaucaauucgcugccaucugaacaggcaugcucccaacuuauaaaacagggaccuacaccaugugcuuucaaaugugaguauacaguggcaccuuuaacaucuuaguauuauaacacagaagcuuauuaaacauugaguaacuugucacgggagcagacuuacuaguccccacagguggcucugucccagaaagcccuacagagggugguauaugaugccaugugccaauguucccccuagugaccauuuucuacuugugcaugaauuuuaugguacuucccaguacaauguguggacaucuuuucccucuagcucuccugccucacagauguccaggggaugagucuuaguuccacaaacacacucagcagugccaacugacuuuaucuuccuauagagcuucauaaguagcaaaggcuguucccagcucacuggcugcuccagaaacauacacagcccauucagucuuuaugagcuugcuuuuaggacacaaacagggcagcuuauguauuuuuaaugccccagacaacauuaaugccgauuuguaagggccaaggaagagaauuaaacucccuuucauagagugcucccuucuuugacggcagagcucauguucuucauuagacacugguucaauaaggagacuacuuccuaucucgucuagucugccucuuucuggaagaaggcacaguauauuuagcaagugugcacuuccuucauagagucuaaggucauuuauugggaagccuucugauuggauuucuuugccuauucauuuucuucgaauucagacaucuuguucccugcuguuugauuuguuucucuuguguauaccaaagacuggcagugcacaauacucuuucuucuaggaucucuuugaaaugcacuauucgauguuuuuggccaccucuccccgaaacagccacccucagagccaucuuuaggccacgccacaggaacauccacucuccuucuugauucaauuuccuggacacuucucugaaacuacuauucaugucccccucccccaacucagaaagcaauaaagagacaucagaaagggacagaggcauucuuacuuggauuacuguguccagaggauacaaguugcgaguccugaaaagacaagaaauaucaaugagucccaaagcggaauacacgauuagaucuauuacugaucuauuacucaugacguggagccaaguccccacgcguaucuccugcuacucucacgagaaacauuuacacaaaugugcucaccagcauucugugggcacaguugacaacuggaguugcuugucauuacugaaguuugguuauguuucaucgaggugauauuucauaauacaaaacaaacauucggaaacaaaaacgcucaguggcguggagcacgguuacggugucaugcaaccgccaccuccacccaggcgcaacguuuuccaucacaaaacagaaagccucuguuuaagcagcuucucccaaggccucuccacuguccccuaagccccagcagccacucacuuccaucucuguucccaggccuuuauauucugcacauauuaggcacacggagccacagagcuugugagcuuuugagccuggcuucuucaguuagaaugccacauuggaagugcuuuuuuguugaagcagauauugguauccaaucaguauccaucucuucccuccuuuucuccaacccugaacacccccccccccaucuuccuuucuucuccucuucuuucucugucaaggucucacaauacagucuacaccagccuagaacucggaauucuccuaccuaacaagaauuuugugugcugggauugugggucugugcuauugcugcaggguauuugaccacacugugaacucuggaauuguguuguuuacuggaacaaccuguuucuaguugugguguggcucagccuuaacaccuuuaaucccucuggcuggaaugcagacacacccuuaguacgcaucuuuaaucccaaacaaugaaccuaaaguuaguuuguagaaagaagcagccacguuugaaggugaugucuaauugaguggcagacaaaguggcgaaucagagaaagacuagacagaacagaauaugcccaacuuucaugagaagagagaggaaagggaagcuacuggaggggcagugcagagagagaggaagcaguuuuaccuggagaguuuuacagacagguugcagagagaaaagggaaagacaagcaugagccagagaaggagaaggagccagauuaaaacagauugccaaaguugggaugagggcaagcagagccacucagaggccaagagagaguccagauugagucaguuagauuggagaggaguuugaggaacagcggagaugcaucagccagccaaagagcagaaggaauaagaaagugugagcuuauucagcaguaagucuuagaggcugaaaacauucuaggccuagauaagauuguacaaaggccagaagcuuccaggacuaggccuaaguuaguagacaguggcagugggccucagaaaugacagucccaaugggugaauaaagucauucuaaggugcuuccuuucauuuuuaaguuauuuuaugcauccacuugccgauagauguguacagugucuauauuuugugagcaacacugcuauugacaugcguauacuggaacguagcuugaaacccuuuuuuuguacauaccuagagguagaacuuggggucuuauguaacuacgguuuugagaagcacuaagaccauuuccuguagcagaaccauuucccugccagcacuuguuauucccaauugauuuugagucaauuugacuugauuugaauugauuccauucaccacacaggccaucuuugugugagcuaagugguagcuccuugugcuuuuuuuuuuuuuuuuuuuuuuuuuuuugcauuuaccuacaaaugucaggcauuucuccacgugggagauggcuauuuucauucuugaagaaauacccacucgaguaauuaguuuuaauguaauuauucaccuuuuuguuauuguguugaaagguuccucauacaguugguucuauaccccuaucagauaaacggccugccaauaacuccguuuccuagucuuuuucuuauuacugauaauguucucugaugcacagaacucuuacauuuuauuauauuuauuuaaauuuucuuuuguugcucauauguuggguauggcaacuuaagagucugucaccuagcccaagguuaugaagggucaacuuggcauuuucuuuaugaaauuuaugauuuccguuuccagauuuagccacgaauacauugcauuaaugucuuugaacuuaacucauuugccucugaauguacccuacuccaaauacacuuacagaugaggccgccaggcucauccugacuggacacacucuacuaagcaauaguggucauagcacugugauagacauaaagauuauuacauauaaccauuuaccauuuaugcaagggcauaaauccagugucacucuguauauuagaucgaguuacuagucagguaaguagagauugaaucagauuuuacuuguauuaaaauguaaauauauacuucugucuugagaauuguauuuuuucuuucuuugaaaacuuuuuuuuuucuuaacauaaaauaugagugaacugagguggcgaggguguaaauaaaaugugaagcagugcauaugaucuaaaauuccuauauaauucugauguguagaauuaaaaucuagugaaauggaauuaacuacuauuacaucaugucacguguuucuacaaaaguuuggucuagcaaugcaguugcuacagggaagggggagucauuuaaucugaccggugauauucaaacccuaguaauagugucuauuuuagaaaggcaccucucuggaaugguauagaauaugccagucuguuggguagaagcuggguauccugagacaugcccaggaccuaagcaacccuucuuaggaaccaugagcuauugaccugcagaagagcaacgaguuuaguucuuacucugaaacucaagcuuuggaaaacugcugugugaagaugaaagaaauacacugcucuucaagugaugggcugaagccuagucugcaaaugacuuuagccuacuuuggauagauucugaaauuuaaaaaaaaaaaucuuuauuuguggacccacaguuaaggacuccagauggguuuguguacuuucccacuuaauuuagagucuauaugcaggcucgagugugcuuuagcuuuaauuugcagacaacauuuugagccucggugagcuucucuguuguguguaggcuguggcucuaugcugggggacucacagucagcuguguguaggcugugccuccgggugugguggugggggugggggaguggcgaagcucaccaucaauggacaaggaugguaacuggcauggauuucaggacucagcucauccuccgaaaaacugcagcaaggccuuuccugacugucuguccacacuaauggggauaaaaugucugcuugcugauacauccuagagcucauauaguaacuacuggcauucacuccucuuaaguaaagaacgcagguaagcucaccguugaccugaaucuucacugcuacauccuagaggaugaaauuuuaggugaaaaacccucugaguaaugacuuauuuuuucauuuugcagggguagaggaagcgaagcagaauaugcuuaaaauaauugcuaguuaaaaauauaauaaaacaccgcagaagcguucuguagagaagguagaaaugaacucagaccuuguuccuuacugugcugaugucuacuggcuggugcacagaccgccagauguuagcucaaaaaauacuaacucauuagacuccaauauucccagacugccauucucuggguagaaaugauaucgccuuauucuuuaauuuuuuuuccaaugugugugcauaggucagacaauuucugggagucuauucucaacuucacccauauuugaggcaggguuucucaugauugugucucugcacugcauauacaggcuagcuggccugagagcuuccagcugacuagccuugucuccucuuccugucuugcuguaggaaugcuggaguuucagaugcuuaauacugauguggcuaauuuauguggacaccaggcuugcagagcaaguccuuuuaccuagagccaucugucuggcccucaccaucauucuuaaugucaguuggcccugcauguuauuagucuguucuuaaaggcauuagcuucuuuaagacacaaggcaccaucuuaacccugauaaaggaccugccgcccuucccuguguaguuaucugugaaaucccggaggucuccacaaugugcagacugcuccuucuacaggaagccagugccaggcugggucacagcacagggagaucaccacuuucucacaagggcccagaagccgaagcccuuuccauuuuuguguccaugccaacuacccagacaccaacacauuguagcuucuaccucaaagggugucucucccuugugaccuuccgcuggcagcugcccggggaugggaauaccaagcccugcugcuguucccacauucuucucagccguuaguuaggcuacugcaguauugugccagugcuucucacccgcuucuugcuacuucagggcuaugccagugaauccagaagggauucuaaccggcuggaagugaugccaagaggcugugugaggcuucagcuggugcgcucugaccuacuuuccucucaggauaugggccucccuggcaucugguuucuguaauucaaggaugacucgcucucugagaucuucccgacucucaggagaccuucucuuuuccuucuucuucuucuuuuuuaaaaauuuucaagcacaagauuuuaaaaggaaaacuauauuaagguaugaauguacauauuuuaaaaagacaacugauaaugucauaaaaucucacucuugugauucuuaauccaagcacgguuccaugguaacaaacaaaguucagagaaccggaagaaacaaguugcugucaucccauaucggaauuucccucaagcuuaugugaugucucaggcucacacuccaaaugucugauggucaagcgcacaacggcgagaaucagcccuuaacagcuuuaaaggaugaguuuagcugggacuaauucugaaguuccaacaccugaacuguuacucggaaucguggggguccugaagccccugaaacgugguacuuaacucacaaguaaaacaaacuguaauuaauuuugcccacgauagaaauaacuaggcacaggguguccaagggaacccuucaaugaaguacugugauaaauugugauaaauaucccauuucauaaaagguaccaugcccuuuaaaucaagugaggccaccuucauucucucaugggcacugugauggucaaccauaguuaugaacuugacggggaugagcagcaucuaagagacuaguaagauacacagcuggcugugucuuugagacauuuccacagguauuagaugaggaggcuuugacuuauggagggauuaauuucuugauaaaugaauaacaugguggaauuauuagaaaaugaugcuauaguucuggacgcacucuggugagggcauagcuuuauaaaaauuuuauuuuuuaucauuuuaaaaaaugaagugugugugugugugggagggcauauugcuagggcacaugugcuaaggucagaguuuaacuuguacaaaucaguucucuucuccaaugugagucucggcacuagaacuccuguccuucuguccucagucuuggcagcaagugccuuugcuugcagaggcuucuuugcuggccccaagcagucuguguugccucauucugcaucuaugaggcucaaguugacaaaauagaaucuacaguuaauuuaaauguuucucuuugaagugacgugaaucauggagcuucccugcaaauucccauuuggaguugugaggagagagccagcuacccagaggagaugugugauaaaguuuccaacugugggcgcuuccuuccacacaagugaguucucauucuccuggugaauuagagaaaaugguagucaauucucauuucuggaaugaugcuagaauucuauagagugcuuugaaaaccacucagcaagaauaguuccagaugagggcuggucccccagacuucuuacuccugaccacauaaacugcucccgagacaccacuggguuucacuguggaucccuacccagaacagcaagcauacugcacccuccaguucuuuauuugcauuucaccuuaugagacugcugcagaaugagggcggggaggggagagaggcagggcagauucauuuucuucucucuuggcugaaguaccugguaaggaauggcagccaauuuacaggagaggcgugcauuguuuucuuuaccaaauccaauuacuuuugagauuugaagaauggggcagaaaugcugggcaguguuugucuagggaaccaugacuccaaaaucaaguccucagaggacagaaacaaaagccaggcucauuaucagcugacucugcuuggcauauaucuuuuaacacuuagacaaaaugaagaaauccucagaaguguuuagcuaauuaaauuagugacacuggacguucaaaaugugccauaaaauugacuuuuucuuuuugggagaguagaugacacccuuaaucuuaauaaggucuuaauuccauuguuuacuaggcauuuugaagauuuuuugccccucagauuccauacacaguucuaguucaacaauccaaacaugaauagucuaaucaaucagcggcauuguccagcugucaagauauuaacuagcugagacugggguacagagagaagacccuuaggacuggagucggcagacccagugcagaagcaacugccuccccgugcuaggcugcacucaccuccagcaccacagacuacacuacagcagagaagcggcaaugucuacugcaaacacuaauaacuaucuuuguaaugggcagaacccuggcacccucgaagacgcugcugcuguuaguuccaagaauaugccgccucaccucuggaaaaaaggcuguggcagauggaauucagcuaacgauucugaaguacgaguuuauucggggaggcucaauauaauuucaauauuccggaugagacaaaggagggguuuagagggagccagagaacacaagacaggcaaggaucuuagcaaggauccuuccagaacucagcaaagaaagaaaccaaguugucccaaagagcagcgcucuggccuggaaccugauuucagucagugaaccuggccucaaggcucugccccaucccuagaguagugagacagugaauugcaugauacaaauguguacauguaaugacacacgccaucgcagacacugagugugcagcaacgcuacaacacaagccagaagggacacagacucagcucaccauaagaucauauucucagggagucugucuaagagaaggcguuaguaagaccacucacacuccugcaaguaaagcaauuuacaugcucacccuagagaugagcaccucgcaaaccccuacagugguccuaaauaagacaguuuucauucauguuugaaaucucuucccuuucaauacguaauaggauauuuuucaguaaaaaaaaaaaaauagacaacuuuuagcuauuuguuauaaaauuuggauuuuucccaggugcgucaucuccugugaagucauuuggagcaugaccauuuuguuaacacaaauauauauuuuugccucauucuuccauggccacuucaagccccggaaacuaccauccucuccuuugcuucuguaggucugacaauauuagauccuacauagacuuagaaucauaagugauaauacaauauuuaucuuuugguuuuggcuuauuucauuuacaugugcagacacacacauuuacacacaccugcacauucuacauaauagacccauauaaaugcagcaugugugugauaugugacauacauguauacaugucauauaugugaaagguaugaaugauauguagcauaauaugucagaaauacaacugcaguuaauauuacaaugacuuuaucauacacuuaagaucugcuaagaggacagaucuuugugcaugcguaugugcaugcauguaugugcauauauaauuuuccugcacacacaugugcacauugcauaugcuuguaacagugugccuauggaggucaggaaacuauuuucuuuuuuuuuuauguaagaaaagauaauuuauuuacucuaaaugguuuucuuuuuuaauuuucuuuucuuuucuuuuuuuauuuauuuuuuauuagauauuuucuucauuuacauuucuaaugcuauuccaaaaguccccuauacccucccccugcccugcucuccuacccacuuacucccacuucuuggcccugguguuccccuguacuagggcauauaaaguuugcuaggucaaggggccucucuuuccaaugauggcugacuaggccaucuucugcuacauaugcagcuagagacacgagcucuggggguacuaauuaguucauauuguuguuccaacuauaggguugcagaccccuucagcucuuggguacuuucucuagcuccuacauugggggcccuguguuccauccuauagaugacugagcauccacuucuguauuugccaggcacucgcaaagccucacaugagacagcuauaucaggguccuuucagcaaaaucuugcuggcguaugcaauaaugucuguguuuggaggcugauuauggguuggacccccggauggggcagucucuggaugguccauccuuucaucuuaguuccagcaauaccucuccugggcauaugcccaaaagauguuccaacugguaauaaggacacaugcuccacuauguucauagcagccuuauauuauaauagccagaagcuggaaaaaacccagaugucccucaacagaggaauggauauagaaaaugugguacauuuacacaauggaguacuacucagcuauuaaaaacaaugaauuuaugaaauucuugggcaaauggaucauccugagugagguaacccaaucacaagagaaguuaauugauaugcacucacugauaaguggauauuagcccagaaaccuagaacacccaagauacaacuuccaaaacacaugaaaaucaagaaggaagaccaacgcguggauacuucauuccucccuagaauaggcaauaaaauauccauggcaggagacuacuuucaaaauucucuacuuccaccucgugggucccagggauugaucucagggaaucagaccuugucaguaaccaccuuuuccugcugagucaugacugguucauucaauacauguucauuugugaguuauaauucaauaaugcuaucaaaaugaaauuuuugcauuaguaguuuaaaauuucauuuucaccucaggaguuaagguccuacuugaauauucacaugaaacaaaacaaaacacauuuuugagauagggaugacaaaauauacuuugggaugaaccuagccauaucacaacuucugucacagauguguguauuuaagaaaggcuuguuugaggauauucugcgugaccauagauucaggucgaauuaugugccgauugugaugauuuaucauuuucuuuuaaacauggcaagaugucgcuagaaccauguauuacagaaauuguucagcucgaagccugagcauucaaaggugucuggcuuagagcuuacccgaugugcuacuuuccuuauuaggugguguuacugaggccuggacuguucacucucugauucuugucugaagaacucugcaaaucucugucuuauuucucucuuucuccuuccucuuccucccacccugucuguuuuugaggcagagcauuaccauguugucaaagugagucuuugaaguccugggguuaggagauuguucugccucggccuuucaaguccaugggacuaccaugcccaguuuaguuggccugacuuaaguuauugagaaauaugugugugugcauauaucuaacucgucaggccuaaaauaaauuagaauguugacacacagggaacuucaaauuccugugagaaaaauggacuaacgugugaacagugcuacaauaauuugcuagccacuacaaagacgaaagcuacuuccaacaucccacaucuuuuaaagcuaaaagcauauuaaaauuagaauagagaccauuguuagaauguaggaaaagaggauuuacuuuccucugacagaaaaaucuaacacuuuuuuagacaaaaggcacauaaauaagguuagaaaaugauuccauuauguacacuagacaaaugaguaagauaaaagcggucacuacaaaucauuuuuaugaagugccaacggaugugaaugggccauucguagaggagagauagccauugcucacgagagaaguaauuggggaaaugcaaauuaaaacaaggagauaucaacuuuccauccaucgaacaggcgcgaugauaaaaccuuagcuagcauuaaucauugccugggauacauaacaagaguucuugaaacauagccaaguguaaauguaguuuccaguggcuccauaucauaauuccagccauuacuggggauaaucaaugacaggcacacaaagggacauucacaaagagugcuaguggcccugguguuugagguaacugaccauaagcuagcuaucuaccaauaagaguggaguagacaaaucaaggcaaauccaccccacccaacacugaguuaucauccacagucacucaggaggucuuccaaguacccuuguuaagggaaauguaagcacccccuaggaggcugggcuuguggcucaaggggagacugcuugccuagcagaccugaggcccuggguuugauucuuugcaugaaaggaagagaagaggggaggagagguauagagggagagacagagacagagacagagacagagacagggacagaaacaaaaguccagcccuuagcacagacuuugucauuugguuauggcaacgaacuguuacuuaaaugguucacucagaagacagugauauuucuguagaaaacugacuuggugggugucagcgagcuucccauuuuccuuucuuccuaccuguacaguuagaucuuuuauagugaggacuuaauuacauggcuaggaaagucacagaaagcauacuagacuuuaaguguaucuugcagcuugaguuucuuacagaagaugcagacauccuuuuugaaucuuaggacauugucuguuguaaaaggauauccagggacguuaauuacuacaugccuucaauucuaaggcauucauuuuaagauuaaccauuaaaaaccgcuuucuggaguguuuguguggacacuggagcucacugaaugggugcaaagacugcaagauguuauucaaucucauaaacacuuagaucagugguucucacccuuagggucaugacccccuuagggggucaagcagcccucucacaggggucaccgaaggccaucgugauccagagcaguagcaaauuacaguuaugaaguagcaacgacacaguuuuacgguuggggggaaucaacacagcgugaggaaccgcauuaaaggguugcaguguugggaaggcugagaaccgccgacuuacauaaaauaauucgcaggacauggaaguguaaggucaaagcuugcugcccaccucaaugaagacacaucauaguuuacaaaccacugaagaccggagucuauacuacuggcagaaacauuuacagggguaaggacuaugaagggcuaacauaccauccacucuaaacgucuacacagacagacacaggguaccucucuagugcugcacacgcucaccuuauuugggaaugggaacuugcuugguuccacuuuggcaggagcuugaauagcagaaaguggaggaagccaggucaucuccuagaggugagauuaaaaacaguguuuucaaacaagugucucaagguaagcagcaugcagagcuucaaggggcgucagaaugucagcaguaaauaaaggacaaaagggaauucaaagggagauucgaaucucauuuuuaugaacagucucaggcucuccccccaacaccuuuaaagagagggcuguccuauuuuccaugaccuacaaacaguggcucgaaccauuacacaagauucacgggauguuucugaaggugugcuuaagacagcugaaaucuuagcaaucuuuauuggaugaacugucuaaacuauuaaagauaaagauggaguucccaaccaguuccauccaucauugcacucuucauaggaaauggaggagaaggagagaaaccagccccauagcuguaguaaagagagagacgauggcaucaaauccuauaagccaguauuagcacaucagaagaugggcuguucacauuuaguauuuuagaauuuuucuucaguuuugucuccuagaaggcagcugccaucaauaacguaugaagggauuaaauugauuucugaugaccaagaggaucaaugaaaacagguucugaaucccgcuuuuaauuguccugcauuuucaugucugagaaaacacaaaccuuaauugauuuuuuaaaaagaaaaguuaagacagcuguucuguuggacagagccccacccucugguaggcaaggcuuugagaaaggauccuucagggcuugggaaauccagggauggucuugagucuucuuccccugaguagcucucuccugcaaagccucagauggggcagaauucacaugggagccaagggaaggugaguucccuaaccacccuguaaggguuuaguggaccuccaccagcucugccaugauacacaugccgcaggcaggaagguuuagcaguaagcuuucaaagugucccuucuccaaucugcagucaucaaggacagaccccgguuagccuaugaccuugucuccucccaccucccucugaggaguaggggugcuagguuuguauucaggggggcaucauguucaugaguggagguacuugcuggcuuuuaaggacaacccuguagaagccccaaagcauuuuacauuuugcaccacuucuugacaugaucugaguccacaucuauuauauauguaauauguaauaauauauauucuauauucucuauauauuauacuauauaaaguauauaaagcauaaaguauguauaguacauacuuuauauaguauauuacauauacuauauacacauauauuguauauuauacacuacauaaguauauaauuauauaacauaucauaauaugcaauauauaguauguguagcacacacacacauauaaaaauuuuuuuggaaguguuacucuuguuucucucuaguuuacucugagcauuuucagaguagaaaaugucucccacuuuaaagucaguacaaccaauuuuucuauaaauucgauaccuaacaccacucagcuaacagacaguguggcugacuucucgaagagccucccaagagaugcaagcacucuuaggucagcuucuaaacugaagcuuuagaguaaagcuuuguuucacuuucuuugaucagacgcugcuaaggagaaggcacugugcaucaguacagaccugagaugcugacuuccaguccaggaccucuagaugucuaggaugcucugguucuagucuguucccucuuccguguucuuuggacacuguuccuaugcucugugaccuuccuugaaccuauuugguucucacauucuaacaguagccaggucuauugugucucugacaacaaccagaggcuccugggugucaguguucccugaagacaaauccguggguccucgugggaaucaagccccacugcuuuccccacuugugauccccaccuacccugcccucuuccugggaacuggauccugucauuguccauuuaacuuuaaccuuuucuuccuccuuggcuucgucccuuaagaaaccgucaucucuucuuuagcuuuucuuuauguauauaauucaugucaauagccaccuuuucuuguuauuuuuuaaaguauuauuuaauccuauuuugcugcaaaccacacacggccaugcucacacacaagagagucuauggaauauuggguauauguaguuuaaggauuaaaaaaaagugggugcuuggugaacucccaacucaccaaggucuuaucaucaccugaaaggagaaccgucccuaauaaagcuaccucaaguggccacagucacuggauucuccugaaaggacauuucuucauuccagugcacuugccuucagagcucucagccucguguaugagagcaacauaaagggacccguguaggucucacucuacuuccuacuguguaacacucacagaugagugagucucuccuugcuuacgaagggccugcuuuggaugagugcccguucccugugcugcugcacuucacagcauccaugacaguuccgugccuuugcuggugcuccccgcuguuccacuaugacaugggaguuccuuccccaggcucauccccagcacugacuguuugcuccgcucagagccuguucugggcuaucguguuauaagugcacuccucagucuaugccuaugcuuccucuccugaugcuuuucucccugcugaauaaaaaccacacucgggagacacugauaccuuccuucaagaggauccagucuuacucaacagaauuaaccaacagggauccugauaaccuuuggugaggaugcuuagauaacuaaacucaagaccuuaaagaggggcugcaagucucucaggcaaagcagcuacucauguaugugucagccagagcauuuucuauagugaaucuucccuaggaggugaggugagcugagcuaagcagucaugugucaaugugaacuuucuugcugacgcugauuuaaauacugcucugcauuucaaugggauuuacccauccaacaaguuuuaucaaacacaaaaaugaguagugaacguggacauuguucuguggaacguccaagcaacaaaaccacgaacuuuuuauggacuauuuaaauaagcuuucuaauguaaugcaaguaugaaauguuauauguuauaguauguaauggcuuuaugagauaugcuuugcauuuauugaaauuauucacuaagguugugcaggaaaaccuggagcagacagacaucucuauuucccuugucacuagcucagcaagcauaccuaagucacagcucaggacaguucguuggaccucagcugugauauucuugaagaagaaggaaugggaacaucguucccugagucaggcauaaaagauugaaucagcuaaugcacacaauaacacagcagaaugccccauaucuaagcauucaucaaggaagcacagaucaauaucacacugugucugauccugcuucuaaaaugagaaacauaauuuauuucugaguuuuagauguuggaagccuaagacauaagaacauaugacaaaguguguuugucuuaaaaauaaggcaucauucauacguaaucuguuguucaguuuguaauuauuuauacaaauuauauguuacuagaacugaaguuauucaaagaauuaugauucauaagggcgauuugcacuuuauuuuugaagaaagguccuuagguuuucugaaaugaauguaucuguaacaaaauaacaggaguuggccaaguaaauuaaguaauuaaguaauuaagacccgauagaaaagcuuucaguugaaauuuacuccugguacugauuaaaagugugagcaaagacucucccaccccacauauauuacaggauauuuccacuacuacugguuacucuacaugauccuauugcugaagacacuacaauacuuacaucaagaaaucaagcugguguucaaauagaagcuucgcugcucaccguugcuaacuagaauucacgguacuagaagguucuauacaaacuaccagaagagaagagcaaccuucaguuucuucagguacaaagucugcaaccuguaacagugaccugccaguaagauagaucugcuggggcaauaguggcacagaugcugugcaaguaaccaaaugcugaguggauuuaaggccugcuccacgagauagaacccauacuugacacuguuaacuaggcccgggaccugagacuagacaggccguggguccugcuaaaugaacauaucaacaacauaauuccuaaugacacauugcuauacacauaggucagugcauugcugaacccuaaucagagacgcuucuucucucaggaaauggugguuaacauggagaugcacagcuagacaaugugcagaaggugggagacuuuggagcacucagcccuaaaugagauguuaucagagcccuccccucagggaucggggaucuguguagaauggaggcagauauacugugacaaucagaggugguguccaacucuaaggaaaugguguuuuccagacacaacagggcuaaugcacaugugaacucagagacugugguagcagacacauggccaauacaaggucaaacaagauggacucccagcaugaggaacaugagggaaggaggaccgagucccaccuguaacccagaggcuacuugugauugauggcugcugagagagauaagugagucucaauggaguggaauggguuucaucaacuggaccucagggcaggccucguguucaguauuacccaacacaaaauggacuccauggacugugugugugugugugucugugagugugcaugugugugugugugugugugugugugugugugcauguuucuuuuuaagagagaagaagaaauggaguucgguggcuaagaggagaaucccgauggagcuuggaggagggaaaaauaugaucaaagcauacuguauaaaaauuaagaacuaaaauaacaaauaauaaaggacaggcacaaguaugauuucucauuccuguccaacuuccccucaguuugccucauauuaccuucuuuucagagaagaauguaguuuugugucaaggcuagagaugcucacccccugcauccagggucuccaaccccauccacacucccgauuuugagucaacccuucuuugauacuuugcuuuauuuacagcauguccccccuuauccacaggugagguauuccaggaccccgcaggggaagccuaacccuggaucacaaagaauccuguguguacuaugucuugucuugugcauacagacccaugaucaaacccuuuuaugacccagccauugcaaucauaaacucuguaggagcuguagaagcgcacaugaaccuuuacaacucaaguccugccaagagucacucauggauaggaaaggagcuugugggauccuaucucucccugucaaaacuuaugucaacugcuaaacaccagguuggaagagccauuaguuuuagauuccccacccccacccccaugaccccaccaagcuccccuggcuggugucacaugcauggccaugcagaugacccuagcaaaaacagccuagucacaaaauaaaaagaugugaacauggaaaaaggaauguagggucggggaucauagguaggagggagaggucuuguuggcaacagguggccaucuuuacagggugggcaaccaacuacagcuuuguucucagaaacauugcuuucuaaguaggaccauggcuuaacucugccacccgggaacggaaggguuaaaugcuggagcagccauuugccuguggugcugacagcugcagauuagagcaggguuucaguaucaguuucuauaaaagaauaaccacccagauuuucagucauuucacagguauucacguggugacauuccuaacagguuauugucacugccaucaaaacaugauaaugucauuaaccucccaaucuccuccuugcagguggcucacugcccucugcagaaggggacagcauuucugaggaguguggucuuggugggggcagucugggaauaagagaagaagaaaugcucuuucccugguguaguggaaggcuaugcccuaaccaccaacccacacuggugcuugaggaaaaggucagcauuggccuucacaugcagacuccagggcuggccaucaaggcuagcuggcucugcucagagcgagaaagucauagccaagaacagaacuucaaagacaucccuugucuacuugucuacaguagagggcuugggcuuggcaaacaaggaacagugcauuugaucucacugcaagcucugucuacagugaagcuggucagacaucaagggcuaaaaugagacaguccaguggaaucagccugagaaagagcauucaacgcaaacuuugaagauugacaaaacuaauaagguugccauuuuccuaauggaaacacuacucacagaaagcuuugggacaaaaaguaguaugugcuggagaaaauguaccuucuaaaaauauuugcuuaagaaauuucuguaguguagguuguuaaaaugccagaaaccaugauuguaacugguuuauauguggcuauaaauaaacaaacgacuaauaacuguuuaaagaauuagcaaaagccacagugaucuuaaaauucaggaacagagccaccgugaaccaaaaguaaccaagacggggguucacagaagcugcacuggcauccuuugguauuaaugggaaaucaucccaagaccccaccuacauuggcagacgcuuccugggauaaaaugucagaguaugcgcaucaaccuuguauaccaucugcucauacagucaaucauccacagguagccugugcuguggacagaggguuuuuaccgcucaccacacaugcaauacuuucucugaguaucuuugaucaguggauggggggaucuccgagugggaugcuaauucagccaaucagcugcaaugcuagggcucugcccucaaaggggugacgcaccaagggauaaaauucagugggagcaucggaauggguugcggaaagaacaugccaugcggucuucacagacggagaaaugcaaaacccacaagugcuccaagcagcaaacacugugagcaucccgcuuacuuaaaagcugagaccacaggaugaaaaccccaccagggcggacuugaguugucucuagaaaugcaggguucuccauagaaagucaagaugugaccuccaaauuuuauuuucagguuagauaccuaguuuuggacuuuuuagaaggaugcauuuuguaggugcaguugugucuuugaggggcaggaacacagaagaggccccucucacucucuagugcucucaucuuaaaggagcccuaauauuacucagaaacuauaauuuaaaaaaauacauguuuuaaaauuauauuuuuuaaauccaccugucuuuguacgccauuucauuacuuauguguagaauacauuagaauucucauuccucagucuaggguuguuuuuauaacucucaguggauuaaaacguuaaagucaaagaauuuaaacuggguucucagaauuuaaauuugccagggcaggggugcauagcugcggugcugaagacucccgugcaagccaggugucagcaucuccaucccugggccgcagcccacacagguuagucuccagucugugcuccugaugagauacaguaauuggcauaauuuuaaauuaaaaauauuuaagucaaaauaauaagcaucugaggaacugugggggcauuucccaaauucuaaacauaggcuugguucuucucugggcuguuucugagaaccacaucagauugaggugggcaacagugagggcaaagucacaguauuaacuguacugccauccccuuagcuuugacucacaugacgccuuuuggugaaaggguaaacaccuccugagagacacuuagggcuuauaaugaaucucugaacugugguuugcagccauuaaguugcucuuuuguaauacagcuaaaggaaaagacugcauuacucugaccagagaggaagaccaugggggcaaaagggagaagugggugcauuuugggucagauuuuccauucccaaacuccuuucuauaaguaugguggaaaauagccauuugacaaacuccugugucaaucaaucaaucacagagaagcagaaugguugaacaggaucagggauggacuaugaagccccaggaccagggaugauguauaaauccuuguauaauaacuggcccugccacaaacgagcaggaugagcuugcaugaauaguucccccuauuauuacuauuaucauauacaaaauuauauuaaccauagcuaaaggauuaauagaaauagugauacguauacaaagagucuagaaugucuggcacacaguagguacucagucagugagauuuauugcuauaauaccaacuuuauaauuacuguuggcagcuuuuggcuugggccuugcgaacggagaggauaaauaaagaaggcauuuaugaguuuguuuuuuaaucuauuuuacuccguuaauuauuuaauauuuaacugguaaauuauucauagucaaauaaaaggcauaauaaaagaaugcuuauuaaacaauaauuugcuuccccacucccguggcacuggagucucaugcacaaacagaagggaguaugugccuuugugucgauagaguuuccucaaagaguaagcaggguucaccaucuuugaaaaggcggcuuaucauguaaaggaaucuagaaugugcacuuuaggccuaaggacaaccccuggcauagcacuggguagcuaugaggggguacauugcucuaagcccucgucugcaggggacguugggcaggaggugaacacagcaguagaaggcuuuguauagcaggacagguggacagacaaagcagggcaggcaaggcugcacaaaaacaaaucucagucaccaagaccaggagaaacacuccagguauggcuccaaguaugguggacuucuuacucaacaauggagggugaggcugguccugcccacaggcugcaaccauccccuuucagacaucucccagcuaaguucccuuuggcuacguuggcuuuugucuauaagaggcuccauuacuuucgggggacacauuuuaagauuccaggaaaugucugaaaucuugcauauaacugugcuuauuuccauguguaagcccacagauuugaacagcguccccaucuuaguuauggguugggucauuaucaaucaaucauuugcacacaagcccugugacaggguggugguggacugugguaaccaacauagccaguaaggaaucagcaggcagguaguguacacagggugaacacagcugacaaaaggaagauuccuaucucaggaggcauggagcggggcaggagagauuuuaauaugcaacucagaauagggcacaauucaaauagcaugccuagaguuauucauuuaguauuuuuggaccucaguaaaacggccaaagacaaaucugcagaagguaggggaccuuacuguguugacuuuauucaaacacuugaggugacuguaucagugaauagcacacacagguggcccagcucaauagaaaugucuguuggucucaaggaugaaucggaaaggcaggauggcuguguaggaaauaggaaacaucaccaaacaccagcagccacccaaccucuaggggacaguuguguagcuuucauaagauccauguuucucccccccacccacuuuuuuuuaaaaaaagcaugagggcaacauucuuaaaauggggcagaaaagaacucaaaugguuccucuaaagaaacgaucuaucugauacgagaugucaggguagucagaacacaaccaaccuguuuguuugguccauugcugucuguauuucugaaggcucacuacaccgugauccuuucaacuuuuuuuucugaagugcugggauuuacacguauguccugcuaccaacugcuuuuauuagaagaaaauuaagcuuuuaauaauagaagaaugaauuugcaaagauguggaagguaucuaucgaaaacaaagguaaaaggggauaguggcccauuauuaaaguaaagaaaaaaacaaacccauaauuacccgagaugcagugggagagaaugugccuaguccuacugggacaagaugcuccaggguggggugguacccaagggggaugccccuucucugaggagaaaaggaggcagcaauggacagaggaauuuggacugggaagagaggagggaggggccuguuauugggaaguagagugaauaaaauagaaaaaaaaaaaaaccaggaaacuauuuuagggaacagguaaacaaagaagaucucauggagacuguugcauagaagacggcaaggauggccaaacuaugagagaaaauggagugugcaggucucacagagcuucucccugacaguagugaugucuccucuccugaggcgaggccuguacccacgagaagcaggcugacuuagcagagccaaucaucucauuuucuaugagaugcuugagugugcauccaacugaacgugugcucagcgcucacugcgggccaguaaccuggcauaguagaccauaaccugucauacaagagagaugcuuccugcuccuaggaaauguaaguaucaaaaggggcagacaacuugcacaauauucuucuauguaacauucuguaauauaacucaagguacuaugcaaaaugcauaauaacaccauaacuauuaaaacugugucucagugugggucaacacaugcauaucaaugacuuuaauaccacacacaagcagagaucauaggaucauuguaguagauguagaaaaugccuuuggcaauaaucagcauuccuuugugauacaagugucaaagaaacuagggacagggagcaaaucucaacacaauaaaugccgugugugacaaaccuauacgcaacugaaauguuuccccuuaaaucaggagccagacacuccccacucuuacucaauauaggccugaauucauaaccaaagcuauaaagcaagagagagaaaaauuuaaaaagauaaauaccuggcauuuucucacacauacagacuccaggucuaacuaacauauuuacacagacauggaagcagauggguacuguuaggacagggagaagaaggcagguuguggggagaggggacgaaggagccugaggugagaaacacgggcaaagugcauauauccucacgugacacauuguuuguacacuaagucauaauguugucacacauuguuuuguacacuaaguacaacuacuuuaaaaccgaugauccagggaagacagcauuaauggaugcagggaagacagcauuaauggaaccauguguuggcucccaggccuucgugucaaaugcugagcugcuucucuuaggagcacugagcaucuccagcaggggugaacuuuagggaucccagaccuggaccacacacacccucugacuuugguugagccauacccggggagagggcauucccaacuucacaguuuuguguguauuugucucuacuccugacuugaugccauuuuuaauugcacacagaauauccgggcugucuagaucauaugauuucauuucaauuuuuaauuuaauuaaauaguaucuucaugguucuuuuucugcuuggauaaauuacgcuuuuuauuuaaaagugaaacauuguacaaaugcuaagugugggagugugggaacccucuaggauauuaauaucuacaaagucuacagugaagaguguuaaacacuggcuacuauccaucuuuuaugugaauauacuaauaugaaagacauauauauauauauauuuucaugcauucauuuguaugugccuauguguggaaguaugaacacauaugugugcuggugcuggagccugugccuguguguggggucagaagaaggaauugggcauccucuaccaucuucuucuaccuauuccuuugagacagggccucuccugaccacggagcuugcaucagcuagacuggaagcuagcaagucccgaucugagcgauccucugacucagccccuguaggguugggguuggagccguguguguaaugccucguuacuugggugcuagaauccaagcuuggguucucaggguuguacagcaagcucuccuaacuccucccucacauacauauuuuuaaugaggucacaccguuggguaacuggcuuguuuguuuuuuaacugaacaucuuuauuucacagugccauauguaaauguaucuccuucuugagcgcugcgaagaccaccucgcugucugcaggagugcucuuuguuuacucccaugacacaguugccuuguggucauuucuucaucacuacaaaugaugcuuuggcagaaauccccgcgccuguaccuauuugcauuucuguauucuucacuagaauuauuucccuaagauaauuucuaguccaaaugguacggauacuuauaguuuugguauauuaccaagguuuuccuuucucaguuuauaucucgaccuuguccauccucacaaauggccccucucucuaacccugauucuaacgcuuucuucaaaggccaccuuuuacauuaucccagucuuacaggaaaacgaucuuuuagcuguuguuuuaacuuugccuuuaauugccaacaaaccauauucauuggauauucccuucuuauuuaugaaauguuuauuaauauccccugcgugcuuugauguaugaauacauauuuuucauaugguuguuuaaagaauauauagggaauuaacggccuguuuugccauuugaaucacuauauacuuuccauauuauucauauacaaggaggaacuccauguaaaaaugaguaagaaacuuggaagaaaaaaauaacuuuugagaaaaaggugaguaauaaaauuuuacugcugggugugaggcugggcgcuuuucugugugacagcguuauaaaagcacgugacaggcacacuccauugccuacuggcaaacuucauacugaaucagagaaacugauuuccaggcauauuugguguaauaaaagcuuaaauaggccacuacagcaacguuccuguuuagcccuugguaggaugaagaugauacucucccagggaccuagcauggugucagccaccaagugacacagcagaggccagagauggcaggacuuuuguucuuaaccuguuugaagauaaaaaaaaauaagacagaccaaaccuccaaacacacacgcacacgcgcacacacacacaugcacacacacacacacacacacacgcauuugcacauguauguguuugaccuuuuggggugccaaaguguuuugcaacucugucaugauaauggucucaaaacucuguauuuaucaaacugaccauuuuaauuuauuucuugcaacuuuuuuugguucauuuuuauacugugaguuccuuuuauauaugcauuauauguaaaauauaccgugacccaacuggaaaaaugugucauuaguuuccuaaauuuccaaaguauucaccaaacaacaacacaaaaaaaauacguccucgggugucauugagucacucguuggauguagguugcguucuggcacagaaaucccuguauaaggugugaacagggaaggauuaucgggaguagcauugggcacugcauauuaaagcagaccggcugggagagagacuugggcagccagcacggagaggaggugcugcagacuugggggaaguugagaauccacagugugacccugcauguggugggacuggaggaugcccugugaggcucaggcagauagaacagguauaggaaggugguacccaggucauggacagccugagaagcaguuaguaagacucagcagcaaucagugagguaccucagguaugcuguccaggccagcacaccucuuaaagggaaggugguuggauccagaccagcacaccucuuaaagggaaggugguuggauccagaccagcacaccucuuaaagggaaggugguugguccaggugaagcacaucaacaaaggaggggccagauuuccaaggaagcaaguuaaguuuuauaccuggaaggccucagagaaagagccacacagcauaaacacauagcaacaacauggggguuggaacgagggcaccucgauucuggucucaucuauagaagccauggaaggcucacaaggagagugacauggcauguuuccaauucuuccaacaaggaugccuguagauugagaagaccuagguuggcuaccucugcugcagagucacuuugcagaacaucugaaugaagacuguucuaucuucuuucagcuuguaaaggacugaugagaacaucuaauacguuuuguggggcguaagagccuuuauaucgaucacaaauaugguucugaauguugaacaaauucacuucaguaggacugcacgcaggcagucccaaguacuucccagaacugugauucucccacaggcaagccuuguucucuucuucucugacccuucaugcacuaugacuaggauaaaagaagaagacaggaagacaagagucgucucuaggugugggcuggguggcuggggcacgagguacaaccggaggcaggacauccugcucugugccuggccagaugaugcacuuggcuuauuggagaucuggccucuccuugucugugaauuccaugaaagaagaacacaggagucggaguguuuacaaaaaggagaaaauuguacaggguaugucagucacagaggucuuaucuucagguucugcucuguuuaccucauccacccuuugauacaccuucuuucuucucuauuugugagauauaauggcaauuuaaaaauguauuuuaacagaccuuuagugauguuaggucuaauaccauucuacuccaagagucaaacauccugucuuaauguuuaaauuauucucuaacugaaaaagcugagguuuuagucaagucauuuuugaacuaauugucacaaaaggagcucuguauaggugugguaggguaggguaggguaggguaggguaggauagggaagagaagggaaaggaagggaagggaagggaagggaaggggaggggaggggagggaagggaagggaagggaagggaagggaagggaagggaagggaagggaagggaagggaagggaagggaagggaagggaagggccagcaauccugaggcagauuaaacuuugacagauaauuuucccagcacgccacgcugcuauucagggucauuuucacuggaaggaaucccugaaucaaaggguucaaguuuuguuccucgcaggaaucccccauauaguucaagggaggaaaucccaccucaggcuuuuccuagauggagaaaaggugcccuuccaaucauaccuuaggaaccucaagacccgcacuacccaggaaacagcuccccucuaccuccuuuucccaggcaugucuggggucgccugguguuagaccccaccccuacccucuucucggagcacuuugcuuucagcgcccauucuacugaguggcaacauaguaacauucucaaguuguuuauggccacagagucuggcuuagugagaugcuccuuagaaaauaguggagugaauuuauggguacuuacaggggagagcuggauucaacauugcuguuucugucacgauuauuucuggcauucuuccugugcugugcuacuacauagggcacaggggugagagaucucaguggucagaguggaacuaaauucaaagaguuagaaguccuuuaacuagacuguccaaugaaauaagagggauggagggagagagggagggaaggagaaaaggagggagagagacagagacagaggaaggcagagagacagagacagaggcagagacacagagagagaaggagcaagagcuguucuggauuggaacccagugcgucgugcugggucuccacugccaaccuuccuucucucagguugugaaaaccagcugaggagucuugagugaggagaacacacuuguuuuccaauauggcuauuuacaagggcugcaagugauuccucgauggcauccaaacacccaccacccccaaacccccaaaaugaaucuaccagcuaacaccuagaaggaauuuagucaauaucuacugacccaacuuuauuacaggguagcuggcgagacucuggauccacacagcauaaaguucaagaugaaugugaugcuuuaaaacuauccagcgccuacagaaggacaguaaaauaauguucccaagagauaggaggaaaagagggagggggacuguuggcuaugcaauucucagacuggcuucagauuacacugggagagaaggaaaagguuccguguuugcugaagucucucagaauuguuugcuuuggcugcaaacagcaagcagagucgggauuaucuugggaaauuuucaagaaauuuaaauuuaaaacaaagggcuucuuuucuuucuucuucuuuuuuuuuuaaauaaagaauaggggucagucuguuuaccucauguagacagaugguuguguuuaugcacuuagaggaguaaugcagagagugauuccagaguuccagaugaggcgcauuugccaagaaaaugcuuccgguuggcagaaggcagaaacccguauuggguaaauauuuagcaacacacaagaauuuuaacacuaauaucucauuuguaguggaguaugcuuuauggccugcugaaaucucuuuccccguucuguuucacagucaaugauaaaaaccaaaacacagucaccugucuccugcaccugugccuccgcacugcaaacuggcugcagcaguggaaaguggccugagagagagagagagagagagggcccuucccacuguccggcucugggcucuggguucacagacaacuguugggauagcaacaacaaaaaucugcuaaaauaauuuuuuuucuuauucuggucuguacaaccaacaguuccagcuggaucucaguggcugccuccagccaaaaugugagugugugggcucagcucugaggcauuugauaguauucccgcguaagggagggacgaggccgccaccagcuggcuucgugcgggggccaugugcuaagugugucaccgggcacggaaaauacaaagaaugggcucuuuuccaaaugagcuuacggcaugugggcagacaggaacccacaaacacacgugugcugagguaacucccucggucacgggcugcaaauucagaugucuccguggguggcaacucguggaaaggagugacaucggagcuugccgugugcauaacaggaacucuagagaagcaggguguaaacacagacugacacucugugccaagugccugugggggucuucucuuuaccugccugugacccacgagcaucccggaacagugcccggaggagcugcccgcacuuucuaugcagagcaaagcuuccucuccugaguccucguguacuugaggcccaggcgcacagugaggcagcgcaugcgcaaaggccacaccaugggcaucagcgggccgcacugugaugugcuggggcuuagcggcugagcccugaggagccaguggucuggauuuccucccacaacgaaagauacugccacacugguguaagcacccucaccauccugcccuugaacacaucucuccuuaagacucuucguucagaacauuuaaagucacucucuaccuucacgauacaucaggcacuccuuggguucuuuuguuuucugaauccaugaaaauguucccacgacccggugacauccgcuaacgcuagaugcaaacccauggcucagccauuuugucccgggucugguggccuuacacagaagaccuuaggcuuguguccugcccaguuugguucugggaacacaagcucugcuugcaccccauuauagaaggaaaacccccaaaccugggaaauuuguagucagcauaucuagcuccaacugguaacaugcauguccaacugaccuggucucaguggacaauacagucaagcucaaguugauuaguuugaggucuaagacgcaaaggucaagcagucucagaagugggaaaacuguaaggccagugcucacagccccaucuagaagccgugcauuccugugagcccucguuuccacuccuuuccuuucccuuauucuuaauucuuuacugaaaaaaaaaauacauuuguuugaggggcaggagaaauggcucaguggcuaagagcacugacugcucuuguagaggaccuucuaguccuagcacccacacaguaguuaauccaguucccggggauccaauuacuucucugacuuugaccgacaccagguuagcaaguagugcaacaggcaugcauacagacaaaaugcccaaacacauaaaauacaguuaaaaauuauuuuuguuugggaaaugucauacauacauacauacauacauacauacgauaugguuugaucaaaguuacuccccaauucccucuccuauagcuccccauuccccaacaacuuucccucucaauuuugucugucugucugucugucugucugucuauccauccauccagcuuccuguugcuuuuccuuuuguggcuuauauauuuauauauuuaccauuaagcaugaaauugcuacacucuugcuccauauauauuuuuauauauaacaaguuguaaaaugugugauauauauguauuuauaaugauaaccuuuauagaguaaggaaguuuaacucaguucauaauuuauugaguguuuugaugaaaaaaaguguugaguuuucuccaaaucagucuuaugugucuacugagagucuuagggguuuuucucauguguguuaugguugugguguauuuuagugcuguuaacacauaaaaucaauuuugaaugcaugauacuaacuguuaguuguauauaguuaugaggcagaguaauauuggcuaccugaauacagcauauccuguucaugucaggauacugaaccacgaugggacucagagucagaauuuucugauuuuaucauuacauauuauaugcauauguugaauuaucauccugaaccucauuauuaugugaaauuauaagaugauuaaggagacauaagugguaaaaguacuuccugggagacauaaaugguaaaaauaucaaugugguacauuaacaggaagacaagcaacauacuaguaauaacccaaaucaguacauuauuucauagaauuuuuacaaacaacuuuuaggugaguuuuccaauaaaaaacacugagagauuaaaaaauuguuauagcuaugaauuuccauuuaaaaauagugauaacuaucaauaugaagcucagagacuuccccaaagacaugauagucaaccagagucaacacucagaaccugaauuugcaggcuugugacucagacacagacauagaaaacaucuuuuauuuauaccgacucguagcacagacuacaucauuacaugaucccaucaaaacuagacucccgcaucgcaucuucaacuccagugaagcuucagacggccgccuggucaccaucccuuccugugcaucauuuuuuuguuacaggagggggaagauacauugcucaucaucagacguucccuugacagcacacuugacuaacugacccauuucccauccucuggauaaccaaacugcucagaagagcugucuacacuucauccucauuucuucucuuggaugcugucagugcagagcugacauggccugucaaccuggucucugcaacucagucucccaacucagcguuguuuuaggugguaauucucucccucaggaaucaccgcauuggaguuccuccacucugucugcucccucccuguuuucaccauguuuccgaagaacgcuuuccuggcucuucugaucuuccaaagguugcucagcccagacagcaacucuguaacacccuuucagacauauuuaagcucugggugauuucauccugggaacauuuguuucugcuaaugggcauuuuucuuuguguuccacacuuguguuuaauguuucccaauaucccauucauuccuuuccaaacagagcuugagaucuguauuaaaaaccucccgcuacaaucugauccugagucacuucugaccuccauagccaccaccccagcacaagcaagggucucucacuugaguucuaaggcuggccacuuuguuuccacucgaguucccuucaagucucuccucucuacaaugaccaggguugucaucuaaaaccaaaucagaucacuucauucugucaaaaacguccaguggauucucguagagaagagaacacaggguccuuaagacagccugugagcucuugcugggaucuggccucugguucucuuguugacugagugcccaccauccuaugcuuacuuagcauuuucuagcuacaacaagcuccugauauuucaccgaacaagcagaacagguugcugccucagcuccuccacacuugguguccccugagcaugucuacucaaucccaacaccggcucaguucuaagaucaauuuguucaacugucacuucagaaaaccaggccgugccugcuucccuuucuuaaauaacacuuggcuaguaacuccaugcaacauggcuggcaaccaagccuaccauacccaguaacccugccuacaagggcuaguaacuccacccaccacagcuaguagcuccacccacuauggcuaguaaccccgcccaccauagcuaguagcccugcccaccaugccuuaucuucuuuaguagucaucaccaacaccauauguuuucauccacccaucuguucauggacaucuaagcccacuaucuuggcuguugugaacagcacugcaguaacacagguuuaaguauuccacaugaugcacugaguuaugauuccuucagcaauauacccagcagcuguacauaucuagaaguaucuuaggguaguucuaauacaaaggcuucuauuagguccuggauacucuacaacuccacuaguggcugucucugugcugaagucaacagccaugacugaguuugugguccucagaccccaaagcaucuaccacccaggccugugcagaucaagccugcugacaaccggucuucuaucagguccagcagauggucuguagaagaggcaccaaacauauagaagaaacaaguaggguuaaacacguuuacuauaaagaccuuuacagucuuacuaaaggaaccaaagacuguuagauaccgagaaaagguuauuuaaaagaacugaguguguuuccuuugugggaugugagggaaguccugggagggaccaugcgggcaaucaugacauguaaguguacacaggacuucacugccuggguagcuucagcccaaacugacaaguacaugcacaccagaagcuaggucugcaguagcaugugccuuccucucuuuuacuucuuucaauugcugaugccaauguuuugauuugccaucucgucuugggccauggcccagagcccuacaaauaucagacuauucuuuuggacuaggauuuacacuuaacagggacaaucaggaggcacauaaggggcgucccauggucguuggcaaaaguccagcagggcauacaccugaaggcugguacacaucauaaaauagaaacacacccuccaccccuacuaccucuaugcucucuuuuuagagaccauaauucuggugagguagggguggaaaugagagcaaaauggaaaugguaaaaauaaaaucugaacuuggaaagauaucacaaaccccacugagcaaccaggggcuuuccuggcccagcuacaacacacauucuagguccaaggaccuccaacaaccccauguagccuccccagggaugucaggagacucggcuugaaaguauuuauuguuugccucaggcauuaccuccaauaccacaucaaaggcccaggccuggucugauguuugacauuucaguugcuaaccuguacacaaacauuuccauccugccccuccccaccccccuacccccaugcccaagaccauucagggagaauucagagcugggacuuuugaagguacuacugguguuucagaguguuguauugagucucugccuaauuaauuguaagcagcauuuagaaacccaggacaaaaggcgggggcccaaaugcuuccuuuggccugugaguagguagaggaucuauguucccagcuuggauaguuuccagaugaacaacuuuaaauacccucaaagucuguccugccuuccuguuuagagacauuccuagagauccagugaaucuaauguggaacaugagagggagcggcugccuggaacucaagcccaggcuggcaagggaaggagcagaaauggcaaggagaaaaugucacuguuuacccaacuucaaaauggcaacaaaggcuuagcuccaggcacugcuaaucuuaccucccuggugucugucuucucuccaucuaaaggggcacguccuccacucugacuguggaaacauggaauacccacuucaaaccuucuucucagaagcaucaugcagguaugucagauaugucguccuugcuaugugaacaaacugaccuugcagcguguguaacucugccuucuuuuugaagagggcacagaacucuacaaauggaagagccaagagccacuugauguuacagagcuucccccuuuaggcugacacugcccuaaggaccaagucaagauuucucugccacaagaaccacuguuccaacccccuguaauaagccauuggugcugccauucuaaaugcaggcauaauuccugcuguggggcuguucuucacuuaaacagccagaaaggggaagaacuauucuugcucagguagcacgucgcagggcccucauagaaaaggacugaagaaugauucaagaagcgcuccauggcugcuguagccaggaaaucaaugcucaguugugcaucuacuauguuccaagcccagauacugcauguccucaaccccgugucauccaggcugcaaucuuugauugacaccaggcacacccaaggauccuuaaagguacucaaggaagagacaccuagggaccacugcagaaagcagagaacaaauguccgucucaccagcugcccuggcuuggaggauuauuaggcuccaggaugcucagagaaccaaacagagcaucugccagcaugacccagaauccccugggcuuuaccuccuucacucuuuccucaaauaaaaauaagcuagugggcugccugugcccugccguccggcacccaaggucaccguggaacauucaccgggucuugggaucugugugucuauuucugaauaaaaaaaaaucucugucaaacucacgcacgcucugaguuuggaggagcauccacagggccugcagaaaucauagcacugaaccgagaugcuuagcccagaccugggacuuccucuccaugggauccauaaagaaaccagagcaaagggugacccuuaggcaaaggaagcguugugugcuccuuuaucacugaauaugggaggcaaaggcaggcggauuucugaguucgaggccagccuggucuacagagugaguuccaggacagccagggcuacacagagaaacccugucucgaaacaaacaaacaaacaaacaaacaaaaccaaaaagauuuuaacacaggaacaauuuucuuuuguugaauaaugugggcuucaaugcucuuagccacuuuuuguuggggauggagaguaagaaacauaagacagauauaacgguccuaaaaccuagcccagguucuucaggcugcccuucuuaucgaagguaccagaguuuacacauuuguaaaaaugugacaagaaaucuguguuuucuucuuugcaaauuuguuauugcuguuuucuuucuuucuuucuuucuuucuuucuuucuuucuuucuuucuuucuuccuuccuuccuuccuuccuuccuucccucccucccucccucccucccucccucccucccucccucccucccucuuucuuucuuucuuucuuucuuucuuucuuucuuucuuucuuucuuucuuucuuucauucuucauuccucaauuuagccucgcaguuacuuauuaagacaauaugaaauguagucuccugggccguaucuugaguguuuaugcacaguggucucugcuuagguuuaaguaucuuauucuccuuuauggaccugccuuuaccauggcagccaagguuguuaagggcauacggugcccaacuuguaagucacacuuuaucauauggaugaaguccaggaaagcacuguagcauccagagccacggaaaaggcaggaucagggugagcucaggaggcugaaggcccuguauugacuuucuugcuuuuugucagcuuggggcuauuucaugccuuuuucuaaucuacaggagacugcguaauaggaagccuguguggggaauuacauuuguggagucgcagugagauuucacauggauaugcugguacuacauucaaacuaaaugaccaacccuaaauuugaaacacaccaucaagguaagauuuauguagauagcucuggcccaaacacuaucuccaaaccucuaaaaaauuagcugucaagguuaaaauuccuaaacacggaagauccagccuuacucucuccuuucccucuuugcuuuuacaauggaaucuuaucagagggcccagggcggcaauaaaaugggggauauuuuuaauucucuuccauguuccagcagaucuuuaaaagucacacaaagcagagugggaugaaaggcuuuccugcucgcucuuguucuccugaauccaugggaaaaccucaggaggcuuccaagucuucccaugagcuccagcaauuccuggggacgggaucuauguaagcuuuccaguuaucuaugaagaacugagguuuuggaacaaggcaccccauuugcauagucucugaccaaccucccacggauuuccucagggauuucuaccucagcuuugcacacucugugcacagcacugaugucugugccaaggcacgggugggacucaaacuccuuaacucacccggaguguuuggaaucauuucugucaguuuugcucagugccuuggaaaaguuaucuccuguccaaggcucuguuuccucacauguaaaugaggacagauaauagagcgauaauagagaggcaguaauggcguucuccugaaaugcuaccauauacugcagauuggauaugauucaugagauggcuggucccaugagaugucaauccuaacacacacacacacacacacacacacacacacacacacacacaccagugcagcaauucacuguucugcaggccccacccacccuuugcccuugacuuuggugauccauggucaacugcaaucugaaucuaucaauagagaauucuaaagacaaaugauuccuaaguucuucagaaguuuuauuauaguauaauugcucuauuucaucaucaauaugguuaaucccuugccaugccuaauuuaugaacccaauuuuaucuuagguauguaucauuaagacaaaaccaggauaucuaggguuugaagcuauuaggcaaaguuuugaagauacuccucaugaaaaugguggccuacaugauugugauuacuucaauuauagguugacaaaguccuaaagcuacggagagaguccugagaacucagcuagaguaacaggccaacuuuaaagcaacaacaggguuuucagaccagcauuucccacauccuuugucuuuguucagcagauugcuguaguggggaaucagccagccgauaaccauggcugcccagaugccaggggcauguagccacucaacggaauagacaccgagcugcuuuaugacgcagugcuauaaagccaaagccagauaaugaaaaaauaaaccagaaccucgaauuaauccuuccauuccaauuugcuauaaaauauuuagaggauucaggcugguuuuagggugggacucaaccugccauggaacucugucgaacucgcaccgcaauggccggguucccgccacgccaucuguuccugacacuuggucucguuaguacgacugcuuuuauugauacacacagccaugcuccucauaccaucuuagcuaggcauuauuuauuguauccauauauacaacaauauuaacacagucaagcaccaggauggguacuugagggcaucauuaaaaucagcaguguucaguucaagauuuaaugaugauuuaauaguauuaaaugaggaaaaaagggcccuuggccuuuccauucucauuuaaaaacauauaaaagagcaguaauucaggcaguuacacuucucucaaagauuuugcucuaaaucacagauggcaaggagaggccauggccgggugcuggcucacaccccacucacucugaccgaagccagaagugcuuuguugggucaugauuagcaaaaugcuugcaaacucaacccuuacaucagaguccggucagcacuaggcugaaggacagagguaaaggacaagggaaaggugaugugggguucucccaaggcugccccgugcagacagccauccucccucacaaggcacugacaccaacgugcaucugaacaugcugugggaaggaaguauucugcucugucugcagggaaaaccuuguggcuuugcuccuuggcucccagggcuucaaggcaacauguuuugcacacucagcucccgcuugcucuugcuguccacagacaggccacacaucucuguugcagaaacaaaucauuuagcaauucucugggaugugcaaccugcagaggaagacuacacaguucucucuagacaccauuaggcuggguuucaaaguuggguggaggcuguuuuggcagaagagaaauaacccuggaguucagugggaggugaggcagccuguuugcuuaguuauggaccagcucugcuccugccagccccugaauucacucccuaucucuaagcuuccuccuggacccaucccagauuuucuguaauuagaagacagaacaagacuagauuacauuuauaaaauguccuuccuuuaaaaggcuugccauaacuucuguaagaaguuguugccaauuaggugacugguaaugucugcauuucuacagacuguaaaaagcaagcaaauaucaucagaacaaaauggcuaaccucucucagaaccaggaccaggccaaucucaaacuaucucguguguuagccugcacgagugccaccuaucuggcaugaggagaaagugauagugagcaugggcagggugugucaggggaagccuucacuguaugaggagggacacugcuugcaggacaugucccacugcuaacagaaucuuucccauacuuucucaaggccugcuggaaaaggaaacaaccauagcagaggcaaauuagcugagagcuacaaaaugaugcucucugcauuuuaaagcacauuacagaaucugucaacuacuuccaacaaugaaggcgauguagagccagccaaaauuacacaggcauggacucuagugaugauaccuaaauuagaccguggauggcggcuccugcaaaaauaaaugcaaagugauugcucaucagaaaacccacacgcucccgugcagaccucucccgccugugauaaauucuuccaucaaaaugacuacucaagcauuuaccaacugcccucgaaauacugcaaguugauguuucucaucugaaaacguguacacagcacagaaaagggagggaguuuuacagcaacaccagagucuugaagcuuguaugguaaaggcagggccucaagaaguuuuacaaccugguggagaacuaugugguaacuacuguuacgacugcaaucaauuugcaacaauuugcuaacaaggcuaccuuacacuacccaaaccacauaggagcagugcuuugaaguuuugaaugaaagacacagaaccucuggauggaugagaucugaauucccuuuacccagugaagggguucauagacacaucuguggugacucuccuaaagagcacuguucgcuuuuguaacuuaagcaaugauauccauuaaguagcuacugaauuugacaaacugucucaacucugggaaacauuuuacuagucacagcuaaagagauacuauuugccgucuuaguggguaaaggucaaaggugcugccacaaucuuacagucccuggaauugucccugcagcaggaaauuaccuaaacucaaaauguuaauagcgucaaggcugacuccuugauagacacaugagccagcaguucuguuuagcguagauaaaugaaaacauacaacuaugcgaagauuugcacacaacagcagauuuacaaagccugaaagugaaaacucagacuauccuuugacaaacaaauaauggagaagccuauuauugguagacacauucaaugggauccuucuuaacauuaaaaaggauggaccaagauaugagcaacacagaugaaccucaaaaacauuuucacacaccaaggaagcagggcccaaagauuauaucuugcuugaacuuagacagcuaacaucugggaucggccuucgaaacucaucuguggugccggagccuaagacagcgaaccuguugaugaaguucgucuuucgaagguuucuccuuuccuguucugaaccuugugucuauacuuuccacacacuugugugaacugaaugugacaggcaugcugucagcaagcccugcauacacuucaauuucucugguuucuuuuuugaauuaugcagaaucaugggacugaaccuuccaacacugggaguuucccagucaucucuuuccuuuuuguuuccgaguuaauaucauuuugaccagagaacauauuuuucuguucuucagaaccuucuaauguagggagguguguugugaacaccaaacagucuaguuuaccaauugugccaugcauacuugacaaaaaccacugagugcugaacugcccaaugggaugugcuaaggucgcucaaugaagccacuaaccugcugcuacugggugcagggcucaucaugucaacuccuuugcuugagauuuaaggucuucugugauccuacuaaaaauuuuuuuuuuucugucaacgaugagaaaagaauacugaaaucuccaacuaaaacugccagguuguuucucuugcuauuucuacaguuuauaccaugucauaaaagguuccuuuauuuuaugaaagguuuauaaagguuguuacauaauuccaaugacugguuacacaauucuuauuauuuuaaacuuuuccuccaaauuccugacaauauuugucuuggauucaauuauaaagacaacgccuuccauccucguuuucuuuagauuagcaugugcaugaaguuuuaagucuuuugcuuuggaaaccuugauuuauuuucaaagcauauaggcagcauacugucugccucugaauuguuauagccacuuuaauaaccuuaaacuuuuaaguagugccuagauaagcuuuucuuuaaaguaauuauaaaaugauagaauguaagcuuacuucuuugauauugguuuacauuuuuuucuccgaguucucugucuucuuuuuagggucagccugaucgcucuuuccuauacauuuucuagguuucuggcugaucugcuguccugcugauuucccugggugucccuauggugacuucgcacauucugugugcccuaaguagaagcacaaaccugugugcggacagcuuuagaacucucgugacuucaguucucuccccucagccguggcuuccucucuuuuugcucuaggcuaucgguuauuuaaaauaaaauuaaaacuaggaaaaauaacauucaccauuuccagaauguucauuuuauggagacacaguuuccauucgccccgacuaauguacgacaauucuuauuuauuuuguuccauuuguuucaaugaauuuucuuguuauuuguagaugaacuaauuugcauuuauuuuugaaagcuguuuuugauggguuuagaugucuaggguuuucuuuccuacuucaaacauacagcccacuauaccacuguuuguaucauauccaacaacaacagcaacaaaaacaacaacaaccaaaccugcuuuucucuagauuuuccuaucagugguauuugcaauuuacaauuuuuaacucauauuaauugcauuuuggucaucuugcuucuugcuuuuguuuugcugaacuguauuuuuucagucuucgaacccucccauccccuccuagcccaaugguacuaaggaauggcagugcauuagugcacccauagaguacauuuagaaugucaaauuagguauuuucuuagcucuaaagaucugcuuuguagaaauuuaauggccuucacugcucugugcaucuaaccuuuuauauggaggagaauacucuagcccacggugaagcuuuagcccaucauuuuuuuucuuccauuucuguuuaucuucucauuggccaguucucuuuuugugaugggucacaggcuuggucuucuugucugucagcauucggguugcccacuuacuaauaccaugggugcuaggcugguaaaccccuuuuuucuuuagguauugaugaaguugggaaaauuaguuuacuuguagaguagggugcucuuuuuacauuuuuugaugaauuucuguagcauaaaagguaauguucugauuaugucauccucauauauacauauccaguuguuaacuuauaccuuauacuucaguuuguuaggguggaaccaaucccuugacucuuggguguuuuagcuccuuugcaagucugcuguagguuuuuaaugaggucuuuccauuacagccugugaaaauuuaaauguaccucugcuguauuuuaguacugggaauuacuuagcucguggcuucaugguaauauuuuacuucuagggccuauggaauuuuacauuuugcaugcaaggauuagcacucagacagauagaaggacccccacccccauccccaccacacacauaccauguagacuuuuuggcucuuccugugaacacugucauuuugucuccuguugucaaucccagcuaccuaggucuuuccaaacucuugcucuauuucuuuucaacccagaccaacuucaagguucugcuuggaccugucccugcguaccacagcccagagucaucucaggcgacugucgggagucaggcaguucauuucccuucacaggaucaugagucugaacggacuguggucugauaacuaaacccagcgacuucaagauucugcaucauuuccuagcuguggugggaggguagguccuaugccauucaugauuuugucagaggaauagagcgauuacucaagaguguccagcugaugucaagcugggcuucaaauccaccugagcaggcuacuauguauuucggcauggagauccuuucuaaggugcuacaauguuaagaauggaugucugcaaaagcaacucucccucuccuccuucccucccagacuguuguucugacguagguuuuagcgccucuagcaacauuauguugcuuccucuguguugcuugcuuguggccgucuccuguuagucacacauccccccuuugccuugcagguguugggaauaucacacuguccaugccauguuuuccagcucaggggauucuauuagcucauugauuugcuuacguuuacaagcaacuggggggggggggagauacauguuguugaaaaugcaaucuacaauauuuguggaacugauaacauaagauagaggaugcucacaagaugguucacuaccugugcuccugcuuaguauugaguaucagugcuaaggaaacccaacuaaggugcuagcuggagucagcuaguucucuuccccuuacaggaucacaaccauccuuucguuuacagucucagcccuauccaaagucuacucagagaaccauaauuuuaacauguuugugaugcuuugugaucugaaaguccccauggcugaagacaaccaugaacuucagaaacagugaccaaagaccccugagcuagaaaugaccugaacaagucucccaugaggacuagcuaugaugguaccacaggacagugugcagacuucugagggagggaggcagccagcagucuuccucagcuauggugccugugaaccauauacacugccagcuuggcacaauaccucugagggugcagugguggcauacauaugccgguggcaacuaacugcucuuuaacacccucucagcaagaggaagaccaugccugguacuggaggucuagcuaaauacucagugcuagggaagucaugguuuuggaggagaauccaggaucacuaauuuaguagaccagccuaccaucaaucuguaagcauuucuccuuauacucauagauacauuuagccuucaccucucaucaaggcaacuucucuuugcaaugaagacagaccacuacagaacaccacaaucaaaaugcagaguugacuagaauuuaucauaucacauuauagauacguucuucuauuagagcaauagaauuugauucaaaauucugcuauuuggaaaaaaaaagauauauacagcaaaggcauguucuucuauuagagcaauagaauuugauucaaaauucugcuauuuggaaaaaaaaagauauauacagcaaaggcucccagggcucuggacacaaggccaucaauggcauugauuccugagaaaugaaagacaaaugguugugcuaugcuccuggccggguuuccugcaugaagggaauguauaggcuaaggugcaaggaggugaggcccuuagaggucugggaagaacaagcuaacacaaguuugcuaaacagagcacuaggaagagaguuuuccagguggaaacugggugucugugcaagcgcucucccagguccuggaugcacacgugugugaaaugcuaagaaaagcaguggaaaacucaaggacagacacagcagugggugcuugcuccagccagaagcaguaauugcucuugacaaggagauaggaaugcuuccuaauuaauggagcacuggauggaaauccacaagagacaccacagaugcacuuguguauucauguagaguguaccaauauucauaagagccaagguauggaaucagccugcaugcccaucaaggauagauggugacaaacaugguccacacaacagaguuuacgggacuauacaaagaaugaaauuacaucacugcuggguggaugcagccacaggucauguuagcaaauugauucagaccacaggagaaugaguaucacauuuccucucauuuguggaccacagaguucuuuagagauaaauuauauauauauaauguguguguguguauauauauauauauguauauauauauauauauguauguauauaugugugucucucucuauauauauggauacauagauauugugugugugugugugcauguaugugagugugacgaaagcaaaaggagaccguggguaaggaagagaugggcuggauuuaaaaagagguggguggaucuaaagggaaagaauugggaggggcuaguguggucacacuuuaugauacacuugaaaagugcacaaaacucaaagcuaucuguaagcaauauauaauaacgagaaaaaaaaacgcacagcaaacagaaagaaagaacuaaacaguaacuaaccuuagauuauuaaaucacacccuuuuccacccagcaaacuguggaaucgagacuuggaaggacaaaccauuuccauguaacuuauaauugcuucucagaacacaguuugagguuugcgaauuaagaacagguggaguuaggcuggucauucaaaccaaggucagcagacauguaaaaaagggagccacaaggacaacccaaccaagagcugauacagaggucugaguuaucugacguggauguucaguggccucuguaagugcaaucuauacaucgacauaagcuaagcagacacacauaagacugaauauauaaaaagaccccuauccaacauaaaauaccaaaugaaaacguacacugaaaugaauuuagugggacauagaaauagaaacuaagcaaaaugaaacagaaaaaaaauaguuuuaaaaaguaacaauaaacuguggaacaaauuaguguaugccugagggauaugaaacuagacuccauaaagaaugggaggagguagaaauauauauuuuaagaugaaaugaaagaaaaaccugauucugaugaaaguuauagacccacagguacuuuaaacucaaguguucuaagcaugugagaugugaagaaagcuacacaaggacauaguaaaguuacucaaagccagugauugagacaaaacacuagaagcagccagagaaaacauccaaguuaaaaauagcaaguguuugcaaagacauggagaaguggauuguguuauccugcagguggaaauguuauaaggcuuugcauaacaguuuggucaaguuuuaaaaaguauuaaacuugauucuaccauuucaguccuggggaaucuaccccagagaaaagagacuucauguguccuguaaaaauauguguguauguguguguguguguguguguguguauacacacacacacacacacgagccuacauauacauacauacauauaugacaccauacaauggaauaaugcuuaaugauaaaaaguaaugacuauuguccuuuucugcuccgccugaguggcuucacguggcaaucauggaugucaggccucccauuuuuauuguacaaauaccucuacugcaaagauggucaauguaccuaaagccucaaaaguuuccccaaagaaguauggcaagcaucagacucacaaagugacccaguacacagaaggagaguggcguuguguucagaaacaauggcuaaggaggacaggcacagccuaucuucugagacaaggccaaagccaccgugcuuguguucuguuuggcuuaggcugacugcagaucucagaggauucuggccaucaggagauggguuuugaauuggaaggagguaagaagagaaagggcuguguaauuuaguucuaaaacuuuugugcuuuugucugggaggaaaauacuucaguaguagaaaaauuaccuguugggaaauagaauuguuaguuauacaaaaaguaauuacuauugauacauguaacacuuugggugagcagcauaguagcuauuuggcaugaaagaaaccaaaccagagaagaggagaagagggugugcccuguguggguccauccacaugaaaugcuaagaggccagcagcagaggcagcaagcagauguauggcuuuguacagagggcuugcaggagacucauaaggggauggggcucggggggaggacgacugaaagugauggacauguccuuugaguucacuguggucaauauccccaggaaauaccacgaaaaaaaacaugcugugucugucuaaauaugugcaguucauuaaaugucaguucuacuucaauaaagaauaacaacaucuacuucagcgugauucucuguaacauagauuucaugcaugcaauauguccugaaaaccucccagaaacccaugcucgucaaaaucagccacguaauuuugaaaauaucauuucaaaguauguuaccuucaaccucuucuuucauguuuaacuuucuucugugacuuuugccuaauguauuauauaguauuuuguguuucuguuaauguugccugucuugauuuuuuucuuuuuuugucacuagaguaauuuauagagucaaaugaagccacuuaaacugcagacagccccccuuucugagaagccacaguuccuaccuauggaagacuguccucccaccuuuucuaggagagccuagcuagagaagccagcucugguacagggcuuuccccaagcugccaccagcagcucagaauccauuucuaggcacgccccuccucacgcacgccccuccucacucagcuccccaagcccuggcuccuuagggcaccauuuacuucugacagaaagauuagaaacgcaacucuagugcuuggggucucugugaugguacaugggccucaguguugggcaaugggcuauacacagacagucuggucuccaguugagcugaggugaaaccccgggacccaguggugauaauucaucuacaugggacagaaggaguucucacaugucuccuggacucaaggcuccugucgaaguuacugccccacagcccccacagaagaaaugugguuaguagucacauagacuaugucccaagcuuccgaccuucaggcuacacuccuccccagucaccuagcaacagaaaagauaacagccuaccaaagaggagcugcuuagccccaccucacacucuuaugcucuuacucccuuuacacucuucucuccucuccucucuccucuccuccucucucucccucuuccucucuagccuuucuucuuucucuccuuuuccccuuucucuccucuuggccauggccacucucucucucucucucucucucucucucucucucucucuccccaccuucucucuuuccuccugccuuucuacaauaaagcucuaaaaccauagacugcuucuguucaucaaggcccgcugugcucacucuccccugcgugggaaccucucucccucagcccucucucccauaaccccggggcuacagggugucaccccagggcccccaguugggggcugccccuuguccauaccccacugucgaguggggucaguagcuuagaugcucacccagcgccgaguggaaagcgucuggcagcccucuugugucugccugcccagagcauaggaggaacucuggccagaugcaggcuauccucccuucucccucuucccccacaccccccuuuaguucccacaccuaagugcucgggucucuaugauuccacauggaucucagugcucaggucucuaugacuguacaaugggucucagugcucgggucucuaugauggcacaugggucucagugcucaggucucuaugacuguacaugggucucagugcuugggucucuaugauggcacaugggucucagugcuugggucucuaugacuguacaugggucucagugcuugggucucuaugauggcacauggaucucagugcucaggucucuaugauggcacauggaucucagugcuugggucucuaugacuguacaugggucucagugcucaggucucuaugacuguacaaugggucucagugcuugggucucuaugauggcacaugggucucagugcuugggucucugugauggcacaugggucucagugcuugggucucugugauggcacaugggucucagugcucaggucucuaugacuguacaaugggucucagugauggcacaugggucucagugcuugggucucugugacuguacaugggccucagugcucgggucucuaugauggcacaugggucucagugcuugggucucuaugauggcacaugggucucagugcuugggucucuaugauggcacaugggugucaguacuugggucucuaugauggcacacuggucucaaucucauccaagucacuaauuagugcaguuucuucauucccucuaagacaauuccuuugcaacucuucccacagccgucuucugcagaaccauuuccuuuguuaaauacaugcuuaugcagguuuucacauguguauuauauaccaauuaucauauaauuacguaauuacuguaaucggauuuaacggcauaauuagaauguguaauuauauaauuaaaacauguaauuaccaaguuuaaaaaguuauggaaauuauuuuuaaaugaauaauucauguaugaauaggaaacuuuuaaaauuugcuacccaggccuuggaaaaauauuuuuuaacuggaaaaacaauuaaaacuccagugaagaagcagaagaguuggcucugcaguuaagagcacuuacagcucuuguagaggacccagguuugguuaccagcacccacaucaaacacugguaauuccaguuccaggagaagugaaguauauaagaagucacaucggcauguacauacaaacauauaggauaaauaaauaaauaaauacacacauauuuuaaaaucuaggaaauguaauguuauaaaauguguugaaaaucguuuuuaagaaccugcuauauuuuuaaaacaggcacaggaaaucaucuucaucaaguguccaugagguguauucccauguacagcaauagcuuucuuaaugucaaacagugaguggcagugacguguacaaaugucauugcccagaugggaucccaggaaaugaugcauccacuucugccccucggaauccacgcuuggucucuaggcauaauguuagguuuaaaaaauaagugcucacuacccuucauuuucauaguaagaaaacagccugucuuuagucaucuaaauuuacagagugaaacuaugucuaagcagaagcaacacugucauggacguauuuccagcgugcugaaagcugcccuccuugugggacuacugaaguuggugucugcggaggaacggaugcuguuuccuucgguccuguagcuaccaggaagcugacuaugcccccagaagacagucuccuaccuaugcaugggcaagugacacuaauaagcucagugagucacaggaauagagaaggcaugaaaguuggagagggagugagaaacugcugguuuagguaguuagccuaaaacggcccuuuacuuccagaaccuucacuguuguagcagcagccagucaugucagccgaguucccaccaacuggauaaggcucuguagucagcaggacacccagagcuguuuacugagggugauaaccggccuguuuggguucuggugcaccauuagguaucacugugugggauccuuuugcuuuguucuuuguuugcuuugcccaaaaccagcacuauccuuuuucaacacggaugaagaagggaagaagaaaugagugaggaacaagagagggaacuaagggcgaaacauucacauauaaaaauucauuauaugcaugagagaaagcgucaaaggaaaugaagaccgaacaagguguaugcaguucaccagauaucagagcaauaaacagaacacagagggucugggcagcaauggcuugugagaacuucucugaaaauacaauaacgggucauuauaauuuggugccugaggaaaugauccucaucaucuaaaccgguaaucaauuauugauuuuccugaccacaaucaacacaacaguugauuacugucuggaugaaaaucucuucucuucaggcccgccaggaacacuuccaacauacuuaauaguaaagugcuuaucccauuaucucauaauuaugcauauggcugcuucugcagaaugagauugcagaagaguaaauguuuucucaccugggcugaaugucgcaggugcacacacacacacacacacacacacaggcacaaaggcaugcacacacauaugaacgugcguguucgugcacacacauagggagugggagacacaaacagugagagauagacaggcagaacucauggaugugugaacacucagcaguuuaaccugaagcauuccuuaagaucaaucuuaacuuuuuauuucuagacaaaauucgaaacgcuuaaaaacagacgaaaaggccucgcaggacagguaaacacuuuaguaagccaaagaggagcccuuggccucaugcacugcagcgaccauggcgaauacagucgacaggaacagaucccagcaguucagggcagcacugcuucagcccacugcucugaugaagucacccucaguagguuaacguucaagucauuaguuaauuaaucccaucaguguguacugagcuccuguauauuaugucaggcaggaugcuaggcacagaugagacaaccugggggcagacaauggcccuguacgucguggacugucucaagccaccgggaguuagggggaugauggcuuccucagaaaucccaggcauugccucagggaucuggcuucugauuuguccugggaacuuuaccagucuggacgugauuggggaagucccaacugaagcuccuuggucugacaugaagucacagaacucuucauuuuaaaggagcacaguauggcauucugauacauguaguguaaaaugacuaauacaggaaagccagcaauuuuauaguugcaaauaccauuucuuugugcuggaaacacucacaauucuuucucuuagauaucaucaacuauggucacugcaguaugcuacagaacacuaggauucacucuucuacuuauguguguucaagcaucugugauuacacuguuuucuuucugccuuucccaggauuccuccuuuucccucugccuuucccaugaguccccugcuuucccucugccugucccaugauucccucugcuuuuccccugccugucccagucucugcugaccucuguucuacuuucuaguucugagagaaguguucuuuauuuuuguuucuguuugucaagaugggguuucucuguguagccuuggccccuggaacucugucgaccaggcuggccucaaacucagagaucuaccugccucuaccucugccuccugaauccugggauuaaaggcuuugccaccacuacucagcugagauaaacuuucuuaaaagauuccacaucagagugagauugcacagugcuuguuuucuguucuggauuuucuucagugaacaugaugucacccagacauacacacacacacacacacacacacacacacacacacacacacacacagagagagagagagagagagagagagagagagagagagagaggucucccacauauugauugaauuucuauuguacacagcggcaaucauggcgcugccacauacaagagaaguccuaauuuuaguuuucuggggacucuacacacugcuuuucacaauggugguacuaauuuacauuuucaacaaaugcauguguccccccuuucugugugcucguuaacauuuauuguugccuuuuugauaacuuaggcaaacacccucccuaaugcagccuuguugggaaauaaguggauagggggcggcagcucaccaucuggcagacagaaagcacuuuauguuaagugcuaaaucuucacaggaaugccacuuauaauacaugacauaguaacacugagcaucuuuccccccuaauaaaucucccucauuucugaaaagaaacauaauauuauguauuguggagcagaaaaugagccucuagacaucugaaggguggaggggucaucugaggcuucaggaagacaacagaggggaugcuuaacuucaaguguucccacucugggguaucagugguacaaccuaugguguucuuugcauccaccaaccaauauugauaaaaucuaccguuugcauauaaguauacugauguucuuggugaauaaaaacuaguucauuugaauacuagcuguccucuuagacaugcgcuaacaggagcuagggacgaguauauggguuguuagcugaucaguugguucuggaugugugcuuaugugugggggaguacacacguguggcacauuauguacauguacauaauggccaggggacaaccucaggugucaguccauggguacccuccacuuauuuuuggaaagagggucucacacuggccuggaacuccaugaauacgcuagccaguaagcccugggggcccccugcuuccaccuccccugaacugggauuauaaaucacacuguuauguuuagcuuuuuaacauugguucuagaaauuacauucaggcccucaugauugcacggcacacacuuuggugguucaggccccauugguucuugguaagucugauaaaaucccagcagcucuuugguuaggacugaauuagccaugccucuaauaucucaacugcuacaacauacccagugugcaugccuuuucugagauagagaacacuuaugucccuaaacagacaauuggcuuuucggacagucaacuugguugggaagguaucauauuagauuuccaagcgcaaacuauacauucuuuccuucugaggucacaaaugaagcuuucuacagacugcaagucaacguuaggggcugucuuaacacuggugaagccaccaagcucucacccaccuccauucugccccaugauuaauguccuuagucaugcaggguccuuuaucagaggaccaggcacaggcccuauuuuucugacaagcuggucauauccuccugugagaaagagaggucaccucacuccucuguaaguauggagcccguguccugcagcucugccggcucaguguuguggaaugcugcccuugcaugguccugggugcuccuuccucgagaaggacguccagucgaauacaaggugcuuggucucacugguccagcacaggugcuguguauaucagugucguugcaaccauagggugggaacccuucccuuaacaccaaaacagcugacccugagauggaggcuuacauuuccacucccagcugaccaucaccucugcgcuaaggccaaaacacagcauguacuggggagaagcaagcaggcaagacuggagaagcacuucagaacaaagaaacagacguccuuggagcgucaagaucaccagugacaggaaacggauucuagaaagcaggucagauauaacugauccaccagcaggcccagucuagggcuuguauuguacuuuaaugcuuguuuguuuuuauaucacauggcagauacuggaacucugcugcaguguaaaaaaaacaauaggagaugagcaagcagcugauaacgacucgggcgugugauccaguuacaaaagcaagccgccaccgccacccccaccccggcuaacugcagagccucagucaauacauccaggaaagaccacagaaucaaugacaaggcuaauuuaacagaauuaagaaguggcguuagggaaaaaaaaauuaaggaaguccacauaacugcaauuaccauauccuuuuaauguugcuuagcaacgauauauaaaaaugagauauaaugucgggaacuuaguuucccggacagaaacagugccugccucagcagggcuguaacucacuuuucuccaacugcaacuccguggguugcuguggguggugcuacuucuguaauacuuucucuuacacggucauguguuuguguuagugcauuaaaaugccggauuugcuuaaugagugccuggugauaauacagccacagaaugagagggcucuuauuccauuugcuucugcagaucacagguccacuccacaggcaggaaaagucaacagguaagaaaggauauaaaucuaaacuccgagagacaacggggaaggaaggaaggaaggaaggaaggaaggaaggaaggaaggaaggaaggaaagaaggaaggaaggaaggaaggaagaaggcuuuugucuguguguguuuugaaggugcaugggaaauaguguuucuugaaguguuuuguugguuuuguuuuguuuuaacauaagaaagauguuucuagaaagaagacagccuuugaggcuccaaggcagaucccaggacuugggaggaaagguauguugguaaggagggaaagaaacagaagaggguauugggggagaugcagagugacagggguggggguuguuaaaguguccuguucucggugaucucaggcaagguggaaaaagaaaggcuucuguuucuaaccagccugaaccuccaggaagcaaaaaggguuacaggugaaaggagugucacaggcaugguucaugucaucuuucuccaucuucaauaucuuucaacagaaccagaauaaacucaaggacaucacauaaucuauccacagacacucagcuagcaagccauaaagcugaaagucaaaagccugucugucuucaagaaacugaacacgggaggcaaaggaggcuacucaagauuguugcuguugugugugggaguggucuggaguugccuucauuuaaggugcaaggagcacaagugugcaugugcgugugcgugugcguguguugcuucuucuaaauguguaagcaaaugaaacccaaauccuugcccaguaagcccugcuauaucuaugugcacacuggccuugcaugccccuguggcuuuugugagcuaccuauucacuguuauguguggucauuaacuccuuuaauauaggguuguauauucuauuuuaaggcaguuuccugccaaauacagcacuuucuggaggaguucuccaguaacuucugauggacaauguguggguaggauaaaggucccuucauuuuauaaaaacccuaggggauuagucugcuacaugcucaguaccacaugggcacuagcaucuauagugggguauaguaagcaugcucaguaccacauggauacuagcaucuauagugggguauagcgagugcucaguaagcaugcucaguaccacauggauacuagcaucuauagugggguauagcaaguguucagaaagaaugcucaguaccacauggauacuagcaccuauagugggauauagcaaguguucagaaagaaugcucaguaccacguggauacuagcaccuauagugggguauagcaagugcucagaaagcaugcucaguaccacaugggcacuagcaucuauagugggguauaguaagcaugcucaguaccacauggauacuagcaucuaaagugggauauagcgagugcucaguaagcaugcucaguaccacauggauacuagcaccuauagugggguauagcaagugcucagauagcaugcucaguaccacauggauacuagcaccuauagugggguauagcaagugcucagaaagcaugcucaguaccacauggacacuagcaucuauagugggguauagugagugcucaguaagcaugcucaguaccacaugggcacuagcaucuauagugggguauaguaagcaugcucaguaccacaugaauacuagcaucuauagugggguauagcgagugcucaguaagcaugcucaguaccacauggauacuagcaccuauagugggguauagcaagugcucagauagcaugcucaguaccacauggauacuagcaucuauagugggguauagugagugcucagaaagcaugcucaguaccacauggauacuagcaccuacagugggguauagcaagugcucagauagcaugcucaguaccacauggauacuagcaccuauagugggguauagcaagugcucaguaagcaugcucaguaccacauggauacuagcaucuauagugggguauagugagugcucagaaagcaugcucaguaccacauggauacuagcaucuauagugggguauagugaguguucagaaagcaugcccagaucagccuuauacacucacaauccaggaccuuccuaauguacuaauggauugguggguuguaguuaaggcucuuggugauuuuaaucaauacuggcaccuguaaaccaaccucacaguugcugaauaagccaggccuccuaccacuggguggucugcaguggaguguucagugugaagagcaggugaggggagccaaagguaacucaaaggcagcugagcauccuccugguugcuauacaaugccagaaaguucugcuuaucccccuccaggauuucuaaccucaccacaccuguucccucgccucggaaaucauuucaacacuuaagcugucuggcagucgccgaguauuuguggaauaccacagggcacagagcaauaaaguuauugcuuacugaagucaggaacuaaagugaaggcaaagugcaggauuagucagaacgccugggcagaccaggcccauguagaggcauuaggcugcuaauccuucagcugacuggggagagucuucgcuuugguuauuucuaacacggcacccgacagacuguguccuugcauuagucgagcuggguugaugcagcucccuaucucugcaggacuaaauugccucugaccuaguggguuaaggcaacacacguuuaugaccuuagaggugaacgccagggugucugccgggccacuuucuguccuggaagcucugggagaauuuggcccuugacccuugagcuccuagaggacaugugcaugacugggcucauggcugaccuuugucuuccucaccugccaccccucuguuucucuuuaucuucaucucaguucacuucugaggggcuuuguggcuaagcugccuuuagaagacgccccagggccaucuccaguucaaggcaagcugaucagcaaccuuaguuggaguacagcucauagccaacucaugucuucuggaggcugggauguggagggcauccuucugccucaauuuaucuacagagaugaaugcagagccauguauucuauggguaugaauaacacagucugauacuucgagaacccagugcucuacagggauggugauaaacacguuaaaauaaugguugcaacaacaacaaaaaaauaagccuuacaucucauuauaugauuuauaguuuacaaggcacuuugaauauccaucuuucuugugagaaccucagaccuccauugcaagacagguaaagaagguuugauuagcucugauuuauagacgagaagacuaggaugcagagggacuuuucuuaaggccauaaaaacagcagauuccaacccagggaugcagauaucagaucuaacacucuucuuaccccuagucugcaaagaacucauggcaagugucccaacugcuacacugccaaaagaagagauccuguuuuccuucuguacaugggagcgggggaggagaggggaagcagaugugagcuuguccagaaacucaaacauauaauucaugcuccuuucagaggagagguuccaggcaucagguucuccacagaccacaccagacagugacaagaugggggaguguuacuucugcaaacagagucacugugcggcugagaacaccagaagaugugguaaagagacauccuggcuguugcucuccagagucuuugccauccuaaaggaggggugcuaugugguggcccagccuccugugaacgaugguagguaggcaugcacaucgaaaugcugaagucagccaggugguggugguggugcaugccuuuaaucccagcacuuaggaggcagaggcaggcggauuucugaguucaaggucagccugcucuacaaagugaguuccaggacagccugggcuacacagagagacccugucucaaaaaaagaaaggaaaaaagaaagaaagaaagaaagaaagaaagagagagagagagagagagaaagaaagaaagaaagaaaagcugaagucucacuuucuuauaacaugucacuuacgaugaccauacugucauccucccaggagucgucauuuauauggagacuccaugagcagaaaugucuuuguucuucuaccuuugaucucccaggguuuccuacuagacaggaggaggaggucaaccccaagggaagccaugccacagugauuccugaaaugggaccaaucccgguuggugaccagguaagaggcgcagggcagauggcagagguaucaguugcuacguauuuuuuacucuacuuucuuuuuuucuuuuuccuucaagaagugggcaacuuaagaggacaccugcaguggucucucuguggcagagaucaugcgacauuacuguuuuccuucccacaagcccugaaggugagacaccugcagaagcugaggaguguggcacaccugcuggcccuuccugauagagccacaugggacucagccuggagcagccucuggcuacagcauccuuucaauguaagaccugcuaagccccaggauccccagaugcucaguguacgcauccuucaugacucucacuggcaaaagauauggaaagagacagucacugauggauggaaagggacugugugaguguaaacacguaacgggaaguccugcgccucucuuaauugcccgacacaauucccacuacgugcauaaacugcaguucccauuaacagcaccaugaauaauaaucaguuuacuuucugacucguaucuaaauauaccuucuauaugauuucaucuuuuaugcagcuguuuagaagcagaacaucuaauuacaguuccuauuagucaacauuaauuuuuuuucccuuuugccacggagcauauguaaugacugauuuucuaaaaacagaauuuuuuuagcauauggaacaaauuguguuauuauuaaugcauucccagaugacucugcauuucaauucccuuaauuauuuagucauugcugauuaugucuuuuuaacauucauuaucccaucucuugaaacacaggcaguuuauucauuaagugucaaaauggaaagcuugaccuccaagaaggaaaaaaaaaaagauaaucaggaaaacugacauaauuuagaaagucugaguguccucucuugaauguucucaagcugcacgauggcauauuucaugcgagcuuuucaaggguacccguagguaccaacgccagugcugaaggcagaggcuggagcggggaggagggugcggaagggggagcaaaaagggaggugugcagccacccacaggagacaucacaaaagauuaggccgugaccucagcuaagccgccaccuuguucucacuuuagagaaaauuacaauuuguguagccgauuguuaggccuguuuuauucaaaagcuaacacaauguuucaaaaauaguuaagcagcccuggagaagcccaggacaagaaacauuuucuuaaauuaaaagagaacgagcucuuaaugaggcuucaucguguccgcuggcugaucccacugacgcucuaaaacccgauguugacccugacuauuuaauaaggcuuggguacugugagcuccaugcagaugcuggcucauuaucucagcgaggucugcguaccccaucugaaaccaaauuuaccgcacagauaaaauaccaauggggaagaaaugggaggaugaagauggcugagaaugugaagaaguugaaggagaagaagcaugccgguuucuacguggaaggagagccuggacuccaucaaaggcauucauuugggaaagaggaaagcauagcaagacaucuccugcuuccuccuccagcuuccccaacucaauaacggcugcuacauggcagccugcccucaaguggagcaaguggugaaccuuuuauaaggcguccuugccuucugaauccagaagauggugccagaaaugagugcgacugcgcaugauguuagauacaauagacaauaaaugccaaaugaccaaagguggguagugagucuaggcuaggugggugaggcuggcaguaccgugugugugugugugugugugugugugugugugugugugugagagagagagagagagagagagaugucuuaggagaaagucgccagagugcuguaguacuuucucuuugucaucugugggaaagggaaaagagauauauuuuuuuuaauuguuguuuucuauuucccaauuuuucauuugccuuaugguucccaucucuagugcaauaacccguguuacucugcaugcuguaagaacagcccauuagggcaugguggcacacaccuuuaaucccagcacuugggaggcagaggcaggcggauuucugaguuugaggccagccuggucuacagagugaguuccaggacaggcgggacuauacagaaaaacccugucucaaaaaaacaaaaaacaaaagaauagcacauuaaugguaucaaaugaauaccuuguuuuaaaguucuacuaucugugcuguaguagauuuugguggggaccacugcuuugccucuuccaaaaaaaaauauauauuuuuuucuuuuuggaugcgucugcacacccacucuucuaaacaaccauccuggcagugucauuagauacugauguaaacaaauuccaugcugugcagugaaaugcuccuccaguggccuugguuuuguucuuuauuuggaggucuguguucauguauccaggaagugagguacacgugaguuccccugggacuugcacuuugucuccccccuuugcaaagcucuucuacuuuauacccuacuauguuuuuugacuuuguguucaagaacggagucagggaagaaagauggugucuaugcucugauugcuacucgggcuuccacugggguccugacagggcaucccucuugagccuucuagcccauuggccauugcacaaaucccuacccuuccccaaggaguagcacuuuagcuuccuccuguccuccccuggucagcgaggcuuccagcagggucccucaugaugcauuucugguacgccugcuuuugugccccggggcugagagaaggugaguguauguuuuggcagaggcuguagcugcuguagcuguugcucacuccccuccucuguagagggaugcagcucugcaggcugaccuucuguguccuuccuguaagcugagacucugaucaggaagagaggcaggguacaugggucugucuggauggauguucauaggugaggucaggauucucccaggucuccccuacaggugccagguagagacaaaaccugccagagggggcgaaccuacuagcaugaauuguucauggcugugagccuaccuuuaaccuuuagcaaguauuucaguuucuaguuggacuucucauagguaucauggccuugauuauucucucauguaaguaacacccaggucucguguuguccugaagcgcccccugcccccaacauacacacacucuauagcuugagcuguuugcucugcaacuugaggucuucugaguuuugugaaagucacugauguccugguccucugucauuuucucucacaguggggccaguguuccuaaaggaagucagcucuaagcuacaagaugauuaauauuuuagggagaacuuucucaaguucugugcaguuaauucuacaccuagugagacacacugaccacuguugugcuagaaaauaaaacucaucaagagacccugcuuccaaugcuggguauuucaugcacuguucuucguguuucaaguaaacacagguuaacaucaugaacgauucacacagaugagaccuuccaccaaagaccaagccaagcuugguaauuuuggacacuguuuaguuccuacaaagacaugaauuuucuacauguaaacuuccacuucuuccuucagagacaaaaagcuaucaaccaacugcuuaucaaacaaauggcccaccagggggugcagucugcacugguuucuguuguggucgcucacuguauggaccugaacuguggcaaaaccacuuuaagaagugacucagaacauucuacugcuccaagaaagacuauucuuuguguuuuauuguuugacaagcaauuucaaaagauuuuuuuuuaacacuuuugucuuacaaauuagggccaaguuguaaagaaacuaagcaaguauuuaaauuccucagggaaguucauacuaauguuaagucuuuccuauaaucaguaauacuuuagcaaaaaaaaaaaauuagcaaauauccuagaacuauauguucuauacugagauuucaagucagcgucauuucuaacaaaucugaaacgucauuucaacaguaagaacgaaggcagcuaacggcugucaguuccaaaauaaaauguuuguucuagucacagguuuacagagcucuccuccagaagcacauguaaugaaugaagacacgcuguuagacaugcugauucacugggacacgugaguucgaaaauguaucuagcaggagccguuccaggcauaugcaacaguggaugagaacagcggcuuucccugggaaaaugagugugccccacacugcagucugcacuggcucuaagucacaugcucaguaagcuacugcuuaaggcagacucagcuggaaacucuuccccuggcagccaggagggcgguggcuucugcacugcagucccaccugcuggguccuuacucugggucuuugccuucuccucccccugagauccagugcugcucuuccugaggugacaaggggacuaccguguaccacagggcucccagagaguaguaaccacccaggccauugcaaaaaaaaaaaaaaaaagaaaaaagaaaaaaaaaagucuggcauuuugagguguguuguuaaauaacugauuauguaugcuccaggcugacacacagggacuaucaaagugucucucugcuugcacaguuccuucaugggguggcuuagacauccaaagccucgguccuauacuucaggaacaguuagcagcccccuccuacccuccacaaacagaaacagucaaagcagccaugaugugucuucuucaggcugaagggagugagguagacuagauccaagggucuugagguacuugcgcaacagucagucggauguuuaaaaacaugcgauugguuuuuguuuuguuuuguuuuuuuaacacaguuguuccuggguagccacuggggauugguccccugaaggcaugcagaucuguaaaugcucaaauccuuuguguaacacgguacgguuuuuguacaaaaccuacaaaugccuucccauaugguuuaugucaucucuagaugacuagaauacccaacacaauguguugaacaaugacuagugacauggagcaagucuaagcauguaagcacagauguggacauacuaggucucacaucauggcucagcacugaggcacgaggcagcggacaccacacuugaaucgcuggagagagccugggaucugugaggagguggaggcugcaggggccacacccacacaucacacacacucagcgacagccuuggcacaccauucagacuguggagcugcuuucaggacucguuccuaugcuccacaggccuggggagccugugggaacagaggacuggcuguacucugcaggguauaaaagagccccaggcugcacagugggagaccucaguuuaaacucugcucugugugcuauggccucuaccucucucuuucuaccuggaagacagggagggcacuacaaugagggaacacggguaacucaugugaaggacaccccagcagcacauguuaagccaggcugcagggaauaguggaauaauugaagcauacuuccaaucauggaacuuguuuagccucggauauuuccuuucauguuuauggguaaaggguucaggacauguccucugaaggucugugaguuuuccugacacuaacacaguaggcuuuggguggagggauuuucaaacccaaaugauugcuaaucuuguuucuuaaauauuccuucugacuuacuacuuuguucucuggcccuuuaguugaguuuccuguagaggcaugugcuuuugcuuuugauguggcacauacuugaaaaaaaaaaaccuuauuaaacagaggagccccauggcaccuggagcugacgcuccauccccggccuacuccgaacaagucucccuuuguguucuuuugugcuaaagugauuaaucaucuuaccauccaagggcugcugacaaucuuucuagaugauuccggcuaccgugaccuccacccccaccccccagcaucagcacuugucucucacacuccuggaaccucuucuuuauucacacacaaugggccggcuccuccuuucauacaacaauaaccagcuacguuuacaucucgccuuuuucccucccgaguucggggcucaggucaggcaggauguagugaugacuucaaugagcaggcaaggaaaugaaaaguuaaaaagucaagaugaugaagccuguuggcagagcggaggggggcucucucccuaauggaaggggaccuguuguggcuucuuuucuggguuacaucauucucagaacacacgaugccuggggauucuuuucuccaucuuccccuuuccucuggugagcaucaacacucuucugaggcucuguauuugaagaccauggaggucagccuuggccucaccaggcccuuaaucucuaauuugguuuucugagacauggcugagguaggacucaggagcugaucauuuaaaaacaaguguucaacagcaauucuugcuaacuuuaaacuuuaaaaagcccaucuguuuuguccucuuacaaguacauacuguuaaaaugaauuuuaaaugcauauuuaaagaaaugaccccacauauaaauuauuccuugagauggaaaagcuaaacuuggagaggagacaaacauauguaaguagucugaaacaugcucauuaggaugaaauaccacggugauuucaaguguggaguucauaucugcaacaaaucuguacuugaaaauauuuacagguagccaaagccuagaguuuuaaacuguugugucauagacugauaauaagaaugaaguuuuuuuuuuuuuuuaaaacccagggcuuucuguaucagaggcagggaaugaguuuauccucugcccccucuguucuugauauuuuaaagccaauuucagaaaaaauuggcuuucuaaguuuuuuuaguucaaaugagcuaaauaucuguaagaucagauagguaaagaaugaugccuuauuuaaaauauauaauaguucccagaauagaugcucucaucuuucaagucucuaucucuucuaucgucaagcuaucauuaucuauguuagaaauuauuuuucagagaucugugugcauacaaugguaauuugcaucaaaucaauguaauuccacaacccucaauuuggaaaaaaaaaaaguaacagagaacacugugugugguuuucauaauaaauacaaguuuuaaauaugagccuugagcugaucacucuggguggauguuuuaauuuuuuugagagacguuuugcauagaccacauuagcagugaaaucgcuuugacuugcagcccuugauucuacaguagcaacaugcuaauuaaccaaauuauccuugcaaacuuauuaucuugauuucuccaacuuguaaaauucauuaucuaucaaaaugaaaaacccaaucucauaaaagacaaucaagacgcaggcggcagauacaaaaggcccaggcuuuccugaugugcugcaguaacagccagauucucuuccacuucugaccaccaaucacuggcaguaaacuuucaucucuguuuaccauguggugugugauacggcggugcugguaguccccagagaaguaauguuuuaagggaaaaaccaccucaaguguuuuugcuauaguucuggaagacaguaugaagaucaggaacaaguaacaagcauucauucacucauucauucauucauucauucauucaugcaugccuccuuauacacuugcucagcauuuauuaagcaucucuuaugggcucgucaacgcagauggaccagugagagauaagaaaggcucccagguaacggguauuagaaagugaacacagguucuugggaucacagacuaggagccgcuaucucggaucuggggaaugagaaagguuccuagagagaaugcugcaucaaggggaaaaaaaaggagucagucagcugaauuuguggccugaagguaaguaaucgaggcaggacccagggguagagccagagguggugacagucuugcagagaaggaauuaaaguuugaagugcagacugggaaaacauggcuggaccaacauacgggggcugagaacacagggcauugcagaucacagccaggaaucuggcuguccugagcuugggagaggcugguaaaauguaggcuuugggaagcugguucugugcacacuguggcgagcuaguuagacaggggauagaugccaaaggucagugggcaaccuccuggaauaaucuaggcuggaaaggguggugcucugaccuggacaggaggugggggaauaagagggggcggggaaggagagaaagggggaggagggagggagaaugagaauaugaaaacuuguuuggagaagaacugacugagagggaggcaggcggagagaaggauccaauagcuuuagcagccacuugacaacaauauucacccaggaggaaaagguguuaagagaugugagguaagguuaagguagagguguuaaaaaccugugggaauggggauagccggacaggugagcaugacauccaggaaacagaacaggguucaaggaauacaucagcaccuaucagcaacgagaauaacaggaggagauaaugaaagccaccaacaucccagauagcuagaggaagggaggacaugaaagccaggaggaaucuuaaaaaaggguacaguggggagagaugccagacacgcacuugaccacaagugcugccaugagcaucaucccugugccccccaugagcauguguggggucgugaccuucucaguacaaguugauuuacagguauggaacgaaagucaggcagcagagaaggcaaagugggaacuaagcugcugagagcuuagccucccuaggaguuggggaggagcuccagggaaugcagcucuggagaaaacccgccuugucucuaugauuuguuguuguuguuguuguuguuguuguuagucagaucaaagugcuuuggaacacuuacacguguacuccgaauacaggaagcuaccggagacacagugguuacaaagcaguagaaaugcuugcuagcucuugagucagcuacaguggaggauggggugugggagcaugggagaggguuggucccaagugggaagagagcgcccagaaggaaggagggaggggcaacauggaagaauggccaagugucuagcaucagcagccuggauuacagggcuccaggaagguggggucucugcccgguucacucagcuauccuggugcccagaaccgugagaagcugaagccagcagguccuacgacacccaagggagaugcuagucugccaaguacagggacugugaaacacuuacuuggggucaguggcacagcaagcagaucagcccagucaggcauucccaaacgcuggccacaccaaaugcuuccucaguagaaaagcuuacucugugccagaagccuggcagauaagggcacagcaucugaagagggacagagcaacugaggugauagaguuccaugagugggauguucagaaaauguuucuaaaagagccucuuuggguacuaagguuaaaggcaguggcggauugugaucuagccuugguaggucucuggguucucucccaaacacccuugccccaauaaaagaucccuuggggaacugaggacaaagaaauacugaugaggacaggguaugaccagugcucacagugagcugagucgaguuccuugaagggagagugcauaguaagggaggcaaguccagcauagcccggggacccugcugcguggcauggggcccacacugcaaccuccacugcuggcugcuggguaugccacugcagcagggccugauggggaagacggccugaccuuaacauggucacacaguccccacgcuaacacaggcagccguucuggggagauccgggcagcgugguacuaggacagggcguggugacauguacuugggaccaacaugcaaagcccaucuguuugacaggauuucuaggucagagugagaacugaaugacaacaccaggcggagaugaaguggggccccagagggggcuggugcaacacugaguucacucacacacuugagggagcaagcgugaucuuauccagcuucacaucuuaaguguugacaucaugccacacguuuucaugucuagacgucuguucauuaggacugcaaaccuuuucaaggaggacuuacaacacaguaacucuaaaguuuaagaaacuuuuauuuauuuuuugaugcauaugaguguuuugccugcguguaugucugugcaccgugugugugugugugugugugugugugugugucccauggagacuagaucccuugggaugaagucacagaugguugugagcugucaugugggugcugggaaucacacucaggccauccagaaaagcaauggauucugcuaaccauuuugcaccaucucucuaggcccuguugaaagguuuccaaaaucuggugaccuauacagcugcuagacauauacuuaaaaauguucuuuauuaaauacaaaaaucauaaagagaaaugagaguaggaacuuaggauguggcucagugguaggauguuugcccagcauuugcagcacccuggguuccagccccagcaccuuaaaaaccuguacuagagaagagugcucuagcaaaggccacgcagaaggcgacucgaguggaucaggggcacagcuggguggcacagaacauaucuggcagguacaaggcucugugauccuuagcaauaaaauaaauuuuuugugcaaacauugcauaacacacgaaucuguccaggcacaccgcgccuuuacacagcuaccauuucucuguugugaaaagcauuuggaaugcuuucccuaauguuuuugaaauauauaauguaucauccuacuacacaacagaacaccagaaucuaguuccccuagaaugcacacacacacacuauuuuuaaacugucaauucaaaagaagaagaagaagaagaagaagaagaagaagaagaagaagaagaagaagaagaagaagaagaaguaguaguaaaaauaagugauguuauugagggugauuuguacauuuuaaagucuggcugccuacuguggucuugcaugcauuaauauuuucugcuuuauacagaagacauagcaacugaagucucacuuguggguacagauaagagcucucacucucuguuccaugagacucacaguugagcacuauuuuucugacaccacccccuuaaacuuagagaggguaagauggagaagauaccccuagaguuugaauggguuauaucaugucagcguguagucccacugugaggaggaggccugugagaccacucccuuguugcaauacuccagcuccuagccucuuguacuguguugguggggcuggacugggcacuccaccugucaaggagggcugauucucaaaggagcacaucuccauagguuuccucucugcuugucuuccaguaaaucacuucuccugcccacugagccucuagggcacugagcgcaucuauuguuuuguagguauuuucugccccuccuggauggaacacauauauaaauggaguauuuuucacugcugcugccauaaccaaauggcacaauccacaaaguaugucaggaaaacccaaugacauagcugcaaauguugacagacacucauggacaggcugagguaccguccccugcuaggauagacgcuaaaggcaggcugcugacgguuuccgaguuaucuaacaaagccuuccaucccgcacaugaugggaugauuccuaacugugcagcagaugcgaaaggagaauacugagaaucaaagcaggacaugcucagaaggagcuuccguaacucaggguuagggguucccguagcugucaccccaaagccuacuaguucagacccaccucucuuacagacuaaacuccuuuagacucauagcacagcaugcagacugcagccagauggcccugcagugagucacuuggacaccucugguagguaagaauauaauccuuuacacagggcuuccaguuucaaccuaauggacuaacggugauuuuuuuuuaaugaagaauuuaucuauagaugaaauaaaaacacaugcaauuucuguccuuaacauucagaugaucaaaaacaagaagaacgcaacacuaugaaaugcccuaacuuauccuugaauaagauucuagguuuuguuuagugaacucucuauauaaacauuaggcuuauuuuggcugguuuuucuauaaucagcaaugggguguauuaauguuauuccuugacaguucucccaggguugauuuuugucacuggugggcuucaauuugucaugaguuaaaucuuuaggguuggaaacaaauuaaaaaaaaaagauaaaagaagcaguacaaacuuuuauaaaaagcagcucugcucugcaguggaggagcugugaccugagccagcucuccaaaugacccaagcgagucacucagaacaagucaucucuuugucucuccuguucccguaggcacagagcagcuaauauguuuucaucuggggcaaggagcacauagauguuugaguacaaggccucucuugucccaccacccggagccuggccaugugacaggcuuuaaugaugcgcaagccauaugacacuguuuaucaugcacagaucacuccagagaugguguguagcagggagcuucaguguucugggaaauuaaggggggggggaccaaaaaugacugcccuguacuugccugaaggccauuccauuauaaagucaggaaauggaucuucagaauuuaaacaagcaugcuuuaccucuuucauauaaacaguaguauggaacccuauguguauacccaggauggauaacucacacuagggaugauagccaggaauggggucuguucagacugcacacucaaauggucucuaaacucaaaccagaaccucaaguauuggccccuugguuguuauuauaaggcacagcacuuaguggggaugcccucagcaaaguguaacaaaaaaccuucuuguauauaaagcuuguauauccuggaucccagcccugcacuccuuccauuauguuguaaagggcuuuuauuggcugagcaaauguuaaugccauucuauguuaaugggagaugcucugaaaggcaccgaaguauuauuccacuuggaucuuuggaggcaagauagagcaugacuugcagaacuaccuacuuggagcauaugucggcccucacggcccaucucuacaggacucggugauaauuucgcccucggcugagagaauucuauaauuacgcacagauuuauuaggucccaggauuaaaaauucucugaguaagaguaaaaaaaguaaugauacuuuagaauguaugguaauauucaaaugacuugaaaacagucaccucagcaaaaauaaaagaacgcagaagcccaaguuaaaagaugugguuggcaaugugagccauaaaccuguguggguuuaccauguggucacacgggcuggcauuuucacaugugggaauccccauugcagcagaauggcccagcuuccuuccuucaaucacugagaacugaccggacacccuauaccucuaaacaucucccggcccuaugcucaaucugauuucccguuucuguucacagauggaccuucccuuccugggccuuaagcacuugcucucuuguuuccagccucucuccuggaaaauguggccuuaucuguccuguuauuaccuauuagcugaguugucugcugugagcuaccucaucuacaugacugucuuuguuccuuggaugucucaagucaacucaacacagcaugucuauaaaaugcauuuguaucuccuccgucucacugaaacaaaguaauccagagugccaccauugcucagagucugcguaccuaaacaucucuccucugcacauuucaagggcuuccacccuuucuuccuacucuccuugccucuucauccugcaugucugugagacuagggaacugaaguugauaauguggccauaucauccucuucaccaaccuaauggcugccuaccauagggcaugagcaugccugggaggccagcccuaucuggcuccccuaacuccauccacugcucucuugucauuuugcuaccuuguccucacaggccuccaccaggcucuucuguuuccuuugcuugggccucuucauuuccccagucaauguccuauuugucuuccucagugagaccagccugaaccacaagcaaggucauacagcacaugguagggucauguaaaucccugagaaucugucccugcuggcguuacauacuuccuaacuagaccacugcugguaggcagacaguuccgcaaggguaggaggccaaggcuauuuagcccacccguuucccuagaugccuuucuccacagaaaggacaugagaacaccaaccgucaucauugugagacagucucagggcacucugcuuccuuuacaagagugucacccauuacauaguauggcucuaaacaauuacuccugaugaccuuggccacauccgguugccccgagugagucacagagcagaaaaauuaugaaagacuuggguucugcagaggcuauccauggaaacuagauggcaagaaaacaaccagccacauccacaacucacagcaaucucaucacaaugacuuuauggguuuuccuuuggaggaaaacucacucacucacuugcucauugacuugaugucagggccacagucuaggagggacagauacacaguaaguaucugaggcugauacacaguaagcacccgaggcugauacacaguaagcauccgaggcugauacacaguaagcauccgaggcugauacacaguaagcauccgaggcugauacacaguaagcauccgaggcugauacacaguaagcauccgaggcugauacacaguaagcauccgaggcugauacacaguaagcauccgaggcugauacauaguaaguaucugaggcugucaguaaaaaggagcccuagcuuucugucugggggagaugguauauuucaggagagagggaaagaugaugguuggagaaucgccaacccagugaggcaaaagauaacaagaaaaaaacccagacaccccuccauuaccaacuuacuaacggcaccugaggggcugggguugguguccaagacuacacugacaccacuacuacuucaucuaguacuagacuuccugaagguucugagaggaggagagcucaaaggguucacucuccucucacacaguccucaugcccaggcccagccaguacauguguaaaaacuucagccucuuaugugggcaacaacccauccacuccauggcuccagucuuucucuuugccugauaggaggagggcugagucagaagcagcgcccagggggaggcucugaggcagugcaguaggaagguuagggaugggguagacagggggaugagacugucauuggcugucuuuauagacugaaagcuuuaaacuugacuggaggaaucugauuuacuuaaaugaauuucaauuuccuuaaagcauaccuuuuugauguauacauuacucaagucuuuauuucaucuucaagcccugucuacagauaagaacacaaagcccagauuugagcaugauggaugguaggcaccuggagucccagcaacugggcaaugggggcagaaauaugggguccagccagccugggaaagcaaggaugaaggagaaugauaagggaugccaaaugauaaauuucuucagaauggauacaagauggugugaggaggcaugucuaauuacagugagagagggugguguucaaauguggucgccacagccagucaaaggggccuaaauauggaguguuucgccgcaaaugaaaauacacugaaagaguuaggaaaagcuuaucagcaucaaaaacuauccaugauuuaauccaaaaugaagcauguagcgcagauuuucuuaaauaaaacacagacucaacauaauuaaaggaaugaaccuuugucccuugaccacagcuuucuucagaagcaaaaauaaauaaauaaauuaauuaaaaauaaauaaauaaauuuaaaaaaucauuaugaauuaaauacuccaacuuuaguuauucugaccaacauccauguuuaaaaggauuuuuaaaauagcacuuuucaggaagaagaauauccuguuuuuaaaaacaauuugugaagguaaaaaauuuaagucaaguaauuauauaauaauacuuuaauguguuggcaauucacauaaaaacauguaggguauucaaaagguagggacaugcaaauguccuccuuuuuacaaggaaugaccauaccaccugguauaguuuauuuugguguucugucuagugcaauaucaguuuucugagaacugugauauuuuuuauuuccgugaaaaaaauaugagggaagaaaaacuauagguugaugaugaauuccugauuguaaguuagaacacgcuagcuaauagggugcaagagcccagccuguccacuugugugugaaacauucgugaagagggaggcagugggaaggauggguaaacacaacaucagagaaauuuaaaaccugcaauguggcauagaaauaauacagcaauacagcaucaucucuaccucgggagcuucugauucuaauuaaguuuagaggaaaaaaaucccaaggcaucccugccugacucagaaugugucauauucaaggaugcucgagugauaaacggguacauacagauaugaauccuacugcaguuuccaccuaacaucugucuuguuggucuuuagcugaucucuuuaauggugucaucucaguguaccccaaagcacggggcgggguaagcuucuagacugcuguuucauucagagugacuuuggugacucagguggccauccucagaaccacuagcgaucccuuugauaauguggccacagaacuuccuucuucugggaacucuauacgcaugaccaaaacauugagaagauuuuaaagagcguccuuacccgaauuauuucuuccacacagcuguuguuuucuccagaucuacucuccugaaagcaaaggaaagauaaaucaggcuugacugaauggaauuauggucacagagagauggggacaaucaaacuuccaagucaccugggggauaaagcaauguugaccuaaagggcuguuuaaggcagggagugcugacagggcuaccccugauggacagcucucauuggucaguuccugcugugguuugcagagucauguaugugugcccuugacauagcccagagcucuccuucuauguuaauugaagugaggaaaguucccagaaauacugcaaacguuccacaauucugagauccauccauccacccugggcuucauccaaguuuggaaaacguugacuuugccacaaaguaaagauccagucuacccaugauauaugugcuguggaccggaugaaaguaugguggucaccacaacuucaauaaaaaucuagaucauaguccucaaaucccauacugagcagcaggaugagucuaaaacaaaauacagaguaagaacagccagguuccacuggguguugccaagagugcugaugucagaucucaccagaaccacuugcucugccauuacccaugcugccgugcacuguaggcagugcugaggugugguggccucaggucacaggggacuggagagcauguuaaggucuauagacacuguuuaguuacugcugguuacacagccaagagccgagcagaggacgugguuuuaugggaacauaaaagcaaugagcaucuacuguugggugugcugccugcggucccggggaagccauucugcgggcccuguaauucaagggugcuaaccgcagcacagggcaacacacuagaaugagacauuugugugugggggugaucuguucaucaaaccaacugcccucucuuuccagcucuuuccuccaggaaugucuucuguaguuuucuagcuaauucuagggcuuacuuggggucauaccuuaugcacagucuccucagagcggcuauacaugaaccugguguucuccgcaguaugaccuuccucagccuagcccccccauacaccccaaaugaucccuucacuuagcacacacucuauauacaacgugucaaauaaacugaacaguguucuucacaccguaugcaccgucguguguaauaugcaugucagcugauggcaagcaaaguaaugaauguguuucuuccuguaguuauuucaucucagcgugucauuucagacaggggcuuacuacacagccuggacuacuuugaaaccugccauucccagucacaagcucucaaguucugggauucuauacauuaccacaccaggguacacaaagcugaucagagucaacucuaauguucaaaagguucacaguggcuucacagagauggaugucuccucacuccuugccccgccuaauaggucagcaugaaggaagauacuggacuugauaaagucucacaagugacuucaccuuuuuucuggcacaggacuggugauuuguauggccccuaccaacugaggcccaagaaguacacaugacuuugaaaaaagacaugugauacaagaacagugacucaacuggauuaugggaugccuggugcuagcaauagaaaauuuccugucuauggauauuccccaacaauaaacacuguccuugaaauauguccuccuucaaagcaggcauggccuaaugugucugcaaaggagaagccuggaacaauugucacaaaggcuacauagaaaagucuuagucacaccagggcuucauucccguagaauagccccucugguauuuaagugggaagaauuaguggccucaguuggaaaauuuaucuccaaagccacaaccauuuuucucacauucaaguccccaaccauucguaggagacaucaugcugacuaagcaaaugcuaaccguuagcucaauauacuuccuguuuucuaccucagaaacaauuagaaggaaaaaugugaccucaccuuacccagggaacaacaaucuacuagaaauacuucaaauucaacuuuagguuuaagcccuuaaauaagccuccucugaggacagagacaggguaagagucagagaaaaggucugcugauuuuauuuccuacauaugucagagaggcaacauccauguggucucauugacaugacugucucaacaagaccugagcaaggacaacagggacugacaugcggacauagaagagggacucucauggggucuuagcccuacacagaaaaccacagguagcuaagggaugcuagggaugcgaaagacagagagauggucuucaccaaggaagagcucacugauugguuacccaggaccaaaugaucauccuugaaaauauaaaugcaaguuucaccaggauggagcaggcuacauuuacaugcuugagagagagagagagagagagagagagagagagagagagagagagagagagaacaaucaaaguauuagacgccuugaauuugagagagagagagcucaaggaaagggcuagugguagaagagggggaaauaauacaaucauauuuaguuuaaaaaagaucugaaaguaaugucuccuuugaaagcuaaacguuaauuccccuugaugugcuguacgcaggggacacgcuguuccuacuauccuguaaguucccucugccuuacuauaguaagggcacaugaagagaaauguguaguggaugcaccuugguccccaaugcugauggaguacauaggauuaugacacuggcucaccuugauggcugugcagaccugguggacaggacagacagacagaggccaucaagagagagcaccaaacugaggaggccaggacuauaacuuccaguagccaucucaggaagucucauccuugcaucagagccugaguaaggcaugcagagugagcccccgagucuucuacacaacaauucugaggacucaagacggaaaccauauugguuugaaccuccagggcuccgauugcacugggguggcuccauggcauggcauugaaggaagucugauucagaaggcaccuaggggcucuuucagcaaaaaccaaugacuuuaacagacaaggaaacuuggcuuaaagaaauaaagggcacuauccagaaucccuaugucagcaacaguagcaaaggcagagccacacacauuucuaucaccccaccagugacuuuucuaguucaggcaaacucccugcgcucaguccugggggcugcaaguaguugacaugacauucaugcucacaguggagagaucaaaggauucugggagcgugagcgucuucaucuguugauguuacuacacauuauucaacauguaaccauggucucucagucaacugaccucuacaucauacacacagaagcagggagggaaaggggaggagaaagauagucagaagucauucuccucucuaaccaauacaaugaacaggaaggguauguauguccucagaaaugggcgcacaggaacccacuuggucuuuuuccaaauguacagaagaucagugagugggggagagguaaaggaggccgaggagccuucugguuuggggaaucucucucaauucggauuucuacuauaguuaugugcuuugauuauuauuuauacuucgauaacuuucucuguuuauggguaaggcugaaacaugcaugcaauuuacaucuccaaauuugugcuuguauuuuuuuuuuucacaaugaaaucacugcuucccuuggaaagguacccacugagaaggaggcugcaccauguaaaauuuaauuacucugcauuuuuuuuuuugaggacuuguggcuguugucucaugcugagccacugaacuguugcucaguuguuuacugugacuuugaugaccccccccccccauuuuucaaucauugcauuuugaaaucugucuuaacagucucaccucauugaaacuccaacuaaacuucaauuaaaagcuagcaucccuggcugauucuccucagucuugguuguucuaugcuuuccccaaauccuagcacucacacacacugcagagccugccagggaaauguggagacugaaguucugggagagaagagcgccagaggcagccagcagcacagcaucgugucccuaauugccaugcugagcacagcucccuggaagaagcaaggcuuaaggagaaaaggcucuaucaaaucagagcgaaauggcaucucauggcagagggggaugagccgcacacagcacucacauuggaaacaguuuaacucuucaucagacacauuguagcaaaacuuucauucauaaacagugcugacagaggccacaacaguuaucagcaaauccucaaaaauccuuaaacauuuagaaauuguuuaucccacacauacaccuaaauauuucuacaggacuaucuugaaacacaucuuacuauuuuccauguacagaaaaccugagacaaagaaaugcaguauugcaucaaugccaugaaaaccgugccuggagaucuaagcuaacaccaggaacucccaaaacucuguguccggggaggggucaucucuaccauuaaguuccaggccuuacccuugagcacagggugacuugugagccaugaaacagagagcccugcuacccugacaagccggccccugaaggaccacacucuccuucccuuaucugaagcuggagccucugucuccucucugcuccucagugccaacugcucugcucugcucacccaugguucuuucccuccgcuacuuccacccagcucugccuguggaaugcuagugucaucaccaucacagugugugcacaacacaaaagcauuuaaaaugccaggcagugcacacgagguguauuugaaacacacaugaacuucacguuuagacaggggaaccagccccaaaauaucuugcuggguauuugcaaaucuuacaaauuuuaaacacaucuacacaauggaacucuucuggccugcugccuucuggggaagggagaaccaaccuguaucauccuuuaaugaaaagaauaaagcaaggauauauucugggcaccacugcuugcaagagcaguuuagaguggacaugcuaccucucguguaugugcucacaaccagguccuggcauagcaaauggugcgaaaucaacaguuaauccuacaggaugccugcugaaugacaaaauguguagccaauuuauucacaaagaaaauuagauuuuuguuuuuaaaucaaaaguucuggggaacggggagcaggcaaaauugaugaagagcggaguuugaacucccagcguccauguaaaacgucagguacaguggcaugacuuguaucccuggugcugggaguguggaggauaaucugcagaauucacuggccccaguaucacccauuauugagcucugggcucagcuagugacccugccuuuagaaaccaaggggaugcugauuaugggguggaucccuggauauggcagucucuacaugguccauccuuucaucucagcuccaaacuuugucucuguaacuccuuccauggguguuuuguucccaaaucuaaggaggggcauaguguccacacuugcauacacuagcaaaauuuuauugaaaggacccagauguagcugucucuugugagacuaugcugggccuagcaaacacagaaguggaugcucacagucagcuaauggauggaucauagggcucccaauggaggagcuagagaaaguagccaaggagcuaaagggaucugcaacccuauagguggaacaacauuaugaacuaaccaguaccccggagcucuugacucuagcugcauauauaucaaaagauggccuagucggccaucacuggaaagagaggcccauuggacuugcaaacuuuauaugccccaguacaggggaacaccagggccaaaaagggggagugggugggcaggggaguggggguggguggauaugggggacuuuugguauagcauuggaaauguaaaugagcuaaauaccuaauaaaaaauggaaaaaaaaauaaguuaaaaaaaaaaaaaaaaaaagaaaccaaggggagauugauagcagaugucaaucuauggucucuacaugugugugcacacaucugcuugcacaaacaugcacucuuacacagcagaagcuaucagaugccaaccucuggucucacacucguacucacauaaacacuauacaugcacaaaugaaauuaaaaaaaaauuaaugaccagggcaguugccugcauuauaagagcuaucuuuguuuucacuaaaacauuaacaaauaauaacugucuuaaagacuaaucuuagaacaucaacauuuacuugcuucauugagauuaaacgcauaccuacuggcucaugaacuacuugacaggcccccucucuccuaaauucccacacuggcaccuguaaaucaagcaauucaugagcaagcgauauucauaaaggguugcugggugagcaucucuuauaaaaacuucaauucaaaauaucuaaaaauaugagcaugaaaagaaugucacacauggagaauuccacaucucaucucaaaugacacaugauggucagaagucaggcacauaaacacaccacauaaaguuuucuaugaucuauguguauacaguacaugccagccauaaacacauuucauuuagacuucaggcuuaucccaugcaaccucauuauacauaugaaaauauuccaaauauuuuaaaacaccaaaugcuuaugaaaugcuuaauccuagcaauuugagauagaauaaucaacuauuacagauuuaauacuccuaucagauuccuagcaacaggauaaggucgccgaguuauauuaugauaacgaaagcuagugacaucaaucggagcuuguagauaaaaguacacauggcugucagcaaguuuagugguguaucagugggcugcccuugucaaaagccuauugaugucaugaaggaauuagacacagagacaguggcuuuauaucuuggucacugauggauauugagugcuuugcuguggggucaugucucaaugaagugcccagugcugaagucagggucaucuuccagacuguccugacgacaugggguaaacaaaccacaaggcagucaucuaagaacacuuguaaucaacauugacaagaacauggcaagaccucuucguucuucauccugaaucacuccucccagcaagaagaagcaggguggagaugggugauaggaccaagguguucgacacucgcucaccaagcaagccuucagagagacaugaaaggcgccauuuccucuccaguucuguccugaauuucauccugaccccaauuaucuaucugccuccuaaucuaagaaagaacaaaugauauuuucuuucugaauagcagguuuacugauaggauaucucuaaaacacauccucuuaaaggaugaggaaaauaaucagaaaaaccacauuugguaaacgaguaccaucacgaacgucuuuccuucuaagcaugaaauucugaacacagagacuugcaggauggaaagaguaauccaagguggcugaugaaauuaaccaauuaaagaaacuuagaacuccucuaaucuguguccccagguuagacauauaaucaauuuucucucaaguaagaauauaaauggcaccgugguacugugaauuugaucauacaggcugaaaucccuaaucuaacauguuuuaaagcacuuuccuauuuucagaucuaaauauugcccuaauuugauucuucuugcugugauaaacaccaugaacaaaagcaauccggggaggaaaggguuuauuugguguagccuuggcuacuuggcauaguauuuggcuacguaguccaucaucgggaaugccaaagugggaaguggaaacaggaaccuggaggcaggaacugaaauagagagcaugcaggagugcuacuuacugucuagacuuuguggcuugcuuaauuauaugacccagugauaccugccuauggauagcaccacccacaaugggcaggggccaagggauuuugcaaacccaguuuuauaggguccuuggacugucucuagccuuucuauacuucaauguucucauucuuuuuuuuuaauuuagcuaaaaaaaaauuucaaagugugugugugugugugugugaagccuaagaaagcuagaaagggguguuagauccccugaagcugggauuaacaggagguccugaaccacuaaauguagguauugggaacccaacuccagucuuccaaaaaagcagcaagugcucucaaccacagagccauauuucuagccucuaaguuguagaaaguucacauuuauuuacuuaauuugugacugcucguaaguacaugaguguggguauggcauggcauggcacauauuuuggggcaguauuuuauuuuccuaucauguccgucccagcgaucaaacuccaaucauugggcuugguagcaggcaggggcccuuacagaccgagcaaucucacggucucaucuuucucauucuaagaacaggaauaagaacaguacuaagcacacauggaggcuaaaugaggcacugcauacagaacauugaacacgugccuuccacaugacagcugaucaaugaauaggaagaacucuuauuguuagaauuacacagacaucauguuaaacacacaggaaagcaauuguuacuagugugucacaucgaauuuaggaagaccagaugauguuaacucuacuauuuugccuguuucuaaaauaccauagaucuuccagauuucuguaaaacagaaaguucuuagggcagaugaagauaucugaauaagguauucuuaugcuuagauggauugguagcuaauuaauaacauucccuaacauuuaguaucuggaaugauuuagauguuaaggauucugaagugaaauaaaaugauaaaaauccauaccacugcagagcuuguaucuuaauaaugagaucuaggaaaguaauaaaaaaaaaucacacagcaugguagaagaugaaauguuaacagggaaacuaugagauggcgucauagcauguggggcuccaugagugacaggcuuguaugaggagaauauugcuucuaacacgcaagacaagguuugucaacaugacacaagccgaagucaucugcgaggacucuguaagaucuaccaguaggcaaccuugugaggcacuaucuugauuagugauuugugugaaugggcccaacccguugugggugcuaucaccccugggcagguggcccugguguguauaagaaagcaaagugagccagccaccaggggcgagccagcaggcagcauucccucacaguuccuguuucagcuccugccugagugccugcccugaguucccuucagaagagaguguaagagggacaugcaagcugacauagaccuuuccucuccaugcuguuuucagucgugacauuguaucccagccacagaaccccuaagaaaaggauuaacauguagugugcacugaacugccccauccucuuuucccuucuugcucccuacuccccuuugcucucuuguagucucaugaccccaugggcuuugucucuuagauuauucuucugagaaugccccaagaguagaaauaagauguuggcacaggagcacaguguuucuucccgacacacagagaagauuaacacaacaaacgcuugaagugaagaaaugguuaaaaucgauauucagaaaaagaaaaugacacguagguaaaaguuaguauguuauucaucccuguuggggguuugacagguauguuccucacgggucugcaugcuggaggcguggucuguacuggaaggugagggcaucucugagcaagagagaggucuaugcuacucuaguggaaugaauuaguguuugugugugacugggcuguuaaaaagcagguccacaccacauggcugcucucuuucccaaguaucugugucucuuucugagucucagccaagggccccugugacaccagugucaugugcuugggcuuaccaagcaagugcacucugaacagcgguucucaaggacaacgacaucuuccaguauaaggcagcugacacagggaccccaugcuaucccauagcauugcugauccugacaucuacuguguucacagcucaacuccagcugcccccauuuccuaucucuucccuaguugcuugguucuuaacuguugguuuugcuuuguuuuuuuuguuuguuuguuuguuuguuuuugaaaaaaaaagucguacugcagacaaccaucagaauuauuauuuuucuacauuuuuaaaauuucugugccugcguugccuuuuagaauguuaucuagggaaagcacugcucaaggcuuucacagacuugccgagagggacacugaggcucagggaagagaaacaccaacccaaaacacaacucucacuuuuuagcuucuuuuguaauuuugccuguagagaaaucaaggucuacauucagacaggcuggugccuuuugcucucccaggaaaccauaauagcuacaaaguuacccaguggugccuaaaacgauguagaccugugguuguagcaauaaacugguaucuguaacucccacuguacuucagagccgagagagacaggguuuguuauccggcuaauaaacaaccugccaucacuuccaacaauuagagcaagugguccuuucuuagacacaucagagaguagccuuccauguuaacuuuucucuuccauuagcucaggucuaagaccaaacggcucuggccugaagucacggagacacuuaaugaaaggcguuuuaugccagucacgagcugggcacaauggugaucagcaguagaucacaccaagaccaggcagggaugcagcagccaggcguggcuagccugcuacauuaaccaccccgugagcugagcagacaccucggcagucucugcuucucauuuagaagaacgaaaccaaagcaucuuaauagggacaccggugggcugaguuucauuaggacgggccuuuaaaaggagucagugcugaucaauacagccggucccgcuuccugcucccaaucuguuaagcaagaaaaugccuuuauguuggcacuaauccacugugcccacaaugaggaaaaaggugccccaagaggcugacgauuuaauaauacacuguuggcuuuuuuuuuuuuuuuuuuaagaaccaccaccaaaauaagacaaaacagcacuacagaaguaagacaauuggaagaaagcuggcagcaaaguccccuuaaaaacauaccagaaugagauaaaagucaaaaaaggggagaaaguagcuaugaucagagaacuagcuggcuuguaaaacccuaguuccuagagaucuggcuauuauuucuaauuccugugcccaaggacucacacugcaccggugcuguguuggcugguggaggagcuucaggguugaacaaaccagggucuaccuuucacggaacagacgcucugugcaguggccaggcaauaaauaaguaaacauggcuacucuagaaaaugugccuguacaaauguaagaaggugcagagugcagggacagccacgguuccucucagcacugaugugucucuugucagaaagacagaggaggacgguucccucauggaagcaguaaaaugagagcucccacccaugacaauaggcacaaagcccaaaacaaaacuccauaaaacccggaacgcuccacaguacgcagccccugcuccuaggagucccaagacccuguucaugauuccgucgcagccauucugaaaagguagagaacaaaucauagguuucugaaaagaaauauugcaaauaacauggcaguauuggaaaaugcuaauguaaacgcugccgggccaucugcuugguauuaccacaaugcagggaaaggcucugagagaaaugauguuugaaaucauuaaaaaaauaacaugucaaguuuaaaauacucaaggaucuuagaagcagcaucaacacauucugcaaccauauggcccuacagcagguuaaaaaaaaauuccccggcuuguaguuccuacuucaaccuaaugguuccuaaagcaugcuugcuuuccauuugagcacuccccuccuacauugaauucccugguguuuaugcuuuuuugaauuauacuugaauacaauaacaguuccaccuuuucucaaguaggggaugaugugguaugggagagggagucagcuguuccagaagacaggcagugcagguggcagauaggacaguugagugugucuuguuggaccucugacguaggagacugauuacagcuucaguuguagcugcuaaucccaguagagaggcuaauuuugcaggcacagugcuaacggcuuugcauccaucaguaaucacuuuccuaaagcaugcccuguuauuacacacacuuuguacaugagcgucuuccucaaggucauguguauggcagggggcagggccaacuguguaaacacaauucacggaccacaucuaugccuucaaccauaauuauacaugucagugaucaguguucagaugguggugaaaacagauuuguguuuuucaaggucaauaaaagucuaaaagccuuuucaagguuaaaaacacugaguaucucagguuagagcuagcucccugacaagaaagaaaucaggaagaacggcuuuucguuuaacuucaaagaacugaguaguggucaaagaaaacucccagagacagaggacacaccaagaguuacagaguucagaaagcuaacggccaauggugggaacaccucccgauauuacugcagaaaacuagaucagaaacagaguucucaaaagaggaaucacacauggcucagaagcacuuaaaagaauuguucaacggccuuacucaucaagggaauguagaucaaaaacgacuuugagauuucaucucaugacagucagaauggccaagaucaauaaaacaagugacaguuccugcuggugaggaugugggacaagggagcacuccuccacugcugaggagcacguaggcuuggauaaccauuguggaaugcaguguggugguuucucaggaacaugaaagauuccucucaagauucagcuacucuugggcccaaggauucuucauccuaucacagaggcaccggcucaaccauguucaacuccucuauucauagcugccagacauuggauauggcuuagaugcccaucaaugaauggauauauauaaauguauauuuacagaaaggaauauccaucugccacuaaauaaaaagacaauaccuauuuuguuauuguuguuauuguuauuauuaugagagagaagaaaaguuguggauuugggugguagagacguaaaaaaggcugggggaggggaaauaguaaucaggauauauuguauaagaaaaucuauuuuaaaaauugaaaacaaagccccauucuuccucuguagucagucauaaaccuagaaguucagacugauuuuugcaacuggguuaauauuuaguagugauuuauaacccuuuagcguuguauguauuuuuuauauauacugcauuccaugaggccucuuucuguaaaucauauuguacauugagcauauuccaucauuauggaccuauauggguccacagacacagacuuacuaugucuauuuagacaaacacugccaguagguuccaggucugcguuuucauguacacugugccuuaaguccaacuagaaaguaguugguuacucccauaacauugaugccaucccugagaccacugguguaucuugacauuccagucaccacuauaaggagcccacuuaucgauaccaugagcuucugcuuccuuggguaucggaucauauacaggcauguuuuagcucuguuaacaguucucaaaguguucuggagauagcacauucagguaaugcuagcaguauggaaaaauacacacaugcaaacuaagcuguugcugacaaagggcgccagugaaccaucgccaccugacuuuaggauggcaacuagaaauaaacaaaacccguugggcucagguaugugccuguaguccuggauauuggcgcaucugaugcagaagggucucccgagggaagaggucugaaguccugggagacagagcaaaucccaucaaagugugugggggggggggggggaagaagcuacuuucuacuuuuaaauguuugcauuauuuuccucgaaaaaucccacacagacacaucuuuucaccucauugaacuaucugcauagguacgaagguuucaagauggcucaagugaguauuuauuuucucaaugggaaaaucuguuaaacugaucauucagucuaaauaaaugaauagucauagcuggugucuauguuugggggcccuuuucuaagcuguugcuauaacuguuaucacucauacaagcauaacugagugacucagagcauaacgcugcacccuacuuauuugcaguaauuaugauugucacaguuaguuuguaagacugaauaacauuuaacccccaaauaaucacacugauuagcaaaugguuuugcagcauauaguuuuaauauagccacugcaaaucuccugugaucaacuaugaucaaaacugggauuuucuuuucugguucuugcuuuacuucccagaagguucuuccaacucaaccaaccagaagcucauuagaaaaauaaaaugaaguaaauguaccuugugguuuuuaggugugcugaacacuaagauacaggaaugcaauggcagagcgcgcucacacacacacacacacacacacacacacacacacacacacacacguaagcuccagccuggauccaugugacuuuccacuuuggauggugaaaccucacaaccauccuguaagccccacucauuucaaccuuccugaaagccuuauaaauaauagaucaucgucucguuugauguucaaagaauugagugcugcucuuucuacaucucuccuagcccaccuuccauaacgggcaaguucuccucaaauggaccuuaaaugcauucaguacaggaucuuauuaauguucucccccugccuggaacaaauuaaagaaacuuuacuguaauacacugcauuauugcuuagaaaauauucaugcuccuccucucucuaaaaaugggugggcuauccucccccaguucucaauucugguuggucaaaugacuuugcuuugaagucaaugggguaacuggacacagagggagacaaagaaaaagaugaccuggcccucccuccagccucucccaccaucaacaggaguaaggcacaugccuuaggagggaugugagcgaaggaaggaaaaaucauagaacggaucugagcacaacuuuuaacaaagagcuggaccuagcuguuccagccuaaacugucaggcuuagggacgggagaaagagcaaaugaccacgguuuuaaccugcucaagguugggguguuucaaaccucaguaguagcuagcugauccacccacuuuaugaacauggcaccaauuuaaaaacccaccacggaaaaacagcucagcucucccagugcccugagcacauuggacaauuugggugaauuuccuugacuaucaucaggauccacuugcuuagcuaagcauugcuccugucggcccauuaagucuuucccuauucuccucagaucuacaugacuauagcuuuuacacuuuuuuucccccaugagacuuauccgaauuacauggaacuguuaaaauuccccaucgcugggcuuauucuggaacaacugagucaaaguccuggggcgggcggggcuacuggcuuccauuuuuaacaagcuccuauggcacucuccuguuacaucguagccugggaaguacugagguaccaaugugcuaacucaucauaccccugucaaaaccaaagcccagagaaugcaaacaaucucugaaucuguuuaucccucguuuuguuuuuaugaugguuuucugucugcuuuaacauaguacuuuuuccucccauuccuucuaaugauauaagaguucaauuaaaaagaggaacucuguguguguguguguguguguguguugagacauggaucagcagcuaaaagcacuuggaccugggcucaguuccuagcacccacgggacaguugacaaccaucucccccacugccgagggaucugcccuccucugaucaugugacccuuuccugaccucuguggcauauuaggcacacuugugguaugcauggaaacacuggucacauaaaauaaaugaagaaaacaguagcuuuuaaagagauuauuaccacagccuuuagucuaugaucauaggccaacaauaugauuauuuaaguugucucaauggccacuuugcuuuuaauuuauaugguuuuucaaaauguauuuggguuaggaagggaauucacauagaacccauacuggccuuacaucuuaaauguuuuauuuagaaauuuuaacuggcugaaagcuauauguacaccugaagugucccguauaaauuguacacaugaccgguguaacgaucuccacaaaacagugaacgcaucuguuagcaccuauuguuaucaucuugugugugugccgguugcucggaaacugucagacagacaggacuauuacuuagccugagcacacugcauuuuauucugcaaaccugccuguuuaaucacaguguuuacacuguuccuucugccugccccucaccuggaggcuacucacaaacaugcauccuuugcauuucuuuuagaaacagaugaaauugguaacagggcagacuuucagcagcacugccaugucagaugacaacguggauggaggguucuaaaaacaaacaaaccaacaaagcaacaaaccaaccacccaauguuaccauuacaucugcggcucuggaaaucucaccagaugagcucuagacaaacagcacagucgggugacagagacaugggccccaagcuaacuucccuggcuuuguguucugcuugcacgcuuucugaucccccuucugcacacaugggaaugcuggccuacuguacgcaccuguaaucgggugaguuauaccuuucaucauguugaaccagugcccgagucgguagaauucaggauuugcaagcugucccauuuuuaaucccugaguguauuccucacuccuguuuaauggcucccuguuuucuuaaacguuuuaguucagaauauaucacccacgaugcguagguacacauuaagaacaauaaaauaaauguuuguaugcccgaagaguuuaagccgaggcgcucagacaauaaaccuaggccucuguuccccugcucaucucccuaucccuccguuugcccagauggagcacaugccaccccaugcucuccuucauaguuuuacuacaugguuuuauuacuaucaaaauaacuuuccaaguugcucauaaauuauuccgugacccauuuucuuguuaacagucuccaucugccaccccuuuuccgguuccucuccuccaguggggacggcagcagaugaggaaagguguuuucuucccugcuuuggucacacuguuuuugcuucuacugguucuucucgacagcuucugucacacuccuaaauguuccaugguuacaacucccagggucauugguggcaaaugauuuugaaaauuucaagauccuuuuaaaaacgccucuccuuuccaaauccucccucagagcugaauauaauuguguuugcuuuuuacguugcuaaaucaaggggcagacuucuuaugguucauggaccauccuugaauggacacacuacucacaauguguucucugcggugcaguguuacacucagagauagccuggggcagggcagaguuucuacaggguaggacaaaauaucccacaaaguaucuuuauauggucagugcuucauguacuagaaaauaucaugauucuaugucaacacucucaccccaggugauagaccacccuccuaaagucuagauuacuaagacccagcauucugccagugucuaagggcugguuagacacacccagucaagucuucagccagugucccagggcugguuagacacagccagucuucagacagugaguguuucaggcuggugagacacacucagucuaguguuugugguugguuagacacacccagucuucagccagugucucagggcugguuagacacagccagucuucagacagugaguguuucaggcuggugagacacacucagucuaguguuugugguugguuagacacacccagucuucagccagugucucagggcugguuagaaacaccuagcaccacuguaacagucucucccagggcuccacaguguaguccugaagcugucccaaacgacauagguaggaaucauacaauccuaucuuguucuucaugcuuucuauccuguguaacagcugaguguaaaacaguauuuuauaaccacaguguggauuuuucaaacccauugauguguccuuccgcugaaggcuaagauacagaaaaguuauccgaugaagcugugacuacacgcauucaauuuucucuucuuaacuaaaaucuagagccagaauccaaaaacuuccccuucccaacuuuggucuuuuaaacagcuacaguggcaauuaaaaagacuccucuggucauucuacacuacuuuaagcacuuccuacaaucccacaacccuauuuuggaaaacuaguaucacaaguacuuuuuauuaaaauaaauacaguuuuaaauagaacucucaauaaauuaucucagcagauguuuuccaccgaaggcgcuacagaaauuuagcaccaauccauccuuccagacagcauccaaccuugcucaguaaagacuccagcacucaucuuguacggccauugauuuucuuccccaguaauaucaagaggcugagaaggagaauaguggggucgcugaaaggcugguauuuccagcacuugcccuggguuuuugcaauggucuauuucagaaaacaaagcaaaacaaaacuaagcuaauaacugcucuuuuuuuucugaaaggauaccuauuaucaaguagaagugacaguucugcgcuguaacuguagccccuucagcuggcuugugaauuuaaaugacaccugauuuaauguacacaaacgucaggagucagaucagccugugcauuuuuaaaccuccuuuuauaaaaacuaaaucaucagagaaaauuucaaagaccccccuaacuagaauucuuuacuacuacaugaaguauccuaaauauauacaaguaugacuuagguaugcugauaaacauuuggaguccagugauaauuuauguuuugugcagacaacauuauagggaacacuaaacagcuaucuacuaaccuguuuguuaugcuuugaucuacagacacaauaaauauaauuuaaagaagacugcacacaaagaagagcaucauuaagcaaggguaugugguaacacuguaugagcggcugacaguuagcugagcagccugaagccaaauuaggacagaugugaggggugaagaacaggacacgugcaugcuccauucuuguuugaaauccacaugcuacaaagaugcugccucuucacaggagcggaacaaacucugcacuggaaaugacaaaagugggcacaagauacaauaugaggaauguccacauuagcagccuaucuacucggaaccucaagucuauggaaccagcuucuaggaggaggaaaauaaaaugguccugaugcagcguuugccgauaacucaucucuauggguggucucuguguauugggcaucuaguccuucaagauaauugcuauggacaacuugucaaggucuuauguccaacuguccuagggcagugugcuucuagcugcucuacaugaagcuuacaauguaacauuguagacuccaaaaucgcuuacaauguaggcucuaaaaucacuguucaauggguaaccacccaaccaaaaguaagugcugagaaaccuaauuaaguauuaguucauggggauucucccagugauggggggggggggggacggacagauugugggcucugccugagcacugcuucgcagcuccauguucacuagacauggaauaguacucccggcucguguuguuaacugauagcugauucagcaucacuaaagaaacuccaaaucaagcaaauagguggagucauguguuucuuuucucaguugaagacuucguggugccuugaguguugccuauugcuuuacuguccccugacagaauuuggggugcccaugaugcagagaauguguugaaguagaaaccaaacagugaagcaagagcuaugugacauauuaaaugaaaguuagcugaguggaauggauaaauagaacaccccagggccaaauggcaaaacucagccacuguggcccagccaccacuugauggggaagggggcaacuaugggccauucuagccauuggaaaugggacagcuucucugaguagggucuuguaaaugggaaaggaaaacaacggcugucuuuguccaaugaacaauggggucuguuaagaguagaauaauccacaguuguuuaugcaagcaugaaaacuacuaauauuagccacagauaauucauauaucgggugacagaaugaaacucagaaagaccucccuaagcugaugggccaauccaacaaaaugaaacagaauccauauuaguggcuccugacuuuagaucccaugaugcaaccccaguaacacagggguugaagcuuggcaagucauggugagccagcaguaaagcaaaguugaggaaaucuuuaauuugauuaauuauucagaucaaaaauuuaggggggggcaggccuaccccagaccaagagaagagagguauacuagguucuagauauuauuuggugugauguaaugucuggaugugcagguaacagggccuggcuugugacagccaucuuuuaucuucagcuugacugacuuuaaggucaccugggagucaccccuccucugugugggucugugagaguguuuccuagagcaguuuaacugaggaaagaagaacccugagggaugcaggcaguaucauuccacgagagucucaggcugaauucaaagggaaagaaagcccaaagcacagaggucacuugucuuugcuuguguacggcugauaaucgcaugugccacuucaugcccccacuaccaccacaucuucccaccucggccaacuucaugugucaccucuuaaccacaaguuaaaauaaauccuucuucccuucaguugccucugccugguguuuugucauugugugaagagaguguuccacuguagcgugugacaacgaaaggacacaacauacuuauaacuugaggguuucacuauagauaauagaugagaauaauucuaugaaaacauuacaggcaaagcuagagccaauauugggcaguauagacauucacuccuaagugucuguugaagaccuacugcaucagucaguacuagagaggcaacagaacuccaagugaugggcaacuucaucaacacuuagaacuugccagaaauuaaaguuccgacaggcuggacacaucacgggcugacugcugaagaguuuaaggcaagaggugagcuuucagucagucacacuggccguauaugugacagauaagccguaagcuccuucccucacagaagcuugugagcacccacgagucaugccacacaguuuuucaguucuuuuaagaaaaacacaacauggcucaguauggcguccaagagaagccgacaaaaccaacacuggauaguuuaaaccaaaaaacaauacuuuuucaagagggcuucagagucuucaggagacuugacaagccagguuugaagacaucaucuucagaaaagaugguuaggguaagaugccugugcuguaagaggggaccucacaugacugccaacagauuaugguacuggagucaacaaaagcaagggcaacugaaggcacucccaccaugggcaucauagccacuaaccuuuguaaguccucacuucuaacauauacccaggaggaugaacccaaauaucagggucugcauuauggaaccauguucaagcauuuacucuuacuuaaaacugaauaaacuuggugaccaagaauagcuuacagguaucacagguccauaagaagccgccaggagucuggaagcuaccaggccaucuuccuagggcuugaguuuccaggaagguggcaggcaaucaccuuucccugcaagccuggagagaaggccauucgcuaagcuccuggaacacgugagaaccucagggguaaagccuucuuuaaugguuccucuuucuucagauccucccaccccuggcaguguagacagagaggagcucacccucacccgaccagucccacuguggucaaugggugguccagaggucagagucagggccacuucccuugcuacagaaugaugugccaacagcgucuucuggauucugggugacacuucagaaugccagaguuuccucaggaagugugagcauacuaaucaugccccagggacaggugggcacacggagagagugugcucagcuuagcuuugccucacagcugucaagcugggcccucucauuaacgcccacggcuugcuugcuugcuuucuuuuuuguaagguccuuugacuauagcucauguacuucaaauaugucacugaaaaaugcacagaugggauccaccagaucaggagaacgcuuucacagcuuuggaaaguguguuggguuucuuuccuucagaaauuuaaaaaaaaaaaaaauccuaaauucuaauuucuaaccuucccaccucuuccugccuuacagagaaacuucaacaguagccaauguucccagugcugauaacgaauagggcaauaauuaauucgguguuggguuuuuuuuccuccuccuuuuuaauccaaccagcuaauugcaucugcuagucaugccuccguagucuacagagaggcccacaucugaagcacucacaguagcugcagcccacucgaauucagcucaacaccaggccaguaaagggagaaagggggacccaggaggggugccugacaggugcugcccugaggggguguguccugaccgggaggcacugucauggaggaggggccugugucacuuugaaaguucuggacaagggguuggguugcuuuuuguuugcuuugguguuuuuguuuuaaugaaagagacaagaaagugaagcguggagagagcucccaggcgguguccgucuugaaccgcucuggcuuccugagccuuuagaucaggacuaucuaugaugcucugacuaaugauaaagaaacacacgggacagacauaucagcucagcccgcucucuguguaugaaguacucuccugucaugaagcugucucaugccaacgugccagcauccucuugccccaguacauuuugacauuuugauauuuuuuggauguaugcguguguuggggcggggggggggggcgguucacaugugacagcauccaaccaugcaaguggaggaaacggacaacuuucaggagucaguuucccccccucuaccaugcagauccuggagacagaacacacugagccaucucgcugucugccauuuuuaauuucugcauucuaaacguccagguggaaucugccauaccuaguggcucauucaacugagaguuuucccuuaaauuauguauaccacaucaaguagaccccauaaccauaaauacucucuguaggauaggcuggauuaacaaccuucccagaaaauucucuacagaauguauuaauaauagcuuucuacugaaacacuacuucugaaagcucagcaaggauccuucacaaaaauggcaucuccucaagcaccaccuccuggucccuccaguggugggcggggucggguggcaaagcguccaaugagaggagcaccaccuccuggucccuccaguggugggcagggucggguggcaaagcguccaaugagaggagcaccaccuccuggucccaccagugguggguggugucggguggcaaagcguccaaugagaggagcaccaccucuuggucccuccaguggugggcggggucggguggcaaagcguccaaugagaggagcaccaccucuuggucccuccagugguggguggggcgggguggcaaagcguccaaggagaggaggggauggacaauaacuagaacucaguccuuacagcacaggagcccacggucaaugacuucacauggacauugcggccacuuuccuggagguaaacuuagcuuuuaguuacucuaugaaaugguagagaaaaagcauuugaacacacacaacugacuucaugcuaggaugguggcaacugugugauauuucagugggacauuaguggaaccaagggccaggacccagugugugccagacaucaauuaaagucaaaagacaccauuaaagauucacccccauggggucaggugcuuuugugggauaauuugaaggugaaguuggauaccucaagaaugucacugugaauuaaugcuucucugggcuagacucagaaagaguagaaggugcugauguccuuaaaggacaagauaaggaaaagggucugaaugcuggcccuaaauagggcacagagacgcuggcagaacugacauguaaguuuccccauuaugcuugcaagcaccucacuagugagagagguuauaaccaauggaguagguuauacaccuguccugcacuccugccaauucaaacagcagugcuggaguggaaagguccaaccaaacuguggcugccuuuggauucuggaccacccuagccaauuuucguucugguugguucaaccgguugacugacaagcucugagcucuuaggucuacuagacugacucucccaagguugagaacagagucagugaccuucaacugcaagugcagcccaucucccaaaguggguagaagaaaaauucaucugggaucucaaaaugugacagcaaggccguggugagguaucacugggccuagcacgugauggauaucagaagcccucuccugcccagcauggacuucagaaacggugaauauggacaagaacaucugcuuucuuuagcuagagagguaagaaaaucaugacucuuuguuguuguuaaucuugcuuuauugguagaaauuaaaauauuaaaguacuccaauauuaaaauuuaaaauauucagauaaaggcaaauauggauauacuauggaauaaaauacaaacuuaggaugauauuucuuguaaccaaaagccaaagaaugcaguucacugaagugugcgcucuggaucauggagcuggugaauggggaguggggaaguaugagaaccuuuaccucagacagcuggagaaagccuaauagauacaacagcagaagaucacaguuacauuucccggggguaauauggucagucuugguaguuauaaaagugaaggccauugaccuuagaaaacacacuuguuauuuagaaaugacagagagacagagugaugauagauagauauacagauagauuauauauacaccccucccccacacauauacauguagacagggagagagagggaggaagggaaggaaggggagagagggagagagagaaagaggaggggagggagggacauagggaaggagggagggaaggacagagggguggagugggaaaacaagggaaugagcaggccagcccaggcaaagacagccacaacuacaagguuuuuaaguuugcagauucaacuaacuacagcagugaaauucuuuuauauaaguaugccuaccuguuuuuuguuuuguuuucuuaccauuauucccaaagcaaagcuauaucaacuauuuacacugcaugggauccuaaucacccagagaggucugacguuguauaggaagguguguagggcucacaugcacaaacuacagcauuucauuagaggcucugaguacuuagcaguguccugacaugacuugggaacucaaagaaugacugucuguagagcaaacagucaaaauuauuguaccuguacaaaacggcuauguuuguaacucuucuuguaaaugugaaaugacaucaagauacaaaguaacagauguucucuggggacucaccccugcucccuggcaugcauucuguucccugcuccucucacccuguucuaagcaaagcagccacaguguccuggccuccaaggcuccaucaggccucacagggaccugcccuuugcuuaacgccccuggucuuggugagccuggggcucuucucucucucacuuccaguucuguuucuuccugcuuccuauuacuacuacuugaaaauauuuauaauuaucuauaagucugccuguaucuuuacaaaugcuagauggaaauccucaguuugggaaucaccaaagcuuucugggagacaggaccuauaacauuuagugguagcucacuaaauauggacuggauggccagauaaacggagagcagcaggaaaugccagcagaccaugcucaacgccuccaaccauuagggagugccugguauggcauggcaaguccuccauauagauguaguaaucaaaugaaauggaagcaaauggaugucagagauuguuucagagaagguucugagaagguucugggagaagagggaccccacugauugcauacagggagccccacacauggcuuggucugcauuugucaggcacauuccuugagacucccucuuuaaauagaccugguguggcuucuguuccuaccuccacaagguggcucauaagcaagucacuggaaaccugcauggugcucaccacaggggauguuuugaucuucauccuuccugcugcuguaagcagaccaagcagcucacuucuuuucccagggaguguuuuccaggcuucaggacaucaguggcucuguuuuucccugucucucaucucugcugcccuuccuucaaucacuucaacccaaugucacaaagcaccaggucugggaccuucuucauuuucuuuuuccuuuuuauuccagacaggcuuggcugcgccugcuggcuucagccauuccccagaccuuggcuugcgauuguguaucuuugacuucuuguugaaguccaggcuugucucucuaggggacugucacauccacuugggcaucucaacccauauaccugagacuaacgucuugaucuccacugcuaagcuuccaccauugucugcccaccuaagauuaccccaugccgacuuccuuuacauucauuuaugccauaaggcaaagcaacuccaucuccaaaaggaacuuuacgucugcauaugcugagauucucaggucuccuuacuucucucuacacagaagccagacuacucugugugagaggaaagggaugcgguaucauucucuugcuuaauaccauugccuuccauggucuuccacuaagaagcaaaggccaaagacagccuaaguggcucugcgugacccaucuccucccucaucccaaaacacucugccuugggauaccaccccuuggccacaccgauauuccuucaguuuccuucaagcguagagacaacgcuucucuagaguuauuugcaccugccguagaacagaacccuuccuugggcuuuccagccgagucagccauggccucucagaaacaauggcuauuugcagccagaguucagacaguacugaacauuuuaauggugugaggauacagcucagacugguuguuuggggauauggaggccuagggugaagauguauguggaaguuaggaauauaagacagugaauguggagagcaggagggugugaccuaagcguguuuuggacgcagugagggacagguucacaggagguucuugaccccacucaucuuugauacaucuugaagggcagugaugagaauuggcauguggucugaacagaaacaccagggcccucucuguuucugguuuuuacagugauaccugguaagugacuggaguguaggauggagggaagaacaugagcccaguacacacugggggugucagugugacauaacugaagcuguccaccucuugcugggcgagggcucugugacagcuccagggaagcagaacagguugacaaggagugugaggaagagacacugagguccugagacagggcgagugggagucauuccaucggacaacauuucaaaugggaauuccucucaugacgagaauaucaugaaggagaacacaaggagaaauucaaagaaaagcacagagcaccguguaauaaccuacugaguuuaccaaccaauauaacucugccucucacuaaagcgaagguugcuggacagggagacggcacgcuguuuagacacuaguuucuuccauucuaaaccaaagaacuucaccaaagaaugcaaucugcauucaugucccucacugugugucagaaucuauucuaggugaugcagaugaagaggagagagagagacagagagagagagagagagagagagagagagagagagagagagaaccacagaagucaugaaccgaaaucaucauucaucauaaauggaugaaccacaacagucacucuuccuagccuacacuucacacugcuaugucccuccccugaaggucaacugaccuuggcuauucgucacucaaugcuggaaagcacucggcaauuaggaucuuuguuaaaaaaggaaaaucagccaauaaacugugauuuugugauggucaguagcagguaaaaccaagguagggcauuucugggaccuugugucaaucuucuccagaccaaccgugcauuuugcuccaguugaggggagaaucaaggaaaggcagcuugauuaagaaaaaaugacuuuagcugaauuucaaaggacuaaguuaggacuuuaacaugaaguuguucuuaaaauggaguguucucugucugcaauuacauuuaguuagauuuacaaaaacaacuugaguuaggggaaaauucugcucuaugauuauuuacuuaauggaauacaaagaagcguuuuaauucucucaugauggauuguugaauguaguuucuccuaaagucauucaguaucucacgauaucucaaauaugcugcuuuguaacaagcauuacagacuuuagcaaaaacaaaaacaaaacaaaaaaaaacauguuuucugauguucugccuauagguauuauuuguauuguuuauaguuaucccgauuucuggggagaggacucuaaaauuuaauaaaauaaaaaaaaauuaaaauuuaggaccaggccaaaccaucaguuaccugagugaaccaucauuaaacuccugugugaacacgugaugccuccugagagagacaaaggcugugaguagacagagacaaagcuugcaaacaaaucuacuuuaggguuccuaacuuagaacacuacgguaauaaacuaugaagacuuuaacccuaacccccuauagaccuggaauagagaauaacuuuaaacagaaugacagcaaaaccuagagaugugccaggcaauaucaucaguguguaaccgucauggggugcucaaggaauggcaacacagcaaacuccauccccauggcaccagauguaaccaagaggcagguaacccccaaacacggagacuacagcagcugccagaguacacuucucuguaguguuuccaggaguacagucaagcugaugauuaaagggcagagcaaguauguauaguuguaacacagcuauguacaucaugaucaauguacacacaccagacauaacuaccacuguccuacuguccuagaaccacaggucaguagguacagcaucaucagaaucaugggaccagugcccugucccaggacguuaggacagccacagugcuuccacuuagcgauaggaccuuuccagcuuuauagacgcucaggggaucaucucggauucaaaugccccuuuccaaacaaaacaccauuauguggugcacagcugucuggauuaaauguagacagaagaaaagaaaacuuggacagcccaaaggcugcaaaauuaggucacuucagaggccugccaggcugucuuuauguguccuaacgcgugugcucaggggcagcccaggacucugccggggagaagaaaugaagugcuaacuuacaggguugaaaacaauuccagaccuggccguggugacagagacacaaagcacgaggcucucaaacuguuuuccagacuggauucuuuaacaaaggugccuauuauuuaugcuuuugaaaagggucugugauguuccuccgaggcccauaaugaguucugcagauucguggaauuccucucuugaaaucauuuccuuucccugaacuguuaggucuccgccauccaucuuccaguuuauuuaaauccacacuguggacaggaucuuguuucuauguucugggccaugcuccucagcuucuuagugcauccgugaaugagcaucacaacaguauuaauaacacuaaggaaguacuaugcacaaucugcaacaugugugacagccucccuccaccaccaaucccuuuagguggaacagaccacuaacauguaaucucuguuaccuuguugguagacgacaggucaagggugcuuugucaaggaauucugaccuuuuggagagguuaauuuaggucagcuggacacgaacaacugaucuuucugugcucauguuuugucaaaggaagcaaaagacauugguuagcaucucucauggucacauaacuccuuaggccaugcccaauucucuggggauuagaaggccuugucuuaacgccaugagcucucucuugaguuuuaugauaauguccauuggaacaaucagguggcucuaugugcccuuuuuaaaagguauucuuaauuauugcugcaacuuuuauuaagauauaaaagucauuauguaugaauaugaguacuaucuaaaaugacagagaaaaugagaagguguuuggauauucuuucauuugcugugaugccagaccaguaggaacaaaauucaagccucugaagaauuucugcagaaaauauuagcugcaaauaccauuuaaagagaguuuaaaagaguagcaacaagaauuuugcuuuccaagaauuugucucuuauguuuuguggguggugaguuuuuguuguuguuuuuuuucucugcagcuuuauauaaaagaaauacaaagcaaacaaacaaaacccaagacugcaggagugugugaguguggaaagacaugugugcacucgacuaagagaacacauuucccguucccacuuuugugccucacgccuaagagugccugcugaacccugggagaugacaagacaucucccaggggugugacucacccaguucucugagccagugcuagagcuguuuuuccucuuaggagggccagacagacacuuggccuuucagaaaaccucaaggaugagucacaagugacaugcauuggcaucuugaggggggaggaaacagaggcuggaaauauggccacacaaaagguggaaugacacugugagcaagcacgaguaugcauguacacauaaacacacacauauguacacauacaugcacauacacuugcacacacacaugcaugcacacaaauacauacacacaugcuugagcacacacaugcauuuacauauaugcauacauauauacacaagcagagagacacacaugcaaacacacaugcaugcauacauacaugcaaacacacaugcauguacauacaugcauacgcauacaugcauacacaugcacagacacacacacacacacacacaugcaagcacacacacauaaaugcacauauacucucacacacaugcacaugcacacauaagcacacacacacauacaugcacacacacaugugcuagcuguuuugcaaagcagccaggagaaucccucaucccaggaucccuggucuucacuucuucacacauauauaggccucccacucaauuucaaaagggugcuacccacccuggaaaaaaauuaagcccacauaguagcugggaaaauaugcagccagggagacagauggcuuagggaagaagcaaucuggauggagagugagggugugggaguggaaaugugggccuggagaggggcugagggaagaaaggacgggcgugaguguguggugacagaugacagagugcuguuugggacaagcaguuggagaaagcaagggaaauggaagugauguauuuaugcauaagggcuccuuuaccauuaggaaaacuccccuucugucuacucugcaagucccgcugcuucagauggaggcagacagcagagagcacaugcuucgccaaagaaacagaggugacuugcuaucccgacacgauuucuauuucugaucgaaacagauccaaacugagcuaauuuguguacagcugcaggcuauauaaacacggcugcuuagaauucuuuauaaaguaucggccuuugcacucaacacuucgucgaaguuaauaaguaggugucaaacucugaauuaaaaucccugcaagaggacacagcacaaaggacaauaaaaaugauuuuuaaauaaucacagggauaaauagcaucuacuucugacugauauaagugcuagcauaaaauguuauuaggcuaccgacauugucuuuuguucagaaaguauguuucauucuccaaccaugccauuuaucauccuaaugagcccucaagcuguaaauuaaacagcagagacagauucauucgaaaagcaucuuuucagaaaaaaaaggaaaagagcuagguguuauaacaguuuucuacuuuuauuuucuccuaguguacugguucaauuuucuuucauugaaaaaaaaaagcccuuaguacuugaacacuucaugggguaaguucaugcaauuuauauuuucaguaaacaguucauucaugcuccaguacucugggaccagcuagcgaacauaaaggagaaaaagaaaucucauuuuaaaaugcugugcccuguaaauuauguuugaucccagaaaaucuuagaaaccugggcaugcauuuacuuuuuaguuuuacucgcaagugauuugguccaaaggaaauccucaaugggaaaggauuaguggaaauuucaaacagcuuuaguuuacugaaccgaauguauuaauggcuaagcaaauaccauuuccaccauuaaugauaaaagaauaaggucacgagccaaauuaguugcgauuccucguuacguaucgauaagaacauuacccguuccuaugaugaagagagaagucgggguuuucuacuugaccugaauuuaugcaugagcacacacaggagugacugaacagcuaugcuggggaggggcacccagcaaaaugagacugggaaagaaaaagagcagcaagucaagucucauuucagcaugauuggucuucauccgccuccccuccuuuacccucucuugcuacagccuauaaaucuuuuuuuuuccaaucucuugcugucccugcuuaugugagagccuagcucacccauaucucucucucucucucucucccucucucucucuagcucauccucugugugggugaauguauauaaaaugaagagacaaauaauugugcuguugagguuuuccugauguccagggaacagccauuaaucugggcaauggggccuuggaaaucccauucugcaaaaugaauuaucguuaagcaaugauaggcauucuaaagacacuauauuuuuaugaggucaaaaugagggggcaaucuccccaagggaaggcugagagcauccagcugugacagaagccaccuacugagcaccacugcauggaugccugacuuccugccaggagcagagucagcacaggcucugguugaauaagcccccaaagacagucuggcccaugccuugggaaggcauccauccccugugguagcaaccccuggcagucuacucuagaagcauggccucccucugcuuaugaacggaugugucuggccgaaggggauccacagaaagucuguacaucccuccggacauccuguccuaagauauuuacuuagcaauggguaauagagaagaugcuuuuuaauacaauggagcugaagcccugagaauccgacacaugaagaccagcacugccagccugggcguggccacuuccucucucccaguugauuccuaaauaggcaauuugauaggcacauuaauuagauucuggugcaagaacuacucugauuacugauggaaaagcuacugucagggcgauggagccucugagguaugugggugacaaggggacauagcacaagucaggggguacuauaagcaaugacauggugcuacuuuugauaaaauagagcaagguuucacucuguaagcaauuaaacuaggagggagagauggacagcaacagacagaucucaaaggggccaggaagucuuuucuggagucugggaagagacucagcggcuaucaauaaacuguuuuauauuuaacuccaagcagagaaaacaaaacaaaauaauauauggaucaggaaaggaaaaauuacccuccugugaaaaaugugaauuuuuaacuuuugcaauguguuaauaauuaauagaaauuugcacuaaugugacgucuucacaaaacacagaaaucucacacauggaaccuuucaaguguaaaagaaguaagccaccccuauagguuuucugaggacguuaccagcuaggaaggcucucaguguuagaagguguagggcuuuuaaccagcucugagacucggggugaauagacccccuguucaaugacugacaggaacuccacaaaacaaaauccacgccucauuagucccccagcugaacuuaaaauccucuggcucagaauaaaucucagccuuuaaaaauaaauucuccgcugaauuaacaucucacaaucauuaaucuucagaguaacccuucaauuuccuuuggaagagaaccccuaugucucucacaggucuuucucucuuuuuggcaaaccgcagcuucauggagagaaggaaaauaucaagcucuuucuucugucacuuccucacguucacccucagggagcuauuuacugcaucaggaaaggacaagaacuuagcauucuuugucacacauguaaggauuaccguauuuugggguguccucuagcuuaaaaugauuccuuuaaacccugaaaaauguccaccaccucuuuaaacaacaucacuucuaacuacuguguugacauuaaaauagaaguuuuaucauguuuuuguucuccgggcuuacaaccgucaauggcucucuggugccuagaaggaagaggcagagcucacggcagaggguagccacagucuacagcauuuugccuaugccuggcaccuaggaacuuccucugaagagacugugagcccuccugcugguuaucugcugaacccuuccuccucucucaagcugugacccaauauuucccccucuggauuuuguguacuaugauugccacuugaauauuugugguaacagggcacauuugugguaacagggcacauucauuauugugauauugucauugcacaaugugugcauuuuaucaaaacagcacacuguacaccacgaauaugcacuaguagaaaagcaaauaaauuuuccauagcaggucugcuugaggccugccuuauauauaaaggcuuuuucucuuuucuuccuccuugaagcccaaccuccacaccauuucacucuuugcugagcuacuaacauuugacaugguaacuguacuagugucucccugagagcagggauugcaucugguguccucaaacaucuauccugccuacaacucagugugggacccacacgacagacucaaauuccuuucuugucccugccuucaaaagcaugccaggcagaacuacuccaagcugcugaccuguguuuacagucagugguucuggggugggggugcacuaucucaggagggguugcugggccuuucaaccccucacgguuauaacacgggcccugucagaaguuuaaaaggacuauaagauguugagcccuuuucugaaagaagaugcacaagcgugcguccagucuguaaaugcaccgugauccugacagccgcucagcuccaccaugugccuugcuauggcuuuaucugcaggguaaggggcggagcaugcauaggagacugccuaucaaaucuaucaugugagagggcuucuucgucugucgugucccauguccuuaccaguaaagggaggcagggaucccugauagagaccaguuugauuucccccuuuacugugagacacccagccaugcagaacuaggauccuguagacaguuaagauuuugguuuuguuuauucaaaguccuguuaaacaucucucuuacacaccccaaucuauauacaaccucacucucauuuuuccccuuauauauuuucuaccuccagagagguuuacagaacccaaagguggagagucacugcuugcuugagaggccugcuccuucuuucucacuggcacucaccauagcuagcaaaguccuuaucugcugcaccugucagcacuugcccuggaauccuuccuuuucacaaguccuagcaaagcccuccacgcaugcucuaugaugcuaauggcuaccuccaacucuggugccaucgcaacaauguuauuuauuuuagacaucgaggaagccuaugcaaagucagacaaccuggcccagagauuccaugaagucaggaacuagaagcacaggcugccuccuuuccuugcuagaacagugaaaagcugugcacucuccuuugggacaauguaugguugccuugaagaucgcuuuaaugucaaguccacuggacuaaagccacacaaagggugcauaugcuaguucauuggccaagcugaaggagagcucugagacagcaaggcagacagagugacugcugcggagcaaauuccauuaucuauccugauuuaaaagaacaguguuaaugaaaccugugcaccacacuagggugugggauucuuccuugaaggcuguaucuguuauacuucaauuuagaaagacuauuuuugaacuauuggcuuuuacuaacaucugggccgacuggaaaugauguucuucccccuaacuacauuuugaguuuacuuccaauuucuaaaauuuccccaccuguuuacuagcuucuguaaaggagacaucugaacugugcugcaacauccaauggguaacuccuguccacaagcgaaacuaggggcagcuucuugagagcagugagcaggcugaugggacaauagcacucauccaugcacauucauccccccgccccccaccauccaauuuagccucaagcucuaggaauacaaccuaagaggcuaaggcaaagagcaggcauaaauuacauccccaagacagcaagccuguccuugagucaggagagguaaaauacauuguuuccuuuuggaaaaaaggaauuauugagacuaggaaaccauugugauucaaaucaucuuucgguaugaaaagaguuuucccaggaccaugaguuuuuuucauaguugguuacucaggcaaauuuuaauucuuguacguguuaacuuggauucuucuuagcuuacgagguuucuuucuuucuuucuuucuuucuuucuuucuuucuuucuuuuaagcaacacauuguucucauucauaaaaaaacgacauugagcaugcuaguagagugugguuaucacacuguaauacaauuaucacuuaaauauauaugugccuuuuccagaaagaguuaauuuccucuacgucaagauuaaauauuaaaaucccgguuuuaauauaguaucuacaauaugauuagcacucaguaaauauuucuguuacuauugugcccaucauucuaggcauuuucaaggauaaccuuagggaaacauggcgccauggcaugcugcuuucacaugacacuguuuaacccucuauccuaucccuguuuggcagauaccacuacauuccacuccaagcugggcaaaugauucaggagagugacuugugacuuacccagcuauaggagaaaauacagagacuuccaccuagggccuuacgcugcagcaaaugcucccagccccccuuucucuaaagaccuaggggccaucuucaauaauuauuauaaaaucauuaugagugacaagaaugauuucacagaggcuaccaccauccaggguuaaaacuucacaccuuguguuuuaggaauggugcuaacauuagcaguucuuagccuuccuaaugccgggacccuuuaguacagguccucaugacgugaugacccacaaccugaaaaucauuuucguuacuacuuccugaccauguuuuugaaacuguuaugaacuguaauguaaauacaugauacacagaauaccugauaugugaucccuaugaaagggucauuugcggggcagcccaaaggggucaugagccacagacugaaaauuaguuuuagugaauuucaaaacaagggaggaaaugguauauuuccauuaaaauauuagaaugggaagcuuaauuccaaaacuuugauuaauuaacuaauuaauuaauuaauuuggguuuuguuuuuuuuuuuuuugaaacaggguuucucuggguagcccuggcuuuccuggaacucacucuguagauuaggcaggccuugaacucauagagauccaccugccucugcuuccugagugcugagauuaaagguguauaccaccacugauuggccagaaauauguacucuaaaacuuaauuguaaauuugagaacagaauacacaagaaguauugggaaagauuagaguuggcuccucuaggaagcacagauauaaaggacaaaauuauaccuacuccccaaugaagaaaagcuaccaaucaaacaaagguugcaauguauaaucaucuaguuuugucuguucaggauagcauugcaucuuuguaucauauuaaaaacaauguauacacauucaagauuucacagagagccaacuauaaacauuuauucaaaauaaaugcucucauuacucugugcuccugugcauguguaugcgugcacacgcaugugcaugugugcuugagaaagagacucauuuucuauaugauauccacuuccuuccucaccaccugauccuuuagauuauguggguagagagaauuacucucagacacugaccuuaacucuucccauuuuuggaaggcauuuaacuucagcagcccugaacugucuuuuuguacagguuuaagcaaucaucaauauuacggagauguauggacugugucuaacccaacuguagcuuuuuauagaaaggcugcagcugucuugacccagcauuacaucuucucacagaaaccucagcaaugcuacuugugagccuccuccugcccaagaggcuggccggcggggaacaauguagccagugccccucaaucacagcccugggaaaccuuuauuuucaaugagguuuacaucauuaaaguaagagaaccauuuucacucguuuaauguaaaagaugggagaauuuaccuauuguaaaaauaaugguacagcugccugccuuaaaccuuuaagaacucauuuucaggcuccaauccuggaaguggccagaaaugaagguaccaauuuauuagccuuuuuucccccucauguccugaaucaaucccuaauaaauuauccugugaagaagacaacucuaagaugucaugaaugauggauucagacuuuguuuaucagcagaggugccugugccauugcuuuugaaugaugaugucaucucagcauguguucuccccgggacagauugauaagugggacuaugaacgucauggcacacacgcguaucuccuccccagggccacaggcaggcuuucagggcucugaaagcuaaaaagcuguaacuauacccuauaaagcuaaccuuuucuucuucuuucuuuuaaagcaaaauuaugagcacaaaauuagaugcaggaucuuggaagagaacucacagcgcagaaggccccaaaauuuaagcuuaauuucacagcuacucugccgucuccuacacuagaaacauuagcaucccucagaaugguucagucaggcucugaagagcugggccuuugauguagucaucugcucucucgugcgagcuccuccuccugagauguucuccaaggcguacaguaaaauaugacggaguaucaguucagcugcggaggcugucaccucugcucagccaucagugaagggacauucugugcaugagggcuccgaaaauuccugacacaauucaggaaauggacaggauuuagcacuauacagauuagggguuuuuaauuaaguacuuuaugcaguugguccucagucuaugagaugagcaucuguggcuucaaaacaaaacagaggauauugggguggggguaagugguauauacucuuggcacauccauacuuaacguuaaccucuaaacaauauccuaccucaagcacuuccacagcaucaaugauaucuuauaagucaugggagaugauuuaaagaauguggaauagcagauguauguuugagcgucaaguguacacacaaacucuuauacaagggauuagagcaguuaggaccuggaaccaacuccucauacagaugagggugacuguacauucaaguacuuuauuucaaauaacucguuuuuaggauuaauuuuuaauugaagaguaauaaaaaacauuuaaaaagaagaaaucugaagagagaacacagagacuuuuauguugauuaagucacaauguguugacaucucauucuuaauaaaggcaaaaacuagaaaagggcugucuagaaccaccaugauaucugacgaggcaagucaaauacuccuggaccagagcaggacccaggcugcucaggaagaaggagccacucuuacuuccaagaguccagcccuuucuuacagcuaccccugcaaacauuuagccccacacugcugcuccacugcccagcuggccugcaaacagcccgaggucagagaauagccuuuggugugcucugauucugucuggguagaggugaccuccauaugcccuuggcuggccaggugcagcauccuuguccuuacagcugaaccuuccccaccuccauccuagauggaagcagacagggaguuagcuucuaugaccacuggagccucacauugccagaccugguaucuccuugauagcaaggccaggaugggaucuuauaucaggaguuuccugauauaaguuucaggagucaagggaaggcagcagagcugugagccacugauaacaugaugaggugguuuaucacuuagcucccaagaggagagggcgugcacaccggaaagggcacagcagagaagccucagccuugguaaggagguaguggagaagagaaaagccuaagugcuuuuugaugcuugcccugugaaggaauggugaggagggacaggcagccuugggugacuuggaguguguacgguuauuacuagauuauuauuagauuauuacuagauuaccucuaguaaucugguccuugcccuugcaugaugauggcuggcugauggggucaucaaggagguggcugggccgugggcugcuccacagcuugcagcaccugcaggccagcucuuugcugcuuugggaaucaggaagcccuaggagagaccuacagguccuccagguugagaaagaucaaagauguaggauacaggaauaucauuugaacaaggggaagggagcaggaagcaggugaggauggcauggugucuaaguggaugcugaggcauaaggaccccucucacuguuccuaguaccagagagaggcuacccccccccccaagcccucugccccacuccuccugaaucccagagcacagagcagaggaggcucccuuaacacuacaaaagcauauucaacuucacugggagaggugacagaaaaaaaaaaaggcacaugggauccaugacccuggaaguaccuuacccagugucacauggcuacacaugacaguggcaggguuauauccaggucuaggucaccuuaccucuuagaauccuuacggguuccagaauaaaaagagaaagcuauaaaugucaaaguuuacauauggauggcuagcuaaacuucucaaacacacaggguuguuucuguuauucuacauauccauuuaaaaguuauguacacuuucagggcugacugugugguauggauaagagaccaugucccccuccucccccccacccccgcucucagcccuccuuccuucucuguaauucuucguguggguuugagaccucacgugcucucuguccaucuuggcauaucuaugguuguucucugucccacucaucuuuaggcauucacguggguauguaccuggcugcugagugcacccauggcugagcgagccugcugcccugggagcuacuucucugcucgccaccuucuaguucccuguaccucccucucacugaggcuuacagccccaccagcuccuacugccuacugagucuggaaucuaacaccaugaugaucagugcucccucccacccugccuccugaggcugagcugcuaggcuccaucaggaaacacuccuucuacucuccccuuccuccaggaacucagccucccuucugcuuccugcccucaccuccucuuccccaagccuguugcugcugaucccacccccaggcaagaugaauaacucuagagguccccucacagugcaggacauacaaaugucuuuaguaaguacauguggauuugauauacaugguuggggcagcacaaaaguguaugcaaaauacuggauaucuaagugggggaggguacaggccauuuucugaaaaguauuuccuuuuccuucuuucaaaccuaccuuaacaaaugaacgauggccuucccaacuccaaauuuuagcaacuuuaacugcaguucucugaaacaaaggucacuugcucagcuacagauaaauaaaaauucacaagcaucuccaggaaaaucaauacacguacuaaaaaaucuaaguugauaauaaauuuuaguuccccuugcacacggcucaggaaugucacuauuuacuggcccugcuguaauaucagauauuucagaaggguauugauuuugccacugaagugugacuaaagggauaaauaaacugcucccggggucaaucgauccauuuaucuucacugguauuuuauaaaaagucaaaguagcauaaacuuugauaaauaaauguuaucgugacagaaauauugcugacauaaggaccugaaggaagaaagaacagacaaucgcgaugcuugaaagccacacaauuggcuuaacauguuagcacuuccacuaacagcuacucacacacaaauagccccuucagcuguucuacauaaucuguggcccacacagcuaagacacacaggcagggcaucacauccuugugaaaugaaaggaggaggcagagagaagggagugauuuccacacccugcuuaacuagaaauaaacuguuaagaauauccaaaacagacacauggcucuggauaaggccaagguacguuuugggauggcggagugacucggguuucagaaaucaggaucgggcacaaucugaaguggcuuuuuagggcuuccacucaacagcagcacaaugaucccuuaaagauuccaaugugaggccagcacacucacaaccuagugcugugauaggaugggaaggccccagaagaaucuuaauucaagugugggagaagugggagcucugugaagaggcuguagcuuaccaugagaaauuacaucucagugcuuggcuacagugugcccagacagcauugccauccagugaugaauccaagccgugaugaaggcagcaccugggcugguacugauccaucaccaguuaaaaguugaguuaaaauuaccauuccccaggggacagccagcuucugggaugcagaaacagcuaacagauugcacauuugacuuggaccucaaagggcuuucaaacucaaaauuuuaccucaguccuaaggcaaagccuuuggguccuggacaacccugcccuuccuguuggucacuaucaaggguccacucaggagccuuccauuucuuccuuccuccacccagauucuggggcugcugcugccucuagaguccugcccaaggaggccuuucucagggacucaagaggaagcccugcucagcacuuggcgagucucgaaucuccugcaggcuggugcggugcccagcaggacacaguaggcacuugauacaauggcauuuacugacuggaagugucuggguggccagacugggccugggauucuguuaaggucacaggauguuggcaauguggcucuaagcagcugcaaaagcugagcugggcacgaacagagugguagccauggguaccgucaaagagggaaagcccaugacgaaaggcugucuggcagguuuggacugucuccacaaaauggggcuggcgcguucucgugacagccggccacuagacagagugagccccagagcucacaaugcggagcauuuuccucacccuccgugagagccuccagugcaacuuagcugcagacccugaaaaaucaacaccuccacauugugugaaacagugggcaugugcacaugugugcugugcauaugugcaugugugcacacacauuuguaauggggcuuuggauuuacugugaaaaguuucccugauauuccugacacuguagcgggcaguuugauacuauucgcacuuagcaaaccaacuacuaauaguaauagguuaguuagaccugaagucugagcucccacagccaggaacucuuggcuagacaguaucaaacugaauucuaaaucgcuacuucuauaacugcagcuuaguguaggucuucauagcucuuggaccauuucagggaaguuuccuuauaguuaaagcaagaucucacaacuggucaaauauauagcgauguagagugaucuuccacaacugggacuugucuaucacaccccuucccacagaagaggggacacaggacuuuaagacaugggaggucagggaggaccacugaaacagcugucucuggacaugacaggaccacugaacuugugaaaucucagcagccguggcugcucacaagacccaguaagagcaagccgaucagcauucuagcacagagcgggaagaaagcucgggaggugaagagcucagccuagagucauagacaggugguggauuauagggaaggggagugguugcuuuaaagguguagccucuaguaguuagaccacacuccaguagacacccacaaccauaaguacaggaacccgguaggcuguugucuguuguuuguuugcuucuuuguuaagagaggacacagaaaguuaagggguggggaggaguuacccacaucuaaaauucugaaaaaauaauaaaaaauauuauacuuaaaagaagguaaguugucuuugguugcuuuucuccucucuuuccccccuguccauuuuucugagcaucccugacaugucucuccagugauguacauggaugaucccugcccucuaguccucauggacaacuuucucaaagaggcuagagagcaccgaagccucaccugcacucggguucccagugucuccacggcuuuccugacccuccaguagacccgcccugcaagccaugcuagcuuuaauuaaacccacacucuccccuccccuguccucucccucuauccucucucuuuuuccuccucuucuuccucucucuucccucccucucucuccucucucuucuuccucucccccucuccccauggaccaagguaaaucaagucucaaugacaaaccucaagauauagacauuuuccuauauuguggucucuaauuagggaaugguacuuacucccucgcaucugccuggcugggaaccuagagucugucugucccaccacacuguaccucauccccuagcaggccugaagaccugucuucuccacagaagccucacucuuccugcucugucaugugccucagacauaauaggcuggucuuuccauagguaaaaggcagaugaccucagauucgaacucucagaaccguaggccaaaauugccuuucaucuuuauaaguuaaauaccucaaguauuuuaucauaguaacacaaagcugacugguacauaucgauuuucucgcugaagccauaauaaucuuuccaggagacccaucucauuuugccaguucccuacucaagguacuuugacagcugugcccuuaaaacaaaaggccaacugcuugucagagcuaagaaagcccuuuaagagggcauggaguccucuuugaauucuugucaccccauauucaaucucuuccugauuacacccacauuuucagauuuuuuuuuaaagcugacucuccauuucuccacauugcuuaaauaucugcuuggguauaauauuuugccuaucugacauaccgguccuuuacuaacuguucguaccaaguccuacauguggcagccauuaauguugcucaucaaauacagaauucagacacacgugaaagaacauuugcuccucacugucgggaggcagaggcaggaggauuucugauuuuuuuuugaggccagccuggucuacagagugaguuccaggacagccaggguuauucagagaaacccugucuggaaaacaaacaaacaaacaaacaaacacaaaaauuguaagcucguggauuaagauauggaauaagcgucaauaaacagcaucuuuuguaucucuguaaauucuaagaaagggaagcuguaugcuacaaugauuauaauguauuaugcgauguguauauaaauagaggaaauacaauuucuccuuuaugagcacagaaauggaauaauuacuuaaaaucaaaaagugaugggccuccccauugguggaagguguucagagaaugcuuugcacacacacaucuuuguacaggucugaguguguuuagaaggauucagugucuggcucgauaaugcagguguaccucauuuuacaugacaagcaugcuauuacaacuucaugcaaaucaaauuuuugugaaucaagguugauuuaagaugucccauuugaacaaauuucauguuaauuccauguuaaaggggauaaucaccuccaaaugugacuuuccugaauaaaccagacauucacaauuggauuuaauuaaagcaauaucauaaaguaauuaaauagauuucacucaccaaaugaaaaccaaggagaagccagcaaugugcuacagguacacacacauuaccagcgcccuccacaauacaaacaacacaugauugggcugucgggaagacucuuguguguaaugagagaaaaaugcaggaaagcuaagcauuuagacuguggaaucccauuugaucuacuaauucaauguuuuucuuuuuucccuuuuuucuugacuuaaauuaucaaggacagaauucuguaucagaauaucagagucucucucucucucucucucucucucucucucacacacacacacacacacacacacacaaacacacaccccacacccucagguauaaaaauuagucuuagugccaucucaaugguaggauuaauauaguuguauuaccacuucccaccccaacaaugcuuaaguguaccacauaccaaaaucuuaagcacccucuaaggagacaaagucccccaggcacugugaggugcacuccacauuugggaauguuugaccguuaaaaaucaugcaacaugguagucagaaaaggcaccagauguuagaaaacacacaacaugguuaucaaugcuauaaacucauaaggcacauauacgcuucauccagaacauggggaaaaaugaacaauaccaaaacccuguuuggugagugccuuuaaaaaucuggauaucugaaacauaacaagauauguagaugucuuuuacuuauuaaaaauugugucuaaaucuuaaauaaaauauugugauuaaaagaaaauauugugaugguguaggcugaguuuuccugacucaaaaugcuuugaggcagacguguuuggauauuucauuguuuuaucaggcuuagaaauauuuccuagguauaacaaggugucuuggagauaggacuguaguuugaaucugaaacucacuuguuucauguaaccuuauacacacacccugaagaugacuuuacauaguauuuuuuuuauuaauuucaugcacaaaaaaagguuguggaugcugaccuaucagaccaagcauguugugcuagaguccccaaaguuucaggugccacgacgcuuccgcauuccagaauuucagaccagagaugcucauguccaguucauuuacagaccaaguuaaugucuccuuuaaaaucacagcucagguacugaaagcauaaguagcaauaaacuacacagaggcuuccagaaaugcacuuggagauuaagacagagggaaaaccacaaucgaaucuacuugcuuuauuuaaguagaucuugaagggauuuauccuaaucuacuacucugcuguacugugagauaaaagcuuuacgcuaaggucuucacuugccuggaguauauccuguacaucugaagugucuuaucuaacggacagaacacccgcauggaccugccuccucaucacacccacccaagcgguaaggugcccugcaucauaacuguuaaugaccagaugauguugccaaucccgaguguuccugcgucggguauggggaaaucucuguugcuaaacuccucuguuguauuuauuuugcuuagcugacaucuuccagcauccuuuuuuaagucauuucuacucgacacagagaaaaaaaugcagcagugucugcuccuugcuuaaauucaccaaguugaaaccaaccaguuaucuuacacaacuucccuacuaacuucaucccauaucugagaggccugcucuuuucucucaugcguguucugcuuuuccagaggcuaccugugcuguuacagauagcuuuccaucuauacucuacugggagugaaaaaugggcuucccugaagcuugccgucccuaccagggcugagacccagccuucucuaugcucaaaacauggcaaggcagagucugcaccucuaaaggauagcuaugcauggacaucgcaccccgccuugacagugaaacccaugucuccugugaaauggcaaacccaucauuucuaaugguuggauggggcagcacuuacaaaugcauucgacuuggcuaaauuuagacugcaggaaaaaaggcuauccagaaacacacuuuggcuuggggccuuuucauguggcuuugaauuaauuuaucuugcacccuuuacuccccgcaucuugugagacaaacgccagcugauugagaaauaucugaacacugccauuuuaaugcucugauuuagacaucgaaugcagcugucaauuauaagaggguucacuuucuauugauuuauuuuucaaugcaagaaaauuugguagcuuggacauuuugucucuuucuucaguaggaaacuuucuugugucauguuccuuggacccuguauuagucaggguucucuagagucacagaacuuauggauagucucuauauaguaagagaauuuauugaugacuuacggucggcagcccaauucccaacaaugguucagucgcagcugugaauggaaguccaaggaucuagcaguuacucagucucacacagcaagcaggcgaaggagcaagagcuagacucccuucuuccaauguccuuauauugucuccaguagaagguguagcccagauuaaagguguguuccuuaaacucggagauuuaaucuucuggaauccauagccacuacggcucaagaucuccauaccaagauccagauaaggaucuccaagccuccagauaagggucacuggugagccuuccaauucugaauuguaguucauuccaaauauagucaagcugacaaccaggaauagccacuacagaccccaccccaggaauccuucuccacguggaagacauuucaccugagccuggccagucacacaaaccuauguaacucugcaacucuaacucgguccacauguuccucaucuucuucuucuucucuguugacuuccucuccaucucccucauggcagaacccagaugaugagacucugucuccaguaacauguggggaugugauggugucucucucccacaaggucuuucugcucuuccucacaccuggugucuguguccuaacagagcugccaucaggacaccugcucagacuuaugccaaucuaauguugcucguuuugaggagagcucccccugagaacuuacacaacaauguuggcugucauagagagcggccagccaggacgguccaggccaguggccugugcacgugcucugaugcuuccauagugacggcccugcuuacuucugccugcuucugcuuagaaauaaagagugccugucagucauuuugcuacuuaucuuagaagccugacacugggguggacagaggagggugugcaccaccuuccuguuugcccucucuccucuccuguguucaucccugacucccgacccagaaugcaguacccuguccacuuccacacagcaguucaggcagcaguagcagggccaggcuuuuguuucuauuuuaagaacaguaacggauauucaugaguuuaauuuaacugucuauuuacuaacagccccacuuguuaagagcugcaauaaaccaacugaaaaauuaaacucuacacucccacaugcccuaagucauacauuaagggccccaucauuaggaauucggccagcggucauagaguggcgcagacccugaugucuguguuuggguuuuaucuaaauguuacuauguaucacacccuccucugccacuacagaaauacaauuuuuauuaugcuuguugauuucccuuguauuugaugaauaagcugauauacuuuuucugcaugagaaaaagaauauuaaauccaguccugaggaauguguggcuggagacaaagaggaaagaacucucauaaguccuaacgauauuuaacacaccuccucuccuuucucuuaagccagcugaguucgggccauucuuagauuugaggaagccauuacaaagucaagagaaaacccuaaauaaauaauacaucaacugucaaacauacaaaaccgcagugaccguccuuugugggcugcucuugccagaagaagaguuaacagugaggccagauuuuaaauauggugaugucagcuaucugggcagccaugauugggaugguaaggccauggcagauguuaggguggcagaauccucaagaucccacaucagcauuauuaacccaucuuacagagaaggaagcagaggcaagaagguuaagagacauccccagguacagaauuaggagacagaagcggugggcuugagacuggguuuucagccacccgcuggacauuuauggacauuuaagcuguagcacagggacaaacccuacuaucucuguuuggugucagagaacugugacacugugcuauggugucgaauucuaagagcuggguaucuaaaggcgguuuaacauuuuacgagcuugacauggugaagguuaacuccucugaugauucaucaagaugucuuguuaaaaguggcagaauuaugacuggcagagcaauagacucaagugaaagagaggaggagaagccuuuucagccuggucacugggucacagcagaggauuccuuccaaugauuccaggaucaaugggagggauacauuguuucagcccaaaggagaacaagguuacauucacauucccgggagaauguaacuaacuuccuaacuuccugaguaacugguccccaaagggcuccauuuauuaacauuagaacacugcaucaucagagacauacgaggggaaucagcagcagccuguaggaacacaucugcucauaaaacucucaauagacuggacauaagcuuaagcuuuaugugugauggcaagcacagcguacaacuacuacuuugucauuuauauugauaaaaauuauuaaucaagaucacaaccggggcauauaugauuccaaauaccacauagcuuguuuuaacaugucauauuuauaaacaggcugcaugccucaguaggacccaauaaauaaccucucugcaucacugacucugaagacuaccucaucaggguccuuugcaaucacauagaacuuucauagcgucauauuuucaauacaauaaauauaguugaauuucaaccaaaugagucccugagaucagcaggagagagacacaaagucacagguucaaucaagaaauuucaaauucagugagaaucagacucucacagggcacuguguccuuaauccgaaucauggaaaaacaaauucuuauauacuaggcuauaauuuuugccccagacaaaauauaugucaaugagcaaaacagauuauugcuuuguuguguuguguuuaaugguagcuuaugauguagcauaagauguagcauaugauguaacuagcccaaacaucccaugagaggggaauacggagaggugugugacuggcauucucuuugcagaggcaaggacuaaguguaaacaaacaaagaagaccaaaaaaaauccuccauccacauaucuuaucuccaugaaucugaaccccauuaccgucuggguucacaguuauauuuuuucgaaagcuuuauuuauuuuucucuugugugaaggaguguuuuaugugcacauauguacauguagcaugcacucauguuuugccuguagaaggcagaagaagacauuggguuucccacaaauggaguuaagguggucauaagcaagcauguaggugcuaggaccugaaucugaguucacgcaagagcaucaagucaucccuccagggccuccugugcuuucagcgacaccaaauggggccaguuguaccuuucuccuccaguucagagagaaaaagaaggcugggaagcugauguagauuaauggaaaggacagggucuuauugugucacccuuaccauuguaccacauugugcgaugccaaacuuaaagaguauaaagaguuacaguaaacaaacacuaaaaaagaguaggucugauuguuuuugaaggaugaaauaucaauuuugaaugauuauuguaauauucagcaacaaaggaaguauacuguacaguggaugcagcuuucuugaugucagaaaaaaagguugggaacacagagggggauaaggaugaacagugcaaugaauauggaaguggagauguuggcaugggcucugacucuuuauugaauagcaagguagacagacaguauaguguaguaccaacaggugugugcuugugugugcagacaugccucacaggugugugcuugugaaugcagacaugcaucccaggugugugcuugugugugcagacaugcauguggaguagaugaaaugcgugugccccugaaagcagcuggaagaaacaacacuggagugcugggugcacaggcacucagaauccgagucucugaauuccacuccuaaagaaaagggagcugccuugagaaacaacgcauuucagaucuagagcuguagaauugcaagagaauucuagaacaccuuguaccaaacacaggaauaacgaggguaugucuaauggaaaagagcuagcccaaagggcaucuucuacuggcugaauguagaaaugguaaaaacaaugugggugaauggccaccaucuaauuaaugaagcacagcuccaugaguucauagcaauuaaguauauuugaaagguaaaaggaaaaaguuuuuguuacaaaggaaugcuaaguaguaaacagagaaaugccaacuaauuaacacggaagucaugacacauaagaugagcuucugaugcaauaguggcucagggaaggaccaucgccauuggugagagggggaaaacaggguuaggagugcaguauccaccagccucaaaugccugaacuuaauuguaacuucuguggagagauacaguguccaccagccucaaguguguauguuagcagaauuaacuguaacuucuguggagagauacaguguuuuccagucucaaaugcacgugcuaguagcacuuaguuguaacuucuguggagagauacgguguccacuagcuucaaauguacauguuaacaguacuuacuagaaacuucuguggagagaacugauagguggcaccuuaaccaagugacgauggcccuaugauccaaccugggucaaagugaugcugccugcuucuaaguaucauaccguauccuaugaugcagauuuucagcaagcacggggggguucaggacucugcacaggcuuaggaaauccuucccagugugccauucuccuuccuaucuuucggucuugcuagacacaugccagucuggaaauccuaaccucuugccuuagaccccugucccaggccuacugccuuucgugccugaaggacacucugguuauuugaauucagcuugaugccagaaggcaggaggcuacagggugguucuuacaggaggguuuccauggcacugaagguggaaugaaguugucugggagaacaaauagaaaagauucuacccacucacauuaauccuucccugcucucagcuccaguaacagcauucuaggaugcucuguaccaaccucuuucccugugccagccccaagcccuggaccuggacucugagcuccuuaaaaccuauucuguaacuauuaagauucuuuaaugauuuugauuggauugccaaacaggcuaucuaauauuucaacauuaaaaaaggacccagaagugcccgugaccacgcuucuaggugcuaguaacaggacuccaucucauuaacagugagacuuccacaacaccugcacaagacacagcauuacccaguaagacaaaguaagugaugagcugcagccugcugcuugacaggacacugcauuuucugccccacaaaaaugcacacacacaaaaaucuguuugguauuuauuacuuggcuguuaugugaaaauauuaccgaaauaaaaauccuaggaagaaggaaaaacuccuaacaaauucucauagaaccaaacggcaacacgcuaaaucacaaucaauucugauaaaagggaggagggcaaggaagagaaaacacagcgcuccuccuucugggagguuuccuaugggaaauaaauaauuuacugauccuucaaccugugauucucuccuauuauuuaaaaaauauguucuguugccacugcagaacaaagccgagagcauuuuccucccagugagcccuugcacagcugcaggucuccugguuggaagaagaagggaacuuaaagucacuaggaaaaguuuuugaaacaccaucuagcuucagugaaagagaaaggcugaagucugaaguacccuaaacuauugaaaaugacuccuaaggcugcacaugguacacacacacacacacacacacacacacacacacacacacacacacaaacucaagugugccugggaggcggaguggggacaaucaagacuacaaagucauccuccacuaauaaguuauaauuauuuaaaugaaacgacuuucucauugcuucucauguuuuuaaaguccuauaagaaguauguccagugccugauuauccaacuuugaagccuugggcaccuuagcaggcagaauaacagaucaaaucacugucaugaugucuggucccaaccuucuacaacacagggugucaagaucagaguacuaucuagccaucccagaagcccuguuuaggauaguaauuguuuuuuaaaaauccauucaaaauuuucauucauccaucaguuuguucugaaaaaucaaugcugauuaaguguugaaacagacagauacaaagcaaguguccccugccugccaugguggaggagcccccacacggccgcugucucagcacaccacagagggugaauguaagcagauguuugaaaucaaaucuuaauagaaccagcuuccaacagcaaauuucuauguucccaucucauuuugggaagguacaaaggaauaacaaccaaccaaaauccuaauucaguaaaacaaaaauuuaguaugagcaaaaaauauggguuuccucugucaucccaaacaacuuuugcaggagaccauauauccuucuaagccucagggagaaaaggccauuuccaugugggguauaaaaauguuuggcuguuguuugugcuuugaaaggcaggauguacuguccaucauaaucacugugguacaguucccggugcaucucagucauggucuuaauuuuaugaauacggaugguaaucaccaauuccuccauaguacuauggaacaguuucucuccauugugcuccaucuccaaaagaaauagacaaaaaccacaacuggagcacccauguauggaugacccaugagcacaggacuauuaaugccagccucaaagacaaugaguauguuucucacaucgauggcaauggcugaacauaucgacuaagauuagauguguaauguucacaucucaaauaaagcuaauuguguaaaaaggauaugccauaugcccucuuguaggcauauuuacaguguugcuuugacaauucuagaaugaauugugggacguaggaucauucuuucuaugaacacgcccaaucucccaugcaguggcugaucucccaacagcaagcagcuacacuuguggaggugauuuucugucuacaggugacuuuucuucauacuagaaaacugacauuaaagcaaguguccccugccugccuaauuuaccuaauaguuucauaacuaucccauauuuuuaagguaauucauauuaacuaaacaccuuccucuuacuaauuaaccaguaguuccuuuaagacaaaacguuaaauauacagcaccccaaacuuaauccagacagacagaagaagguaccaggacuuuugcuaaaauagaaaauugacaacuagaaaaaaaugaacaaagcuagaagucaauuaucugggaauauuaacaaccaugguaaccauucagcaacacugaucaagaucuguucaaacaggaaaacgcauauuagcaauaucagacucauaucauggugggcaucagcgcucacugcauaguaagguaaauuaugggggaacaacagcagacucuacaaauaaggcuugaaagguuugguuuacuaaaaacaacaaaacaacaacaacaacaacaacaacaauaacacacacacacaaaaguagaagauacaacuucuuaccuaaccaaagacagcaaacacgauacaauuaaacauuauaagagcaguuaaaauacuuccuacaaaaauauuuuuaaaugaaaacauuccagaaugaucuuaagaaaaccugugcaaggucuuuagauguaacaaucuguuauguaacugaggcaacaaagacaaaugggcagauacacauaagugcuucaccaaaagguuucuuauucucaaagcucaguugucccugacucaucacaaggucugauggguuaccaguaggaaaugcuagcagcuuuuucucaaaagaaagaauguaaaaauaggcuuggggacaaucauagaucuaaauauaaagacaaagagaaccuauuaaauaaugaagugaauaauccacaauuaacugucuaauagcaagaaaugcuuuauagaguaauacaaacuggaggguguuuuacaaaccgcuuagaguggucuucaaaagggcaauguuguaagggggcagggcugaggagcuccugcagacagaggaaugcaagggaguugugggaaggaaagucauguagaaccuugaacugugucuugaacagggcaugaagggaaacuggugagagccaacaaugucaggaguuuauuuaacagaacauauagauaccauguucuuagcuuugauacauguuacaugagauaguaacuucaggagaagcuaggaccaacauaaacagagacucgauguacuuauuauaguucaacuugugauuuuguuuuguauuuuaaaaugguauaaaagcaaaagcauucaguagagagcauaguuugaauuuugcucauuccuuggccuagccacauuugggacagagcuccuaggcaguaagugccaccugcugcuucugcuugguauagugugugugugugugugugugugugugugugugugugcgcgcgcgcgcgcgcguguguugggguguaguaaacacacauuuuaacuauuugaaucuguguuauuuucaaccuacaaugcuuucauauaagaaccuagccccaaugaacacugaggaacacuguacuaaaugugugaauuuuucaguuauucuaaaguuguuucaaaauuaaaagggcuuaagaggguuauaaggacaaaggauagauuacuuaaagggaacacacacauacacacacacagagacacaccccaaagauaaaaacccaaagaggcacuuuacaaugaagguaaacuguggccauccaacaguauaaaagaccuucaccgucaccccugccgaacgauagacaccaguauccacccacaagauugauuaagugaaaaugggcaaugucacagaaugcagggugcucagaacacgucucaccugcugguaaacuguaaaauauuaaaaucacuggaacaugcuuuuccaguguuuaaauacuuuauaagcaucaauucacuaggcauuuauuaaagaaucaaaguacacaucugucuauaggcuugcagcacaaugucaucauccauuugauucccaauaucuccaaaauagcaaaguucaagucuccaucaaugggucagcuaaugcauuauaugaacuacaugucucagcguggacgucauguguuuauacaacaauaugaggggaucucagagucgcucugcuggaugaacagaagccagaagcacagucccucagcauggcugaauuccuguaaacacuagcacagguaaagacauuugguggcaaauggcagaucaaugccugugucuggaggccaggcagcuacaucagaacaaacggguggguaagcucuuaucuugauaaauacacaaaugacaugauugacagguauaccugcuaacugagauuuuuuuuuucugcauagacacuacaugccaagaacaaacuggugccagucuuaagaacaaaggaccgaggucuuuucauguuaacauguuuucccuuuaugcugagucucuccccuacuucucuggugaaaccaaccccuauaauuccuugccucuaacacauuucucuguucauaauacuauggguugguaagccagccuuuuggggcuucuaccccagggaagcuuacuccuuugcugcaggucuuggcgaugcuccgcaauccugaauaccagucaugugugcacccucacuucccagugugccaucugagauaucaacauuauuaaugucccuuauuuuucauacuuucaaagaagacagaacaacccaccgccccccccccccaauucccucagcuuuccaccuuuggaaaaguguaaagccaucaugccaaauucaauacauuuuccaaaaacccacucuuuuccucaccccaggaagcaugcaguaacugagcccaauauagauaagauaucagggggccaugugaagauaagauacaacugugguuccuuuaacucugaccuacagggaucuccucacagcugucaucucuucaccccaaaugccaagucccucaaaguuaaauggcuccauaguccuguaauugcauguguauugacaaggacuuaggcaggcagcacaucugugaagcuuagccgagggcagauggucaguuccuuagauaccaacucucagugcuggauagcauaugggagagguggaaagaaagacgcuuugagcugaagcaucaaccaguacuugaucucacauucuaccuaaguauucucaggaugggcaguuacagguuaugaagagcgaagucaugauuuucgcaaaagaaacaaaaagugacuggaacccucuguguucuggauggauggaacauaaaguccaagaaauccauuccagggcuccuaagcaucaagcgacagcugguuuucaaaaaguccacgaagucuauggcgcacucgcuguuugaaucacuuguuccauaggucugucgcaaucaugguucaauuuugccuuggaaaaaaauauucuccaacuagaaauguuuugauguccuuggguugugacaauuacauauccagcaaggaaagagaacacauuaagagucucugccagguugcuagcauguagacacugaacauuuugcuucuacaugucgucuaucauagaauucaccuuuuaauuuuuuaaagaaauuauucaugagaauuucacauguauauucaaugaaauauaaucauauuugcuaauaauuuucuucaaccuucccccaaauuuucuuaacaauuuccccuccuaacaucauaaauccagucaguucccccuuacguguguggacaggagaccauucacuggacuaugggaaugcuacagugaccauauccauaaagaagagugaucgagucugccuucccccaggaacuaccaacuaccagcaccuccuccuuuaaggauggggccuggaggucaucugcugggauuguggcaggcaugagcguguacagguagcaccccugcucaguggauucauggacacacuaguguccagaagugucuuugggugcuuuaacuauugcuaauaaaauuaaacaaagguaaagaauaaagucauuuaacaacuacuuaugcaagguuaaguauagccauguaagaaacaucucugcuuccuggcuacagaagagaggagggagacugagguaaugacuucacacaugagcuuuccuaugaacaaggcccccagagaggacucugcuaccaagcacugacuaauuagacuagccacucccaaaacauuugcauaagucucucacugugagccguccccccuguacucaguaagccagccaacaaccccucuauaacagacugcagcggcuggggcagguuucccuucugcugcacagauaggaauucuucuggauaggacuccuucucaccaccgauguauucccucugcguuuaauauguauguaccuaugucucugucaagguccuaccugugaguucccuccuuuugucugucuugagccugcuacuucuaccacaaauuacauuacugcugcaugucuuacuuggaacccacagcugcccuacaugccuugugcuccguucccacuccguccucucugacuacucuccacagugcuuacacagcacuuuuccuggagucagugcuccaucaacagcaguugaacuccuaaccuuucaacuuaagucuggaauauguaagaggguugucacuauggguagggguggggcaaaggaaugaauguggacaucuggcaucuaaguucugacacgcuucuuuugucuaucaaaugguuuaaaaucugaagccccccucuacucuguuuacugucauaaaucaacaguaaugguacaggaucagccucauacauuucacauuuagaaacuguagauagaacauguaaaaccccaaguccuauuuggucagcuuaauuuuccuagggguacauacuccaaagggacuuucuauuuuagaacuacagcaucacaaugcaaguggauaaaucuuuuauaaaauuuuauaagauuuaucagguuuuuuuuccuuuguugauacuacuuauuaaaauucaugucagacaugccaugguuaaucacugccuauucaagcuuauuaaugauguaaccauauaaauguguuaguaagcaugcuugucuauagagaaggcaaacuauccuaaggaacgguccucaccaacacagaucacaaccaggaauuauuuauuuauauauauauauauauguauauauguguguguguguguguguguguguguauauauguuuguguguguauauauauauauaaaacaucuuuacauucucaguacacagcacaugugugguguacacaaggugcuggguggaagccuacagaaugaaugccucacuguuagucuuggacagauagaaggacaacucaaaguugaacaugugccuaaacuuggcccuccacuuccuuggagagcugucuuuccaggcuucccagaaucgaguucuugucaugauggaggcuguucaguggagacugugguuuggagauaaggacagguagagaguagggaucugcagguacagaagcaauugaagacccagucccugauggcacuggcugaguccagagaagacauucaguagugcuuacugaaacacuuaugguacuccaaggcugauacacagacuuccaugcuggaagacuugcucuauuaucagaaaauaccccauggccucaugacuauggaucaagaaccaauaauacuaggaugucugcgauuaucuccugcaugcuacaggguacuuaguguccaaucuucgcaaauauuuucaugauacccuggaaauguauguaugaaauguagucaucauucacacauuugguaaacacguguuuaccccaguuugacugugcaaagaguuagagauccaaaauaaagaaugcagagucucccuggaacuaucagcuacugggccacauaagggugcuuggaaacagaacagagcuggcgacagaaugugugcaagagcccaaagcagcucagaaacaccaggauuccaccugcuucucuccauagcgccaggcacaccuggagcuuaugcagagcgagguguucaagcuucucgaguuccuaaaugcuucaaggcaaagucccuaaacccaaacgacccaacuuacacaguuuaaugggcacaaacacaugcuauaccuguacagagaaugccauaugcuaaacaugcauaugcugccuucuuaugggagaacuagggcacgcuggaggacugcgcugucugaguaagacucugacuucuguggcucugccgaacaugucuggaaaggaggcugccuggucggcggcacacagggguggagaaggguaagaugggccagcaccgucacaucaccacacaucagcaugagaguaucugaaacgccacagacacguaucaccucuuccuagaaaccuguucuuuucucugcauauaccgacagaugaagugauucuaaaaacacuucauuuuuuuaaaacuuuauuauuuuauucaugagcauauacuuguauguaugucauauguguugcaugccauguaugcaucugcaugguuaugugaguugaaagacagauuauagcaguugguucuuugcuuaccgcaugugggauccagagauuggacuaagguucucauacuuagugccaagggccuucaccugagucaucucaccuggccccuaaaaauuaguuucugaggucaaaggcaagaauuuugcucacacauacaaaugucaacaaaacaaaacaaaacaaaaagaggaaacaaaaccaaacaaacaaaaccugcaaagcaacagcucauucagaugauauaauggucauuaauuucuccagguuccuaccuaggccugcaaucacaugcagacugugggugucccgaugaucuaugcugguccuggacugguggggagcuugcauggcugccugcuuagagggaaagauagagaaacugcaccccucgucuccccacuagucauacccuaucugugcaagucaagguuugcaucaaagccacaagcugggggaugagcaauuacacaguauuccaaagguuucaacaugagucauaaccacgccagcucacaggcucucucugugccuuuaaaauccuaagacccuaaaguguccuucucggagaauaugcaugugugcacugggagcccgcagaacccagagggaggugguuucaugugucagagucugugaaacagccauugugggacagauguacuaagagaggaaaugaaagccuaacacuaaguaaguccaugcaaacuucaacgcugauggcgaagaacagucuuuaaguccguuacacaggaagagagcaaucuuucauuaaauguacauucgcauccucggcagugaugacaagggaacgcuuucauuuuuagguuuuauagaucaucuuuacagcguauacuugccuaauuauauuuguaaagcaagaaugggcuggacuucguccuucccugucagaaccugaaagcugcuaccugugaaagaaccugccuccaaaggcucggaaacccgaucugcaccuaccaaguuaucacaucgcuucagguaacucagcccacuccuucuuccgugggagacacaggaagaugccagaaaacaagauccggcucucgaggcccuggcaaucugauggguaaaguaacacuucggcuggggcugcagacagccccgaccucaguucacauagcagggaacguuaucaggccugcuguuggggacuugucaauucagucugggacacacucauaccaagccucccggggcugcaacagccuuugauuagaagaacuuugaucacaaagcacuccacagcagaauacagagaucacaugagucacacacacacacacaaaccacacaugugugcgcgcacguacacucacacucuucaggaacuaaauuuucacauccuggauaaaauguuauggauuauaaagucagcuuuugaaacagccggggccuagcaaacacagaaguggaugaucacagucagcuauuggaugggucacacagccccuuauggaggagcuagagaaauuacccaaggagcuaaagggaacugcaacccuauagguggaacaacaauaugagcuaaccaguacccgggagcucuuaucuuuagcugcauauguaucaaaagauggccuagucggccaucacugcaaagagaggcccauuggacuugcaaacuuuauaugccccaguacaggggaacgccaaggccaaaaagggggaguggguggguaggggauuggggggguggguauggggaaccuuugggauagcauugaaaauguaaaugaggaaaauaccuaauuaaaaaaaaaaagaaacagcugaauaauaauuuacaucaguuuaaccccuuugggggggguuaugauuuaagaaaugauacagauagacaaaaauaaauucgucaaauauuagaaaacccauaacucggucaauauuggcagaaucacaguuaauugcauuuauuuuucuaauuuggaccugagauguuccccucccaaaggcccacccuucacaacauuguuugccagucuguggauggccagggaguggugaagccuuuaaaguggggcuacaagaggaagagaggauauccgcuggguauuuucucuugagaaugguacagccucccuccccugcaauacuuccucuguuuucuuccauucucuucuccuccccacucacugcuugcugguauccgaaggagagaagccuuguucuaccagugcucccagccuuguucuaccagugcucccagccuuguucuaccagugcucccagcuuuguucuaccagugcucccagccuuguucuaccagugcucccagccuuguucuacuagugcucccagccuuguucuaccagugcucccagucuugauccacccaugcucccagccucggucuaccagggcucccagucuugauccacccaugcucccagccuuguucuaccagugcucccagccuuguucuaccagugcucccagccuuguucuaccagugcucccagucuugauccacccaugcucccagccucggucuaccagggcucccagccuucuucugcuuguguucccagccugugagcucugccucagcacaacccauugugauaaaauccacugaaaccaugagccaaaaaaaaaaaaaaaaacccaaaaacccgucuccuaaccgguccuucaccucagguauugucacagucacagaaagcuuauauauagaacagcuuagcucaacacugaagugggacacagagcccucuuuuuauucuuuuuauuccugaacugagucucucuuugcuuuaugggaauauugguuauguuuaaagaauaugauuucuuguucucccacauuuuccaaauuaaucacccccaaauccccaacccucuucaauuuacauuucuuuuacuuuaggaauaauuuucucuugaaacaaagcacccuagacgccccgccgaacugacuucucuugauuuagauucaaggucaggugcaauaaacugugaagugauucagaacuuucaaaauaaguccaauuuccauccaauauuuugaaauugaagauugcuuuaaaacaguauauguaagucacugaaaagauuggucugccaccaaauaucuaacaacaugcacagcacucaggagaaguuuuacaugcccagagauggaggacaggaacuagacacuaguacacagguggauuuuuuuuuucuuuagcuucaugguugaauucuacauggaacucaagacaagucacauuuggauguuaaaguacuucauaugaaaccugucacaggucuuugagccaacaucucucuacaccuaagaugaugaccucugaucugacagugcucaaugaccagguuagagccacaggauacaggcuuuacucuguaaucuuccaaacaagaagugacagaagaaugcuucucgccugcauaggaauauuugaaaaagaaaacaucuuccuuuaaugcugcacucugcuaagaagccaggcagguaagacagcccacaccugacccccuaaggagggccucuaggugccugcgggguaucuggaauccaggaacaagguggcccugagaugucacuccugcucugagaaccugagcugcagagguaugcuguccuugaccuggguccugagggaugccaaucacucacagggaugccacccagggcuugauguggcaucugaaugagcaaccugaugcuggagaagacacuccccccgaaggcuaggcaggccuucuccccguucccugcuugguggcccguccucuuuuccuccucccccuccuucuccuucauacaaugccuauaucccugcacacgcugagauucugaccaaagaugauuuggauucaaaagcuuugucugaucauccuaccuguuacagacauccuugggaauuauguggaugcgugaggcgaagggcuuuuauuucuuuaaagaggcagcuuuagugugcuaaagccagcaucuaaagcuaguacauggggcuuauauagaaguuagacgcccccccaaacacauggauguacauacuucccaaaaacuauuccauuucuaugaggcucuaaggaggucugagaucaagcauuuuuuaaaggucacauuuauaaugacucucauaguaucuuugaguauaguuuagaaauuugguuacacauucacauacuaguaaccacuacuuuaagauuuagaauugaauuucauauggaaauaggcuuaaagucacagagaaacaaacaaacaaaaaaaacccaaaacaucuuaguuucuuuuguuguuguuguuuguuuguuugcuugcugguucaguuucaagcugcugaaaaccagauauggcuuuauuauguccccaggaucaguuuguauaauaagaauaucaacgaaaaggugaggcagauguaacagggcuccuccaccucacuuugcauuagcucggcauuagcucuggacauaaugaaucaagaccaagcguuauccuccaccacuccuugacuagcuacugaguucaugccauuuccaggcgaggugacuuacacacucugcccacaggcagcucucagcaucugaaccccacagugaagucaaaaguagguuguucccccuuuagagagagaagaaacauggccaggaaaagaccagaguuuucugugggaagcuggaagaggccagccuggagagcugguugagagcuggcgcaugucgguggagucucuucuuucauucuuuaaauauggcagcccccuuuccugcaugcacagcuuuccaagaucuuccaacacccccccccccagucaaugccagaaaccauggauacuaccagcucucuauguacuucauuucugccuacacacaaaccccuaugauaaaguuuaauuuauaaauuaggcacaguaagagauuaacaacaauuacuaaugauaaaagggaacaauuauacccauaugcuguaauaaaaguaauuuaaacucaugaauaauuuauuucuagaauucucuaucccguguuuuagagccacggcugacuguuggguaacuaaaaccguggaaaguaaaacaagaaggcucuaacguauuuaaaaugauaguuauuuaugggcccugcucagaagcaauucacaucaugauguuuaaucaucugcucuacucuguaccuuggcauggcuuugagucagucuccccaccucuacaugucaaauacuauggguagacaagggucuagcucagugcuagaucacuuucaguaccggcaagggaucaggaguuggucccuugccccguacagauuaugcauauuuuuauuccuugaugucaugccacagucaguguacauuaugcuugcuuucuucuugagaaagaaccuaucagaagauuauuucuuccccuucuguuuucugcugaaaaaagaaaacaagguuuggaaacagcauccucuagucacucaaggcacuacagacacagucaggaggacucccaccacacaugucuacuacacacuacacacacuaugucaccaccauccgagucuacgaaggaccagaucuccagugcugacuugccuugcccacuagccuggaucuaugcuguaccaccuuacaaaucccaugcaacucugccaauccugccuguccauccugccugcccaguucagucaugaauugagaugauaaaaaccggucuugagaauguauuugccuggcauucacaaaaugagcuucaguggggguuccaaacucgaaaucagaugaccccgucagagguucaaaaggccacugagacagggaggcagguuagcaguucccacaugaccccauggaaacagaugacuacagccaagcacagacucuuaaugugcuuuguucacugugcuccagagauccugugcuauugcugaucuaaugcugggcacaaccccuuuguuaucugguccuuccugaccuaaugcccuuucauuacugagcuugaauguguuccuagaagucacacagcaaugaaguaauuucggcagaggggcaaaguggauuugcuugucagauaauaaauaucuauguccuuaauuagaacaaauuuauguuuccagaaaggcucaggauggaaggaaaaaagcgccguggcuaucugaucugaguacuuucaguaaugaacacucccugagcccucuuucagacaaaugcaacacugugaauauuaagaaccuggagacuuugcacuaaacagacuugaaaaggaaggugugguucuaagucaagcaucugaaaggcucauugaaguaggaggcugggucacaaccaaggacagugacuggaaguaaugaacagaacagaccaaggacagcuucaccuccgggucaaucuccucggacaucacaacagggcccuagguccucguggccaucacuugucuuaucccaugaucaugaagcuuuggaggcauucccagaagcuccaggguaaccagucacgucucaggaaugguuuagaacagggaacugcaaaaaccuuaaccacauaacacagccaguggugaucuagaaauucacucaaagucucccuggcagaaagaugacaacucuuucugguuccgugacucuuuccacucugagacuagacagugcuucucaaaucaagugugaggucucucuuagacuagugccauacagugucuggucacauggucuuacauuuggcacuaagcugucaaccucaaguuuagaagagacauggauaagagauaugcauuuucauacaguucucaucaucaaacucuccaaggagaaguauucucaugguggggacccagcagagaaagaguuguagaaguaauugcugccuaaagcaacagguggcuuccagggccuccaugaccuccccucugcacaugucccgaagcaaauguuccagugugaccgaccccaugggaggagaacagaguauggagaaggaauaaccugccaaugcacacauggguggaguuaggacaaagguccuaggagcagaaagacgcucuacuggucagcucugcgaagaugcuucaucaacgaaugugucuaccuacaagugucugucauugcugacuuauuuuuuucaguuaguuuugaauuccugaagggagaaagaaguacguuucugagucuccagaauaccuggccccucaauaacauaaagaggaagcuccagugacacucagcacuaccguaaauaaacgccaccccuccugccugcacgggcacccucuucccucuguagagaaccugccuccccgaaucucuaagccuaggaagaucagucaccaaucaacgaccagagcauaucggacauuucuacaguaccuucugaaggauucucucuuacguuccuuagucaaacuacuuaucuguggucauuauucuuauucauucauuguacaaauauuuaaugagcagccuuuaacucucaaggggaaaaaaggcuaucacuuuguugaaggccugucuaggaaauaauaaaguucucagaauacuaaugaaguaccuugcacuuuccugaggagacacaguuuugauacaugauuuggaaacagagggauuuugaagcuccagggccuccggagauggcagggcaugcaugcaugcaguugaggacuggugacagccuuacauagcauaugauggcugcaaaccuuugauagcucuaggaauccacacauguccauacagaaagcccuacgcuauacacuaccucugcugucuuaaacacacugccaaguagaauacaucuguacgugggccagcucacgaaaagauguuuguaagggaucagagugcucagagacaguaggggcugggaaaaaauacuacucuagccacaaaccuccagaguccuaguaacuugccauuuuuggccaugggaguugcaagaaguaucacccagcgaaagcaacaggaagaaaaagaggagguggaaaguaggaauaugaauucagacaacaacaaaaacgucacacucuaaaucagagcagaaacacucacacuugaugguugguuauggagcuugugaagaaacaacugaagaauaagaaauagauaaaggggugggggugggggagucaugaccagccuauugugggcuuccauuugcuguuuuccuggccacuucuuccuuucuguuuuguuuuagagccuuugggggaagcagauucagguauaaacuggguauuaauuagagaaccuaaauuggccgccauggaaagauuagcagagccaucccuguggugcuugacuaaucucuccuuggaaagggucucuccuguuggcuagggcucccaggaagcccacaggauggcaccagcagauucaugagcugaggaccaucaccuggccugcuuugaagguaggguuugcccuagcaggaccacccaggaagugaaggaaaacaagccagcuaaguuucagggagauaagcaggaagcgcagaggaggcuuagagaacaaagcgaucuccuuaucuaucaaauccacauucgagccaacccagacugggaagugugugugugcuuacaggguuuaugggcuggaaccucuucaaguuuuuggaggaaaucacacagugguaaaggaacaacgugugacuucaaaauccgucccaggaaggaaagaagauuagcauucacuguguuugcuggcucuggcucuuaaggagaaauuccuggaguuaggacucaggauccagcauguuagacacacgugacaguucagagaagugacagcaguaucaacaggagaugucuuccuccaggaauugcuggcaugcaacuccuaucagccuccuccacuucagacauaacuacgguacugcccugaucgaugccugcacgggacacuacaguaaguguguccccugggugcacauaucugagguuauuauuuauauucaguaagaaaaggacaauguacuuuuugaaggacagucguaagauugguguccugggagagaagaaaaagaagacauucacaagagccaucagaguccacagaagagcugcaugaagagauuuuaaugaaaaaggucugaggaaaagguugcacaccucaaggaacuaaugacucacgaguguuggugggcaggggauccuguuggcuggaucauccagacuuagguauauguuuuaacuguuugaggagaggagugcucaguccagaucuuacacacagaagcucaggguuagggcuagaggaacaauuaucgcucccuuaguaagcaguuacuaacgaaccacagaagacuccugcuuugucuucaaggaaacuacacaggaagacagacugugaggaccaagucagaugagguaucugccucucugaugcuaaguacagcagugaauguagaagcugauguugcagaaacuuagacagcuacagagcagucacagaguucauccaugcucacugcucaaaacaucguagggcacaugguaccuguggaggggacaggauggggaggaagagggagaggaagauggggcggaggacggaagaggaagagggagaggaagagaaaauagcaguuuauaugcccacuuacucuggccacauuuucuaguucuuuacugaacuaccaguuuugacaucuuugugcaaauauauauguguguguauauauauauauauauauacacauauauauauuuuaagacgagaguagugucaaaaucaguaaggauuucaguugugauccacaaggaggauaaguuuuaucuaauaagucaaaggaaucaaaacaaaacaaacauaaaacaaggcuggggucucccaaggaggaaagaauucugccaaaugauaccuuuuaaauugguuuguaacagcaacuuuucuuggguugcccagccugccagccugcccuguggauuaugaacuuccuagucuccauaguuaugcaugccaauccaauaaaaucaacugacugaucaaucuagucccuaauuuuacauauauaguucaaauguuaugauuuuuguaauuuuaucaccaugaagggugugugaugagagggaacaauauuuccaaauaugcuguuugagccccuuuucuggagugacaguccuauuagggaaggcuccagauuaccuggcagaaugucaggaggaguuauuacucuuuuuuuuuuaaagauuuauuuauuuauuauauguaaguacacuguagcugucuucagacacuccagaagagggcgucagaucuuguuacagaugguugugaaccaccaugugguugcugggauuugaacucuggaccuucggaagaacagucgggugcucuuacccacugagccaucucaccagcccgaguuauuacucuuaaucuggcuuucuccauucuagcagaacagcuacacgugcucagugaccacacacuuaaggaacacucagacuuuugcugauaguguaggccaaauguccuuauacccaaaugagcuaaucauguaaaugaacagaaggaucccauucuugaacugaggggagaagggcccgugcuggucuccuuuucucuuuguucaggaacaacucagagucuuucccacaguaccgcuuguucacuucaaaucgaccagggcauaagaacguauuuguaaagcugaaacgcaacauacaaguuaagaaauucaccuucuaccccugccgucacccaggcugugccucucaggacacauagacgugagcaccgccuuccucgcgguucuccaagaugaacaccuugaacucuuuguucaaacugugcuucuggaaacaucugacguggggcugcucuugcuggaugaaugagaugcuuuaaacgugaggggcgaaagcugugcuucucuccuugucuguuuauggcacuaauaagaaccacuuugcaguugucaguuuccuauugggauaauacuaagguuuuaagaguccauaaaagcuuuauauuugagucuuguuccuaaaugaugacucuaguucugccggggcccauagaguugagauuauagccagauguguggcaccauauugagugaaaaacuaauuucagagaauucuccuugacaaaugagaaggccuuagguuucucugcccgacaacugcacacaucacaugugcuaagucagguaaccuagauucuccagagcuucuccacacuugcauggaugacaauaucugguguguguguguguguguguguguguguguguguguguguguguguguacuguuacauuuaguccacucaccucugugaucaucucugugaucagaaagcauuuuaaccacacccagugaugauuacccuuugagauaaauaauuuuuuuuuccaaauuacuaucaucaugccaaaaaagcaucaccgguaccacaucccuccuuauaaggcccagggauaaccagacaaccuuugacaguuacacaguuugccaccuuguccuguauuucuaagugcuugcuaaggagccugcuucgagccaauuauuacagauauaaagcuuagcuggcuggucaguucccaccaugaagcaggagaaggccuccuugggaagaagcagagugcaugccauguuuacuuuaggacaccauucucccaccacgcagaugucuacugaguaccuacugcaggcuggccucucuucugggaugcaaugacggcuuuauggucuagauagcaaggaggggaaaaagcaaugaacaagaaccuucugaagcaagggugaggucaaucaugaguuacuguugggauuauuuuagaucugaugacucaaaugugacaucugaacucagggccuacauuaaacagggaaagcaaguccacaaagaccuuggagaagaauguucacagaagaaaagacagugcaaagguuccaaggaacauggaagcugagaauaaugucaaugacuuacauaaguggccuccuggccuugacggggaggacaucaagaaaaguugcuugagugggugggcuugcaguccacugcuucucuuccuucccggccccacauucccagcaagggaggcacacagcugacacccacccaucuggcuucccagaaggcucugagacagagcucucuaaacccccuucccagucauuucuuucccugagaaauaaccaggagaggaacagggggaaaacucagaagagacucuucuguuuccuucuguauucuagaaagacagaucuucuugacagcucagccauuacagcugccaggcuaagccuacccugcuccuagcauauuggccacauaaggaucaguacacaucaagcucaaaggaccaagaccacauccacugcugacuuaggucuucaaggaccuccagagacccauaguuauggcucauggaaaccuacuaaagguggaaaucucacaagguaaggguggcagggaaggucuuugaucacguguauucucaacugggaucagggagcccaguccuuuagucucucuuguucccaugcccuagccauaggagaacaguuucucucagcacagaccaaagucaacagggccaaucaauugcagacugagaccugcacagauuaaucuaaaaugcagcuucucuguucacaaguugucucgguuauuuguuaucacgucagaaagcuggccaagauccuuacuucuuaucuuauucagggucucugcugcuacaguaaaacacugugagcaaaagacacuugcagggugggagaguauuucaucuuacagcuuguaguccaucauccagggaagucagagcaggaacucugaaggccuaagcuauggagaggugcugcuugcggacucccuggcuccagguuugcuagccugcuuucuugagguacucaggaccacugccuagagauggccacacacgcaauggccugggccaaaccauguaaaucacucauaaagaaaaugcacaauagacacuauagccagucuuggggaaguauuuuuucaacugaggaucccucuccccaaaggacucuagugggugccaaauugaccauaugcuaagccagugcagaagagaaaggaucccaggacauccaagcugcagaaaguagaaauuaugagaaaccaacgggauccacccauauucuagauccucacacuauugcuggguguggccagugacacgaaugagcaccugacagagugcccauccuccuuuaacagcuccaugacaaacauccagagauaauggcguuccuaugucuggauuuaguccucaguguuuagccauuuagaagacuaaaaccauaaacccacuacuguggauauucuuaaaauacauguucauaaaauacauauauaaaggaauaggguuuaaauggaauuaccauaaacagugaagaagcaauaucccaacugaauuuuguauguuaacaaauaaaaucuucaguaccuuuagaaucauuaaccuggccaccccuaauucaucaaauacgacagguuacuggagaagacuagcaugcugguccaaucuguucagcuagcagagugaggaucugagguuugagcaccuuggugaaccucccugguuccuauaacuguuucuucccugugccaacaucagguggcaagcaucccagggccccucuccuccucucugugaggccaggaacacaucccuguagaaguguuucagauuuucuacucacuuagaguuggccuucugcuacaccucagggaaaaugauccgguugagacaagaacucuuccccccuaaggccucccacagacccucugggcuuuguagauggcucagcucugaaccccgguguaaacagccauuagagaagccauccuucuccacaggaagccaagcuccugaagaugcuuuguguccaaaggcagaggcugcccacauaaacuucacugauacaaggagcuucucugaaauggugugaauuguauggcagagggaugugccacacaccagcauaccucuaaacacacgugcugaaggaguucuauaaaugacuagguaugugcaaagccaacugacuaaacucagacauguagaaagucuuugguucccuuucaugauauucugaacauuuaacaaaaucucuagcauaugaaaccugggcccuuggugaagucucccccacagccuaccuaccaaauccaucuuacucagggucacagccccugccagaagguuagauuuaacucuaaugggaagcaauugcauagaaagguauuuaacauaccccugaaagguauuuuauuguacaauguuucuucugagauccuugaaagccagggggaaaacugggagaaguaugugaaaguguaugucuacuuggucugaauguucuagacacucagaggcaucucuacaagccucccaccauucuuagaaggaugcuugagacaccaaauaacauaaggacguguccuuuuacaucaccaugcaauaaccaugcugagaucucugcauucuccuuagauauuuauaaaaccauuucucuuauauuuucccuagccauuagaaaaacaacaacaacaacaaaaacccuagaaagcauauagcauuaacaauaugauguauaagagacaggcaacauguuacuaaugaagugacuucuacuaucuccuaaccacaugcgcgacccccucugcugagccuggacagauaucaucgucccacggaagcaugagccaucauaaccuaacagcaaauuaugugagcugugacuuuacuccugccucugucaaggauuucugcauucgaaauuaaaugucuggugucugucuggggcccuuucuaacccaucaaaggggugaaaacuaguuaaagaaaauggauaaaaugaggugaauacauaaaaagagauuccaggagaggaaaaauggaaacauggcauugugucacugaauaaauaugcuuuggcgaaagggacauaaagucacugaacccuguaugccagagacuggggagagggagacaaauguuuggucuuugaaugaaggaggacaguaguucuaagaacaaugaaaguaacauaacacuggcuuaauaaagauauaauaugauuguuuuuuuuugaacuaccaacaaguuguccuauccauaaaaucaucucuccuuauacucucaagaaggauauacagaauugguccaaacccauagauggagauauacccaucaaguuagaaggguauuugcaugauacauaauuaaaauagaagaaucaaacuuacaaacaaauaugaugauuuaacgcuuguuuaauuuauguuucuagucuucaugguaaugugacaagcucacaaaaucuuuaaaacacaagcucucucuacacuaaaugaaguccaauuuggagacggaaaacccauacucaaguaaugugcauauaaacacaaaucuguuguuucuuaucauguggucaggcaaaacuacugcacccagagccccagcuuccauauugaacagugagaaaaacugauguuagaauuuuaaggagaauuugcuuauuauauaguuuaacauucccauguucugauugcgauuaugcacucguccuuacacaagugauaauuauccucaaagugguuuucacacaaaaauuacauggcugugcuugagaguauugcccaacugcaacucucuaagagguguugacaauggccaagcagugaaaggcaaacagcagaaagacauaaaacaaauacccgcaggaagggaaagcgugguagagaccaauucauaaucggucaguugguugauuaggaggcacggcuacguaauagugacuuuugauagucgcugcaagccuagaacugacaggauucccagaguaacagaagagcaugaaauaccaugcuaacugguguuguccacauaggaggauguaugggguuggucaacuugaucuucacuccaaaccccucauauccaccuugaagauaaccugccuguugccuguuuugcacugccccgccccgcuuuuucuccucucaccauuuucuugccccauacacuaguguuuuuuuuuuuuuuugauuuuuaaaggaaaauaggcgguuuuuuuuuuaauguggguacuacacaaaguagauuuuuuuucccagucaugaacacaaacaagccccgaacuucaaagagugaauucuacuaacagagcuagcauuguuuguuugacauacauuuugcauuauauacauuuagggcaauucagaacaugauauaagacaaaugcauuccauaaacaauuugcaauucggauaaugauagagaaaagacacugcuggguugggugaaugguucagaggguaaagugcuugcucacaagcuggcaaccugacagaggucuuuaaaacccacaguggaagaagagagcugaauccuggcaguuguccucugacuggcacaugccucaugacaugcaugcaacccacacucuauacuacauagacacauacacacauguacacacacagacauacuacauaugcacacacacacauauacacaaagacaccacagauagagacaacacagaaaaagagacacacacacagggacaaaacacauaaucauaauagcaguaaauaguuaacaacauggaaagauuuuaaaaggagguauuauuuacacuacucugucuugaguuacacuucuucugauacacaaguauaaaaagaagagguucaauauugcuuuccaauaaauggugacaccaauccaccagaccuggaauuucauggaaguguuaaaaaggcaauaguguaacacacaauacaaugucaagauuuucagcauuuagaaauguuucaauugucaccauggugauguaauaaaaugagggcaauaaaauauaauuaaacauuaauuacagaaacuaucaaaaauaauugacuuguacaaagcucaguacuccuguuaaaaaagaagcugauggauaauaaaauauauaucccauccuuuagacauaauuauuccaaggcagcaauuaaauuuauagaaaauuguucaguuucuucuggaugcuucacugcugugaacucaaugguauuuucagagaauuauacuuguuugacauccuaacuggaggcauagccauaaacucaaguauguguuuuauaaauauaaauagcuuuuuaaaaagccuccucuuaagacuacucugcauuuguuguauuucugguucccacaggaaagacuucugcuuugguuaagaaaugccuaaguccccuauauccauuucugagcacauuuuaauaguaagagaaaacaauuuuaauauaaaaauaauguucugcagagcaaauggaagaguauuuuuauuaauaauuaucauuccaagauuuuuacaccagucuguuucuuuaacauuuauggaagcaggacugggucauaaaaucauuccacaguccuuaugggaagcauuaagguuuuuaaagggcauaaaaaucaccccauuuggacuuuuuuuuuuuaaaaagcagaguccagagaauccucuacauauagggagucaugaacauaaacuuuggagcacugcugccugaaguggggggagacuauacauaccagauaacuugcuaucaaaaguuuuagccaguggaaaaugaaaguuucaagcaaaauaaauguaagaacaucaauugcaaacaaaaaagacaagacucauacaacggguuuaugugcauacaaagaacagcccuuaaaaaccacuugcauuucauuuuuuccucuauuuacauuuuugugcuuaaaaguuguuugcagguugggaggucaugcuuucaaugccugcuggugcacccuaguucuggagagcccucuuagccccaagaguagacccugguugcuguaaagccacaugggguacagcagaggcugguggggauucugauguaaugcuuugagagguggggcuucaagaugguaaggaugaagaugcugcaggcaccggagagcauccuugcugagcacuaccggaaccuacagaagaagccauccuaucuggcccucaucagcuacauaagcucugggucuaugguggccauggucugagaaguguacaauaugcccacaucucaagggcuaugauagaacacacugacucagcagugguagccccugggacaaucaggggcaacuucaguguucacaucagcaggaaugucauccaugcuagcagagggagagccagcugugguuucagggcagugaacccuugaacuaagcaaacaguggucaccauagcagcugcuacccagccugaggguuugaacuacacucagcacaucaggguccacccaugaccaacuaccucugucaacaagaacuuaagcccacacccaucccgucuccccaagccagucccagcucacccuuuguccaacuucagucccagggagucuaggcuucaacuuugugugccuuuuuguauccuaagucagcacaauauuagaccauauccuuguguaccaaagugccagacacuuuugcggcauugucaaaggugacuucgccuaccucaauggagagacauuaaaaucauauguuaaaaaaacaaaacaaaacaaaaaagcuguuugugagggguuuauuuuacuagauauguucauuauacaaaaugauggauaucaccauauccccacagguucaugucauguacuuuuucauauucauaugacccuccccucucuuguuaccccucccacugggcuccuuccucccccuagacaaacaguaccucuucgugugugugugugugugugugugugugugugugugugugugugcucaaguguguaaaaaucuaguucaucauauuaaagaaagcauacaacaccugucucaaaauacauuuuaaaaauacauuauuuuaauccaaagauaccuccaacacagugagaggggcagccaauuauggaaagaaucaaccuaugaaugucugucagggagaacugaagggagagagacaggacaaaggaaagagaaaaugcuagcaaacaccaaggccguccuuuguugauggagggggagcaaugaauaauguuuccugagacagagcuuggcagguagaagacaugagccaccauaggaagcaccacuaacuggggcagcucugugacugcacagacacucagcagaagcccacugacaggaaacccgcugucuccuagcucaaagcaaacugcaguuugagcaucugauuugaaccggugcaaguucccuuggccuguaaaagcuuugcucuuacauuagagguaaugcaaaugaccuggcaacaguccuugaaugugccagauucugacaacucaagauuagaagacugaggagauuccagaggcccaggcccucaucauccaucuaggugccugacagcacauccagcauccugaggaagaggccgugcgugcgugcgugcguuauuccuguagugcggccgguccgucaaaggcaagcucagcaagggguuucugagugggucaggagacugaaaaggaagcaagaaacucccagauaguacaaagcucagcacugcugccuugucuggaagagugugaguuguacaccuuaagaauucaauggaaaagaggccaacagcaaaccgaaauauucuaaguaccuacucacacacauagaggauagcagaaacauuaagaaugguacccaauaaauaccagggcccagcuagugccuggaccuaaggaccacacgcauggacuugcacauguaauuggaacaggagucuauaucacaaccauuacguacagagauacuuuccuaaucaugugguggggacacagguuacaugucauuauucauaugaauuauauacuuuuaugcauuauaaagcaggaagcaagaccucuccucccaaauguggaaagguauuugcauuauuuuuagacaaauuuucauuucuuuacaaauaaggaaagauagcuaucacuagguugcacaugaaacagguagaaggucaagggagugauccagccugauguuucucucccacucaccuccacugauggccaaaugaggaagucuauguaugugggaaaugcgucagcucgggaagcucucggggcagacuaagacacacucauguuuucagaggaccaaacugaccucacagguuagaaagaucuuguggccagugaauugucaggccaucaagauuugugguagaucaaagucgcccaaaccacugugugggacaagaggccaucccuguucuggugggcauucugaugacaggcagagcguguguuucuguaagaaggacaguggccucugaacaagcagaaacccugccagggacacucagcacugagccaccucagcuccgucaaaacgaggagacucagauggcugugugguuccucucccaaaugagggccauggcugcugugcaguccccugccucugucagaaaggauauuuuaaaggucuaagcaaaugucaaaggcagaugcuguacacagacagcguuuucuaaguguucacaguccaagggaagacaguuaggcagcccggaaaaagaacugcaauugaaaguuauuccccaaaauccccaaaguccccuggcaauuccacucaauaaauauuuacuaagcaacuuccacgugaacaguccuguuaccagguaugcagacauaugccacauuugaugcaaaacaguuccuuuccuuagagagucugcaaugacaggaggggaaggucagcaagaaucuagcacccaguaggcccucaggaggacaaaguaccccagaacugauccguaggcaggaaagacugcauuugcuagggaacauuuuugauagauguacaguauuuuuaaaaaccagacauuuuuuuauuauuauuuuauuaaagugaagucaagaaauacaaacacucucaagaauggagcaauuaaguaguuagaguagaaaacaaaagacacagaagggccaaugaaugccaagaaaagucuccuuucgccagagaagcaggcuauaagaacaacaaaaugaucacacgugucugauguacuuccaagguauagcuguauucacagacaaauccguugauguuaacagagugcacuccuuauguaguugggaggcuaagcucacaaacagaucuuccucucaaagccucccucugaacaguggguuguaagugcucaguagcacagcauuggcuguucuuacagacaucugcacuuacauucuacaaaccgugcauaaauacauacggcuucauuauucgcaguuacccaagacccagucauguuucucccuuuccuguuuguaaacaaagucuauucuugcuaacaugugcuuauaacaugcgcuguggauuuuuuuguuuuuauuuuuuaucugggugucggaggggggagugguguguauacacacgugggugcccauauccaagagugugcuggagcucuuggaucuugcugggauucccaucuacagcccccuccaagaggagcaaguauuuuuaaccucugagccaacuguccacaucccugcugguuugcagugguacagggaaccaaaucacagggucucuuauuauguacuaaagccaagguucugccaugggcuuuucaguuucuacccuuggcauuucaaacagggaauuacuacauacauacuacauauauaguccaggcuagucuccaacugucaguccuuaggccucagccucccagcugcugagacuggagguggugugacccacaugcccaccugucccacauuucagucucugccaauagucuucccaguggagaaaaccauggagggggguuacuguguauuuguuugcuguuacauucagagugucuguaagacagucccuggaaggaaauaggaucaguaucuguuucacuguuaaauaaacuuaguuuauggagagugagcuacugcaacacugugcccuuugguuccuuguuuaucugcuacuggggaggaucacagcccuguuaaaggagcucuggcaagguuuuacagugaaggaaaacugaaagugcauccaaaaaaaaaaaaaaccacaguaguguuaauuucugguuauuuacacuccugcagucaucuucaaauguuuaaaauuuaaaugauaaagauaaaacaauggugauauaguugggucuccaaugugacuuuuagguccaauuaggaauaucugcuuauacaccuucauacaccuccacgguuaaaaggguggaagucuuccugagacuucacggaauaucacaaauuuacagugauuuuuacauuuccugagaaagccaugaacaccauuuguaccgagucagggcuauccugcugggaugacgcauucugucagcaauauguuccaugugcacuucuuacagcaacccaggggcuuuccuccccauuaaaguugugaugcccacgaccugacaaccaagcucgccauccaggagcccucagcuuugcuuuuucuugccuuucccccuagaccuacacagagggauccucccagagcgcagggucuuggggcagcaagcaaagguuucagaugaggccggaaaggaagaccuaagaggaaggcccuccuuccaguccaacaaaccgaggagaccuggcuccagacuuggcuagccugucacacuuagaccuggcaguuuuccuucuagcuucuugguguaccugccaaagccaugacccauuuugacagugccuuguuguaggugugguucccaugcuaagguccuguucuucaauugguucucacaauaaaauaaauaggauucauaguaccaauaaugaagacaaugaugucuugaagcaucucacauauugugaaagaugucaauuccuauacugaacaaacuaaguagaucccagaaacagaugacucccccaaaaauguauagcaagacucaucaccauuaaagacuucaaccuaaagacaaaacagaaaugcuucagacaccaaaaugaagacaugguuaacaagaagggguuggaugucuccccuggaagcaaagcucucaucuggagcagggcacgaggaagaggcacagcaggauucaaacacagcugucaacugugaacucuguauuuggugacaauaucuuuuagaaguaaggaggaauagagaccuucauggauggcgucagagagaaguagcaacagugaggaugacccuucaaaagcggcuacaagaugcccucuucuuaaaaggagcagcagaaugaaguaaacagaucagccuuguagcacacguuauuaaaccgucuagggcauggcuucuggggaagggcgauguaaagaaauaucaguuagaccagggauggcagcacucuggaggaagaggcaggcagaccucuaggagcuccaggccagggugauuauacaucaugaacuucagcuagccagggcugcacagggagaccuugucuuuaaaaguaauaaagagaagaagccaaugcacucuagauggugguggcaucuguagauuccagaaagcauccaccuagcguggggaaacaguaaguuuuggggcuuuuucuacugaagcaucaggagcucuaaggugcacuagggaauguggaaugcccuggggagucacugaaaagucugacuugaaauaugagugacagaagcugguugagcugaggguuuccccugggacacauguggacaucaaaguuaucaaugagcuccaaguccccuuucaagcuccccccucccaugagcaccucaggaagccuccccauaguuccccaagagaaugcuaacaggcccuggguugcaagagucuugggugagggauugcauuaauaagccagccucgcaggcagggggucuucugugaguggccacugauguucugauucggaauguaaauagucacagucaaccuggagggaagaaucacacaacaucuggccuggaacauaauguauggaggaggaaaaauacuugaaacugaaccuuaaaaacaggcuaagauauuugaauaacaacaagguuucugcaaccuguucaaggaaacaggauaaugagacugguagauggggauauguguauugaaauaacaaauaauuccuaagugaggcaucauuuuaaaucucccaagaacuuuuaaaaagagaaaugagaacgaggucagaaaacagaagaaccaguggcuuaaaccuaaaugccaaaauauggcacagaggcugucacgacuggauuaaguaaguaacaugaucccaugugcuacuguaagagauuuaguugaaacauacuuccaugaguguaaggauauaaaguaucaaaacaugcugcacauaacugaaggaauuuggaaagaguacucaacacuccauguaaaaccugcagccguaggaugcacacaccgucagccacacaccagugaaaguaauccagcaguacaucgagugaauuaugaccgugaccacaggcaguuaaccuugggguacaaaggcgacggggugcaucuuggugacagagaaacucuucugcaccuucacgucaguggccacuguccuaguugugacuuuacaguguggcaagcugucagcuuguaggaaaaugguuaaagggugcacaggaaaucugugugcuauuuagaagccuucugcaaccuguucaaggaagcagaaucaugagacugguagaugugugugcgucacugcagugacgucaaaauauauaaacuuugauuaagaccucuguggaugccgaaucuaaugugauucaaccacgacaguuucuuaugaaaacuauuagggcugucucugugacuucaaugucauucucuaaaaggagagccugagauugcucucugagauguccaccucuuccucugagguucaacagagugacuggaagacaaacuacaaaaaaauuaacuuuccaaagagaacgaugauagcuagacacacaagaacucaaacugaggcaaggagacugccggaaguucaaggcuacccugggcuaccuauuaaguuccagguuagcccuaccuuaacagaacaaacaacccacauacaauacgacaaaggauauaaugaauaaaauuucagcagagcuuucgaguuauugauaaaucuuugucgugauacuuauguagaaaauaauugaucuugauuuaaguaauuuuauuaagacaaauaugaaacuggaaaggggaaacauuaacaguccacuauggaaaauugauuaugggaaagaaucaaauuagcuuaaugauguucccucgggaacuuuaugaaaauuaauucauucugggccaauucugauuaaaauauuuauauuuauauuaauaaacucagagugaaaauguucuuuauucuaaugacaucacugucucucaggcucugacgccauguuuugcuucucagcacucagcccaauuuuccuccagcucuucacuucuguuccacuccagcacggccccugcacacacacacacacacacacacacacacacacacacacacauccuccaagguaccauccucagcccacuuugaugguuucacauuuuuaagauucauuuucauguuuuaauuauacggaugugcaugucuauguaugaacccauacagaugaaugugaguguccuugaaggccagaagaaggugucagguccccuggagcuggaguuaguuacaggcaguugugagacaccugacacaggcuggaaaauaauucaggucaucucuaagaauaacaggcacucuuacgcacuggccaacucuucaguuccccuuuugagucaggauauuauguaaucuaaguuagacucuaaaucauaauccuccugccuccacucccaggugcuaggguaacacauguguucuaccacuggacugguguucuguaaguccuguggcaggcaucuugccuuaguaucuauucuauacaucagcauuaagcuucaggugcccuuguaucuuuuccuuuuuuuauuuuaccaggggcuggcucagaauggcuuaugaacucaugguaaacauccccucucggccccauauucagucacacuaccauucugauaguaggauggauuugaucuguguuuauaccauggaaauugguagauaaaacagagcagaaagaagaguaaagaguccucuuuuccuuggagcuguaagcacauaagguaccaccuuccucaacgguuauaaggcaccaucauccuugaugcucauaagguaucauuaucuucaauacuuguaaggcaccaccauccucgaugcuaacaaggaaccagcauccucgauguuaauaagggaccagcauccucaaugcuaacaaggaaccagcauccucgauguuaauaagggaccagcauccucaaugcuaacaaggaaccagcauccucgauguuaauaagggaccagcauccucaaugcuaacaaggaaccagcauccucgauguuaauaagggaccagcauccucaaugcuaacaaggaaccagcauccucaauguuaauaagggaccagcauccucaauguuaauaauggaccagcauccucaaugcuuacaagguaccccauccucugacucagugccugucaugauuggcauugagaguaagcuuugucaacccaguacauuugaacccacacauucaacuaauggccgauagcugaguuccaguuccaaaauaccucccaugccuuccaccuuuuguccaaacucaaacgauuccaguuccaccaggguacgugacuacuguucuugacagacuucccugauucccuccacagucucuggggucucucccuuugaauacauuugggaucaugccauggcucaccauguucuaagggagccaagcacuaaaucucaccuacagcgacaguucacugaaccaggcauaugcauuuaguugagacugucuaagaccugggcuucguaucccuuagccucagaugacuuuaccuucauucuguccuacagacccauucagcucagaaaucccucuccuaguccuccuacccagaauggacgaguccuuccucucugccauacaaccuuugacagcacuacuauucuuccggucguaugcuucacuguuucacagaugccaagcucagcaagcaauuagcuucauuuccaucagauuuuagaaccugcuuugcccugaagugauagagauucuauuuuucucucaaccauguauuuuccucauuuugcuucccuaacucaauuuuaauuauccccaaaccgaaagcauuuaagacuuaagaaugccuacucucugacacaaccaugcaagaugaaaggauauuuaaccucaggcuggguguuccaaccgccugcaauuaaagcacuccaucucccucgcucgcucgcucgcucgcucuccccacacacuuggguugacucuaugauuaaaaaagaaaacgauuucauuacagauaauuuaguugacauuuuugcuuugguacagcuuggaguugagauggcuuucgcugucacaagauaauuuagcaugcaguagcaucaagaaacacaaagcaagagugcccuuaacaugugcaaggcauaugggggaaaggcaaagcaaggcgagccacagggaaguuggucauaaaauaccugugaagcuacagcaucuugaggcaggaaggaggaugcccugaggcuacuucccugagcccucaacaucuuccuccuccuccuccuccuccuccuccuccuccuccuucucccccuuuuccccuccuccuucucuuccccuuucucccccuccuucucuuccucuccuuccuccuccucuuccccccuuccuccuucucuuucuccuccuccucuuccuccuccuccucuuccuccuccuccccuuccuccucuuucucuuccugcuccugcuccuccucaagcuccuccaaaguggccaaagucauaccuucuugguugugugcugaaacugaguagugcgccucugcaugacaaggaagcuaaagagugcauggagcagagagaacacaggaugcuuuggaguaggaugcugucaacugaccuuugcccugcuccugcguucucugcaagagcccaggagaaagugggggggcgggcacaggagcgcacucugcuuccagcuguccucugcaggagucccgggggugggggagaguggggggugaacaggggaacagaagucugcuuucuacugugcucugugggaggcgaugagggucaaggaggagagaggcacucuucugguuuuugcucucccccaauuucuugcugcuuuggugcagaaagaaggaguuaacccaagcggccccucagaugugcacucggccggcuggcuucauuaggacuuugccagguguccaaccgcagagcuuuuuguauuuacaccuucaaagacaacgcccacacucaucuuuuuugcugacuggugaccugaguugaccucggagaaugugugcuaauuggugggaagauccacauuugggcaucucuagcauacagggauguauagcgucaacuuccaugucuguggggacaucaauuacuucuuucuucccuuuagacuuugaauuuuucccuguccuuggcacaguaaucccacauauuuccagggccugggaugaugauggagccauggaaacaguguacagggaucaggucuuggucagggguauggggucacucacacagucaccauuucuuucuguugagaacauucaaaaaucuucucuacuuugaaaaaaugcaauuaauuccugucaaacauaguuacccuaucgugcgguaaaacacgaggaaagagaagguagauauugcuccuagccaaguguacuaugcaugagguaaccaucuguucuaucacaacccuugcaggaaauuauagucaguaguuuuaguuucuacauacaaaugagaacacacacuauccaucuuccugggcuugaccuauuuuacuuaucaacagaaaguucuucaucuaaaaccuggucccccauaccaugcaaauacacaugaagaugaagaaaguccugccaaucuaauuaauaauucuaaguguauauaucuauuauauuuuguaauuagggucugcgaaauuuuauagggacucgccacaccugcaccauacguuuauauaaugguaagagcacaggcauccagauaugauccaucccggagucuaauagcucucuccguagcacucucuagacacggccugugaggaaacauaaugucacauaauguguucaaauggggccccauugguaagugguaaagaacuguuccaguaagagacaggcauggaaagaugguuuucuuuuuagucauucacucaauggcugacagaaaacugagguuguccucauucagauccaaagaaagacauguccccacugucuucugcagacucgcucuccgcccgugacccugagggagcauuuucuucuucaucauuucaacucucaaaugcuccuuuucuguucccacagcuuggaagcucuccaauguucaucccgucccucuuccucuccucacucucuccuccaggccugcucuuccuccuccaugcucaccuccccuuuuuucacaacaaaccuuaguuuacagauaaaauaucccagaaguaggcuggugguccuugucuauacuccagcccucgggaggaggagccuggagaaucaggaguucaagucuggcuuuggcuacaugagaaccucaucucccgcaagcuguuucaucauucucugcccccaucacugaaauccuccucacaggcuuagauucucacaacacuccaccuucugacauucgggaaccauucacguuucucaccccagcccucuccuaucgaagcuccucuuccugcagucucugauaaggcuuaucuccccuuccuugcuccuggggggauccaguggcuugcuacuggcuccccguaacacagcguuuuuaguuuccuguuuuugcucuaaaucaccuucuggaggagauugguagcccuuugauugucugaugauuaucucugagaccuuucucucuagcacacacaugcuucaagacuccacuuggguuuucuaccaugugcccagcugcgacacccuccaggccaugagagucaugucauggcacaucuuaagguccugaagcagcugcauuuacaucauuuaggacaaaugucauucucaccuuguccuagagcauugcuacaaugaucaacugugaauuuacaaaaugcagcuggcuacagugguguaucccauaaccccaucacucaggagaacugcagguuagagacuagccugggcuacaaggcuacggaugcauaaaauguugccaugugauuuccccacuguccucgugacuuuaaaccccugggucuaugaugaagucacaggaucaaaaaccaaagucuccacugucuuuccuucaccucuaauagacgcugagauuucagacgccccugggauuuuaagauacuuccuucuacacccccuccccugaguugucucugagccugcuucccuuccaguucgucucuguucgcucuucugccuguuuucccacgaaucagcacuuccuucuuacaagaguguuuucguaaauugaucauuucuccuuucucccuccucacuuugccuccccuggaacacucuuccuaaaacuuagcuucugccauguuccuucccaucgcccaaaucaaucagagguccuguguucaaggaaauaucaaaauucuucucauuuguuuaacucucaguagcagaaucuuuucucuccaguuaaaauuaucuccaaacuaaaauuuacugucccuaaauauaugucuuaucuuccuucuggcugaaagcuucuugaaugaauauauauauauauauauauauauauacauauacauauauguauauauacauauucauauauauauucaaaaauguguguuaaacuucuuuuguauaacucagacuccacauuacucugcugauugggaaugcagugcuugauucacuguguacugaaaacuuggagcuggguaaaaugauauaaaauguaaucuaaagguaauuuucaguuaaagaguaacucaucaucuagccccacaguggcaaggcagaccuaaggccaaauaaaaaaguaagcaacaaaaaacucaguauacccuugaagguuuuaaagcaggauggacgaucugaaaaauaucccaaggcccagccacuggaacuucaugggcaaaagaaaaugaaaagaaagauuccuauugauuuccacuauauaaaccacaagcaaaggaacaugaccuauuuaugcacauucaacgagaaaaugccuaacucuaucaagaaguuaaccuaacauuggaugccaccauggugugguucuucccagugcacagccaacuucccauccagggcacgcggccagaaaccugauagguaaagguucaacagcaggggacgauaaucauggcauuaacucugucacuaaagucaauaguguugaaugaaaagguccugaugucggcccucuccagguuugggggauccaccugacuucuagauccucaaggucaccuggaagucaaaagauuuaucuaguaaaaagcaacacaggccagccaaucacacucagagcugcugaugucagugcagcucuugauuugugaugucugccucccuugcggggcguguaccagggaaagcauggucugugaggcgccauugagggaaaagcccugaaaaaguguuacuuuguuguacucacaggcuacacuuucuauucacuugacuuaugacaauucucccuccgagaguagcagugauuaagauggaccugcucgguaauuuccugaggagccagacaacagauguacauauggggaagauaacggcaaugaugcggggaguuuaugacagguagagagggugggggcugaguaucgucggggaccuaaggcacaucagcacaaaaacauguaaauaaacaagaggcgagugcugccuugcagacaccauggccacugccaccugguagaaauacuacacugcugauaauucuggccucacacggucacugaaacuccucagggucaagcugucacacuagccacacucgcuuagagaugagacauaugguaucucaccagaaauaucuugaaacugcaugugguacguugaacuuccauccugcuggacccuuguaugauuucuaaaacaugcagacucacuagcccuccccacgcccaggagcggagguaaagauacuuuccuuagcuugcuccacacuaacucugaucgugugucuucguauuauaguacacuugugcccaaaauaauucauuaaggaaaacauuuccgcgcuaagauuucaugugaggaaagugugcgacagcuuucagucacaguaacaaaagacccaaaagaaugaacucacaaaaagauuuacauucucucgauuuucagagguucaguccacgagcagcugccgucauugcugggcuugugaccaagcagugcaucauggcaggaauguuugaucaaacaaaaccagggacagcuggggaggcagaguaccaaggagguugggguuacaccagaccuuucagaugcugagcuccacucccaugaccuucaugccuuccccgaugccccaccucuuaaagaucccaccaucuuucaacagccauauucuggaaggcaagccuuuaauacacaggacuugagaggaccacauccaagaccucuacuuccauuaagugagguggaaacugaagcagauaaccaaucucucucacaggcucugccuuccacuaucuguauuaaauaugaauacuucauaaagacuuuuuacccauaggcucacacauccaccuacaauggauaacuuuagccuuauauuuuaugcauauaagagaaaaagcuacuuaaaacugacccaugucuuccuuaaguuugauagcccccuaucugugcagaagagaaguguggugagaaauuuagugguaaugaaauaacuccuccuauucgcuugggugcaggaaacugcacagccugaucccuggaugcccgagucucacucacaagguuucucuuuccuggaguuauuuuuugugugggguguuuauauugugcuuuguuucaaaccaguucugucaugggagauuccugaugcaggcccagguauuccucgugcaaacugucccugcagcuauuguuuuaauuaguucgccugcuuggcagcuugcccugcgcggugggcugcucuggggcacaggugucugcagagggugccuccucuggagcacaggacguaaugagccauuucaguaauaagagcccuguaucaagccagaagcccccgcacuggagaagcccccaggcacuggaacugcucaugaauuucuaagcuaccuuuugaauuugcauuuaaacauaaaucccccccccaaaacuauuuggccugugacugucugaccgaggggcgggagggggguuaaaggacuuugaauacugaauguguauagauuauaauacagagucagauguauggccauguaagaugcauaggucuucuugccaugccuauuaaaaaaaaaaaaaaagcuuguuuuccuuuuucccuuaagaaaaaaugugauagaaaaaaauuaaaugaaucuuuauaaguccuguuugauuaaaacucagauuacuccucaucuuccugcuaccuagacaucagaaaccuguucgggagcagggauuagcuggcgccuggugacuucacacaauagauugaaaccaaucuaauuuaacaccugugugcucaucaaugagcgcacucaagcacaaaagugagcaccguguugagcgauucugacacugacugcaugacaaccacagaugcuguauccaaacacucccagacaagaagcuaauugcgucgaugaaagguacacugcagagugcaugagcaaucgcugccacgauccacggacgacccgcucuucacuagcagggcgcugcugcacagcugaucuagaaccuuccugugaugguuuguauaugcuuggcccagggaguggcacuauuaggauguaugccuuguuggaguagguguggccuuguuggaguggguguggccuuguuggagugaguguggccuuguuggacuagguguggcccuguugaaguagguguguugcuguggguguaggcuauaauaagacccugccuagaagccaguacuccacuagcagcaucuagaugaaaauguagaccucucagcuccuccugcaccauguuuagaugcugcccugcucccaccuugaugauaauggacugaaccucugaaccuauaagccagguucaauuaaauguuguccuuggucauggugucuguucacagcaguaaaacccuaacuaagacacuucccuaccccaucccacaaccacaugucucuccuacuagcgaaaacugagaaugacuucuuguuaacuuaugggcaauggccaaaguucccuucucagcagagacuuaguuuggcagucacguauggaaugcacacagauguugacaucugucauuacaggacugagacaaaaggcuaauucacaggaucuaguugacucucuucucuccccagccuauucuggguaccugugaaacagaagcacugucucccuagguuguaacacacacagagaaccaucagagccaguggugagacaguuauguugaaauauaaccccuaauucuaugcccagaagacaacccaaaccaaugauacuuaagaacucagauguugaaaccuacagcucagucacugaaggagcaagaggagcugaccccugaaauaaucagaauugugcgguccaacacagacgccugcagaaggaacaugcaugcagagacugauagugcauuaacccauucauacaacaaguccaggaugaccaagccucgccaguuauuuacaucuuugugcuugauaguaaacuacaaagugccaaacacacggcuggccugaaguucgaaucuacccagguccauaacaucgcugaucuuauugcuaccacagugaaugaauguagaauugaauauauugaaaaaauucacaaaguagaaaagaacccagcauucuaccaaaaucagcacccaagacuguccucuggccuggucacacuugcaugcauacuugugcacguguaccugcacacauauguaguauaagcauacguggaaauaaacacacacauaggagagggagagaaagcuguaagaagacauaugauggugacaggcuugugccauccaccuacauauguagcaagcagcagagcugguuuucugaauugcaaggaggagguucacaccaacccuuauuccagauuaaauucuaccagauaucaugaaauccuguggggaauaccucaaagaugaaaagcauuuccaauuuaaauuaaaucaaauuuccaauuaagucacagagaauuauaccuucaauacgaaccuguuuccucuguuccuuuauaacaagaaagauacucuauuuuuguggacaugaauuaagaguugguauaaaaugauucaacucuaccucugacuaagaccccuucuaccuuagguuuccggacucaacucugggguccaagcauucagugaaauccuacagagaaacuccuaaagggacauauauguguuucuaacuucuuuguauuuaucagguuuuuaaaugguuuuguuccagacagagcagauguucuggcaaaauuacggauccuugacucuggagugacccuugcaguauucucuaaauuucuauauuucacauuacugcuucuugaauucacaaaggaaaccccuaaaacccacaaagaaugcuccggauccugcuggaagggagcaggccgacaaagaagucucugcagugguggacgggcagcgcgaagcuuccggcuucauccccggcugggcagacuucaggugggauguugucagcagagaaauaucuauuauuuguuggccucccucccauuuuuucucuuuaaaaagaaaagcauuguaucuacuaaguuugaauuaugcuagcaagccuuuucuucugaauucaaauuacuacuaccaaaauuuuuccuucuggggagaggcgaaagcugaaagccaauacuaaauuggcguuaggauagaggaagguuuugggcaggugucagccgaagaaaugggcuuugaacucaaguaugaggaaucugagcaugugcuaaauugcugucaaaguuuaugacacugaaagaucuuuuuaagggauuuuuuuuuuuuugguuuuucgagacaggguuucucuguauaguccuggcuguccuggaacucacuuuguagaccaggcuggccucgaacucagaaauccgccugccucugccucccgagugcugggauuaaaggcgugcgccaccaugcccggcuuuaagggauuuuuaaaacaguaacuaggcaaaauaauagaugccuauguucccuauuuuggggaagcagacacuauuggaugccaaccuggaaacaauacagugagaccccugugucaaaauaacaaccaccagcaucaaacaacgagcaaacaagaaagccaucuaggacagacgugucugagauggcucgaauaggauuucaccaugccuuguucccuucugcuccguuagcccaggguuagaacagauccuacuagguugugcucagagugcucagccuggccuacagcuaaaggucuaauacugcaggccgcuuucuuuugaguuugggcagaguuguccaacaaagaagaugggggcaaucuaacugcuuuggaagcagagcugggccccucccuuuccucagagaaaagauguacuuaaagccaaguacaggcuuuugaaauugaaauucauguaagcucugcucucacacacagggagaccugaucuugugguucuugaaaaccuaauauccccaaggaaucucuggggacuggggacaggauuagggaacacagcucuuccuaaugcaagccuguuccagaguccaggcuggcagaggggcggggcugcgaaugugcuggucagugccugcccucauuacaaggauggcuuuguagauguccugagcgucuaucuugucagaucugccuucagagacacugaauugcucagaguccugcaagcaucugaccaaaccuuuucuucaguguagccucuuagccaugacuccaaggugaccaccuaggcccugucagugcuucucuagaaaagaaucucuuuacucugauauccagcccagaucucugcugcucuagaggaugccgggaaccccaccucccagagcuaaaaugcagaacauucuacaaggugguguaauccagagauagcagccugcuuccucugagguucaggagcagaauucccauccgauuagugccucccaccccaccccagccgcugccaucacuguggagagaaugggcauuuuaaggagccucuccccagacaaacucuagguacacguaccuaaaucagugaauagaugaaucgcugcuaaauguuguuuccuucccaaacucaugcguuggaaccuaaccuuucaaagugacaucauuagaacggggaggagcuagagcuggcuggauuauaaggaaaaccgucuggaauggggcuugaaccgguaacagagguagcacacgaggaacaagaacauggcugcuagacaucgaaucagccaggaccuucugcuugggcgucucaacuuuccaaacugugggugaugcuugcuauuuauacagcauccaguuuauagcauuuucgcuguaacaugcugacgagcuuaaaacagcaaauaaggggaccaaggccugcagguucaggaaagggcaggaggacccucuaaccagagcagcaaguacagcaaaggaucgugacucaagucuguccaaaaagaagaaacaauguagaagagugccaacaggaccuguuucuuuaacagacagguuuguguccccaucagacuccuccaaagaguccgagauuagcagaaccccagcacugccucuugguacucagcaaguguccaccacacacucaacuggacugcaucacucugagaacuagcucauuuuagcaugaggugugcugugagagagguauuccuggaauaugcugggggcccgcaauggaucugaagcugagcaggaagauuuagguucagggaggagucccaggagugugcugggcaacuaucagcuucugcagagcaaagagugaccccaccccuggccccaccccgaccucaucccugcccccacuccugcccccagcagacuguugggaucucuuugauccguucucuaccuuuaaagguuguuucucuggccuacuaucuuuagagucaauguguucuuuccugccgcagauccaccaucucaaguccuagcaucgauaaggacuugaacuccauaaagcacacacaguguagacaagcacacagcgcucuguccggugucucuauuucucacugacuaugguuuucaacuacuccucagcauaauugugugcccuuaauuaaaucuaaguuacuggccaauucuucuuuuaaugugaaaacucacggugaugucucuggguuuauagcaccauuacuguuauggcaagcaauucaaccucagcuuauugcgugacuucagcuaauagaagauuuugaguuucauauucauaggaguaacaucacuuauggaaauaaauguugugcuguuggcuuuccccuccccuccccuccccuccccuccccuacccuaccccuccggacuggucagcaaucucgauucauccucaaggaugcuuggcucaagagccagaaggaaagacacagagcuccacagacacacugcugaugaggccauguuuucuuuccugaauguacagauauaaaaacaccacggggcacggguaagcaagaaguggucgucggggacagggcacauuugagagacaacucugccaggaggacacagagaauagcagugauuucuucuucccaauaugaggcaauuuucuuauuucagaggaauaagagacagacccaccguaugaaaggauuugauuuguggcgauugcuuuucuuguccccauuccauuaaugccagguuugcuggccuuaagcucagggccaaguguuucccucuuacuuaggacucccuggacaguuauuaucuuuaucaauuuucuuuuacccacaucgauucugugaaacugaugugccuuucagucacugccuuuuauuuaaccaaaauauccuuuggaacacacgcuucugucgacaaacuaaagaacccauaaguccuaagaguuguuuuuaaacauaaaaguuguuucuggcgguaaaaguaauuuguguucacuauaaaaaccagaugcuaaagaacaaaaaagagggcauaaucaugcuuaaagccacugccccaggcgcccucugguaagaggaggcauuagaacacauucacaaagcuagaauuguccucuaaacaccgucuuaccuguuuauuuuuucaguuaaaacuugugaaaauuuccucacaacacuaaacauuuuuaaaguuuuuguuuuuguuuuucuacuuuucuuugguuuccuuuauuuuuaugugucugaguguuuugccugugugucugucugugugccacauguguggcuguugccuguggaggcuggaggagggcauugaguuucccggaagaggaggcacagaugggagcugagaacggaaauaggcgcuuuagaagaccgcaaguguucuccgccaccacagcgucucuccagcaccauggcuguucaacuuuuucaaaucaggccauacaggcgccagcagguugguccccccaguuagacaacugcucccauguccucucucccgaguuuccuccccucucuuccucuuuccucugaggauuuuccauuucuacaagaugagaagaaacacuccaugaccaggagacaucaguuguguggcucuggguucaugugucccauuguucuggauaaccaacaccuucuuggggucauuaucugucccacgccuuugccuuuaucuuuuuuagaauacuggagucauucccacccugcccaaguuaguagagaacaguaucuuacguuuuaaacacuauuacauggugguuucuaauucuuuuucugguuugcuauuugccuuuaauuugagaacaaaguuuuuaaagacaugaauaacaauguguaucuguauuauuucccaaguuaacuugcaggugucauuagacguuacuacagugacaguaacaaucauguguauucucuauugugaaucugugcacugacuuuaucagacccuuuggauugaaggcuucagaaucauugagaagacaaacuaugccaguacuuuucacugcucauuugucuguuugcuggguuuucuuucccaguucagaggccaggauauggauguaugccucaaagcugugagcuccaccuaccacucuacaucaaaucaaugaagucacacgugcguuagcaaagguggaacaagauccagcaagcaccuuccagaacucaguuugagguucuaaggcaaccaaaccagaaggagaaaaacuacaauucaacuuuaacuucugaauuucauucugaugugcuaacuacugaaaauguucucuaggccacaguuuccagccucccucccauuuuagacuuaguacugaauuuaucugauauauauaaaggggguggagugaggaaaggagagaggggagaaaggguugggaggaagaggccuuuaaacagacaacacaacguaaagaaaacaaacacccaaaagaagaacccacacugaaaauaauacucaaaagcaagaugggccaaaggaaaucuuuugaguuaaacagaggagaccgucauuuccugaaguacagggcauaaucuuuguauaaugugugauacucauacacaagcaugcaagggaaacccacaaacagcuuaacauacaggagagucucaccuucgaaggauuaucuuuaugugaguggcugaucaaacuucaguccuaagaaguuagcaauguagccaguggacucuaaguuccgcucaaucucaagugugagugcguggccauuugguucucugugaaggggucagcuucauccaacccuaaaccaucaccaccccaauggcagagacaaggcaggcugcagccuacuguauacaucugucuugucugucucauucgccgcuggaugguuuguggcuuuucaauuauuuauaugaaagaugauucccauauauauauaucuugaucaucucugcuucucccuuccaguacgaugauaugauucacuugccgaucacaggggaauuauuaaugucuguuauuaugaucacuauuauuauuauaaauauguccuggaacagcaucaaauacucaacaacaccccugcuaaccaagcagagacuugaccuucaaaggccuggaguuauucaucaccucacgagacagcuucagagccccaggcccugcccccugcucccuucugacuucaaagugccagaggcauagugugugagcauucaggaagcucaggugggaaaacguuucuuuuccuugaauucuuugcacacaccagcuuuuuaggagaauaaccaacuuggauaaauaaguggucuggauuuaaaguaagaaagggaagaacgcucccagggacuuggauuucagagggcugugcuguuccagggcacuaacuaacuugccucuucagaguguugggagagcaucuaaauuaaucugaaugacauuagcucuuacuucacucaguuugaaauaaacccacuucuacaggccgagcagauacugcuuucaagugggagaaagagggcugcuucuucuuucugcaaaaugaaacgcuguauggaauguuucccucccaaggagccgcuuuguuuugcaucuuugccuuggucucuugcucuuuaguuuuauguaccagcaucagcagcaucucuuaauuucagaacagcaagcugcgggaagcagccaggguaggaacagagauggcagagagcgagcgaaugcaccgugucuccagaguugaaauaugagaaacaaucacuuucaacagaacagucuauugauuucuccauuaaaaaaaaaaaaaaagaaaaaaaaggaaucgccaaggcuuuugaauucaaucuggaguagaaaauguuaauacaaaaggagaccaucaucgcucagauuccauuucuaguuucauguaagaucuuuauuuuauaugcuaugaaauaucuauaggaaauauagauagucuccucucauggaagccugggcuagccauuaagguugcauuugaaccagccugcaggauuauuugaauauauuucgcuuuguuugggcaaauuacaugaccauaaauaugcuaugcuucuauggcuguaaaaacaacugaacagaaagaggcauauuaaucaauccacaaaccuaaaaacaaaacguacauuaauaccaucuguguuccgucuacuccaucccacucugcccaccccagcaagcccccguccaucagaaggaucuaguuaacccacagagcugcuggcugccugagugucuugccagaacacuuaacagcucccucauuuguugggugauuuuauaggucucuggugaugcgcagagguaggacagcuugcagggugugaggagaauagauaaaacuacccugcuguguagaucuaguccauuugcacuggcucuccgacagaaaaacaaauugcaaccucucacaaaaaggccccuuucugcacuagcaagcuagaaaaaugcaggcagaaucgaguaaaucaagcaacuucccaucaggagaaggggaaauggcuaccacucuaacagcugcucucguaauuaagaacagauuucaucacuaaacucuugcugguuauguccacagcaaaacaaaugcacagaugugggguauuuacauacuagaaaauuuaucccaggcagcccaagcacauuuaccuuuugugcuggagaaugcaaccuuaaaaauaucacccaaucgacagcagcgugcaaggcaaaguccaaaccugaauucaacgcauuucugucaucaucuugcaacuacauuugucuuggcauccuaccaaaugcacucuccccuuccauauuuagagucgcgguggacagccacaaacgcgaccucucucaaauaaugaaaaugugcuacguguuucucucacucauaaaauuugcuaaauuuauugcugccucauuuauccauguguuaaauggcugcauggcacacgcaauaaaaggacugacaccugaccucugcagagguaaauuggugugaaguuaaaucaaagaaauaaaauuaaugaaacgguaaaaacugauggauaaggguggguugauggaaagcccugccgccgugagaaagaaaaaccucugauuucauacaacgaggaugacgcucacaacaacuaagccaaacaacuauucauacaaaguagaacaaaaaugggcaaaaauaacuuugcuuuuagaagucacuuggccaggaguguuccccagcaggaaggucuccggagggcggcuccaagcagucauacacagcgcuuaaucugggugauggauucacagguaccuucacuauagaaauauucuucauguucuuccgcuaggaucacuugucuuuuuuuuuuaaauaugcaaacuguucucuaaugaaauuggaaaaaugaaaagaagcuaaggggugcgcuagguuuccugauuugauugccagcccucagcucucagacguauccuucagccucugcuucacagagcuucuuccugcccugcucgagaagccucagggcacugggcagcagcgggcacugggccacagucuauucuuucuaaaggacuguacugguugguggaagguuggaguuuagacuacuagcauuauaucuuacuuagacuauguccuaucuaacacuugaaaucgauuuuccucuccaaaguggucaaugauauauagauagauagauagauagauagaguacugaaugaccacuacuaugguuuacaacaagaaaauagauuaaaacauguauauuccaauauaauguaguucuaaaugcauucuaaacaaugaccugugaugcuguuuuacauacaaaacagacauccagagauguaaguaagguaacccugacaugaaaaugcacgaucaagccugcucaagauggccuacgaucuccuaagaccuccaauaccuaagcauguaugacaugccucaucauguguuaugagaggcuuuggagagggaaggcccacgguugugaucuuuaugcuuaaacaccacagaguuuuagaauuaaaauuaaccucagacuggaaacacucccaccaccaaccauaugcaaguguaguguguugaggguggcugguauuuaagugguagauuucucggugagaacugcauugucccaaguggaaacugagcugcugagcagccacugggauacuggagcacuugcagaagaacggguaguaaggaagaugcucugccaggggcgggaggauggugugaaagaagacaccauguccacagaggcuuucaaucgaguuaggucacuggugcacaaaaagggugaccauugccaauacaaucacacgggcuuugcuccaaguagcuucacagccgugugucucaaucggugacccucaauacaaccgccaggggucaaaggcauaaagagguccagcgaccuccuccuuuauguuuguucaucuauuuuaauguugcuggagaggcugaguucccuucugauagccugauccuguguagucauuaauguuuaaaccauuaacccucaaaggaaggaggauggagagccuuacuuggcuuguaaugcaucucucgggcaccugaugaaagugcaaguccuagagaccuuacuuagcaagagagcacaccccagaaaggagaggcaguagaagagcucccugccagaucgcucuuucaccuacaaggauuccagaaacacagggcuauacucagggcugcuauuuugagcuaaugcugccgagauccauccacagaccuucccauugggauuagucugcaaucuagcuggggccucaggguugugugggcuccuugaacguuuaauuuuaacuuuccaguuuagcuggagucagaauguuaacacuuucauuuaugugugacugggcauuuaucuuaaaaaacccuuaauagccaaaaugucaggaaaugaaaacugucuccuuaaugaaauuauaggauuucaaauuugaauacucagagggcuacaacuggccgcuaucaucugcuaccccaacaggagggauuuucuccaugaucucacucuugaauacauguauguuucaaaaaacagauucucugguguuuaagaacuuaauguccagccagaacucugacaggaugcacaaccgaaaauguacaauuuucucaaucuccaauuggaucauguucucuuguaaaacauuguagaccuuuuaugcaaagaacggaugugugauuuugcuacaguguugcuauuucguucaaugcccuguuaggaacgacagaaaauguacacuuuuuuuuucuucaaucuccggucagauaguguucccuuguaaaacauuguggaccuuuucugcaaagaacaugugauuucgccacaguguugcuaucucauucacuccccaguuagggagcaccugcacgcucagagcuggauuccauacaaaagaugaaagcaaggaagaaagaaggugccuugccccuuccccccacccuccccccucacucccuccaccccucaguacccacccuugggaaaugcaugccgugugaaccaauccaaguguggacaguggaugaauggauggaaggauggauagguggacagauggauguaugauagauuacucacaaaauggauggaugcggagagugauaugaggaaacccagaagacaaucacacacaggcuuuggugagaauuucccuucaggggguuggagacaacagaugaugcagauuucugggauggagagauucacuaaggagggaaggucuacucauuguggggggcagcugcuacauuuugacaauuccucacaccagguucucaaauaucaaaggaacaguugcuuuccaauuuugaaggguccuguccaauggauuaaagauuuuuaccuuucagguuaguauuuucuagccaacauuucccaacaauacuaauccuuugaaguguugugcuuugggguaaaguucauuuagggagugcugcuacagccuagaguuuuucagagauucauaauauacacaagcaucaaguauaacuugaaugccuuuuucuagacaccgcggacacuccucaaacccagaguucugcagaagagucauuggagacaccaaacacugcuggagaaaaguagacaaacagcuacuggaacuucaauugaacuuccauagaguaagauacaauuuaucuuucucuguacuuuauuaaagaaaaagucuugucuauggcugauacugaaacuguuguccaacgaagcuggaaagagauuaaugacaggaaguauguggucaugaaacacaggagcaaucccucucaagggacuuuuaaggauuaaauggaacaggguuaaaggugguuggagauuuaagaauaaaagcagaggcucuuggagaggccauggagaaagcccccuuucagccacaacauggaaugugggagguuuuaccuccucuucaguguuagaaaaacaccuuguucaucucaagaguucucuuuuccauuuuaauugcuauggcauguuaacaauauuagcuggagugagggaaguguuccgugguguaccugacggaggcaauucuggaguauuauggggauuagcccauguucuuacaauaguguucaagagaaacaaagacccaaaagcuaucuuagccccaguagacacuugaccuacaaccagcauggguggcgcacucucuucuuguggcagacaccaggaaagggagggacacagugcacucagaauauagcccaaugaccgcuccagugggaaucacaacaugguguaugugcuuuuaagcaaucaguaugaaguuugacaaaacaaaacacuguacuacauauaaaaggauuuacaagugucucaggggaugggagaaacuccuuaugaacgaugaaauuuugcuguacagugaaaauacuguauauuucacacuacugaacaauauuaacuucaaaaaaugguuaaaacaccuuuuucuccacuacaguuuuaaaauaguggugaauuaaauuauuuuuaaucuauauuuguccauaaaacauuugcuuucuaauucuacagagaguggaccugccuuuuuuuauauauauauauauuaagauggaccuucacaaaggcugaucagacaauacagugguaagugaggaagaaaugucaaacauucaaggacuaaaaaggucagugggaaugacacuguaaagcaggaagggagaaccaggauuuggaagggugggagagggcagaggagaagccuccauggguguggcuguuagguuaggguaacaguagccaggagacaccauccacacaccaagccuccaaggcccgggcacucgauuuucugaaccugccuuuaagaagaggaaagggggcaaguuggaaagagaugucaacagagaugcuguuuaaaaacuggaaaucauuucucugaugauuaaggaugcugaacauuuuuucaggugcuucucagccauucaguauuccucaggugagaauucuuuguuuagcucugagccccauuuuuuaaugggguuauuugauuuucuggaguccaccuucuugaguucuuuauauauauuggauauuaguccccuaucugauuuacaauagguaaagauccuuucccaaucuguugguggccuuuugucuuauugacggugucuuuugccuugcagaagcuuugcaguuucaugaggucccauuugucaauucucgaucuuacagcacaagccauugauguucuauucaggaauuuuuucccuguguccauaucuucgaggcuuuuccccacuuucuccucuauaaguuucgcaagcuuguacaaccacucuggaaaucagucuggcgguuccucagaaaauuggaggaucccacaauaccucuccugggcauauauccagaagaugucccaaccgguaagaaggacacaugcuccacuauguucauagcagccuuauuuauaauagccagaagcuggaaagaacccagaugccccucaacagaggaauggauacaaaaaaugugguacauuuacacaauggaguacuacucagcuauuaaaaagaaugaauuuaugaaauuccuaggcaaaugguuggaccuggaggucaucauccugagugagguaacacaaucacaaaagaacucaaaugauauguacucacugauaaguggauauuagcccagaaacuuaguauacccgagauauaagauacaauuugaaaaacacaugaaacugaagaagaacgaagaccaaaguguggacacuuugccccuucuuagaauuggaaacaaucacccauggaaggaguuacagagacaaaguuuggagcugagacaaaaggauggaccaucuagagacugccauauccagggauccaucccauaauuagccuccaaacgaugacaccauugcauacacuagcaagcgucugcugaaaggacccugauauagcugucucuugugagacaaugccuggccuagcaaagacagaacuggaugcucacagucagcuauuggauggaucacagggcccccaauggaggagcuagagaaaguacccaaggagcuaaagagaucugcaacccuugcaacaacauuaugaacuaaccaguaccccgaagcucuugacucuagcugcauauguaucaaaagauggccuagucggccaucacuggaaagagaggcccauuggacaugcaaacuuuauaugccccaguacaggggaacgccagggccaaaaagugggaguggguggguaggggaauggaggggaggguaugggggacuuuugggauagcauuggaaauguaauugaggaaaauacguaauaaaaaaauauuuaaaaaaaaacuggaaaucaaacgucaucucacuuguuugauuuagaguuaaguuuucuguuuaaggagcauaguaccccaaaugaugugaguaacugaaaaauaaaauaacaucauuauuguaugaauguacacauuuacacuaucgguucacuguggggaugugcacacuuacacuaccggcucagucucugcccuuuaccugaaauacuucccuuucaugucaacauguauauguuuuaauuuguaacauuuuuguguaggccuuguuuuaauacugagacaucucucuuguccauguuuuaauuuccaauguuaagcuauugugguuuauuaaauaguuuauuuuaauauauauauguauguaucuguguguguauauauauguguguguguguauguauauguguguauauauguacauauacauuauauauauacacauauaucauauuuuuguuagcuauuuaaucuauaaaaugcggcucagagggggaaaggcagucauaaaccuguugguacaaagauaagcaguuuauuuaauaucuaauuaaauguggucaccagagaaaucacagcuuaugaaacuuuaucagaaaaagauuaauccauuucaagcucaacccaaaugucacaagagaacucaugaauuuagauaggaauccacuuauuauccagagacauuuuuguauugacuaaaaggaacugauacuaccagcuauauuuauaccuacuucugucaaauucacauacuuuguagcaaucuuugaauaauuaccaaacaagaauaauauauuacugaauguuuuucuauuuuuaaaaaauauuuaaaaauauuucacgacuuuauaggcauuauucuuuuauaaaccaaccugaaaauucuacaaacauggccuauuaacuaagaaaaaaaugaaugcuauacagcuauacacuguacugagaauugaggauagauauuaguucccuaucggauuuaggauugguaaagauucauuucccaaucuguugauggccuuuuugucuuaugacagugucuuucccuuacagaagcuuugcaauuuuaugagguuccauuugucgauucucaaucuuacagcacaaggcaaugcaauucuguucaggaauuuuuccccuguguccauaucuuuugagguuuuuccccacuuucuccucuguaaguuucaguaucucugguuuuauguggaguuccuuaauccacuuagacuugaguuuuguauaaggagauaagaauggaucaauucgcauucuacacgauaacugccaguugugccaggaccauuuguugaaaauguugucuuuuuuccacuggaugguuuuagcuccuuuuucaaagaucaagugaccauagguguguggguucauuucuguaucuuuaauucuauuccauugaucuaccugucuauugcuguaccaguaccaugaaguuuuuaaucacaauuacucuguaguacagcuugaggucaggcauggugauuccaccagagguucuuuuaauguugagaauaguuuuugcuaucguagguuuuuuuguuauuccagaugaauuugcaaauugcccuuucuaacucggugaagaauuggguuggaauuuugauggggauugcauugaauucagcaacauagccauuuugacuauauuaauccugccaauccaugagcaugggagaucuuccaccuucugagaucuucuucgauuucuuucuucagagacuugaaguucuuaccauacagaucuuucacuuccuuaguuagagucaaaccaagguauuuuauauuauuugugauuauugagaaggguguugugucccuaauuucuuucucagccuguauauccuuuguguagagaaaggccacugauuuguuugaguuaauuuuauauccagcuacugcacugaagcuguuuaucagguuuaggaguucucucguggaauuuuuagggucacuuauauauacuaucacaucaucugcaaacagugauauuuugacuucuuccuuuagaucccuuccuaucaaggacucauaaaggcacgagcugcaaggguguacagacagacagacagacagacagacagacagacaaaggcuuucauuauaucuacuauaaugaaaacagaaucuggucacaguaguagcugugcugauuaguuuucucucaaaucacacgagcuaacgucaucugagaggagggcaccucuauuaggaaaaugccucuaugagaucaggcuguaggccaaacuauaggacaucuucuuaauuaguguuugaugugugaguggugcuuucccugggcugguggcccuggguucuauaagaaagcaggcugagcaaaccauagggagcaagccaguaagcagcaucccuccauagcuucugcaucagcuccugccuccagguuccuggccugcuugagcucuugccuugaccuccuccaaugauggacuaugauauggaaauaaaacccgaacaaaccuuuccucccagagcugcuuuugggccaugguguuucagcagagcaauagcagcccuacauuggacaaagacccagcauaacguccugaccuccagucuaaagcuggaacuaggugacucaguagagccagugggaugugacagacagcuguucuccuuccaggcagcagcauuauggacaggcucucucaucccuuugcgcucuucuuuguaaucaucaaaaggaauagggcccaucugggaucacgaggucacuguuugcauguauguaacacuguauguuaauuaggauggcuauucugaaaaacgaucuggaguucuucccaaaaacucaaacuugugguaguguguaaccuaggaaucccagugccggagaugcacacaacggaagcaaagucaguaagccaugcagucuggccacucugcacugccacaugcauccagagcucugcaugguggccaagaugaagaugugggaaugagguggcgguggcgacaugaaaccagagaagaaaaugugacauaugcgcacacacacaggaaugcccuucggucacacagagaauaaaaucgcaagucauaugaccacgggggagaacccauaggacacgauauuaagugaaauaagccagacacagacagacuagugucuaguggucuuacucauacacacaagagaaugaaggcgucaucgaauagaagucagaggcaacagugcuuagcagaggaggaaggggacaggagagaggagacagaagcugacagugaacaucaaguuugagcucagaauccaugcugguaugcuaacauaguggggguggcuauguaugguuaacacuggugcacuauuuccagccagcuagaagaaaaaacuggaagagucuccccacaaaagcucuaaguauaagccuguacuuuugacaauacauggauguauacagccaucacaccacacccccauaaacagugauagugucuauuaaaaagaaauagagaguaagccucguaccggagggagcauaauagaauaaagggagcccuaauccacagcaugcucagaacaccgccccgggucccagcgacaggcacugcacucuugguuuuaagccacuuacacagaauucauugggaccagccucacauucuacucaauguguaauaacagagcagccucucuuccugagcauuuaggguacuagaaaacgcuccuuaaacagaaacccuaacuauaaaucaagcgagugagaugacguuugauuuccagucuuuauuuuucaugagaagugaauuaugucaauaaauuaaucuuacaauuaaaacagagagcauaauuacacucauaaguuauuagaaagaugauuuauauauucuuggagaggcauguuuuuaaauaaggcacaaaacuauauauucacaugauaaauuauuucaugacuuauaaaguugauuuaaaaaccaauauaaaaauuauggcgaaccaauuuuuaaaacucaggaacagcagaacacagaaaauaagacugaaaauggagucacaugucaacaggaaaggcuucaaaaacggugacacaaaagcccugccgagaaucucaugagagcugaggagcucauacaagaggccagaguguccagcagcaagcagcuccuucagagacagaggggaagccugcacucaggccuuuaaaauuuccuccaacuucaagaacagccuugcagauggaaagagcucuccauguuuugaagauuccuuaauguugagauauauuuugguaaauauucugcaauucuuuuugguuguuuguuugguuugguuuuuuugagaaagcaucuguguagcccaggcuguccuggagcucacucuguagaccaggcuggucuugagcucagaaauccaccugccucagccuucugaaugcugggauuaaaggcauuuguaacaauauuuuuaagguaagaaaaaaacuugcaaauauuucagaagaaaaaaauggguaaaggacaugaacaaaaaaaccuauauaugcucaccauuuccucaucucgggauuguaaaguacaugguugaggcgguuucuuaggaaugaaucauaaaagcauauaaaauucacuugcgacucuuuauaguauaauuuauauuugagaaaaggcuuuaaaauacuuaaaaugguuuuacggugguuacugaaaaauuaugcaaauaaaucuuguugaucugaaugaaguaaauuauaagacaaaccaguaagguugcccaacucgaugagcgguaacugcugaauccaugcacugagcacuuccggacuggccaagggccggcgaggacacauuuaugacagcagggaaaguaaauucacugacgaccacaugcaccuucaucucagcucaaugacauagcauuuaaauggaaucagaaaggcccauuccugaaugcugugugugugcuuuuccagacugcaaugcuauugguuuuagucagcuuuauguuccuaguuacaacaaaaacaguauuuucaaaaucuuuccuucccugggcacaaagaacagcuuauagguaaaguuucuaaacccucuuucugaucugucuuaggaagccaggacucucagcaccauaacuaaagacuuuguucauuuaacugauucuaacaacauggcggccaugggugcaucucuucaugccaacaugccaccuuccucuggcaucuaaacgcuaccacucagcuggccgcccuccuuccuucggaucucuucucuguuacuugaaggguuccuucugcucacagacuucuuccuuccugcaggaagggcucagcucucuaccuuguccacacggucucgcagggugaagucaaccuagccagucucagggugacaccaaguguaccccugaaacucaaaaucuauaucccugguccagaacggccucccuucuucagugguucugcgcccauugggacagacugucuguguccuguccucccgucuguuuccucaccggcacagguaaacggugacgucacagcguuaggaagcucaagucagccagugguucuccaguguggcccacgcguacgguucucaccucagaugaaaacauuuucuucuucucggcagcucaggucaaaccuguccucagcucuuucugucaccagucaagcuguuggcaaccuuacuggcucuccuucaaaacacuuccaggguccagccuucccuucuaaauacugucaguaucagcaagugagagucuauccuuuccuccuguguucaguuugacugaaacgccccgcaggcuuuugucuugagcacuugaguauuuccauacuugaguauguccaauggccggugguaccuacagauugaaaggcuguggagcguaagacgugguccugaggugguggaaguaggucacuugagauaagcuuuuacagccugguccugauucgggcugugcucucugcucccuagcccaaugccauccaugucaaugaagagcugccucucacuccugacaccauguauggagcuaguccucccagcauccucucaaaccaggaaccaaagcaauucucaauuacuuugacucagagaggaaaaaaaaacauacaaaaaaaucccuacagaaauauucuuucauuuguuucugucggguaucauggucacagagagaaggaacugacgcaccugugcauggacaccugucaccucauccuucccugcuucugccucagaccacccaggucccacagccagccugguccuucucauuccuccauugcaucauggcacuccuccaggucaaaccauucugaggcacccaaguuuucauucacagagaagcugaaauccuuccuguggccuaacagaccuucauggcaggcaucccaucuccaccgcucuccuccuuacucugcuucagcuuacuguugggaggucaacccaaugugaggagauguguccccacacaaggggacauccaccacaccccguggcaugcuccaccuccuggggucuccuagcaaccccucaugccuuaccucacucuccuuccauacgucucacuuuuuaaaugauuacucuaauuuuguuuucuuuuucauuuaugaguacacuguagcuguuuucagacacaccaggagagggcaucggauuccauuguagaugguugugagcccucgugugguugcugggaauugaacucagaaccucuggaagaauagucagugcucuuaaccacugagccaucacuccagcccuaaaugaugacuauaaauacccuucuuaauuugcaaaagauuuauuuuauuuuuauuuacgcguuagcucucugugugagcacacauaugcaagcgugaauguucaugugauuacacgccugcaaauguccaggaagucagaagaaggcacuggaucccccugagcuggagcaacagguaacagaugguugugaaaccaccugcuguagacgcaggcaacuuggggcaucuguaagagcucuuagaaccccucagucacuucuccacacacaccccuuaguuucucagcuugcucucuaaccuccaacaccacaugccugcccucuauggugcccugccuucuccucucuccaugacauauaucccacacaauaaaaugguugaaacagaaauuuggggagaguaaauaguucaacuggcuaucacagagcagggaaggcugcucuggaaauccaugcuaaagugcuuuuccuuaucuuuauuauuauauggaaagaaugacaugggcccaaguaagaugaugcccaaagggacagagcaaagacccauucagcagacgcuaauaagcaaagguggguaaaaggaacagucaacagugaugaagcauaagaucaagugaagccaagcauauguuauuaagagagugaggugcaggggagccuuaggagggaggggccagaguaucuaaagcugggaaggcagccccaacaggcuaggcguuccccuuuaacugugagaacugaagccaggguaaguugguaggagugacauagacaaggcaucaaauguccacgggagauacaggggccauccauugcugaaguccuguuucuggaguaccuaggaucaccaggguagaaaagcccuauuuguuguuugggcuucuaccgacaaaugaagaacuauccacuuucccauuucuucuguuuaccuuuuuguuaccuagacaagggucaccguuuacuguguaucaacagaaugcuuaaggcugugacacgcagcaguaucuguaauggagggaucugugaggcaacagacaaacagagcuccgguaaacauguggaucauguuugccaacugugaaacacuguguucccaugacuaacugaaauaggaaccguggcaagcaggacugauaaagugcagaacaacaugcagaggaagagguuggggucauuccuagaggcacagagguggacuaacuguauucucaaauguuaaaguccauucaaacuuaaugcagcagagggcuggaaguguggcucuccccuccucccucaacccacucucaucaacuuccucaucucuguagccucucaaucaacgccuacccucccuguggcuguagagcagaacauccucaggaaaacacacacacacacacacauagacacacaugcacaaacgcacacacaugcauacucaugaaagugugcaugcacacacacauacucacaguagacacaaacauauauagauggacauacacaugcauguacacacauacagcacauaugcauguucacacauguagcacauguguucuuguacacacauguccacauacauguacacucacacaugugcacaaucacacacacaugcacacacacacagacagacacacgugugcacacucacacacaugcauucacauacaaauacagacacacauguacacagucucucucucucucucucacacacacacacacacacacacacacacacagcaucuucuguuguggagaccacaugaaaaaaagaggggcaggagaggaaaagaaggaugaagaaggaaaggagggggaaggagggaaggaagagaggggaagggggcaaagcaucucuauagagcccagaccucuuagcauuuguuucuaaggccagaacacaacucagcggcucauuugauaugugcuguguuuacauacaacagugaauacgguucccauuccucuucagagcagcagccauaaauuauacauugggaaguauauagcuccucuuccaauacaaagccuaacaaguuacuaagggcucaacguggggaagugugucccaaauggagaagauaucagucuuuaacgcaaagguguaucuuaaacuugcccuuuaaguuaaagagcuaauguagaacaugacuacugagcacaaacugcauccaccacggcuggaggacuaaaccgucaagaggaaaagcccugccuucgcugagauucuacccuaguguauucauggacuucaccucaauuccagauucaggcugucaaaccaucuggggcuuugggcauuagagguaaaaggaaaggcaauacggcugucucugaguguuauuuguaauuauaacacaucauuacuucagagacuuucucugagggcagcccgcacaccaaucacuguuguagaugcuaaucaaauaugaacucacucacauuguacagcagcuacuaaaaggguuuaccacaacccccauuccagggucaucuccagcacuaucagaucuggacauaauaugcagaaagaaggguccuugacaacagaacuucugaagguaugcugguccugaacccugaccuuagggcaaaccagacuuguggaaggguagacaacagcuccaggucauacaugcagcuguggaggugggggcuguaaaaagcuccaaagaggcucuaguuucuguaaaaguauugcuggugcucagcugaucucacgagcucuaugaugggcugugccuccagcagcccugagcagucuaaguaucaacugccugaaaauguuguuuccuccacuugaaucuuguugauucuguacuucaugucuuuggaaagaaagcucaaagguguaacaguucacaggaaaacacacaaggaaacaguaaacaugaucccagacuugggaauacuaucccagagggggccuaccuuaaacaagggagaauuaugucacuggggcuuuguuagacagaccugagaucaucucagaagucgucaacauuuuccuuauuuucuagcaaguaaacacacacacacacacacacacacacuuuuucagaauccccacccccggcuuccgugagacuuaagcauauacaauguugcuguuuucgacuccccccuccacacugugucacuaacacagcugacccuggccagggcucaccauacuaucuuuccucuaaccacauugcuauacuaacagccccaccuuguaccgcccacugucucugccacagaacuacugcccuuuucucuaguucucuucuguagaaacugagccuaucuuuucagucaccugggcuccagacccagaauuugaacucaguucuugcuagucugcaaucagugaccacccuguguccuccacaguugaaagacuauacuugaauuuugacagaagagggcugaagguacacaccagggugccucuccugcaagacucuaacuguaugguggcacgaagcacagaggccucacucacacuucugauuagccagagauuuagcacacacauaaggcugugguuuaagagaagccagccuuguaauccuuccagauguuuucuaggggaggaaaguuuacaagaauggagaagagagucagggaaaacaaagcaggcuugcuaaccacccccagcugggccugcccuccuacucuacccucugagguaguuucccaccuuagggcuagaaaacuugguucuaauuucagucugaaguauccccaggaggcagaggaacaggaaggacaccaucuugcaaggggaccuuuuuuuguuuuuguuuuuucagagacaagauuucucuguguaguccugguuguccugaaacccacucuguagaccaggauggcuuggaacucagaaaucugccugccucugccucccaagugcugggauuagaggugugcgccaccacugcccgacaaggggacuuauccuaacaggcaucuuuuuuuuuuuuuucaaauuuuuuucagucaaugauuauaaggaccaaagucacuuuuauuuaaguaucuauaaaaggucuaaaaaagauagaaguguuuccaugugcuagccuccaccacgaucuucagaacaaccuagauggaacaagggaugcaagugcugucacaguguaugugagguggccagugcuuggcucucacccuucugaaccucuguaggacaagcaagggccacucucagagaguggaggcugugcaugcacaugcgcacaugccuggucuggguguucucagagggcggaggccaugcaugugcacgguguggacaugaggaaauacaaagugcuauaccagugcuguugcuaaaccacuccauucugucccagaagagccaccuccuucugccauggggaaugagaauggguagcgggugaucgugauaggaaggaugagacuccaacagacagggaaacugagucuccuggcuccacacaggagaaacaaucugacagcauaauuugacuugaaaauauucuaccucacacauguaauuaagaaauucuaaccggugugaauauguaauacacacucuguuuuugcagaugccuucucuaccgacaggcuggugccgacuuucauuuggaagaaauccauuuucauacaaagguaaccgagagugacaggaaagaggaagccuacaucauuuaucuucugugaacuuggaacgaaaucaguuaauugcuuuucugggaagcuauuuuguagaaucacagccuuccgguuuugugcucuuacuugugauaagaauggugauuuuuuuuuuuuuuuuuuuuuuagaaaacucuagucauaaauaugcuauguuuaaucaauacaucuuaaacuauuucaguguacauuuuaagaauggaaauaugaucaaccaaacagcuacucuauucuuguggaugaagaagcaaucacaacuaacaguuaacagucuguuaacugacacucaacuuuagagaucucuuucaagaccaacaaagcuagggugacagagcuggcucugcccauuggauuuuaaguaugguucccaucccagccaucagacgucugugcaauaguguauucaaaucacugcuacugaucaacagcaaauggcaguaagacauacaaguuuuuuuaauacugaagacacugaaaacuucccaaaaggcugacucuguagucugugacacaccuucccaagucagguccuacuuucauaugcuuucuucagauucuucaagcagcaggcaagcgaaguauaacacuucauagcuccugauguaugugcccaccccuauugcucagcauauaaauagguacuaaauuugagccugauauaaaguaccuuucaaaugaaaaguuacuauuuuaaaaacaauuuugcauuaccccaugagucagagauggaaagaucuuaguauuaggcacauuuaaguuucauuguaaccaaugcuuaggaagaaccuugguaacauauuuauauaguuauuuacauguuuuauaaaaauugcaaauuccacaaaacuguaucaacuccucuauuuaguaguccccaaguguguguguaaaacuauucaccaugccuguccuaugauguuguagaaugcaugcuucagccauuaguuaaguccccugccucucgccuaacaacagauaccuuuccaaguggcacucuaggggaaccccacuuaaugagggguggcgucaagaauaggagacucagcuauaacaacaaaaauauguuuuucauuaaaccccaaacugagcugggauaagccagcugaggcaggugcaugguuaaggaauccucuugaggcuuuuaacuuccacaucaaaccgcacuaggucuuucugcacuaauuacccauuauugaagaguaaagaauuauaacaaauaacucuguggcggcggauagaauacaguugaugaacuaugagcaaagagauccaagucucuccauuuuuaaacaagugacaaucggugucccuuuacaaggguagagagugugaaagaauauucuugggacuagaagguuaauuuuaaaauuaguuucgacugugagauaaauugcaaauuaaaagcuaaguguuugagagcaauuuauucaauucauggggauagauauccugaaggcagagaucacauuguagauuuuuaauaucucagugauacugcaccuagccaccaucugaccaggaaugugccuacacaauaccagacagcuacuugcauauucucccucccuuccucccuccuuccuuuccucccucccugcucucucaaaucucauuuauaucuaacacaucuuucagaaucuggaugcuugacaauguacuaagucuuguucuauagcuaacauucucaaguacuugaggaauauaagugaucuugucgucacuuccucuauauuucccuagaaaacacuucccauacguuacuggaaauaaguguuacuaagaaugcauuuucagaaugggauuauuuuuuaagguacagacacucacacacauauguacaaagacacaauauacacagacacacagagauacacacagauauacauauacacaggcacacacagauacacccauacacacacacaggcacacacagaugcacauacacacaugagauuuucaauugcuugcuaugucagauuguuuuucacuccauaaaguaaaucuaguugauaaaauucaguuucuauguuguuacuguguguuuuacuggaauagccuaaaacuaccaaccugcagaagggcauuuguuaaccuccagaaaaacaguuuaaaagaaucuugucauuugcaggcagaagugaagaccagacgcccgccauuuugaaugagucuauugcuuacuguggcagugaacuucauaagcagacauggcuugagagucaaguuaaguuuuuccuaacaugcaaagcuuuuagauaacacagagacugacuccucucucacaccagcucgaacugacucaacagauaacacuccaguugccccauuucugccaaugcgugccuggccucacuggcacacucaggacagggugugagaaggcagcagacugucaguuuccaaggcuguacuuaggagcaaugaagcaguuucuacaugucgcucugaccuuuccgagaugcccccucucccaggcacggcccucuggcugugaaaucacugcacuaguacauagcaucguuuucccuaaucuuggauccucacagggcagcacaacaauguccagacuacugauaauaaugccucccuaaaacuguauggggaucugcgcaaggcuccuggguauaaaaauacagcucggugcuuuuaaccagaacugacuaccucacuggauucuaacugaacaguuaccugauaaacaggaguuccugcuguaugaaaacaucauuuuaauaaggauucaacuagaaggaaaacuauaaauggaucccuggagguguaaguuggccacuagauuuucucugccaauagagaucauuugauagaaaugauaaaaccuagaguuuggaggaaaucaguuggauauaguggucuccauguauuucuuacagacuuuacaaacagaugccuaggcuuagcaguugagagcacauguugccaucuuaaaguuuuauucucagcauccaugucaggcagccaccuguaaucccaggucccugguauccauuaucucugauacccaugaguaccugcacucagguauacacagacacacacauacacacacacacacauacacacacagaaagagggagggagggagggagggagggagggagagagagagagagagaaagagagagagagagagagagagagagagagagagagagagagagggagaauuuaaaaaauaaaaaauaaauucuuuuaaaaagaaugcuuggaaaagcuacauuuugcuuuccccauuccuaaggcuuccugcuuccuaauugcuagaauacauuaugaacuuaugaacguguaaucaaaagaaguaucgguucacacaucacgacauuuccuaauuaaaccucagucaacaccuccuggaacgcagacaguuugcaaagguaacagggucaugucccacuggcccauggagagcucugagacgauagccuggaaacucucugcucaaccucaucaaaagcacaacaggacucaucaaauccuuugucuccuuugguuauuacaucagacuaagaugugaagaacaccccagucacaucauuacuccaucuuuagagaagaacaugucaaagggaaaacaacuuagcaguuccuaagaaugguguuagggaaaaaccauuccagcuacaucacggggagaugacaaaagcaaauaugcacggucaugauuucuccucauguacuccugacaaucauuaucaauuugggagacacuaugagacacacuacucuaaaaggauugcuuuccacccagauucaagcagcuagucgcugccuuuccugcgaccuaucgaguggcgggcuugugggggauucucaacacucaauguauccacuccacacauucuguaaugcaaugugcaaaugugaauucucaacacuauccacuccauucuguaaugcaaugcacaaaugugguagaacaaaaucaaagcacaaagcaggggcauaugaacugaaguacuuccuucugagaauacgucuacacagccuaacacaagcgcccaaguaaagacucuggcgaauaggaaugacuuggaaucauaagcuuuauagagugggugggacaccuaauauaugggaauguugaccagacuuaauauugauuuaauacuugacaaauucuuacuuauacacuguacaaauucaaauuccauuaagaaguuuaucauaaaacuuuucaaauuugauuaaaacguucagaguucugaacuauuuuauggaaauauuuugccuccuugaaagugaaguccauacggccuuugaagugucuuauauugcugcuuuauaccuuagucaaugccaucuuguucaugaaaucccaugaccucaacugaaggaggcauuccaucgcuaaguaauuccuacacaaccacaaacauauauauaugcauuucaguauaagacaacccuauuauaaugaauuugaaaauaucaaaauuuacaacuucuauuugcgggcuaugaaucuuaccacaucgcuggggagaugggaggggcagaaacauaagacuugcauuuucaagucaggcaaugacaaugaacucaccucugccugcuuggggaugcugaacuuggcaagcuuggccuuggcucgggcugacucugguuuguuggccgggaccccucuguaggcugugcagugcacagcaguuucuguggaugacuucagcuuaggagauucgucaggagcuugguccuggccauccauuggccgcacguaggcaguugguuucugcugcaccaggcuggguuuugaagccagggaugggggaaaguucugaacacaguguccacugccgccgugcuuggcugccauugcagguggccucuccugggucugaagccccgucuccauauugcacacuugcuuggcccuugucugcugucugccaacaccaucuccaagcaagguccugagagagcccuguugcgcugaguuggaagaagaaggcagugauggugaggaugagguucuccacacacagugaacagguuuugcauuguggcucuuugagaucuguacaaagcaacugccucaugccccuccuuaccugcucucuguuggccaucggacggugggugcccagccuucugccagcccauggcaccucucuugcccugcugcacagggacagcugcagguguagaggacgcagugcugcagacgguugagggcuggggcugggcucucgacucugccccaaaaugcucaucuaucuuguucacgggagucugagggacaccuggcuuggggacgccaacaagaugacucugguuggaucuaucaguuaaaaagucuuucaucucaucauaauuuccuaauguauucuggauccgguuggagaguucaucccccuuguucgucuggagaaagaaaaauauccaaggaaauguuggagacaagauacaggcaacaguggacaggugccugucagguaacaaagacaaggcugauacacucccaauaaaaacucagggacaaaauugaaguccuuaugggcucugaagauagcuguuagccuccgcauuauucaagaacuagaaacuuguaauggauaacuuuacgguauauuaacaaacaguuguuacugguauuugugcuacggccaaaauguguguguguguguguguguguguguguguguguguguguguguguguguaauguauauguaaccugaaaaucagaaaauuuacucuaacuacuucauuaaauggucuagauuaggucuuucuagaauaaguguaucauuguuuuguagaacuacugaaagcuuuucuugaagacuuagguuuggcucacaacaggguugcuuccagaucccaagcaaguacuuauucuuguuagaagcacaggggguuaggcuagaggaaucacaguaaaugagaagcuauacaagauuaaauauggaaaauucucccgcccuaagcagaccauguuaccauguuaccauacagccgaaaaguaagcgaacucuuggacaguguuucauuuuggaagcgagaggaacucugcagugcugguaagaagcacagcaugugugagugugaguguguguguguguguguguguguguguguguguguguguguugguagcuggcaccuccaccacaaaagucauucugauacccuccaaucuccuuacaugauccacacuuaccaaauauauaaccuagccucuuuugaaugggauagaagagcccagaaaacauuacagaugcauuaauuuuggaaccaaagagauggagucugaacuccugauaaaagucauagcaagugggucucagugucacacuuuacuggugacgucaggggugugaaccccacugcgugugacaccacaggagcaaugggaucuuccuaggcuaaacagaccaaaaaccaaaauggagucucuuguugacucuugcucagggccuucggggcggcugaaagagaaggugaacagcugaaaaccgucuaccuuguaggguucgcugaagagcgaguaaccggaguuaaagcugccacuguccugcuguguuucuugacuucuucuuucucgcucuuuccuccguaacgcauuccuguccgguucauagacacugcaccaggagaaaggaaagagaacaacccccaaaauuaaagggccaagcccaaagucauguacaucugaacgcagacaucugguuaauggauaaaugacaaugacugaauagacagggaugagauuaaagcugggcucagcaggccagcugaacuccguggcugaaaaucacguucuuccagaggacagguuccaaccagaauuagacgcuucugcccgauaugagggaaagcaacuauauaagcaacucugucagaugauggagcgccuugcucagguccgugguaauuacuucaauguguaaauacaaauuaugaggcgacuuccuccggugacacucacugccucagagugcuauaugggaauguuccuggcugggagugugugugugugugugugugugugugugugugucucgugucuguguuucuguagugauucuaucauuaacuagcucccugaagagcuguuaaagcuccaggcuacaguggguuucugcuguuacgagccuccuccugaucucugcuaaucagucacaucgucaaagacgacggaaucaauucuuccuucugauauauuugacacuaucgcuccuccugaccauaaaaaguggguuaggaggaggggcugcaggaggcaaaggggaaagauggaaugucaucccccucacgaggagaaaaauaaagggguucacgaaacuagugaugagaaagugacugguaaaaggaggcacacugaccuucugggcucacuggccuaguguggacagacacacuacccaucagcaaacguauacccugaaaacuugguacuguccucauuucuuagcaaaagcaaagaaugaugguggcaugucugcuuggucuggggagcaaaguaggaaccaagaggccuaccuauuaguuaaaggucuccucaaacaaagaggcgacgacagaaaagcuacucaaccccuucgcucccagguaucuccguuugagguugggaugucucagggcacugcaguaaggucaaagugaggaugugguuguagguaauucagaagaaagagcuaggacauuggaaauccaggauauugcuauuaaaacacaguuauaaagaaaagggucuguggguuggaagaacuuuaugaaaacaguaguauuuugaauguugaaugccuaauuuuaguaccuguguugugcacaugcagggggcaugagcgacacggggauacagcgauuaaaaggcacuccucaucucaguucagcuccuguggccagggcauauuuuaaagucacugucugaggggcgauccuacacaugcuucuggcaaggcugcccgugcccccgaggcauuuaauuuaaauuuaaaaucaggaaaugcuaaaauauccagagcaaggaggccauuagcauuuuaauucauucuuaguacauuacccaaaguuauuagguucgggagccuaaccgguguccuuacauuaaaaaaaaaaaucgucuaccaacagagaggcucauccuuccgaugucacagcccauggcugagcagcgcaauguggaacccccaacacacucaugcaagcccaaagggauggcugugacugucgugugcugguaguugcuugcccugaguccccggcuucuguaaacgcugcauggguuucacacacugacaggauggaaggacacaugauuuaugguacaggggcaugaagugggcuuugagcaacaggacaacucuagucuaucaccaacuucuaccuuuuagacuuacaucggcuggcauuugaagggggguaaauaaagacuuuauaucccacgccucugaacuucccuccuccggcaccuggggugccgaccuucaaacagagaccuccacacacaugccaugcaggccaagccaagcacacacaagacuggggugaugcauggaauggccuuaugcaggaugaacaaggugggcuucugaggaggccccacacacccagaaugauaccuccugcaucugcuggcugaugccugaacuuccagaacuagagaaucauuccucuggcuuaggauaucuucaccccuguaagaaauacaaacaccacaagaagaaagagagagcgcuuuaaaccuggcaagccugcaugugguaucguugcacguacaggucugccgguauuccccucaaaggccuaugggaagcugcacauggacacugggauccaaaugggaggugugacacugcuccucccacccccaaugcaguguuaggacagaggaaaaaacacagcuuauucugcaacaugguuuagaugucugagaugaaggcaagggaguggauaccacagucagcucaguggcuccccaggacuuuggaguaagagucagaucaagcuggagcugaggaaaagcuguucccguguaaaugaaccccucccucuuucccagccacuuugggccugaagagacaaaaucaaaaccaguccaagaugcagucuauggcugaauaaaaguuuucugugugguucagcccaucaaccagacuauguaugauuucaggcagaagggccaaguacccuuacaaacaugggucaggacauccaacagaauagcugcaccugccgcccuuucucagggccaccacaaagccugcacagugcauucacgccaucagaugacccuguguaggaccauagucacguaaccaaaggagauuaaaggaaacacaaaagaaaggaccagcuuccuccaugccuccucuuuggucucugcuucuucuacagccuccacugagcagaggcaucccacccucuccuucuuaacuagacaugaagcccccaggucugaugucaggcuggaggagcuaaaauagcaccugcucacagcaaacgccacucugagagaaaggcaggaucucccacguuucccaaucccucaccagugcucagcccuuuugcuccuauagacagugguggcuuaacuaguccaccucugcacuaauuacagaaagcauccacgcacaagcuggcacgggcucucuaucacccugagagagcggccuccaccccucacuuccuugccccugcagcaaucugaggccugugccauuggcuuuaguaccaaaggcaccuuuccccugaagguggcaagugggucggcuuccucaggaugucagacugguccuagauaauccucauuccuggcagacugguguaccugguaaacucaguaacugccacgccguuucugccuugcuaacagaugguaaagauucuaucaacuguuaaaguuuucccuuauuuccauagaaaucacaggaaucacacccccgaaauguauaucaccaaaugcauuuauuuauuuugcacagaaguguggcagucaaccgccauaauguuauuuauuauuuauuaugaaugcagaacagucccagaaaacggaaucuuuuaaaucaacuccuuaaaaaaacaaaauaaauaaaauuacguuuagguuuuuuuuuaaagcaaauuuuaaaaagauaaaaauauuucugauuguucuucauuuacuugauuuuauucuauuaagccgggucucuuguugggcucaagccaaagccaguauggaacauggguaagaggaaacaucuaaacaagauaauguccaaaacuaaucuauccuuaaaugcaaggugaaaacaugaaacuaaguaacauuguuuguaacucuggggacaucuuccuccugccacaaacaccuagacagccaccugaagucugucugcugaguguccuuacaaucccuguuagauaaagacagggguaggagguauuauuacuaggcuagcuuuucaaaaucaagggcuccagcauggcuacacacuuccuuccucucaguccuuggaagaugggagcaggaggaagaugggagcagggggaagaugggagcaagaggaagaugggagcaggaggaagaugggagcaggaggaagaugggagcaagaggaagaugggagcaagaggaagaugggagcaagaggaagaugggagcaggaggaagaugggagcaggagaaagaugggagcaagaagaagaugggagcaagaggaagaugggagcaagaggaagaugggagcaggaggaagaugggagcaagaggaagaugggagcaagaggaagaugggagcaagaggaagaugggagcaagaggaagaugggagcaagaggaagaugggagcaagaggaagaugggaagaagugaguccugucucaaacaugaggaagcuaaauggagcaggguauuuagaagaagaguuagaccgcucaucuuagauccuuaaaaagggacaugcagaagagacagcaaaguccaaagcacuuuacucaucgccaccgagagagaaggagguguccacaaaccaagaccauguccauaagccaagggugaauuaacagaaaacacagaaacaaauaggauaguugaaacaaagaagcuauuccccauacaaaaagaacaaugaagaaaaguauguuaguaguuacaauuuuucccaguuuccaaacaacagaaaauuaucuuuuucuaaggagcccuacagacacacacacacacacacacacacacacacacacacacacacacaggauuaccaugcauccuagacuugcaacagacaacagaauuccagauccuaaacagucacaacuggugcugacagcauugccuaucccagucucucccacacugugcucgcuggaagaaaaggugcugaugagugcagccaacccggacagcugagcccagugcuugaccuacccaauucagcuggccaggacaagcacucacccacguguagcccacccacauaggagcacucauuccaaaccaacugccauuucccauggagguggcugucagcaaaggguauauuggagccaaccucagcccuugacuggaaucauguuuugcucuuuauaaaaagaucauccuaacuuacggugugucuccaaauuagggguuuagcauucacagcauuggcuguuguuauaacaaaacaccugaggcaguauaccuuauaaagaaaugggggcuuuugguuuuuguuucaguuugggaagcugaacauccaaggucagaugguuuuaaucagcagugauggccuucuggcuacauuguagcauaguagauagcaucauuuggggguucauaagaaagacccaaaggauuuaccauccaugccacuuaugccucaacucacccuuacaacucaacggucuaggaaagaagagugguuuuuaaugcagagaacaccuagacuagaugccaccuuuucaaaaaguuccagccccacagcacaaggcaccaugcuuucaacaaaggggccuccgggaauucacucaugccaucuccaaaccauggcagggacuagguaagaguugagacgagagucauaucuccugaccuuuagggauauuagucugguaaccauguauuuaaagaggauaucuuucaaacacagaaagacagcuuaguccaaagccaacuccucaguucuauaugugagggaaauacucggggcuacggccaauccuuccuacugcugagaagaucucagaacaagagagaaaggaggaaggagcucacucauaagcagcguggguaccagguauguagacaagcucugagcugggccccguaggagggucggguagaagagaaaccacugagugguccauaacacagaucacugcugggggcggggggcuuuccagagcuuggggcggcgaccuucacccuuggcaggcaacaugacuuccuuggcuagaacucuguuuucagaaucccacagccuagguuuacccacugccuguccugacugcucuccucagagcagguuucucuagccucucccaagagcagaggauguaggaaccccagggaacgcucuccccuucuuccauucuccaucaaagauagcugagcagccuaccacggaggccauuuuucagacacuuugagcucugggccagcacacugauggguaugaacacccagaaggugaacagggagagggaagcaacugguggcaagaaggagacugcggugccucaaaaacuccgcugcucucagccggcaacaugagacgcuguguauaauuaaaggagucuaaucaaacgccccgaauuuuuaacaauuguuuuagauuugaugagucaaacuaauuacaucuuucguuauuucuaaaguaaacaauaaaagacccggaaucccgucucaaaagaaaggagagcaagaugguugagauguuauucauaaauccccuccaucuacagacuugguggacagaaaggcagccgggcuuaaaugggugaaaagaagcaaucagagacaaggugauccagaguuccagucuggcagaaagacgaaggugucccagaugcagccccuuacggugguaaggguugugugugagguggugagccuguggauggaauggugaugaucccgggagagagcgagcugggcaauucugacacaacucaacacaagcuagaaucaccuaagaagaggcuuuuggugagagauugucuagaucaggcuagccagugggcauuucuggggggggacugucuggauuggcgggaagacccauuuguggacacugucauuccgcgggcuaagaguugagaaaucuaacaagcaagcaagcacagaagaaugucugcacucugacuguggcuagagcuccuauguuggcuuuccuacaaggagggaucccaacuuggaaaugucagacaaaucaaggaaacuagaauagagcaaggugugagaguugugugauacgguugaggcuggugguggugaugagggaggcuguacuaggacagugaucgugguggugguggugguggugguggugguggugguggugguggugguggggugauugugguaaugguggugaugaggggggcuauacuaggacagugaucguggugguggugguggggugauugugguaaugguggugauggugguaguagugguuaugaugaugguagugguggugacagugauaguccuaagggaguuucugaaggcaguauugaaggugaccaggacaguaguuacaugccugcuaaggacagaaaaccguucaacaacgcacagucucuucaagcccccaagaacguuaugaugucucugcucccuuaucccggcuucuucuuucugaguaaagcaauuucagcucccagcucacuucgcauauccugccagccuuacacacgcggcccaccaucucccuauaaguggaccccccucuuccucguuugccaccaaccauggagaguagcuccaucuuauccucaguccuaaggggcucugcugggagcaucuguagaccucggccuuggguccucugauugcucuugcagaaaaacgaugacgcugaaggcauugcacaccugagucuccucuacaccacguucugagagagcuauaauaucacacccagaugaaccacccacaaaaaccccaaguaaaccuaggggugaucuaugccauucuccagacccaucugauuuguauuaaauuuuccaauaaugacagcuacugcaaauggaucucacaugaauuauuucauuuaauaaucuugaaacucccaagagccauuauccuuaguuuccaaugaagaaaacaagaggcucugagcauagcuaacuggcccugucccacgggcagccaggagaagcucuucacuuagaagcccggcagucuggcaccagacauagaauuccucgacuccacugcacugccucucuggggacagcccccugacaagcuuugacaaaugguacccccauccuuuguuaguaaaugucaggcugaaggguguuaauuucaaauggugacuauucuuuuaagauuugcuagucacccuugauugacucaauuuuacaaauucuguagucaaaaacaaaauaagcaaaaaauaauuuaaaaggauacaaaacaucaaaccaaaccaaacaaaacaaaacaacaacaacaacagcagcagcggcagcaaaaaacagucauauuacuucaauuaagacaacaucagccccucacugacucuagacugcaagaguuauaauccauuucccuauuuuauccuguugagguggaauuccauauauggaauuccuuagaaauuacauaacaacguaauaagagcauucuguaacucgcauggugagguuucugcugcaaccuggaaggggaccugcugcaccaagcuuuuacugaucaucuucuggguccaaacuccauuucuaugucccuggaaaugaagacuuuagaauuucucuuguaaacauccuccaguggauagagagagagagagagagagagagagagagagagagagagagagagagagagagagagagagagagagaggugacagauaaaugacagcuuugcauugccaaggguuaaauguuuuuccugagggaggccuaagccuccauaccaugagaacaagugucaggcgcuaauggaauuguuccaugauaaauaaacugccaggcuggaugacaagcagcuuucaaagaggcuuuccauauagucuaaccagcagaaguuaauuugaguuucuuaacaggaccuuuucccuucgcaguguaaaagugccuugggaugaagcaauuacucugauuuaccaucuucuccuugguagaauauaaagaugcggcgagccucacaaaagcaguaacuuagccaaaugagacuggcuugcaaagucccuacuaugcuauuuccaagcacucccucccuggcagcagcacggagcugccaucaaucacgggugcccgagcugacgcggguggaggaggcugcuuccucucagggcugugcauguuggaggcaaucaaucauguuucccuacagcaaacgcucaguuaagauuugucuucacuuugcagcauguuucccaaucucagcuucuaggaacucgaagagcugcuuauggcucugccgaguuucacagcauucauugccuguguuuuaaccaggaugcuuuucuacacagucacugucuuagccacucugggucauugagcuggcgccucagguuugagguuaucaagauggccaaguugaaucucccaaguagaucaggcuccugggcauagagcugggcagacugaguguuagcccuuaaggaaugcacuguccucuccugaauccagccccucgauaugccugcccagaaccaccuuggagauacgcaccuacugguuggagcaggcuuucugcaaaggaaugaauaaauucaggcuacuucuaccugcugcccugaauuaauuuaccugucaggcacagaacuagcugauggccagggugaaauccagcagagcugacuuucaacagaauaugcacgggaccaacauaccuucugaucauacaggacaacaauuccauauagacagcauggcugaauuacuuauaggggaggggagaggaucuguuucugcacagggcaguuuaucagcuuaaccuggagccucguaggucaacagagugggaacaaauaagggacaacauuuugaugcucuccagcccugacagaaaacacguaacauucccugagaauaaagcuguaaucaugccaccacaaagcuggaccgggguguagagccuugucacagagcaucuggcaaaccaggcagauucucucucuauuuucugaccugcaacacugcccccuuaccugccccacccaaccagauucuauuugucuccucugagcucugcagcuugcccccaugcccacauuccacagacaaacucacuuugucccaugugcucacugucuugggguuuccuggccuuuugagagagacauauucaggcauuugagacaccagucuuuaagaagggaaagcgagcaguucucccugccuguuccucucacguggcccuucccugucagccaguuucugacacuuguuggcucuccccagcgccuggccuggucuccuguccgcacgaucugcuucugcugcucauggccagcucguuacuucccugcagggcuaacccaugggcaggaucacuucccaaccuccuacugcuaacacugucuugacugggugccugagguacuucuaacccccuucugcuucccuguacuaccccggggcucaaaggggcugccaugcuaacugagucuuuccucccauuacaguccccugaccaaugucugacuccagcacugcucaucauaacguccagucaaucccuagaccagauacagcuaagcggugcuggcucuccuccacuggaaccucccuacccauaaucaccacuggguccauccaagaccccaggggccuucccaugcgucuccuagcuuuucuuucugacaguuaagugucccucugcaucuacucugguuugagcgugacuagaaugguccucuucgguccaugcgugaaggacuuaguccccaaggugguguuacuaggagguaguggaacuuuggaaagaggggcucuucagucauugauagcacagccacuaaaagggcaauggaggcauuaauagcccucuucucucaacucugguucaagauguaugcacuuuguuuccauacaugcucccaccaugguacuccaccucaccagagacuacucugauggccucgcuugguuuuggauugaaauauacaagacuuugugcugaauaaaacuuuucauuaccuaagcuuagcugccuccgguaucugaaguaaagcaaaucugaccaaucugacacuaaagccacguggcauuucuuaucaggucacugcccugcccugaggacagagggcugacucaggaccccacucacccauccucagucugagauaggcuagucucuaggccacagucucucucugagccugagucacuuaaacaccuuugcuuuccagcugcucaccgcacccuaagcccaaaccucucccuugaguaauacuucuccuccugagcaugcccagaugcauccugguauacccaagggccuccugcauccuacagagaacgcugcagcuucacagugacugugccuaugcagaaucgcccucugcaccgcagcucccucagaagucgaucugugcugaucugugaaacugcgcccuccgugccuggcgcagagugggcacuggaaauuucuguuaaaaacuuuaaaaauacauaguaaacagaaguucuuuuuaucuccuuccuugcccaaacgucauccacagauauaaagcaacuccaacaaauacaacuaaaaucauuugcacaccgaguccugaacuuucuuuaagauucuggaauuuaacaaucaugggaaucauauuacaggugauucugagcaacugccuggugcugggggcguguaaagaaguuugcccuugcuaccauguuugucccucucugcaaagcuguuauauagcacuugccacuguuugaaaaagcauuuuaauaaaugaauauauaaauacaaaagugaaauaaaauccaugugccauaaacauuauuauaaucagcuugcaaaauaaagaccuuucaucaauaauacaaaaaagaaaaaguggggcuuagaaaauuaacgcuauuuucccaaagcacaaaaucauuacaaccaggaguuuuaguccuuagcaacuguggauauuaaaaacauuguaggcucuaaaauacuauguuucuuaauucacaaauuaaguaacacuucuaaccuacaaagugucagccagacauggaaaaaaaaaaaaaacacacagcuuccacaaggcaccgugaaggacauuucucuggcuuccuauggugaaaacuccgcaaucaguugagcucgacuuggaggaaaacauuaaggaugugaaucauucaaacgguaugucucuauaacucauucugugcugccaacagcagagaugauuaauucuaaauauccauauaacacagaggcaguaaagcaaggggucuucccauagcugacagacuccuucacacacauucccaaauccacaagacauguaauccaucauaaaaauacugcauuugaucccaagaauguuagcagcauuauauauuacagugcuacccaugcaaggugauaguuaucaugacucuuaaggagauggugccaagaggaugugagcucuacccugcuguuugcuuccucauuguuucucucggcuucccuccacuucucuuugugccuucccucuccaccccccaccacacacacacaaccacagaaaagugagugugcccuggugggcaguaaauauaaacagcucugugaauuauuaggauaaauuuacuaaugaaaauaaaccuagaaagaaggcccuucugccucaaaacugcuauaauuuuuaacaagaguuaggcaaucuaaaggaggcaaggugggcauuugguaguacacaacacagguggggucagggaagagacaccucaugucucucuucucuccugccuuugaucucuuccuagucagcacaucucaguguucugcugagucagcacaucucagucaucugcugagucagcacauuucauuccucugcugagucagcaggaaaccuacaauucuguuagcuucuaucccagcuucucagauuucugggugcugggcggggggcggggguguguguuacccucucuggaacuucacagucuuggcugugagaauuagcugagcuuguuaagauuggccgaaagaccacaauagugccauacuguccuuuuaaaaguaaaagucagaagguguuaacaaagaguaauuuccuagugggaagcauacuacagguugagcaucucuagucuggaaaucagugcucuaaaacauuuuaaaaucuggggauguuuuguaagccaacaacauggcauaagcguauaccuguacuucauaauaggucacugucaaaacacagaugcauugugaguuucauguguucaagguauaccugaaacaaacaaaccacgucacauuugggcucuauucccagaauaucuccuuauuauauacagaaauguuucugaauugcaaacuauaaaucuuuuacauuuuagacaacaggcaaucaagcaggagaaaaauuaucaaacuugaagggcucuugaauaagaagcgaaugacuuggaagcagagaagacagaagauaacagaaaagaguccccaccgaaccaaaacacuucuuaccacuggcccuguaauugccaagggucuggaucauuuucaaagaacuuaacauugggccuggaaugaggagacucagucacuaccaaggaagagacaagccaggagccacuccaugucauaggcucccuggucaagcacagguaauaaaacuaauccccacaucgacccgcgucuaggacacaaaugagguaaugaacaguggucugugaaaacgucaaagcauucugucagugugaaauauuacuaaugccuggauaagcuguaacuaaaacgcccaccaugaagaguaagaaaacccacuccuuauccauuucagaccauaaucugggaagccugucauuaauuacagaccuugagacaauacugaauuuggaaacguauaccacaaacauguaggaugucacuucaguguuacacaucgacagcaaaacaaaagcaaauuugaaacuaauuaacuauccaaucuugcgggggcugguuaggaaauuguacugcuacguacaauggaaggcuauguagccaugggugggaugaaucugaaugugcagauaugaaaauacccagaauccauaguaaguaagaagugcacacuguggacgaacacgggggacgucaacucuuacgcaaaacagaccguucaugauaacugagcuaucaaucucugagaaaaaccacgggcuacuggaaaggaggcguuacacuccgcucugcuugggggccguguaagcucgugcugcuucucugcuucagucuuuaacauaucagugacgaugugaguuuucaucugcucucugaauucugagguggcaacauguacaacacuuuaagugugauguaggauauaugccacacaagaccagaguccuuguuucccuaggauaacuuaacccauuugcucuacaaauguaaucuguagacuaugacgcuaaacaaauacuaugaguucaaagacauccuuagucucucuguacuaaacuuuguggguuuugaggggaaaaauacuaucuaucuuaauaggucaagcugcauuuacuccaaccaaguguggauuuaggagaaauaauguuuauuuccuccacccccaagauagcacaaggcgguaggucuucugauaucagaagggcccuucuucaugaagacaacuuguuucccagagaggaaaaaauugagaccacacgccugugucuaggugccagggacuucugacuugcuccacuccccugccuacagacugacugacagcucuacagacugacagccuaccccacccagccucucucccacucaaagaucuccuauccuuagaauuccaucaaagcuuucagcuucugcauaaaaguuaacucccucuuucacuugucaaaccuuguggaauugaucauuccuguuucuuucuuagucaauaaguaauaagcucuuauuuuaggucagaauaaauuauucuuuuuuuuuuuuuuuuuuuuugguuuuuuucgagacaggguuucucuguauagcccuggcuguccuggagcucacuuuguagaccaggcuggccucgaacucagaaauccgccugccucugccucccaagugcugggauuaaaggcgugcgccaccacguccagcagaauaaauuauucuuaagauuacagugugcuuccuuccccccgccccccaagaauucuauuuugagcggcugucacugaccagugucuacaaaccuuacauaccaaggaagccaucaauaauguaacagcacucuagcauuaauauuaagcacaucacauuuuuuucuuaaacacuaaagcuuaagauuaacagacucucauucuuucacuaugaaaauauuuguaauucaaaaaauucaacauaucauuuccuagucacauaaauuauuaaaugcuuugaauucuugaaagauuaauaaauacuaaggacuacauauuuucacugauaaucagaaaaaaacguaccuauuaaagguaaaaccauuuuuaccuucuuggaaaucuuggaaaagauuuucuaaaauuugguaguguugagugucaggugacacuggcuucccacacagcugaagggugagaucagaauaaacugacugaagacaauacuguaaucugcaacauacuucuagaaccuuaaaaaaaaauaaccuauagacuuaaagauaucucccuagguauauaaaaaaguaaacuguuagaaauuuggauuuauguccauguauuuucauuuagagauuauauaugagaaggaacuagaaaaauauauuguacaacaaucagaauguaauuaaaucauuacuuacagaaccauaaaacucuuguacuucaauauucagugucacagaaaauuuauaguucacucuuaaaugggaaaagauuaaagaugauaacaguuuuucucagauuaugcaaugguauauuugugaugagcguuuauguugcguaggcaugcgugcuuggaaacaagaaaaucuaacaauguugcaaaugguuccucccgagccgcagagauugggacuucaugaacuuuuuccgcaugccuguuucuccugaauucuuuaccuuuaacgugcauuucccuggcacucauuagggugggauacucuuaaaagaacagaaaacaauaaagugauugugacacuggaaaaacuggagcucuugugaccugucaggaccauguaaaauggcuaggcuccuaggauuagguugcagacuaacaauacauuucugguuccguaucccaaagcagcagaagcagggucuuaaggagaugugcagagaacacccaugugcauagccacucggcucggcagccaaggagcagccuauggacagauacacagaaucacgggaguaccgaccaacacauggaauaaauaauauucaaccuuaauauggccuauaaaguuuugggauacacucugucccaucucccagaacccacaugguggagcucuauguggcuucagagugugacuggagagaaguaauuaauucaaaugaagcugucagggcagguccuaacccaauccgacaaguguccuuaucaggagaggaaaucuggacaaagacaccagggaugccagcacaagaacacaggccaucugcaaaggcggcaggaguccagccaccugcaagccaagagcacaggccacaaaggaaacggccucaugacaucuugaucuuaagccuccagcuucagagggggaagagaacaaguuccuauuguuugagucaaccagccuguagcacagacugguccucacaguguauacccauugaugggccgcgaggacgcuagguugagucaaguagccagccacauauagaugaugucacauauucauuguaccuaaaauagcaauauuuaaugagacagagaagagacagaaaggcuaggagaguaggaaaugagcaccugucuaauaaacaugguugcuauuuacaaaugagaaauccuaaggaccaguuccaaggcagcagcagcaaggcgcuuacagauacuggacugaacagguuagcaugccuaaacaggagcacauugguauacagagaggcgguuauauagagaaauguuuuuaauauaugcacauggagaauuaaggcuagagccauuugagcagcaaaacagaagcacugaaucgugaccaaaaccagaaaauaaguacuuuucuaucugcacacugccaaaagagaaaugauuuacuccacaugaucucgcacuguccggcagacaagucuaggaacauucaugccccacuugcaacacccauccuguugcugugacacaguaccugacaaaaacaguuuaaggaagaaccaaguggcucacggucugaaaggaacugguucaugguggcucggacagcacagugcuagaacugguguaccuugaaucucaggcagcagaagaugcugguguucagcuagcuuccuuccucuugccucuguauucagagugggggcccuccaugggguaguguugucuacacucacgguaggcauuuuccucauuaguuaucaucucuguagcccucacagacacacucagaagaggauauccuuggugguuccagaccaaagugccuucccagaauauuccaacgguaguaaauaagcccucaucuuguuuuacuuauuguuguuuuuuuuuuuuuuuuaauuauacaguauaguuuggcccuuaagcaucacuaacucagugaucuccaagaacuacagcuugguguaacaagauaaauaaacaccauaauguggcacaggaagggaagagcaggagaaaggacaccuuguauauaauuguaucucuaugguguacaagcuaagugcacaaaguagcuguaauuuauagucuugggauugaacguaauagccaccucuggagaggggaugaggaugugauuagaaagaugcccggggagaguucugagguucugcaacuuucuauacaauuuaaucacugauuuguguucuguugaagcucagaucaacucacugaaccgaagcugacccacugcuucugacuguacacagccaacugcagcugugggcugaugcagggucagaugcugugagggcucugguuuuucucucucuucuccauaugguaauccgacugacuaagcaccaauguuucgaaagaccauaugccugaggguaagcugcucugcagagccaacucugaugauacaucaggucaucuacauacagacagacagacagacagacagacagauagacagaacaaauggaacaugcagagacccuuucaaagauauucuaucuuggaccaacacuccaugccucaaucacuguagguagauaauaaagucugguggacuucauuuccaacaaauuucuaagacugguucauccuucuugaucucuuguacuuuuaauaccuauuuugcaaucaguuugccaauaauaaucuccacacaacugcuggaacucaacuggggacaagcgcaucagaccuuccgacgugucauguuuaugaaaucuugugucaaaugcauaggcuugaauauggagcuuccuuuaaaaaaaaaaccacacauucacaucaguauguuaugaaguagaggguggacaagaaauaaauuccauuauuaaaaaauaaaaagguuggggcuggcaugguaacauagaccuuuacugcaagcacuuagaaggaagaaaaaggaggauggaaaauuugaagccacucugggcuacacauugauacggaauggcucaaaguaauaagaaugggaauaaaaauaagaagccagacuugagcacauaaauagcccuacaucuauuccuuaauacagcaugaaacugugugcaguaggauacaucuauaauuuugcuacuuugaccuuuggcacuagguguaaucggguggugguauacacccauaacccuagcucuugggaagcagaagcaaggagaucagaauucuguuuggccauccucaaccucauagugggcuggagaccaucuugggcuacauagccgccuaucucaaaaagaagaaaugaaguagccaggccuguggucucagcccucacaaaccuaaggcagaaagaaugccauggguuugccaccagguggacuacauaguaaccuccagaccugcagggacuacagagugagacauugccucaaacacaccaccaccaccaacaacaacaaaaaaccaaugauaguaacaguaguaauaauaauaacaauaauaauaauaauaauuacuguaguccuaaaacuugagaguaggaggaagcauuaagagaaacauuuaagauuaacugcauuuauuuugaacaucucaacuauaaaaaaaagugcacuguuaauuccuuauaccugucugaaauuaauuuaaaucauuuauaggugguaaauucugaaaauaaauguucagucucgaagacaaaaaccaguacuaccugacauguccaugacacagaguaccuagcuacaaugucaguuuugaacugugagaucaggaaguuugauuccucacacuaucuucaaguaaucauuaauucugauccgcaaaccggucugugcguauccuuuaaaaaaaaaaaaaagugcuguuuuccuuaaagaauaaaagcuguacagacuuacugggguuaacaaaaauguaaauucuguaaccggggucuacacaacuuuuaagaaccuuguuacccauuauuacauacagauaagaaguccuacaccugcgaggucaugugauucuucaguauccaucagcuccuccagcgcggcgcauaaaucaugcaaaggaauucucacaagacauaauauaggcaccaaauuauuuugauuuaauucucaauaagaagcaaagcaguaacuuguuacuugagacugaagaaucaauaccaaaugcuuguucuuagauugguuaucacuccgcucaugcaaggagcuggaaaagcugacacauuagcauugacaggggacugcucuauuuguuuucccugccugacuccauacuuaguucuguggcgaggaaaaucaauuucuuuauucaacuugucaaucugaaaacacguagaaacaacuauucuaggacgaccugcaaaacuacacugcacaguaagguaagauaaaaaaauaaaaagagcuuuucuaucgacuguacaaaggaaacaggguuagcaugccgcuauaauuaucauccucaugaauauaagcccaaguguaaaaauaaaauagaaaucaaaucuaaccaacaaaaccaggagggcagacucacuggugcccucuuuauucaaauauaccaaucuccuuucauuucagaguuuaaaaaauaaaaucccuagucagaccagcuucuucugccaacacaagaacucaaagacaccuaauuuuucuuuuuaaauuuuguuuaaucugcaaagacuuucuagacuauaaugguguguguuuaucagaguaucaaugaaagaaacaguugccuuuaauguuucgagugauucuaaaacauacuuugcauaagcaaaucaauacagagaguuacagguguugggcuuuugauccagguaagagacaggcuacgaagguagagagcaacauaauaccaggauccaacuuccaaccaaauccgcugcucaaauccaccauguuugaagcacuaaaugucauccacauuaacuguuuccugugaguuuucuuuuauuuuaauggauaaaugccacgcccccucgagcaacuccccucaaacaacucuguuccuggccucugaggagucagaugcgugucuuucacguguucauuccccuaggaaucacuacacagccuuagcuccuucuggggcccucauggccacggacaaagcacacacccaugacaugagcgagcgcuuaccuaugccaaccagccacgcuauuccuuaccgguucucuacgcaccacccaauaaaucccugcaguacaacuuuagucugguguugcucacgugcacaauuugcagcacgccuuaaagaugcucagaccaagacccagcuuagcuucagaccaacuuuaucaaaccaaagaugucagcaagacaaauuucacucuagagcacgcgguggaaagaaacauugugagcuaagagaauccucacugaacugagccaaacuuccucuagccacagacugcugauguacgaggaccuuccaaaccacagagaauggauuacgucaguuaaacgaaagucaccagacucaccaacuacaagcaaggcuucugcagagucacaugacucaagaaggaaacggcacaggaguugccacagaacaccucacucaggucuacuaccuguucgucuacuaccuguucuuagcugagaaggcugcggcuggugacagcccagagagcagguuguagaaaaagcacuucugauaucccaggcuccagaguaagugccagcucugccuuucuguuuacuaaagcaacugaugagcaagaacguucccucguaucccuggguccucagcacuuagccaugucugccacaguuugaugauaaggauguguguugccuuauuuagcacuugggcucuuaggguacagcuucccagauuuugaaaacuaaguaaaugaugcuuugaugccugccuuguuaugcugaauugccuucaaagucaagguacuugguacauauggaagcuaccugcacgugugauguuacagggcacacuauauguaaagaagcauggggcagugauggcagccccguguuuccucggucccuugaauuccuuaauucacuucuuggcugucccaggaccaaauccacaggcuauuuauauaacucuagucaaaacugaaaauguagagcaagcucuaaaaacuuaagggcuguuuugcagaguuuguuacauucuuucagggcaaccgccugccucgcucuugccuucugguuacacuggguuuuaagaaucugaccuuuaccagaacugcccaccugugcccuagcccauuagugccucucuagaccugacacugccuaccuucgugauggugguaagccaggaagaaaaucgggcuuccaauaaacucacuguaggguugugaaauacuagaugaaauauucaggggaaaaauacauuuuaucuuuucuuauaacauaugaaaauacaguacuccaacucauugaaugaaaauaaucaugauuucuaaauaaauccacaaaacaggagggaaacaaagggacuggcuucccagucacuaaaguaaugaaagagaacagaaauauauacacgucuauacaucaaaacaugaccaugaaguuaaauaaaacuaaggguagauaagcuuggcauaguggcuucucacuucuauuuuaccaauggaaaggcagagucaugaggaucaagaguuuaaagccauccuugacuucagugucuaccuuuauggucagccuaggcuacaagaaauucuaucuaaaaguaaacauguggguaaacugagggaaauaugugacacagagaggcagaaagauggcauuaaagauaauacaauuauaaauuauacaacaaagucaauacaauuagaagccauacaauaaagacaacacaauuauaaaaucccaagcuugcauuaggacaugaauggggagggaggaaggaaaaggcaaagcagggagaagguggcucaucuuaauauaagaaaagaaaaccgcaaauggcaaacaucguuuuaccuaugagcagauagagaacuaaaacgugugguccucaaucuagacaauucuagcaagaaauuccacauguucuuccugguacugaaacggagacaucuuucugaagagaaauuucacaauuuaucaaaaauguuauaaaaguucacagccugcaaucaauaccuccaucuucaagaauuuacuaaagggaaauggagagauggcucggcaguuacaagcacuggcugcucuuccaaagaaccaggauucaauuuccugaauccacacggugguucacgagccccggccaguuccaggcaagccaaagucaucuuguggccucagacggugccaggcacacaaguggugcacagacauacauacgugcaaggcaaaacaucagacacauaacauacauguuugaaggaaaucucagcaauauaugcaauaccuucuauaccaaaauguucgccacagcacuugucccugugaaccaucagaauaccaggccaggacacuuaauagggcagccaaaaaaguugugucuauucacacaaaugaaugcuagcaauguuuucaaaguggacguagugauaucuaauaaucaaugaaaaaugcaagauucaaaaugauggaaguguaauccuuacauaugagagaaaauaucaagugugaauguacacauuucacauacaaaaaauccuacacugcuuaacaacccgaauguguucucagaaaguaucauuaggugauucugucacugugcaggacacauaaacuaagacagcuacuguaucaccaggcaauacaacuuuacaggccaccacauacacgugaccauggcugacaucauaacucuaagucuguauucaugucgggagggcugggggagggaggagaauuaggcagggagggagaaagggagggagaaagagcagauaaauaaaggggucuaaaagaauacucugaaacucaacuuuaaagaguuuuguggguuuguuuuuugccugauaaucguuagaauuuggauucuagagagcccauaaucguacaaauaagagaaaaucuuuccaaguugauacuucgaaucaggaaagcuuugcucuccacaugacaaguggcugcuucuugcccacagaugaaaacaaaacaaccuccuacccccuuugcuauucuuucaaggauuacagaaccaauaaaauuucauuguucuuaaacugaaaaggaaguccagaaauaucaacuaucuccucccgcgacgagcaaugcagacagguaccuaucuguaaagaagccgcacaaggcaaagagcccguacagaaaguugcaaaagcagaggaaaccaguucaguggcccugugagcugcuaacacaaagaggaguucugacuuuaucaccacuauuuuauaaacacuaaggcgcaugaaugagaggcagcacacggccuagaguuggggguaaggagaccaguaccaguccugacuccucgcauggccaucaccaggacaugcauccacaugugcacacaggacauccacuguguacaucagcuacucgauccgcgccuccagacagcggacuaugugugcagccuguagcuuugcugccuaagcaaacagcacagaagagaccuugaaaacuccagaacaguacaucuuuccuaggcuucugcccuacacucuaaaccugggcugaguucaacuucucagaccguugcauucaggaguuccuuccugucacugcagaaacguggcuguagcugugguggcagcacagagcguccuguaggcacauccguguugggacgucauaccacaacuugccagauuccuaucauagaaauauggucauuguccugaauugagaggugggcacaaccaugccugcucuguauaucuuuugcagaaagaccaauaaaauuaccccgucgcugugaaaaaggauuccaguaaaggaguuguuuaaugcagcuaugcgagacaagaaauugguguuaggaaaagagcacugagauccacagaccaggauccaucagggcugaccugcgacugcuaagcuuuguuauuuacuuucuuuaaggccaccaaguuguaaagauuguggugguggcucucccugguggagguuaaguguuuggguuaccaacuggggaccucugugguugcuuuugucccuggaggagaggaguuaauguccccuucauuuaauguaccucaucgucccugugguccaggugacacaggcucacugccagcgcugcccacucaucugacaccuaugccaauccaggccugggucaccucaaagggcagaaucucacaaagguccgaguugaacgugaccaguggcucugcggaucacaucucacagggguguccauaaugcccuccagaauaaguuucagcuccacacacucgggggugcugucuacagacacuucugauggucuuccccacaaaggucugaccuuuggggagcggugccuuugacauauguauaugugagaagagaccacaugcauaaggaaagacuacauaugcaggacgcugucaaagacagaaucugaccguggcaaaggcagcccuuggaucuuaauccuggagugcagagucacugggucugcaguguuuggugaucagaugacaggcaggaagcugaagagagagucuacgcauaucuaauuaaucaaauaaccucugugucacuuaucuuugggcuggcauuagaaaauuccccucgugcccccgaaucauauaaaucgcaugguuuccuauucauuaaagcuggcuuggucugugcugaugugucauauuuugacauguaaccacaagggaugcacaaucaaaauuaagaagagaccuuagcugaaauuggcaugcccuacuccaacgaacaauuuaugcccacacguggccaaagcugcauauaucuucuccaaaugaugaguauuaagccuguagaaauacagacacccacaauucaccuagcacauuuugcauggaacauuucuuuuagcuuccaacuaaacacaggauauuuacaccacagagagugcacaggcuauuauuacacagaauuacacacagacuuucaauacuauuaccaucguauuuacuggcuaauccugccguguuaauaccaucauguucuucccgggcuuuacagcucuccguggcuucccucugcauuuagaaucaaugucaaacucaucauuaccaccugccaggucccuacaguguccugcuguccacacccacuccuccccauccugcacccucugcacccucugcacccgagccgacccugacccgccauagcucagcugucucugccacgcuggccuucucuuuguucuuugucuccugagcagcucuugucucugcugucucuuuuguuucaaaggcuuuucacccaaaccuccguggggcucacuucucccaucucaggucaaaagucacccuccuacugggccuccccggccaccccagugaacguugcuccccaccugccaucaaucucugucacacccuccucucccaucucauuuuucuucacaacacaaauacauuccaacgggaagugcccugcuuuugaggaucaucuggcuaccaaaauguaagaacaccauuugcugauacucuuguuaugccugcagauaggagcuuguuguccucugagaggcuccacccagcagcugacucagacagauacacacacccacugccaaacaguggguggagcuuggggacucauggaagaacaggaggaaggauugugggccccugaaagagauaggaacuccauaggaagaccaacacaaucaacuaaccuggacccuuggggacucucagagacugaaccaucaaccaaaaaacuggacacacaggcugaaccuaggcugacucccugcucaugugcagcagaugugcagcuuggccugcacaucauguggguccuuaacaacuggaguggggccaucccaaaagcuguugccugucugucagauauguucuucuagcugggcugccuugucugaccucaguggagcagaagugucuagccucgcaaagacuugaagugccagggugggaggcuauccaggggggugcuccaccugcuuaggggagaagggggaugggggaaguggugggaggggggaggugagugggauguaaaguaaauaaguaaaauaaaauaaaacaagaacaccauuugcuuccacugcugucuagagccaguacugacauagaaugggagcacaguucacauguggcacaugagugauuacaugugacgcaagccacagcaccgggcauaccccugugguggcaucagaugauuagaaugcuaauggacaaacaggcaagugacccagaaaugauggcuacaugaucagagcuggccagagguaucugauaugaagaaaggagaaaaccuacugagcacagaccuucucugugguuuguucaugguuugggugcucaccggugagucuuuuaggaguguggugauacuggaagggagugcagccugcugaggguguuuguauauguccuuggcaggccuaaaguagaguguuccccuaggacuacucaguuacuucucuugaggaggugguaagacagcggaacaccacacacacacacauacacacacacacacacacacacacacacacacacacauacacacacacacacacucuggcuuccugccucaccaugagaccucuuacacaugcucuguggccacauuaggaucgaucuaccaagaugugauccggccagagggcucuuagcagagcugguaccuuacaguuuggacuuucagcuucccaaacugugaguuaaguaaguauguggccuccaugauugagucggagcaucagacaugcuuuaauaugccugcucuagugacucggagguuugagacugaagagccuaaacucucacacacacugccugaaccaucacagcugcucgauaaauaccucugcaucucuaaacauguauaugaagaauguguuuaaugucauuuucacuucccuagcuaguguugugaagaccacuccucuagaugccgguggugcuuucugguacaggauguauagaugcuaaaaugaaggaggagaaauccaucuaugaauacaggugggacaggacucugaggaauguuuuguuaagugggaaggauuucauuuaaucccuaaaaacuuccaaggggcuuuacaagugcaaacagacuuuagcucauccacauuuuucaugcccagaaacugggacauuaaaaugccaggaacccuuucaauaucagaagccugugguccaugauggagaaacccuccaaugaccaagaccagcucccguggagcugccaaagaaccugaugauuccaucaaaagaaugucaauuuggcuucgaaaaaaguucuggccucagccuuccacggaaagaacaguugggaugauggugcgggcuacauguccucauggccuuugaagcauccaucccugacagcugaacugugcugcuccccagcugggaggcacaccucugcugcacagaaggaagaggauagggagaacuugguacagcagaucaaaaacgaaaugauguugcaauguccaaaugucagagaaauuggcccuggauaaacaaaaggucucagagcaaaaugcuaaaacauaaaacugcccuuaacccacgaaugcauacaacaaagagcauuguuuuuaccaucugauacaccaagcuggagaacucucuccuuaauggagaacuuguaaaagggcccuucguggauacccaccucugaagaccccugcgaaccuggccucuggagacuagaaguuuguaccggucacuaaggcuucuucuuucacguuuuaucuuuaagggugcccagucuccuuuucuacauuugcacuuuacagaguaggcucauguuuaaauucgcugccgggauuauuuuguccguuucuuuaacccuggccagaccccccaaccccccugagagcacaugugcucugggcuuuccuaaucagcagcucgcaccugagcaugacucuaguaauuagcccucgccugccuucucgccagcauccuuucuucccaucuggccacagggccuggaccgaacacaucuaggagcugugacuucauuccuucucccuacucugcucugccuggguccucgauuaccaugccaucggugccugaagggcacagcucacauucccaucccacccucuccuggcacccagacuccucucccagggagcacagccccugaaugcucauugacagacacuaacacucucuagguuugugcauccaugaagauguucugagugagcuagcuuucuguuuccaucugcugcugucugcuaaaagacauguauuggggguggggaaagcucugaauggaacaacuaaauguauucugaacugcguagcccacccucccucccucccucccucccuucagacccugacuuauggagcuaaacagaccucgagaucuuuuuccaagaugcuuuuuuuuuuaaauccaaacaccaacacguaaguucacuugccugacccacugcagcagucaaaggaugaaauuauaaaauucccugggcaguaaaggaaaacgcacacugucucaccuccucguccccguggaugacccuggugcuugcugcuucgcuggucaccagaugaucagugugacauaaagcugagcauucgauguaaacaaugaaccucagagggugaccucggagcuuuagugugagaguaguugauaaguuuacaucgcuugaaaaauaaccuauagaugugccagagaagagaaagcaaacagaagcgagcauccaaagguguggcuuuguacacaggcgcagccgaggcuggcccuucagcuggucagacccuugccuugcacugugaagcagaugugaagaggcaaggcaggagccagcuucggggaacacagaauaggacagcacucugcucagugcgagagagccucuggagccugaggacccagaggaucacuuccaaucuuaucaacagaggcucauaugcaccucauuaacuuggcuauaauggugcugguuggaaagacaguaaagggagggagggagggagggagggagggagaggcaaaaggcaggagaugugggaagggcuacaugagaagccacugacaguugucuuuauuccaggggccaguguugucagagacuggaagcaccagaaagccccaguggccgaacacuagcagucaccucccaccagcaacagccagguuucugcuagaacucugccucuaugguuaccugcagccgugcaugcaacugugccucccgcucugccucuaugguuaccugcagccgugcaugcaacugugccucccgcucugccucuaugguuaccugcagccgugcaugcaacugugccucccacucugccucuaugguuaccugcagccaugcaugcaacugugccucccacucugccucuaugguuaccugcagcugugcaugcaacugugccuccugcucugccuuuaugguuaccugcagcugugcaugcaacugugccucccacucugccucuaugguuaccugcagccgugcaugcaacugugaacuguuaacaagcagagcaaagcuccauuacugagcucccaccuuaugcugccucucuguauucuaagagauagcauaagcucugucuuugagagucucaauaaauauucaccauuuuaagcgagguccuucaaaauaugcauucccuuggcuuuaaaagcaucuaccacacagugagccauggcuuagggcagggaccuaaaaccucuuuugcaucugacaagugggaaugaggugagaaucaaugaugcgugcaugcuggguauugucuaugcuaaaauaauaauuuaaaaauacacuugagcaucuaccuucuaccaaaagucugaaacgguaaaggccccacgucugcaaacacuuuaagcaucaugucaacaaaauuuuagauuuucagaugagaaaaucugccguguccuggcacugagggaaggugaacggugauagagagacucucccuccccucaacaaaucucuacguuuccaaacuuaacgaguuacugaaucucagaauuccaaacucuaggacaaacccugaaauaucuaaacaaaaccaaaugaacauguuuuuaauuauuuuuaaaauacaccuuguauauucuuagacuuuuuaaaccaugaucuaaucagaacaauaauuuauugcauauuucaaaacagcuaaaagagagaauuuuugaguguuacggcacaaagaaaccugaaaugucugaggugacagauaugcaaauuacccuaauuuaaucaucugcccauugcacacaugucaaaaucucacaauguacccuacaaacauauacacuaugaggugucaauuaaauaagcaaauaugccaucuaauggcaaaaaugcaauaucaauagaugaauacuuagaaagaguaucaagguacucauuuuaauaaaaugaagggacauucuuuaaaaaaauaacccacccaguuagaguaauucaaaccuugaguuuaaacagucaacacuaugugcuaaggcaaugucuaucacugcaguaaugccagggcucucccaccucuccccugugugcugaggaaacccuccacaaccauccaacccuggugccaaauuaaagugugaagcugcuucugccgcccucugcuuggcacuuuacauuaacuggcaccauaaacgagugucuuuaugauaauauucauuuguagaaacaaacaucgauucaaggcacuuagcagcacauguguguauugagggguaaacuagagggaauccuaguauuucaucauguccuggggauuaugacaguguaccuggguaucucucugcuccucucauucccaauauuucaugucaggcuucaccacccaccacagccauucuccuggcauaccugcauauuauccacaauaaugaugccgguaaauaucaugucaggcugucugagauuacauaaacaugacaucguuuaagaaggaaugcuucuccacagcuuacaaguuaaccaagauaaagccaugacaaauaucauaagcuauaaauaaagacauucaccacugcacugcacuuauucacgucuggguugaacaaauguuaauuacagagaauuugaaaauggggcuuguuaaugucauuuuuaauuuagcauguuacaguguaacuguuuuccauuguguuaauuuacaccuguuaucacaagcuucauuauuagguuuacagaggagcagcucucugugacucuuaaaauuugcuuaaaguggcaggaacaauuacuaauuagaagggcauguuuacuuuaauuauauuuauuuccuagucuaguuuuauacauaaugcacuauggaaguguaugauuucauuagcgaaaccaauucaucacaagcaguuucucaaaugaacauuguuuuaaagacugccacagacucuuucaaugucuccaacaucccuuggaugguaucucugcagagacacgccugcacacauggagucaaagcuccaugcuucccuuagcaaugauaauccaucucucaagaacacuaaugcagauuuuaagauaguguguguaaauaugcaaaugagcuaggugcaauuauauucaaaauuaacaugggguuuauuuacugguauuuauacucacaaacuucauuuaaaaauccuauucuaaauauaugaaaagaaaauuugaauuauaaaucaaaugacacagacuguuuuccucccuaaagacaaggcuggcauuugcauacacaaugacuuuugggguagaggucccauacugggcacagaaaucaacaguacaauguucacagcuggguaaauuuaucaaugacuuuccuccccgcagcaauccacagagcaccuuucagugcuggcguccaguagggaagaaaggcagggagcuucccugccacuacugauuugaucgcuccauguccugugacaaaggugugugcugucuucuacaauucuuguaggcacccagaagcaagagccagaacuguuuggggcaucuccaggauagcccuggacaacaucuugaagguuagcaucacacagcacagggcuuucuaaauuuuucuguaaggagaggcaacuagaauuguucacuagaaacccuggagcuuugcaagacaguaaaugucaccaagggcuuuugagaagcugugagaguggucuauauuaaagacccuaaagaaaugugagacucuugacuggauucucaauuuuuaaaggaaauauaguuauaaggacaaacggcaaagcaacggguaaaauaaaaauacagaguacacaggcuagauaauauuuuauugaggggaaacugccauuuucaagguaaaaccagaugacuauauaugugacauuagaaugaacuggaucuguggcacuguccccaaguccagcaaacagaauaacaacugugaauaacaacuugugaagcaaguagagagguucauuagcauguggcagugugaaugcgcaguggagagaagcgcccccuguguucacugcaucuuggugugaaugagccugugagcaguggagaagggugcccguguucacugugccauucucagcuucuucaccucaccauucugagcuucuccacaggcuuggaacuuucaaaaucacaaagugagaaaauauaaguaucccauggucacuugggaggcucaguaacucuuccauauaacuucucaucauuccuucuacauaacuugcaaacucaaaaaaaaaaaaaaagcaguuuugacacaugcaauggguaucuugccuccacucaaaauauagcucaugauauucccuggaaguacaucucccacucugcugaucauccaugcaacagaacagccaggucauuuuugaacagaugcagacaucacacacuguuaggaaagauguaccugcagguaauguuugguauaguuuucagauggguucucuccgucuuaagcauccaucagaaauuggcuucaggauccuugccaaugcccuuauccugggauguucaagucacuuauauaacauggcaaacuguguaugcaucaaaccuacacaaaucuuccucuacagagcaaaucauuccuagaacacuuaggagacuuaauaagauaaaacaguagacgcaaaguccuuacacuguauuguuuagagaacaguaacaaggaaagacuuugcguaucuucagcagagauguuauuuuccccaacauuuugauccucggaugguugaaauacugaguccugagagcccacagagaugaauagcugacuguauuuauuuccuucauuacaguauucuacauuuaacaaaguauaauuucauaagagaaacugcacguagaaucuuguucacuuaagaaucuccuaggaugcuaaaggguucaaacuacacaagccucucacaguucuaagccacacacauacacacacacagacacacacacacacacacacacacacacacacacacacauacacacgcacgagcuugaccauacucauuaccauacaauaaaaugguacaggcaaccucuuccagggaacaccaaggcaaaagccaaugagaggacagucccacugaagguggggggucccccaagaacagugucagacacggaagcacacuggcugcagucuuucccugacugcacauaagacuucagauucuaucacaccccuuguaacugacacaagacuuugcaguaauuguaaccauuuuuagagaaaaauuauuccccaaauuuccaaguucucccagugauuuucccauuccuccuaucccaaacagucaucaagaaguuaucuucagcagaucauaaugguaccugccauugaucccagcagcccagaggcagagcaagugaaugucugugaauucaaggccagccuggucuacaaaauaaguuucaggguuaccugggccuacuuagggcucagcucgacaaaacagucaaagagauuaucaagcugcuucauuaaauauucugucacuuccacuccugggcagauuuguaauuaucaauaaagccuauaucugacuacguaaagaaguccaaacagcccaauggcacaaugaguuugaacccccgagacccacaugauagaaggagagagcuaacacccucagguuauccucuacccuccacauacaugcuaagcacaggcuccucauucacgcaagauaggugaagaugaaauugggguuuuagaggaaguaaaaugauauugugaucaagagcaggaaaacacuagcucaaccaauacaaugccucuggggaaggagcagggcugcuagcuaugugcuagugacaaccagggcagccaauaaaucagucgcccggcagcuuucaacucuggucucaaacaucccgcacuagcaauguucugaggccaaaaauagaucuucuaucuccagagaaggaaagaguuagggugaggcgaagcuuguuaggagaaacaagagaggcuggaguugaaccuuucagcaguaccuucccacaugcuuucuaaaagcuacgcuacggaguccaagugguaaacauuaacauggcucccauuucuuauugacuuguagguguggagugaaguucaaacacagggaggugggcagcaugcaugguguguguuucucucggugaggcaccucuggcuucgugugugugugugugugugugugugugugugugugugugugugugugcggcauacacugggauguauuuaaaggauaacccagauaaagugaaguugcuaacguggggucaauuucaucaagguauaacccuccucuuagaaaccaggaaccggaguaauuagauuacaaucuuuccaacacugugggagagauuugaucaauuagagccaagaucaguuacauuauuugguuuaccuaaguaauggacccuuaaaugcaaucaauacuucuccaggcugugagccuccaagacccgaggcgcauucagcaaaacacagacugaguuucaaaggaucucaagaugaucaaugauaaaccgggacugggggcugaagguggaggcaggggaaugagagguggguugagaaguggagggaaggagcaggaaucaggcuugcuauguggaucuaucaugcucucuccucaccguguccugcuuuuguuccucacagcucauacaggaucuaaguucguaaccccggaaaaaccucaaucccaggaugagcaaucacagcuuucaauuucuuuuuuuuuuuuuuuuagaugugauucuuuuuuuuaauauuuuuauuagguauuuuccucauuuacauuuccaaugcuaucccaaaagucccccauacccucccccccacuccccuacccacccacucccauuuuuugaaccuggcguuccccuguacuggggcauauaaaguuugcaaguccaaugggccucucuuuccagugauggcugacuaggccaucuuuugauucauaugcagcuagagacaagagcuccgggauacugguuaguucauaauguuguuccaccuaggguugcagaucccuuuagcuccuuggguacuuucucuagcuccuccauuggggguccugugauccauccaauagcugacugugagcauccacuucuguguuugcuaggccccggcauagucucacaagagacagcuauaucaggguccuuucagcaaaaucuugcuaguguaugcaaugguaucagcauuuggaggcugauuaugggauggaucccuggauauggcaguuucuagaugguccauccuuuugucucagcuccaaacuuugucucuguuacuccuuccauggguguuuuguucccaauucuaagaaggggcaaaguguccacacuuuggucuucguucuuuuugaguuucauguguuuugcaaauuguaucuuauaucuuggguauucuaaguuucugggcuaauauccacuuaucagugaguacauaucauuugaguucuuuugugauuggguuaccucacucaggauaaugcccuccagguccaaccauuugccuaggaauuucauaaauucauucuuuuuaauagcugagaaguaauccauuguguaaauguaccacauuuuuuuuuauccauuccucuguugaggggcaucuggguucuuuccagcuucuggcuauuauaaauaaggcugcuaugaacauaguggagcaugugucuuucuuacuaguuggaacaucuucuggauauaugcccaggagagguauugcgggauccuccgguaguacuauguucuauguuuucugagguaccgccagucugauuuccagagugguuguacaagccugcaaucccacuaacaauggaggaguguuccucuuucuccacauccucaccagcaauuucuuuugaacgugucaauaucaaaacuuggcuaacaggagaagaaaagacuaauauuucaauuuuuguguuuaaaagauacaccaaacuuacauaguaacacuauaaaggaaaacaggaguugacacccacucuucccauccauucacccacaugaauuuacagagggggaauggaguaucagcccucuagaauaugcuuuguuuagaauagauccuuaaaagaagcccuggucacaccaaacuuccacaccaucuacacugccugguucugcuccauuccaaaguaucuguaacuaaauuagaaauugucauucacgugguaggucugcuggcuaccauuacgaacuaagacuaaucuaucuguacauccugggaaauuccuaguguauccucuuaguccacagaccauccuccuaaacgaagucugcuggcagaguugggcaaggccagaagcaaccgcucacucaucucccucaagcuccugguacguuugccugggcaugcgcaccuguaguaggcaaagcucuuaucuaucugacauuugcuuaacacacuuguaauaauuagagagcaaagcaacuaauuccuggcuuccucgggagugagguuucuguuaaaguguguggaagaauguggcaagaggggaaacggaggggaaauuuuauccugagagcucuacucugcagagcuuugaagucucugcaguuacgaugaagagauccugagauaauaugaaacaacaggcaaucaaaaagucauuuauauuuaccucuagcaucaauuauccuccucuuggcagcaguuggaaaauuauguuuuacucaaaagucagccuguugacuuuauuuauacaacaccugaaccuugcuggugugagcaugggagggagccaccauggaauugcaaauuuugcuguuugguagcauuggauucugagagcagcauucugaaugauuuuaucaccauccccuaacucgaccacagugcucggguccaugaguguggaagcagaaggggcugagggguaggguguaguggaggaggaguauguuagaaccuggcuuucccuguuccuggugauagacaaaauaugugugacguucaaccuucaccaucaaugcaguaggcagaaauuaugucgccugcacagcuacguucuaaauuugggcaaaaguuaaguaccuagaacaguucuaaaugcagagagugaggaacucugccaccaugaacgcugucaggagcagcagcuacaggauuggcuucagugucucuguguuucuagccaaacccucugauugaccaaaaagacaccauaugcuagaagcucucucccuuagggggucugaugguggucuucuguucccuaauuauguuugcuagcaagaugucuacccaaugagccaccuucuucauccucuugaaggcacuaaaaggcuuuuuuuuuuccuguucuuugaggagaccuggaggguaugacuauauaaaaugcagagcccagaauccaaguacauacgcuacacuggccaccucuacacagaccauguccaggcaagcacagguucugcacugucugcgguucucaguccugacgagaaccauucuaggguucccuggcuuucccuucugggcauggaucuuccauuucuuccaguagccaaucgaaccagucaugaagguaagaaaggccucagaggucauuaacaugaccugcuucugcugagcauccugguggcaggaagaugaggcuauagaccguaggcuugcaaaauagacugccacuguugguugccucuccugggucucucgcuugccaauuuacccugaggccuuggaaacuucugaacuccuaaaaucaaauuucccuuaaaagauaaauaguagaugugguaaucuaccuccuugauccuccuucucaggacaccuuaacaaaaucuccauugauacguuuuuuugcuaguaguucucuuugucaaguggacccuccaagcaacaggccucucugcuucaucuagccauuagcaugcugcaagaagaugugauuggccucuucguaagagcuacccuucgugagcauaaacucugaauuagcuaugcucccaacaggugcuacaccucacaggugugauggaggcaaaguacacuaaagccuugaccacugauuuucacagcgacggcauaaaugcagucacagugaccuugcuuguuuccguuggcuuuauagcauucuuuucugaguaugucuuuaguaaagugguggguuugcaguuagcccuuauuucuauucacacaaauuacagggaggucaugguccugccccaugcuuccacagaagagauuuagaacaugagcgcagaaguuauaaagauggcuaauaucagcuuuacuauuuuagagucgaaacuuugcagucccuacucccucaucuaaaggacaacccuguugcuucucuccuauagagaugguuuauauauagugggcucuaacagaaagcagagaugguacccggcccuuugcaggagucucuauagcaacuuccuccauacuaagggaucuccagcucuuacugcaagccaggaucaugccaggcccaaauucaaagcagacuugcucuguuguuaaagacgggaccuagguguaagagaaacaaagccagggcaucuauaaaaacauuuacagcauuucuagcaggaaccaguguccuaucuaagcuguuggcuggaaaacaauuuuuaaagauccacagagcaaauauuuuagggucugagggacaagcaaucucugccacagcugcucaucccugccaugguagagugaaagcugcugaagaugauagguaagugaguguggggcagugggcugugcacaaacagccuggucuccagucgagcauaggucuugacccccggggacccaauggguggugauuucuaccugcaugggacagaagguauucuaucaugccuccuggaccccuggcuccuguugaaguuacugcccccacagccccugcaggagaagugugugacuaucagucaugcagacaaugucccaagcuccuggcauucuggcuagacuccaccccacaguuaccugacuauagccagguaugcuccuccccacaguuaccugauagcccaacccacuauaagaggggcugcuuggccccuccucgcucucucuaagcucucacuuugcuuacucucuagcccuccuccuucuucuucuucuucuucuucuucuucuucuucuucuucuucuucuucuucucucucucucucucucucucucucucucucucucucucucucucucucucucuccccuccccucucuccacguggacaugacuggccucucucccuuuuuuuaccuucucucuuucucccugccuuucuacaacaaagcuguaaaaccauagacugucccugcucaucaaggcccagcagugcuugaaggaugggaucagcuuuccccuaaaaagccuuguuuaaccucccgccagagggccuuccugcaccuaagccaggacuggaccaaggacucucauccaccugagaaccauccagcgccccccacucccacccccuucccuuuccucccuucccuggggcugacugaucugccccugggggccccauuuguucucagaucuuccuugguauccagugugggaugccugagacagagacugagaaccuguuaucuaggacugccccuuguccaccacccgcuguguggggucagugguuucacacagccaggcacccacccggggcgcauggaaagccugugggcaguccauccgcauccgcccguccagagcaccagaacucuggugggacacgggcuuuccuccacucccuuuauuuccccgaugcccacugccccacaagugaguaaauauaaacuauguuccaauaaaacuuuauuuacaaagguaaguggugggcuguacacggcuccuggucuacaguguguggauugauccaaucauugcccaccuagaaguggcugcucagcaaacagaaacauuuaacuacaugagcuaccuaccuagcucacauuucuucuuguccagggcaugagagacucucaaacggcauggagagaucaauauucucucgcucuuacuucucgcuaucgcuuccucccucccucccucccucucccccuccuccccucacuccuccuucccuccccccucacacucucuccauguaguacauuaaugaucccauguaaacaaggacgaaccuuguucugaggagaaccaaggcgacugcagucuuacuacaguagucuuacuguacuguagacucacuacagucuuacauaucaaaccccagcucaauacugcuccuagaauuucaucggacuuggacgagcucucucccaccuguaguuccugaaccacgcguuuuccccuaugggacacacuacuugaaauaauuucccaucuucuggaguauuauuuuccuugagucacaaagcauugucuuaauggcucuacaaucacauauucaagauccuccccugcccaagagacacaaaugcauuucuagcgacucccauuaucuucucuaucuugggcuuuaauuucuccuaaacauguuuacucugcccuuuccaaagcgaagaucguuuuccugauaaaguugacaagauccaaauagaaguccagcaguucuguuuccuucccucgucuguuuacaauauaccaucuguuccaaauaagccuaugucacugggguuauuuuggcuucagaaauaauuguuuggaaauugcuaucuaccaugugacuauccauggcuugucugggacagucuugcacaugccuuugcccugggguaaccgucagcagagcccucaggugccccaugugaacagcugguugcacagcaaagcagaagaaacaguggaauguaucacaggccuccugucucucgagugcucaggaauaaaaggcaucucuguugaaaugccuacaucugccauuuaccagcagggugaccuugaaauaaauucuuuaaucuaaugcuugguuuugcucuauagagucucggugccuaugaaaugauuagacgcaugaucgagcacuuccuguaggacacauauugcacaguaaauguucaacagaugcuaccaguuuuuaucgguaauuuucuuaucaauaucguuaccauccucuguguccuccacagcaccauggcaacugcaucccccucuggguaccgucugcccuuccucuuuccucagagcuacuuccucucucucucccagcucuugcuccuggguauaaacuccucacgaugcugucaaguuccucucagguuacugaaaauauccuuaggugcacuagagaucugggguucuugcuugcaagucucccucaggcaaagacauagccugcauuucuagaugcugagcugcuccggcaggaagagacauggcucuacggaccccuuggaaucugucacucuccaaucaacacuaacuaccaucccuaguggaucccuugggaacccaccaucaucacaaccaccaaauggaggaaaauucaauucuuaaauugcuccaguaaaccauacugcagagucaaugauuacacuggcaacugagaaaaagauggaucaaagguauguucaaacugggcaccaggaaagggagcccacggugggaaagaaaugagaacuagcaguugggaccagucagaaauggcagcaguuaucaacucugguguucaauagugagaggcacauucacaauguuaggccaugcauuguucucaacaacucuaggagaaacugaggcccagaggacuaaaccagagacacaacggggaaagacaggacccacaucugucauggaucuccuauacccaggucucccuuuuuaauuguuaguuuucauaaagauggcccaguccuguuuucaauuuaaaaacaagagccucaacagaacuaaauauaauguauacacguagcuaucccgccauguauaaacuuuguugauucaaccagcagagcuggguaaaaguuguagacuuacgguugguuuuuauacacuguaauacacaaucugcacaauggcagcagcuugaagcaggugugcaucaugcagguaugcaucaugcagguguacaucaugcagguaugcaucaugcagguaugcaucauauaguuugugagguucacuuggaaucaucuugaauuccaaggcgagaacauccucaagguacuaaacuuggacuccaagccuaguccauauauccacugcaauaugagcuuucauaagauaucauugucccuagguuuuuuggaguuuaguuuaucuuuguuauguauauauuauuucaguagaccauaacugaccaacugcauguccacaugcaacaggaugaaauaguacuaaccuguauaaggagcccugagacuccaucgaccuucucggcauacuaaugucuaagguucacuguaccaacucaggcacugguagcucauagagacugugcccacaaagaagggacagcaguuaggucaugagaaucacacaggcacuguccgaaggaaucauguauggcuucuacguaugcucuugccuuucauggcaaaaucacauccagaacucaucuccagaugaaaacacaagaucaugugugaugcuuccagaagacugcaucggaaacuuaacacucaaagauguacugugaccugggcacacauuugccauggucuagucuagacucaaaucacagaccccuucacgggaaagcaaaagaucucaccagguauaaaaauuaacucaacaauccuagacugaaagguaagacaugaaauuguaacaaaguagauuuuguugccuugaucaaccaagcuuucauagauacaaugcccaaugccaugguaacaaaagaaaacuacggugguuuucauuaaaaugaaacuacuugucaaugaguaauauguuuaaaagugaaaguggggccuagggaaaugacuccgugaguagagugcuugcuuugcaggaguagacuaagguccccagagcccacaggaaggucagaugcaaaguucagauuaugagucugcaauuucaguguccuuggaugggaggcagggacagaagaauaauagauagauaugaguauauauguauauauguauauauguaugcauauauauauauguauguauguauauauauauguaugcaugcacauauauauguaaugaaaaggaauacauaucauagaagaaaacuacaugcaaacccuaucuuauaaaagcagaauauauuaaaaaaauguuugagacaagagucucaagagccuuggcuggccucaaacuuauagacaucagccucccuuuugccucccaaguucuuggguaaaagcauguccuaccaugccucgcaauauaugaagguuuuuuccuuuuuccuuuuucuuguauguauuuauuuuuaaaauuuauacauauggauguuuugccugcaugcauuucuaagguccauaaacaugcagugcccauggaagccagaagaagacaguggaucuccugagucuggagucacaagacaauugugagccaccacauaggugaugggaaucgaaccuggauccucuugaagaucagccacugcucuuuaacuacugaaccaucucuccagccaaaggauuuacuuuucuaucuuuauguguaugagcuuuugccugccuguuugugcacuguguguaugccugguacucuugaaagccaaaacagggcaucagauccccuggaacuagaguuauaaugagcucuaagccuguguauggaugcuaagaaacaaauuuggcucccuugcaagagcaucuagcaagaauucuauaaagaauuguuaccacacaauaauaaaaauaaccaaccuaagauaggcaaaagacuuauauaggcauuucucuaaagauuuaucaacagccaauaaguacauacaaaggugcucacuaucacaagucauaggugagaugcaaaucaauaucauaaugagacacucgauaacucgauacuaggcuuccuguccucagaaggauagauaaugagcacaccuccgagaagccgaguaagcgaacccacacacacugcugucagggauggaacagugaagucaggaagauacgcuaaaacugaucguggucuuggcugcaaacccugagguguauacuuauggcacagaugaguucuaugguauguauuagaucucaauacagauaacuauuuuuaaaaauaaacacuguacauauccaucuuuuuccauuucuaaagugaauuaaugaagaagcaauggugaaaggggccaaugugacccugauaugacccugaugugaccccgaugugccccccaaugugauccugaagccacaucaagguuuccauguggauguaaacucagcagagaggucauaugccauggaagaaaaccacaagccaggauccagugcagaggccucgcaagugagaacggcagcaagcaacggcuaccuaucuggcagcgaacacagaagagagcagccucaacaaauaaacuuugcucugcagaucaacaaacuaaacaugccucggucagaccgucagggagcacucacgagugaagccgauucucccgaaugacccacgagguauguccucuguccuugcucucuucaacccugaccucugagcacagugucaccugaucugcaaacccguccccuccagucaccuaaauggggaaagucccugggggggaaacagugaaugcugacuguaauagcaagagggccaaggcagaagagacccacaugugcguaaccagcccuccucagaaccacuucaauaggcagauacugagucccaggaaggccagcuuaccuaaagucacagggcuagaggagaaagcugggcuucacagcuaagaaacuuggcaccaacggccaggcuuuuaaccuugaagguuaauaugcuucaugguguggcccuuccuuacgaccucguuugucucuccuaugagauagucaaaggcuuugccaaaaugcauauaacacuaacacacacauaccucuuucacaaagccacaggaaaccuguugaaauauuuuuauuugcaaauagcgugcagcguacuucggcauaccucucacgugcuuuacuuuaucuuaaagugcacucuggucccagcuaaggaaacgaggcugcuucacuaacguugaccaaagugaucucugagucucagaacaguaggccugcacuaucuuuuccuguuccgagcgccaucacauccaguaguagccacagagccuucaccgacguuggucugugacaguuucucagacucggugggcuuggcacugugaaggagcaccaacagggucucugcgccaugcaccucgcuccucccaagacugcccuuauggguauaagacaaagcuacagaaguggagaguuccucucaccucuucccaccaaaggccgaugaugccaacuccaaucaccaaacuggagaaguguugaccaagacacggcuuucucgucucaugugacauucugcucucuggaacugagucacaaggugcagaaaggaagacagagaagccaccucaaaggaaaaaaccacuggauacacacauugcccuguuucuaucuagaccacugcagcauaaugacuuaaaaaauaacacaggccaggaccuguacaugaccacgccagucaaccuccuggcauggaggacuagguacccagcuagguauuccuccuagcugaggaguugggcaguucacaguggcuaaggguuuguggucacugguaagcuguuccugcucuauuggauggcacauauucauguguguacaagcaguaucaauuggaugcaggaggacaucaaguuggaagaaggacauguuggagguucugggaggaacugaaaaggcaaguagagaagagaauaugauuguaauucuuuguauaaaugggugaaauucuccaagaauagcuuguuuaauuucuaaaugaagguaaaucauuccagaaagacauuuugcuuuugugaucacgcaggggcucugacgguucucagcucaccguccuuauuucccagacucacaaggagcaaggaagacuuucuccgagggaaucaagauaugcaucaacacagggcugcagagauggcucagcaguccagagcccugaaugcucuuacaaaggaccaagguuuucuucucagcaccacguaguggcuaacaccuauccacuuccagggcaucugacacuggcuccuugcauauccaugcacugcacacauguggucugcacauauaaauaugcaaauacauacagguaagacacgcguaaaaauuaaaacuauuucuaauguauaucaaaacugacuuucgcaggaugucagcaauucaucccaggcuagcugacugcagaugggggaggggggugaggaggaucccacgauaagggaagcuguucucccuguccauacacacgaggcagaggcuggacagcacugcaccugauuccaaaccccaaguggagcaauggccucucaaucaggggaggcagauguaaaaccuauggaaagauuuccaacucagcucaucuugcccagagacuucuccuugggugauucuacaaaaucuaaagcugagagagacaggagaacacaagguaaaaguuucccaggcccagcagaggagcccuaagacugcccucauggaucucccuuuaauccggcuuagccuuccagaaguacggcuggcuaaauacucuggggucaaccgguaagccagccagaacuuggguuuaaaaacuaucauuguuucaucaagaucagugagaagaggaaaaagaagaaauuuuucugaaaugggguuaaaagaaagcaacaaaauaccuggguggugugcacgagaauaagggcuucacugugcaugcucauucagacaccaaugggaacuggagccuaaagucuaggaucagaggguccuggacuacaucuccacaucuggaaggcucucacguggcccaagacacagcaugacuucuuuccuaagcaaaugcaagcggucugagaaaagcacccaugacuuacggcccacggcguuuucuccagaugaagaucaauccaagaugagcucacaauuaagguuuacccaagacacauggaaaccaaacaacaucagcaaggaagagaguccaaggaaauaacaaugcacacaugugauggcgcuccauggacuucagaggauccagagaccggauucggaaugcaaaauagccacgaaugcaggaaccgcuaaagaagcaagagacagaaucccaaagacaaccagacagagaggacuaccaaaaacaaagagcaggcacgaggaagacaggacagacggaagacuggcuagcggcacaggguuucaguuagagggcagcuggguucugguuuccauugcaaugucucaaggucacacaauaguguucugaguauuucaagaaaaccugaagaagagauuugaaauguuuucaccacaaagaaaugguguuagaggagauguauuuauccucacuugaaaauuacaugaugcauauaaguauuuaaacaucacacggcaucccauaaaugcacaccauuaggucaauuagaaauucuuaauuaaaaaugaggagaagaugacuggguucgguuaugcaaacagaagaguuguggccauugaucccacaauauuaugaauagcauuugcugaacuaugcgcauaagaagcggcugaaacggcagauuuucugcaaugugguuuuuaccauaauucuuuaaaaaaugaacaggucaaauuuacaagaagucaauaaauauuuuaagcagacauacaacaacaacaaaacuccucugguuauuuguggagaguggaggaaggcccgagugagcgaagugucgaaagaauguaugcugcugagaaguacagccgcgcccgggaccugcgccucagauccaugggagagggaagcagaguccuuccugaggugaaggucagacgagacuguaaaggcuuccucuacggucuguguuuggauguagauaguguguguagaaauguucacuaugguuuuucccccguacguguagggccugaaaaccacuccucuauaaaaacuguucuaccaagauuagcuaaaucugucuguugcuccaacuguauacccuuaaccugccuccuuguuuaucggcaauaauuccgaggccaugauucugcuguaugucauaaccccgcucucugcucaauuccauguaaucagcaagcagagcuuccgaaggagugcggcuucuccaucggagagcccacccaguccacgcaaccccagcuuucugcgugucuguucuuuucuuuggccucucaccacuccuagucaaacugagucccuuauagguaagcugcgcaaaggcuuagaaguuauucaaacuaaaaaucuccuaacagugucuauagaacauuagccaaagcuaauuugugaccagaaaauggggaucaaaaugcaauucucggaaacaagaaacaaacauauaaauguuaugucaaccuagguggggagcaugagucaaccuggguggagagcaaaagucaaacuggguggggagcacuagucagccuagauggggagcacuaaucagccuagguggggagcacuagucagucuagguggggaggaccagucagccuagguggggagcaucagucagccuagguggggagcaucagucagccuaggcagggagcaccagucagcuagggggagcaccagucagccuaggcagggagcaccagucagccuaggcggggagcaccagucagcuaggggggagcaccagucagccuaggcggggagcaccagucagccuaggcggggagcaccagucagccuagguggggagcacuagucagccuaggugaggagaaugacaggaagugcugaaagauaccugaucagauuuugagagaggauaaagagaguggaguauuuaaguagauaacaaaaauucccaggaucucugaaaggugugaaaccacacacauuaaucagaguaaaugagccaggucuacugugagacuuaaaggcaccaacaaugaagagacguuaaggagcaccgcagcccaggaaacacacaucagucacggaggaaacucuguuucuacaguugccuuucuuuccuccuucucauucccagcacuaacucaaacaggaaagagcagcuaggacaugguagagauguacagaacacuaaugccacuucuuccgacauccucagaguggaugcucacaacuacagcuuaacugaacaagccaggcccuaccuuccgacaagugacauuuuugaaguucucauccacauauuaacaauagacugagcuguuuguucaucuguuugcucugaggcaggaucucacuauguagcccacuuuccugaaacucacacucuguaaaccaggcuggucucggacucacagacaucccccugccucugccucccagcacugguauuaaaggcaugugccacccugccuagcuuggcugaacguaguacuugcuacuaagauggcauguuccaacucaacacugucuccuggcauagagaaaggacccugaguucuccuucccggauaaaguuggugauaaaucccucuuaccucucucucagccgcuauagaagaaacggagccuuaugccccuucaucuguuucccuggggccggaaaccacagcaagacugguaaacauggccuccacgauaggaaacaguaucauuacucagcaaucagugugcuguccaugcuuaccuccaccaucuaauggagaagcacucauccgccagggccucauaaagagcccaugacaggagcuucgguuuaaaaaaaaaaucuauagauacauuaugauuagauacucuucuauaauagcagcuagccagaaaagaggaugggauaaugaaugauaccccagggaaggaaaaccccuuuuucagcugguuuaaguugugucgauaaugugcacacagcauuuugcauuuaccauaaagcuuuucaauuaguuccuagacgaguuaaccuucuaacucccagaacauguaauucaugcacguuuacaccaugcugcauccugcuggcuauuauccaucauuuacgaguguuauuugucuauaaaaaugacacuaaauuuuugaaaaaugggacugcuuugccugcuucuggcuguguuuuaacaaauggcaccaaugcgaaaggcuuuaagucacauaaaaagcaauuagucagggaggcaauaaauauuuuuuaaaaggauauaaaugauggccuguccagauagccaaaugucuacaagcugauacacaauaaaauaaggguuggcgugaaagagggcacuccauuacuuacuguuaauaaggaugaucaaauccugugcuuuuuaucauacaggaauauggaaacacaaguaggaaguguguguuuacggaaaaaugaauugaaauaccagcagcucugaaagaaaauccagcagagagagauccauaacacauaacuguugcccucuuaaaacacacuuacuuuaauugaaaaguauugugcacuaaauaauauuuaguuuaauuuagcuaacaacuguacuuaaaauauguauucuaugacuaaugauaaaauaaucugggggagaccaaacccugugaccagaugccugcagccuuucuuacccuucuacuauagggucuuuucuuauccaccuacuauaggguauuuucuuacccaccugcuauagggauuuuuucuuauccaccuacuauaggguauuuauauucucccauucaaaaaccuacucucaaaagauauauuagauucuuuuaaaaacacaaaacuagauacacauagccccauuggugagcagcuuccaaaugcauuaucuucaaguaaccuggucucugacaucaucugucuaaaauuaagcauaaaagaguuuccaggaagauuccguagguucugcaagcauaucagcagacagcugccauuauuauaaaucagggauuauauacaacaguuaagccagaaaaagaaaugcaggcaauuucagagugggagauuucccaagaaucguguguacggucaauguugcuaagcaguagcucacucguggugaaaguaaagccucccugcagauauuucuggcauuguggcucaugagaacggagcaggauuuccacaggacuaucuuaaagggaaaaauggugagagacggaggaauuauaaugauacuaacuuugcuauuccuuuucaagcugaauccuaaaccuucccuaugucaaaauuuaaaauagaauacauuauaguggggaagaagauaccccauuuuacacaagacuugggcaaaaagacacuggacguggccugggcuuggucuccaugccguccuguucucugccauuugaauagaggccaaaaugacacuuguaaucuuauuuuccguuucuuagauguguuuuauuaacucuggcuuuauggccauuagauauucuaauuggcccacugcaggcauauaguggcaagauguugauugcacuuuaaugugccuguuaccaucugcagagggaagaagguucuggcagaccaguaaaaccccauuuacuuguagugacuucacuagaucaacugagcagagcuuuggaacacaggaccugcaucccuaaagagggaaaacagccucucuuugauuucaaagugcuuugaagaaacaagauauccuuucuagcccuuccaaacgagagccaaacaacagggucauuucugaagcacccucugcgcuucaaaacuuuaacuugugauguuuucauuaacauuguuacucuuugcaccugcaguaagcacccuacccccuaccccgggcugguguuccggcugguguucuaaaugugcguuguuccccgccucaugaccauguaagcuuuaagauauggggccugucugauggaggcagguccugcagagacucucaaggucaagccaugaguuaacuuuguaacucccagaaaauauaacucacacaagguuuacaguucgcagaaaccugcuaccugucacccaucauuuccagcuucucccuuacuaugccgcugugaucugaacagccuguggccccauggaacccaccuguuccaacaugccuuuucgucaucauggucugaaacccuucgaaacugugagccaaaauuaaauuucuacugccguaaguuucuaucaggaacuauggucucagagauaugaaaggaacuauuacaucgcaugccacccuagcacaucuucaaggacaggggaaauacuguccaacauuggucugucacugaaaagaaaauaggacaauuccagaacucggcaaaggcuggagagcuaaacggaagcuggaaagguucucccugucaacucaaauuauacagagauggugaacccacccaacaagacaccaguucucucuauagcagucacccccuccuuucuuuuuucuuucuuucuuucuuuuuuuuuuuuuuuuuucccgagacaggguuucucuguauagcccuggcuguccuagaacucacucuguagaccaggcuggccucgaacucagaaacccaccugccucugccucccaagugcuggcauuaaaggugugcaccaccaaagcacgggugauucccauuuuccuagcaaacauuaaaauguaacuauucacccucagacaguuuaaaaagugcuguuccagagguuaggcagacacccuacccauaccuagagggauagacaacucugcuccuuccauccaaucuacugccagggaaggaggggagaacaagccacagagggugucuuaucuccuuccucccugauaacaaagggaccaagcagacaagccugagucucacugugagcccauccaugugaccaucagccagaagcuaaccaagaguuguuucugugcaucugucuauggcccgaaaggucagaauuaugugccaaaugcucuuuaaugauucuaccuugucuaaacuaacacacugacacacacaaaaaaaaaugccgacaaaaaucuaaauagcacaccgcagaaauggagucuaaauuucacugagaaacugacagcaggagcguaauaaugguaauuaauaauucauaagagcauaauauugcuuccuguaacacauuucucuggauguugcaagacucuggguaaccacugcuuuccccagccauauccacaaagcaggugaggguguuuaacagcuauuuuucaugagagaaccuuggaccagaaauuuaaaacauuugucuaagcuauccauuuggugacaacgucgagacaugaauugaggucuccaaacucucugcuaacuaaauaauagcccagaagagacauacaaaaggcaacacaaacagagugccagcuguuuacacugcuuacaauaaauguuuguuccaggaaagagaguucaaacaggaugggaaauaguuuaaacacaagaggcugaaggccucaauauaggaggaaaaguauguuugcuuuuaauacagugguggaacugcucaugaaccacuaguucuucuccugucgaggccagccuugcacugcccagggcugcaaggucacgagcuacauggaacugaggcuguggaucaccguggcucaggucccuuccgagugccugaguucccgcugcacuaagucauugugacucugaucugaaaucuggaugauccuuuggggcaaacaaaaugcgugguacagaaaagcaacucagcgcuagcuacguaauguaaaaacaaaacaaaaacaaauaaacaaacaaaaaauccaaaggauauuaacugggaauccagggaaagaauaaaacaaaaaccaaacaaacaaaccaaaaccaugagaaagaaacggccacagugcacgggucagacaagcuggggacaggagggcugguagcuauguguugaggcucuggggaaauuuauguuuggaggugggggggggggggggauucauaaacacaaccuaggaaggaaaugcuugaacagggagaagacugguuauuucaaauagccgcagggcugccaugcaaaggucuggacaucucccagguagcuccagaguccaaaacuaggaagacagaggcaggagccugccugcccagagcagagcuugcuuguaauuagaauagcucaccaacagcuggcuaccuaaagauccugcaguugucucuucccaguugcuuccaggggacacucggagacccugugaaggaugccggcagggagggcccaccuuagaaagacccaaagugccaggaugcuauaaucagccccagcuccaucacaucagaacucagacagaauggaucucccacacaagugugcccucuaaaccugcuggugagaagccacugaaggaucucuuuuaaaaaguacucagauccacacaccagagccucaaaaucuuaagucccagaggcaagaccaggaaucuguaauuuaaaaguuuccugcaaacugcuaguugaucaauuuugauaacuucuguauuagucaggguucucuagagucacagaacauauggauagucucuauauaauaaaggaauuuauugaugacuuauagucugcaacccgauucccaacaaugguucaguaguagcugugaauggaaguccaaggaucuagcaguuacucagucucacacagcaagcaggcaaaggagcaagagcaagacucccuucuuccaauguccuuauauugucuccaggagaagggguagcccagauuaaagguguguuccaccacaccuuuaaucccaggugaccuugaacucagagauuuaaucuucuggaauccacagccacuauaccucaagaucuccauaccaagauccagaucagaaacuuuuaucuccaagccuccagauaagggucacuggugagccuuccaauucuggauuguaguucauuccaaauauagucaaguugacaaccaggaauagccacuacaacuaccaauaaauuucuuaaccuaccuacucauuuguaaaacaggaaaauaguaucuucccccuauuuguauccuggaaauauauaaauaaaauuagauguaaaauauuuagcguguuuucuacauccagaaaucagugucccuuaacaacucaguucucuacagucccuaaacaagcuaaaaagccaggcugacuccaaagaaagcagcguggcguaugcagaguucauggcuggccuuuccagcuuucuauccaugcgguguucuucaagcaggacagacauccgacgcaagaggagugcgacucauugaaccacaugcuuucugugaacacuaccuugaaauuaaucaagaagcaguuaaacuucggauacaccaccagaaagccugugguuuacuacccuucuauaauaauuauuagaggcucgugauaugaucucuuugcccuacaauguuuaaaauacauguuuacucacauauacugggguaaugauaacacacacacacacacacacacacacacacacacacacacacaccucuucuucguaucaagcagccauacugcccucauucaacauccuguaaggcauggagggguggggggagcagggaucauccugugcugucauuuucauugcugcaaauggcuucaacucuguaauuguagaguugcuucuucuagacauuagagugaggguuaagauaacccgagacagaacagaaaaaaagcaaguaacuggggaaaccuuaacaaguggggaaaauagcucugggaucccaggauuuguaguuuuuagacuguguuuggacaguuuuauaaacacacauguucgcgcacacacacacacacacacacaccacacaugugcacacacagacuaaagcaugauuccuuaagaacaucuaaagguuaacucugagagagcagcuaauauggaugugagaacaagcagcugucaaacacuuaaccuuucccagauuaaaacugucugacucgcagaugugaaaacaucaccgcugugauuguucuaaguagaaaucugagcauuuuuagaagacacauuuuuuuuuuuuuuuuuuuuuuugagcagccguguuuaugccccaggucaacuuucuuguucacaacagagacagaauugcgcaggccuuucauuuaugcucagaugcugagcccccggacccuucaucauuuacccugcagaugaguucuugaaaggcuagaagcuggauucuaaucaucagcccuauuuccaugcuguuccacacacgagcauccuaaaaaaaaugcuuugucuucauuucugacugauccuaauuagcuguggcuccuaaaauccucuguugccugccaaucuccagugcucauuuaugucacagaagaagagugucaguccauaguaguugcucaaccaagauuugcugaaugaaguaauuaucuuuaucaccuagauccacucccuaaagagccacuucaguaacgucuuuuuuguaucccaaaguguuaucucugcugaaccuacuugcuaauuucaauaaaccagauucauuucauaauagcaccuccuguuucugauucuccauaaacugcugagagggauguacaaaaccauacuuggguagcagcucugcucgacacacuguagguaagaaaccacaaauguuaaauggcugugccuuuuagaaacugucacauuaaaacaucugacuugaaguguacugcaguuuaaggauggguuccuuauaaacaauggucuaauaauacauauccacuuuuaagagaaacaaaacauuggcaaaaugcuggaacuauaggcauggaaaauguaagauuuaaaaaaaaaaaaaagcauugucaguaagaauaaaaucuuuuaaauggaaauaggagggauggggagggagcuuacauguccaaaaucugagcauaccaugugugcauaucaugcaagcaggguauaaaaaugucaaucaugaggugugcaccaggccaacugugagagcaaaggcuacaucacaccauauaucaaacgcaggcuccuuagagcugaagaaaacagagcacagagcauacagccccucccccuccucaucugcagggggacauguggucuucagaaguccugagcuaacaggauaaaaccugcaugcucugccuccuacggaaccugcacacacaagaaggugcccgggcugggaggcgacucagugggugaaaucccaccucucaaguagcugccuaugaucccagcaucuacaaggaagagacagagaucccaggcuucccuggcuggugggcuuuggguucuguguuaauaaaguggagagcuaucaacgaagucaccagacaucaguuucagccuccaugaacacacgcaaaaguaugcaugugugugcacccugcacauacauauguuaaauaaauaaacaggcaucgguguugguauuaggaagcacgcagcaggaugcagccaagugaaugggagacaccuucaugacaacacauuuguguuucucugcuucccccucuacaaaucaucuuuuucccaugaagccauucuguccaucucagggucccagggaggauguauuuaagaacgcccugcacagauguggaaaucuucagaucacacaaggcugugaacccaccuugcuggacucuauaacaaugaucacuucuaacacugguuacuaaauauaaacaaaggaacagcugcuggaaacuagacgucucugcccuaggagaaggauggcuggcaaaaccacuuaugcuuuaacuauagaauaagacauguuggccgccagguccaugcuuagacugcccucugagugaccucucagccucuaagagaauaugcuacagauggaggaggcaggaagggagccaaguuucagacuagguggaccuacugccuaggucacaccaggagguaaaggauguagcuguaagaauggauggaccucagaauuggaagauauauauauauauauuaacuauauuccugugaaaccccggcagcuggaccuguuuccauugcuauuaaaugugagauucacaccacaagaucugagaaucuagcgcaucacuaauauggaccugcuuggucuuguuauacugaagugugucuggagcagucauagauuucugcacaucuguagcacuuucaggauuaucauggcugcugcucaugguugcccuuggcauuuuaccuucauuuccucuucaugaccucaugcaugguuccuuuggucuucuucucacacuaccuggcguggcuaaucaaauaaauucaauuacaauuuaaucaaguaaauauuaaaaugaaaagaaauuuuuguuggaccucacugcaggauuuuuucccaaaaaaauauaagauaugguuuaacacucauggucaaaggcugaggauaaauucccuaacuucagccuagauggugauauuguucuguagucuaccaugcucugauggguuaaguuuuauaaucccacccucccccuucaacccccagggcuuaaggcucagugaguuccaaggaagauagaagaagguuaagaacuggcagguggguagaagagaugugaaauacugguuugggacuugccauggcuagcaugcuuuaacucaaagaagcugggcuuaaccacacgagaucugugcaagaucgugccagcuaauuuccagcauggaugagggcaggaggggaggauugagaccccacccuaucacagaggagcuauuggcaauugauggcuucugagcaucacucccuuuuggggauguggcuauuuguaggguguuauacccagaggauggccguauacccacaugaauaugggcagcacucaaugaacuuggaauaacucauaacugggggaaaagaaaagccagacguaagguaaggagggagacagggaagaaagcuacuagggagcuggaggaaggcagcaggggauggauagaaccaacguaugucauauaaauaaacaauguaucucauauaaaugugugcauccugggagaauaaaaauauguaaggggaacacuggacaggaggcagagaucaaaauaaugcaucuacaagccaaaagacugaacagcuaccagaaacagauaagagaacagucaacaaauucucacuccugguccuuagggaacaaacucuccugagacuucgaccuugggcuuccagucucccggauuaugagaaaauaaaucccugcugcuguuguuuggcuacuuggucugugauacuuuguuacagcaacccgagggagccuugcaguuccuccggccacccagaagcucagcaacaacaugucguccuguuuucaaguaaaaccaaccuggagacaaacaacugaaacacugcuguuaaauaaagcaaguuuacauaucauggucagaaguuaaaaauaagagaauaauuauggaugucuaauauucaaaggucgcugccuaugauugguugauuucacaugccuucuucaugagaaucaaauucauuuuucugcaguuaaaaacugggaaacauuauauuaaaguuuaagauuguaaagaauuagcguaaugugcaaaagcgaaauguuuucuucacccaugauauacagauggaaaagugaagaaugaaaacagauauuguuaaauuauggaaaauaagaagcucugagcuacaucaguguagcgucuugggaaacuuguucaaaagccuccccucagaugccccaaagccacugaagcucaaaugagguucuucuauaaaacgguauaauauuugcaugcaacccacacauagccuccugugugccugaaaucaucucaagauugcuugcaauacugaauacaauguaaaugucauguuaagugguuguacugugugguuuaggaaaaaaaugacaaggaaagcccauaccuguucaguguggaugcauuuuuaacuacuuucacucugaggcugauugacuccauagcuguaggagagccagaaggggccaauggugcuacuaaaauacuaccagaagagcucaucucacacaaacuagacugaggcccacuaagacccgggaaggaaggccaccaccagggccccacuguggcucagcugagcugcaggcacggcagcauccuaagccuuuguggccucagaggcaucacccacagacucggguuuagccacguagcccagcaugugguacagacagaucuggaguuguguggcggcuacaauugaugauacugacccaucccucuagagaaacccccacuuucugggcuucugggcucucguaccuccuauucucaucccccagacuguaucccugguauuccgugcaccuuccauaaggaugcuggcccacuccuuccgacccuauguuucuaacccuaaccucucgccuaccacacagccaucuccagaaaaaagagcuguguuaauacaacagugugccugcacuuccacacaacuuauauuuaggcuuggcuaagcacuguguuuucacaguugaucuacagaguguggagagaugagaugacuugaaaaguagccuguuaauggguuaguaucuuaaagaaaguuuacacaucccagcaucuugcuuacgacacugacuuaacacggcucuugucuuguuauaccugggaaacaguuaaagcccugugugccucugaacuaucuuaaccaaagguguauacacaggcccagcacuuccaauaacacagcaagugcaggucccucuguagacucaacaacuaggacaaaacccccaaaccacaacugaccuuguuucuccugagagcacaaauucugaccuuggagaguuaagaaauauuuuggaaauggcaacuuagaugacaaagucugccuuuuaauuacauggagaagaagguaaauagaaacagaggaaagccugauggguaacuaugugugugugcauguguguauauguacaaauacauauguauguauuuggagaaagaacuugucaacagacauaggcugugguccaaguuaaauggcaaaguucucagguuuuucuacagcuauugacaaaauacacuacucacccccaccauccccaaugagaaggucauguguggugaugcaugguuuuaauucuagccuucaaaaaguagcagcagaaggauaucggggaguucaaguccagccugcucuacauagcaaguuucagaccagcuagagcuacauccugagaccccgucucaaaagaaaggaaaccauuauuucgguucaugguuucaaucuauggucacuugguuauguugaguccaaaccucuagugaagcaggguaucacugcagaggagagcaagcuuguguguccaucagaaaggagaaagagcaggaucugggaacaagacacacccuuugaaggcaucccaccucugaugacuaacuuccuccaauagcuccgagcuccuaacugucccuucgucuauuaaucuaucaguggauucaucugccgguacucaucacuuaagaucugaucacuguuaauagcacugaucaggaacaaacuuucuauaaaccuuuugagguuuauugaaaccaaaccaaaucaggguccuaucuaaacccuaacacuauguaaaccauggcaggcaucuugucuccuuguccaacuauuucaaaaugcacuuaagcaacaugaucaugcugugaagaaccaggcacaagaccugaggagugcgacaggacaccccgcucacuugaaagccaugagaacugaggaagacaacacuauuugccaggcucuuugcuuauuucuuggagcauccuauggagacucuuaacuauaaacauuuuuagaauaaacauuugcaggauaaauauuuuuaccccuuaaauaccgucagacuaaaaaucaugcuauuccgagacagagcaacaacaauaccuccccccuccccaaaucuuuaauuggagaaagaauguuucacuauaauuaaaggaaaaucucaaaauauuuaauaaauguuucuaaauuguacuguucuccggcucuggcuacacuaucaugccuuuaugugaggaugaacacagucuggggauucccacugcuaucucguccgugguuuuugaagguguugucauguggucaguauacuuuggugccuggaggacuggcccagggcaauguggcuacuuggucauaccaacauccccaacaacucaggguauuuuuugcacaaacagucaguguuccucucucacuccagguuuagaaguagguuauuauacuuauagcaugacagugggccacagaaaucuacaggucuucaggagccagguaaguuucuucuaaugacaaggauguuucuguccaaucagcacacaggcacuguccccagaguugauggugacagugcaccugaaaugucccuggcuuguucucccaacugcgccuuauccucaauuagcucuccaucuacaagcugagauaucuuaucuaauacagugacaauuaaaaugucaccacugagauaaugaggacagacucuuagggcuucugcagucaaggaggaagaugacugucaggucccugucaggcuguguggaagaauuucuuuucuagcaagaguucagauaacuucccagggcuggaaggcuugccuccugaaccuuuccaucauagacagaaacaccucucuaucaaagaugguaugaccaguguagagucacagauagcuuaaaaccuagugucccaccacagccuagaugaccgucucaaagagcugcagcucccguucgagaagccggguuaccucucccuccacaccccugcccugagaugaggagguaaaacugccucucugaugugugguucuugcccuacucucucccuuuuccuguuaaucuccugcugggacaccagaggcuggaucugggaagccgauggucgaugguccccugugagugauaaaggugauugaauguucuaacaauauuucuucccagagaggaaagagcaggucacacagaacuaucaacaauauguaugugugguagggagaaaaacgguuccccaaggguguccugcucugaauuccaagaacgaaagaaugcguuccuuucuacggagacaguacgcagaugugauuauaucucgagcuggguggcuuuccaggugugcucuaugcauucacaagggcccuaaugagagaacuagaaaacaggaagauucaaacuauaggccagauuggggaagaugaagaaagaacuauaguuuaaaaaucauggaaagucuguugggaauugguucuaaugcuuugucuuaauucggcucucaaagccaagcuuccagacccugcccccagcuggcuuccauucguaguaaagaacugccauacggccaauggcugggcagggagacggagaagggaccuuuagauugugcaagcaagggaccaagagggaaggggaaggagaaucgccaugacucgaggcagagguuuaagagcugcaggagaaaaacauccagcaauguagguggaaagggaauguggccccauguggggcccccgagaaaguaaaaggcaaugaggcagcaaagauaaaauauagauuuagaagguaugaagcuaggauaccggaggggaauguaugauagcugcggggagguuaagaagugcccagccauugagcuagucaagguauaucaaaauuagcuggaacgugcgugugugugcaugugcgucuuucauucacgaauacagagcuuugggcgggugaaucacaugcgcacccacggggagccaaagcagauuaacuaauucucugcuccagaaguccagacacuagacccagcaaggaaguaaggugucucugacaccuuuaaaggcuccagugagacgcacugccaaccucuggucuucagagcugcaagaugguaaaucugaguccguuuaugccucagaaucugcgacgauuccuuccagcagcgauaggaaacuaauagagcuaauuacuuccuucuuccugugcuaaucgaacuaggacgucugcacagcagagcaaauguggaagaggccuggcugcuaccuaaagcccacuucucuauuaccucagcucucagcugcacguucccauaagagaaacaagcaaggcaaagcuuuucaucugagccgccuagcaccccaagugccucaggaguuaccaccagaggcacagaaagcggaagaggcccagugguuucagagacagcuaguucauagucucuaagccagcucugcagauuccuucucuuauuuuccuucuuuuauuuuacucccuucaaagucacaucaccuccucccuaagccaagccgccugcaaauuuuuccacugaaaagaauguuucaauuagccagauacagauauuuucauauuccaauuuggaaguaacccaaaccagcuagcaagugccuaacaaugcaggcuccaggagccuugccucacaggccagccucagcuccuggcuaaggcaggauuccguaugaguaaagacggcagucuugaagcuggagagcgugaguuuucugcugacguacagaagguaugcaagucagugcucgggcuguugagcaaauuccacccagauguuuuuaccaccucagaaucacagcuuucacaagagacuuguuuuuauuauuuuugaaauaagacuauauacucugagcaggaagugguauuggagaucauuauuugaagccuucacuuggagaauuuucucuauaagagcaccugcacggccccuggauuugaccaagaagcaaaaauccuacugugccucagagacaacuccuggccaggcaucaaggcuugcuuuuuauguaaucagggguaggacugaacacaggaacaugcgcauuuaacugaagaacguacugaguuaaaugaacuuauaaacaucucuaaaaauauaauuaauauauauuauuuauaauauauuaaucauauauauauacauauauauaugaagagucccauaguaccuacaaaagauugacuccaggacccucauagauacuaaaugugaauauucauguaguuuaucuaaaaggcccaagcauggcauccugugugcuuacauguucuccagaucacucaugauggcuaauacaauguaaugacuacgucaauacuuacguuggucaagaagguacaggagacuacuaaugcacaggcugcuuuguccauauauauuuuagguagaguaaguugguugaauucuuagacauacaauccauaggugugaaaagguucaagccagauuacaaaguucccaaggacacacacucucugagcacgauccuguccacuguuacagcuuacuuagccacuacugcaaucagugcuugucgaacucaacugaaaggcuccucuuagcucucagaaggagagguucucugcaaugagaagcguacucucuucugacccuucaagacucccucuggaacagcaccaugaagcugccacauauuguuggaacuucucguccuucacuagcccuugauccuuuaagcucgcuuuccucugcauccaacccaguucuuaugguuguauauaccaugucugagcucaggguaacuaggaugccaccugcuucacaacacaaaaagacuagugucccuggcuuguggaguucccuguuaguuaugagaucugcuuuccuuugucucugaccucugugcacugcuuucccacucuuguccucgucccuugaguagcaguuccccagacagugucuugaagcacccagcacccagcacagcaaggcagcaaagaggaagaugagaacuaacaaaaaccauucgggaucacugauccgaucacucaggagacugaggcagagagauugccacaaguccaaagucaaccccaccuacagaguaagauuuuuuuguucuuuguuugguuuguuuguuuguuuguuuguuuuucgagacaggguuucucuauguaguucuggcuguccuggaacucacuuuguagaccaggcuggccuccaacucagaaauccaccugccucugccucccaaauguuggugcugggauuaaaggugugugccaccgcugcccagcagaguaagauucuuaacaaggagaaaaaaaaaaaaaaaaagacugagguggcuaucccugguugucaacuugacuauaucuggaaugaacuacaauccagaauuggaaggcucaccagugauccuaaucuggagacugggagauacaaguuucugaccuggaucuuagcauggagaucuugaggcauaguggcuaugaauucuagaagauuaagacagggagaucucugaauucaaggucaucugggaugaagacgugguggcacacacuuuuaaugugggccacaccuucugcuggagaccuacauaagaacauuggaagaaggaagauuuacacucucucuucuucaacugcuugccuugugggacugagcaacugcuagaaccuuggacuuccauucacagcugcugcugaccauugcugggaguuggacugcagacuguaagucaucaacaaauucccuuacuauauagagacuacccgcaaguucugugacucuagagaacccucacuaauacaaagaccucacaguuucuuaagaaacggcaauauccuguaggauccacagcaccugcuuugcuuccaaaucacaaggacacagaaaaauacaugaccaaugucaaugccauacugggcagaaauagcuaugccucaguuuuccugucuggauuauuccuucaauggaagccuugaugccuauugugucugguuacuaaggacgcaaggaaaugaaagcaagaugcuauuaaucauuagucauucuuaacuucuacuguuuaugguauuuuggauaugaacugcauucuuaaugccucaagucuuacaggcuugguuuucaucugggggcagaaaacaaaaggugguggggccuggcugcaggaaguaugucaguggggauggcccucggugguuaucuugccccuuccggucucugcuucaucuuggcucccauaagguaaacagcaaacggugcuuaccguguucugucuccauaauguacugccucacuacagacucagaaaagagccaaguguccacggacuaaacgcucugaaagcauggaccuaacauagucccucugcccuugaguuguuuuacacauacucagagaauuaaaccaagugcccagcaguuucccuccccuuaaacagaauaacuaauacuguccgggacaagcaaccaacuuaaaaagaguaaagaucuggaagggauugagggacagaaaacuggaguccugguguaauguaugagagaaaaauucauuuaaaaacaaagggguguuggggcuggagagauggcucagcaguuaagagcacugauccaggaccaggguucaauucccagcaccggcauggcagcacacaguucugacgcccacauaaaggcauacauacaggcaauccaccaauauacaugaaauaaaauuugaaaaaaaaauaagaaaaggcuguauuuuuagagaggaaaggggggauaucugcauauaguauuucuaccucuaaucauaagccccugcuauccucuucuggagacaacaggaagaagcggcuucagcagggugagacuuaacucugcagagcccacaauuccuucugcaugguauuaaggcacgugcugaaccccagcccccuccuuuccccauuucucaaguggacaacaagagcucacugcacuaccugcagcucuucagccugggccauacacccugggccuccagaaaaaaaccccacucugcccuccgcuggccagggcgacagugaacucuaaacuucugaaacagaacucccuuaagaagcccagccuagacuggaaugagcuauaguggcugacauuggucuugaacucaugaucuuccuaucuuagccucccaaugucaggauucuggguauguaccuguauggucaugccugacuguauguacauuuguuuaaguguccuuaaagaaauacuuguugacacaucuucccuugauauauaguaagcuuucuuauccaauuuccuagaaaacuuuguuugccagguuaucugaacacuuuaguuuuuuuccccccuuacucuaguuuuucauuaucagacuucuucuugaucaaacaacucauguccuucuaaauauaagaaaauaaacacaggaagcucugaggcguggugaaauaugaacaaauggaugagcuuccugauguacgcugugucacaucccucuaugacuaaaucgucuaacgucugcaagaacuguagcuggaaacuccugacccaccacagcccuugguggucuccagauacuaaccguggacgaggcuugaagucuaacucuggcucuauccuauacuaugacagaagacuggcauccuaagaaggccuccugaccagucacacuuaacugaauguccccagcauguccugucuuccaacuaacugcuggggauaaauagugcacuucuggacucucgcugucuggucauauuaagaaguccuugcuugauccuaccccugcaacgaaaagugcacagccaucaauuacauuaaagcuguuaugugguaaauuugaauauuguauaaugaaggggggaaaucaagggcuucauuacagcucuaaaagagacaaguaaagcuauuuggucacgaguuuaucacugaauggugacccucaggguaacuauaauuaauauuugaaaaacccucgagaugggguaugguauucacgcuuauaaaacgccuuuuauuacacuccuuccaauccuucggcuuuauauccaacacuggcccuuaauuucauuuuaaguacagaagacauucuuccucuagcugccaugccucacuuugagaaggucugugucaaucagcuuauuugcaauuaaagcaaaucuccaccaccugccucccaccagggcauaaggagacaggagaagagcagggggguuccuggcuuccuuuccaaauguugaugugggcugguugugcccuagcuccauugccucaagccuccugcugggguagcagucaggaagggaugcaguuguaugcucacagacaagccacucugccuugcaggaugcucugcaggcaucucuguuggugcccgcaguuuccacagagccuggaaacaguaacaaaggaauccaguucucagaguucuccaagcuccaccucaacccuggcuccuaauggaaaccggcugcugccagagcggguuuccaucacacagaagcaggggucacggaugccucugggggucugaugaaagccgcaggcucccuccacagaggagacaaaaaaaaacaaaaaaacaaaaacaccgaaaggcagaaagaaaagugcacuuucgaugugacggauucccugaccuccagguuaggauucuaggauuuuucaagccugaaagagaaagaauggagaaagagaaggaaacacacagaggagaagauagaacacguggggcagucggcccacgcagcagaacacggagggaaaggccucuaggucuuugcaugugacaaucagaugaucuaguuuugcccagguucuaacuccccgccaaaagccacaaaguuguguggcuucaucuaaaaugacccauuagcccuaaccuaaaucacucucaggccuauaaccaucccaaaguuuaauaaacaaacacaggggccaaaauacaaaucucuagaccccuuccuccggaugacgucuggaaaauggcuccaccugaagagccuugaaccacaucacagcaauuagcauuugguuauagguaucaguucucuacaguuaaagggaggggaagggccagaagaugaucugaguccagaaaaacaaagguucucuaagcccugacucgccagcuguuuuauagauucugguuucucuccaaccagacugcaugcacgcuccuuuggagcaaggcaacauucuuuucucuguauugccaagcuucguguguaguaggugcucagccaacacaagacucaugaguuuggguagcugugucaguagccuccaggagcuacuuguuagaccauuuacagauuuaauggugcaaucuugcaccaaaacuucguauguagugcuaagaugccagaguguggucacaaaacaaacauaggcucaaacuauuucaaaugcuuagauaccaagaaaguauaacuccucacuuucuauuugucaaggaagccacagauaaucauuauagguagcacugggguugugaggaaccugaagcuacugcaggacugucacaaggacucauaucuaucaggaccugcggagaagacuggaacaaaaguccuuuuuagccgaaggucaaagccaggcaacacuccaaguccagaaaaggguucuuucaacuauuaccaaguucguucuacgaaaaggagguauuucuagcuggucacauggaaauuuucagugguuggguagcaaaccuuuggaacaagaaaguaucuuuuucagaaaauggagauucacagaaaagaaacaauguuccuuauuaugacagagagccuggucuuuucaagccauuccuaugcauuagaccaugcaguccuuucaaagcagcccuuaaggaccacguguaacuuguccauuaucuccaucuuacagaugagacaacaaaccuauggaaaaguucagacuauccuaacagugggggcuuccugaaugacugguccugaugagaagauggauaggcccaggcagugggggccugaguuguuuuguucgugcuauuaucuguuuuaccuuaaauguaggaaucacggucacauguaacuauuucugcccuagacauuuauuugcuuggccucuaaacuaucugaauuugugaacuaaguuuuuuuuuucucucucuuaaaaagggcuacacuuacuaaauaaauaaaccuucucuaccuguaccaucauagaggcagacacacacacacacaucccaugaaauuacuuguucuccuaaaucuucuuuagugauuagaaaacuaagggggggggggggagagaaaugacuuuuuuuuuaaggucaagacauaaaaucuaaaugugucauguuaaaaauauguaggaauuuccugagcauaugucaagacagaauuccuuagaaaagcauuacauaaaaguucugagcuugaauacuugggcacauuuuagguuuugauuauccuuacuuaaaggacagccacuccaaauaugcacagaaauggagccuuccugucuccacagaaagggcuucuucuuuuacuuuuguucuccaguccucgugagcuucugcuauuaaaaaagaaacugagggaaaguuuacuuagaaaaagaaggucauuuaacaaaauauagcaaaaucauuccagcaacacauuuacaaugauuugcaugcuuuagccaagugaaaaguugcaggagggcaaggcugauucgacagaugaccaucagagcucaaaccacacuaagagaagaaaggaaaguccauauggucaucucaacagaggcuggaaauguuucuaacaagccugcuucagcaagggcagaggggaaugccaaccugauugaggacaucaagugaaaaccuacagaugauaguacaauccuaagcaacugaaaccccucuccucccaaggccagaagcacaccuaggauaucuauccuaaccacuaauuccugacauucuauuagaggucccagccaggucaacugagcaccaaacaagcaacuagauuauaaaugcaaaaccaaaauggccuuauuuucacauucacacaaucuugaacauauugagauccugaaaaauacagauucgaaguccuaaguaacacacacacacacacacacacacacacguacacacacacacacacacauacacacacacacauacacacacacacacacacacacguacacacacacacaccccagaaaguaaacacuugguggcccaagaugcaaaggcaccugaaaugcuuccuccuuggaucucaccaaucaccacaccauuuagaacuuauuuuagcuuuuuaaauauuuuauuuaaaagauaauugcuuagaagaagaauuccugguagauucauaguucuggaaacguggaggggaagagccucaugcuuuugcagccaaggaagguaaguaaugggaaucagaacguauccugaaguagcaaaagaucuucugggcccauuagagaacagcuaaucuauucaaguugugacucugucuaauggguuuucuucccgaguacuuuagagcagcagcaaccaguucaaaauauucucucucagugcucacacaaauuaaaaagcagugaguucauuuguaauuauuuauauuuuuaccuuguuccagccucacggagauuuuuaaaugccauuuaaauguuucucagugccgauguguacuucuuccugcuucaaacuuaauauuaugauuccaacagugcugagaauauuucuaagcaauaaaacaaaacuugcaggaaagggaaaauugcucuuuucagaaaaucauugcauuuauguauucuucugaggacaggaacagagguucagcccuaagucucaggugaccccucuacuuggcggccauaccaggugcucuccugcucagugacgcucugcuuacuugugagcccacacugcuuacuugugagcucacacugcuuacuugugagcucacacugcuuacuugugagcccacacugcuuacuugugagcccacacugcuuacuugugagcucacacugcuuacuugugagcccacacugcuuacuugugagcucacacugcuuacuugugaacccacacugcuuacuugugaacccacacugcuuacuugugagcucacacugcuuacuugugaacccacacugcuuacuuugaacccacacugcuuacuugugagcucacacugcuuacuugugagcucacacugcuuacuugugagcccacacugcuuacuugugaacccacacugcuuauuugugagcccacacugcuuacuugugaacccacacugcuuacuugugaacccacacugcuuacuugugaacccacacugcuuacuugugagcucauacugcuuacuugugagcucacacugcuuacuugugagcucacacugcuuuucuugcugcuucaagauuuucaaaggucaaagccagguucaaggaacacagcccaacuaaaagaaagccacaaacaucauuuuuucuauaaacuaacucauucccuuccaacgaacauauuuaucugaccucugguucaaaaauuaauuuuaguuuuacuaugacgugcaaauuaccuuauuaauuugggaaucgggacauaacugaauauauggucuuaauugcuacauaaccacauaccucuaaacaaaauaauuccccuaacauuuuagccuaucuuaagaaaccuuugucuauuuggauagaaaugcgucauuggcuuuguugguagcagugauggugguggugauggugauaguggugguaguggugguggucugguuguguguguuuguguguguguguguguguguuuauuucaaucaauuucuuccaugaauauucaaagaugugauaaacuucaguaaaaacagaaucauagaccaaaauguaaagauuuuuuacaguauacaacacacuacagaaguguucccaaugcucucuugaaauauauucuaaguugauuuuaaaauucuaauuaacaguaauacaaugcugacaaaugaccuaggaggccauuucaccacuugccacgccucugucccgaaaagggccccaugcuggcccaggcugucugaccugcugcuauacugggugaaggagguauuauggguccacaguguugugucuggauucucuguaugacuccuuaggcuaauggaauaggagcagcacgucgcaugccacagccugacaaaggucccuuucuccuccuuccuguuaacaggauggcauguuccaaaggaagguauaccugccagaguggucuggaaagaggcaugggcagagcugauccacaacugccguggauagaacuacaccucagacacugacaucugugggguguuuacugcugcagucucaccugaccgugacaccucagcaauccgaacauaacccuacugucacuggaagaaaauauugguccuuauuuggaggggaaauugauuacaggaaauaaaaaaaguagugacucacacaacaccccuaaauaucuuuuaggcaacaaaacagauguagccauuaguccaacuagaggaauaauuaagcuuaucaaucuugaagaccuacugugugccaaacuacuaacguauauucuuauuuaauccuuguagcaaaugaguaucgguauuacuuccacugaugggcaaagaaauggaggcccccaugagaugaugggacugagaaagaugggacugggagaggcuaguaaagggccugucagaaucugagcccugugggcuggcucuaaaauccuggucuuuccaauuaccaauggugccucucugauguugccugccaaguguuuuuuuuuuuuuuuuuaaaucuuccucaaaauuguauuugucucauucucaaagagacaucuuuaaagaaaacaucuauggcuauuucugacaucugucucaauuugucacaguccauuaugccaagaaucuauuaauuuuacuuuaccaaaccaucucaugacaggaauuuaagccuguuuacucucuucugucaccaaggcagcccaucuguauagguucagucccacaggaagaggacaggccgacuguguaaggaauggaacaagcugcuaugagacuagcuacuuuuacaaacaccuucugcagcucucagguggcucucccgggguaguacugcuaguuugacugcugcaccaucauuguugcuauuaauagagcuacacuuagguauuacaauacauguggccagcuguggcaaacauuuguugccauuuuguucaaccauaaaacuugucaaauuagugguuuuaugggcauacaaauaauuaagggaaaauauauagacaguguguuuuuuauacaugguaaauauggacaaaaaaauagauuccaaaaugauaauggccugcagacaauucauguccagggaagccaauuaaucagaaccccuccagccugcacccaguauacggcuacguuauucaggguuuuaacauucacaacaaaucuuaagaugcuucauacagauaaacuucccuguuccuaguggagacucguguguauacacacaggauggauaaaagaaaagauguuugacuugcacauggauaaaucucacuaauauuuuauggcuggugagcccuuggagcucacacuugauggcugucauuaaguggaggucuuuguaagauaguggcuacguauacacacuuccugaagagaugcuccagcucugccacccuagcuaugggcucuguguaaugugcuaccuuccuuuguuucuccacagaacaagaaaggacagagcccacuuuaaagguuaugaaauagcaugaaauauuuaaagacucaugaccccuccuuaucaguaagagcccaagaaccacucauaggccggacggcccaccacccuuucaaaaggauucuaccauuacgcgucaguuagaauaauacacuggggcuccuggcuguguuuuuuaaguuugaaaauaauucuuacaaauccauuuuaaagucuccccaauuagacaaguucacuaaauuuuucuggugacuuagccuuacccaauuauuucugaaucaaaauuaccuucaaaacacucuaauuaaaucacagaacgugugacagagauuuaugcugaaguggcuuaugcagacuuucauuaagucacuaauaauaacuaugaaguaucuaucuguuaccuuucacagggaguauuccauacacaacucugugacuacuuuuagaagcucccuuuccuggcagaagaggaggagggagggcaaaugagagaucuagaaaagggggaggaaggaaugugguccuaccuauaucuuaggucuagccccuccauccuccucugagagcugccuugagagcuguuucccuuccccucaaaagugagacauucacagcuccaccucaccauguccagccacuuuuucaccccucugcccaucagugaaccuucauacuguguuaacacagcagacaacuggaugaaugcaucuggccuuggacccaagguccucggccucuccauucuccagcuuucucauccuccuccauccuguaccaaauaccccaggccugcuccccauccucaucucacuccuccuccccauccuccccucacuccuccugcuccccauccucccuucacuccuccugcuccccauccucccaucacuccuccugcuccccauccucccaucacuccuccuccccauccucccuucacuccuccugcuccccauccucccaucacuccuccugcuccccauccucaucucacuccuccuccccauccucccuucauuccuccugcuccccauccuccccucacuccuccugcuccccguccucaucucacuucuccugcuccccauccucaucucacuccuccugcuccccaucuuccccucacuccuccugcucuccauccuccccucacuccuugcggacaauccucucauuuucaccagcaugcacaugcugggacuccccaagccuucuccccucaccuucuuccugcaugucaggaucuuacagccucuucucuauaugccguucuaaccgcacagcgcuucaucuccuaagcaacaccucuguucccacgcucucaccuccccaguccacccucagggucugacaaccccaccucccaaaugcccuucucacuccccuuccucccuguccuccacgcugaccucagacaugacuccaguauaagauuccuccauguacaaugccuucuagacauaccaccaugcaagcacagccagcguauucaccugaucauucaccuucacgccugaccaucuacaagaaaauguuugggcuccuugcagggacccucuggaacgagucugcacuucauucuccagcuuccucucccgcuggaaguuccccccuuagcugcacaaaccuucagauauagccacuguuaccaagcacggucaugccugcuguuccucuuccaccucugcugauaucacagcacccuacucuguccuucuacucacauucauccuuuaagacccauaagcugucacucaucccuaaaugguaccaccgccuaaauaucccgagaugccaggcagguaaaaaccacacuuacgaguauuugaaaaaaagucuguacugggcuaaagcacacacucaucaugggcuagaaguaaggucuagucacacuuaucugucagacucuaccaguggcugcucucuuaauccagaaaccuacagauccagagaaagaaaguuacaaagaacagcuaagagaccccuggacucuacacauacugugcugcauuauuguguaugguauuuuaggguucuaaaauauugcuuucaucuugcugagggauagaaguaaggaaaauaauaugaauuaauuuauguaacuaauuaucuaucuaaauauuagaaacuaaaaaugcuagauuuccucucauacuauaaauauacucagucucccccccccccccccguuuagauuagaauacaaagcaaucaguuucaucauggccucugcacacacauguuguuauaaagcgcucuuacucaucccccagaggcaaacaacugacccuccaaacgucuaacugcacuuggaaccuguuacucaauguuagaguuuuaaaccaaggcaaagugauaacuguguaguaaauaaaauucacuagcuuucccagaccaaaaaacaaaaacaaauuccgguaggucaugccaaaagauuaaauucuacuuauuaaaaauggaagaaaaggcaucaagcaagagaaagcuccaccaugcuuugaaggagaaauuaucuccaaggacagacagacagcagacagacagauagacaguccuugugucacaagaaugacccggccuccugggucagccaugcuucaaggacugcuggcucugcuggcagcuuggaacuggucucuccucacuucacuucuaccacuguaagcuggacccaggaggcagagauguaccacaggcuacaacccagucccagggccaggacuauagaggugaacuuuuaaccugagggaaaaggcauucaaaaauggcugauuggcacaguggaugguggaguccauuucucagcagauaaauaacauucauauucccuuaggagggucugcagugccaagcccgcauuucccuugaguccuuguuucuaccucccagcagggcaggagaggggcauuucagaaaguggaaggacaucagcauccuagggagacagaucagcauccuugugagaucugucuacccacagcaucccaaacacauggccucucucucuccauagguaacugcagagcuggcacuacagggaugccugcaucucagaccgaguucaaguccucaagcuuuacccacacauuuugcacagcucaaguuccaagaaaugacagacuccaucccacaggaaaaaagcaagccgggcccugcugaugcaccaaagcaagagcccugaaccagcugccuguacaguaccacuuaagcucagcacccaacugauugcuguucacuuauuuuucuucuuaagaucucuugacccaacagaacaaagcucuggguccuuuaucuaauuauaacggggacugucucuaugagcaacuauuacauacuguuagcuuguuaauacugcucucuacaccuuggaagugaaugcauuacuuugaugaugcaaauacaagccagaccaguaacuggccacguguuccccuuaccucuaguuugugcaaaacagucuccuuuccucuuccucacgauauaaaacaagguaaauuagaagaaaauaacaaggggcuggagagauggcccagcgguucagagcagcagccacaugguggcucacaaccauccguaaugggaucuaauguccucuucagguguguccgaagacagcgacaguguacgcacauacauacaauaaauaaaucuuagaggaagacacugcaagcucaagacauaguaauauacaauuaguuagguagcucagcacuccaugacacacgagguaguaacaaguccgcaaggaacacaaacaagaucugaggcucuaacagcacuauaaauacuucugcaagugcuaccuucaccaauuggcaugccucguggaaggccacagauuucaaucugccccacuauuccugaaaagucauuuuuuucuucuccaacuccuaaacacugaguuguuuaaauuguaggaaguggaagcauguguguacaugugugaggacccccucauuaaugacaucaugcuaacgaccuucccacagauuauacaggauacacaguguuaacuaugcucuauuuuauuagucccaaguacacuuauuuuucuauggaaacaggguccgguuagccagggaaacuauggggaaguuuccccaccucucugcgguucucuggcagagaaauggcagagugaaacauaucuggucacacugggauagaagugucuggaauuucugucugaggaauccaaaaccuuccuucccuucauggagcuugaguugagacuuuuuccuaggacacugggaaagcugucauuuggggcucuggcuaccagguagggcaauuauucuguaaacuacugccaucccuaaacucugaccugcaccccuuuccccccaaaggcagcaugacugagaaugaacaaggacauuuggucuccauucugggcagcuauugagucucccuuagaguccccauagauccaaaaggucuuaggaccaucuagguagucccagagucccccucagaugcaguaguaacagcugaccaaggagaacugacaaguacugaauagcuauaaaaagugauuagccuauuuguuaccaaguguguuuacucgggguuuuaugucuguuucaacaaucuaggauacaaguaaccacccucucauucaucgaauuguauuaaaaaggacagagcaauaaaauaaaugcugccucuaaauguaacuuccuggcauuaggaaacaguguuccucuagagucuccccugaagagcagagagaauaacagaaagccuucugaaagagggucucuucaaaggcauaauuucuguccucacaagucagagucuguucugugaggacucaucauuccucaagaaccuaucagaaauggaaacccauggccccaccuugguccuauuaaauuaaagucuauauuuuaacaagaccccugggcuaucuggauacacauuaaaguucagauguucccugauacauuaaguacacugcccucuacucucaaaacagcuuuccuugguccauaauccucuggauaccuucuauagaaauacacacacacacacacacacacacacacacaaaacccaacaacaacaaaaacaaaagacaacaaaaauaaaaagaacaaaaauaaaaauguacuuuuucaauuuaaaaacaaaaacagauuauuucccagaauuggggcugaucuaguacaggaaggcuuuuuuuuuuuuuucuucccugucuaccugucagggagcuaauuaacauuucaaugaacgcugacagaaaauguguucucucacuuccuaacugagguaaacggcccagguaugacaagaaaaauuuaacuaagacuaacaggcucgcauuacaacccccagggggauucugaaaacuaauuuccugcccauaaaaaaagcaaaaauaaaauuauuuucaguaucaagguaagcacauaacugugaguugauauguuagugcggucuccaaauuacagucauuuuuguuuaccuccgcuaacaaugcgccuccuggggagauauucuaugaagaaguuuaaguccccucccuggcuuucuccacaaguuaguggaaaaacugcacuggagagauacccaagggacuacaauuaaugccuucugcuugcucuggcuccugcuccccaguaaugggagugggcucagacuguagcagcuggaaggagucuaccccaguuugccuguuauugugauaaacaccaggaucagaacaacucggggaggaaaggguuuguauggcuuacaagaccauccugaagggaagccuaggcagaaagcuggagaccggaccgaggaagcaagagcugaagcagagacuauagaggaaugcugcugacuggcuugcucagccugcuuucuugaucuuauauacacaccaggggaggcagcaacccaaauaggcuggacccacccaagucaaucagcagucaagaaaaugcuacccagacaagccugcaggcccgucugaugaaagcauguccugggauucaaguucccuucuccaagugacucuagugugugucggugugauaacaacuaaucagcaccaaguuccagagauagcccacaaccgcugcugguccacuuauccagguaaucauguuuucacauggccucggucacaucauugauaaauguucacacaguacccugcccuauaggcaaccucggcccgcacccaaccacccaguguguccaccaccuucagacacccaaguaguuaguagugguuugagauuaaaacucauuucaccucuuaguuagguggugugguauccucauagccugguauaacaguauuuuguuucuacuaaaccuaaauuuccauuagcuagauauacuguaaggggacccacgguaccaaaugaagucauuugaugcaauggcuaguacuacaauacauucuuagugaaacauuggagauuauguaaugcuucacaugucuacauaagucacuaguacaaccacauuuaucuauugcacuaugacacaaaauugggaaagacuagucuucacucaaaugugucccuggguugcaaugucgagccaagaacuguguuuuuuacauauagcugaagcagaccccaugugguccuucaauaagcuucuuuguuuauuaaaaaaaaaagaaaaggaauuuuaaggaagcaaaggcuguaaaagaagcaucuuuggcccucguggaguaacugaugcuuuuauuauggaacgccacagccugaugagguaggacaagcaccauuauggcuuuuaagugauuaagccaagacuuagacuggggggggggggggggugagcuguccagagcccaacagaaagcaagguugaagccagcugaauucaaaaucuccaauuacauuuccagacaaaagggaacagccgccaauguugaaaguaaguuuuacagauuuuugcuugggaauaaaacaaggaaacaguauuuucuaucaaaugauauuaauauguucuuucauggccuugauuuugccacccaggcuuucuucccccaaacuaggaaaacuuagacaaaucuauuuuaagucuugaaaucccauuuacacacaaaauaaccuaguacuucauguugagaaauugaucuguuguuuaacuugccuacuauuuuaaccuauguuaagcagaagggccugcugaguugcuaaucugcagugucauugauuagccguucuggcucacagggacuuuuucccaaaauagauucuuagcauuuucuaacccuccuacauuccacaaaagagaaucuggaacacaggaaggaaccauuuccauacacguaaucgcgucuucauugucaccaaaaggcaucugauuaaaacccaaagacuuccaacgcuuguaugucucccacgccagcagcaccccucaacuuccacauccugaacuaaccagcccuccuacccaacuguccucaacccaugacacauccgggucccuggucgcugccucucaccaaacaagaggauccauguucuuccggcuuucuccacacugacacuucugaaaaggauucucaaaaaacaauuucacccuggagccuguugagaccccuuucucgugcucagggcaggugcauacaaacaguuucaaccaaugaaagccuccuccgaagacuaugucaucacuuucagccaaugggaguguagguagcuuaccaaggcugcucuccuugaaauaccucuaggaaacucaggaugcaugcgccuagcucuccaaucaugccuugugggccauuuugacccaauaggagagagaaaagagacagagagaagcuuaaaaauugauaaugauggaagaaaauguccaggaaccugagugccaagaugagaaguuucuggaggugcccgacaugaaaagccugggaagcccagguccucguagacgcuguccugggcaugucuccgggugauugacuugaaaagaaucaugagcaucacuugauccccgggaagcauccuucagcagguuaggauacuguugguucccagcagccuggugggagugcaguccaucgucaucccgcccuagcuauaacuuuauguucaaauaaguaccacgcuuuguugccuccaugucuauuugcgcuauuccuuccacaugaauucucuucccuuuuauuuccuccuccugaaauucuacuuccucagaauacauuucagugccacgaagccaugaauauuuuacucucccucaacaggaugugcccgugccuccuccagugggcagugucugcuuuguauuucagauuuuuaugugcauagauauucucuaaugcuguaguaauuuccaaccccaacaagcccguauaaaaacacacaaucugguuauuacauuccuaagcuauauguccggauugggcagacuuagggcugcuacuugaaacuucuccuggccacaugguuaggcuccguauucacguccucuuccucuccucuuccucucuccucccuuuuccuccucauaucugcccccacuuucuaagacauccugucccaccauuucuuuccacugcccaaucacaggcucuaaccuuuauuuaaccaguuaaaauggagaaggggaaucacaggagaucacccaugugauccacugcucucggcagggggcagcugggggcggggguggggagcagccccucuucaggaaguagaauuaacaucagaaugcaaagagcaucagggcaaccuacaacacucuaaacuccuaacagucucuccccuuugccuccugaugggggaugcgagauguucucacauugcaggcuucaauccauggaugggaaauuuuuuaaaaagaaagauaucagauuugauauagaagauaucagacugcaucauguacaucaccggguaucaccugacacucguauuuuagucauguguacucacguucacaggaauacuggguugcaauguuaaauguguaucaacucagagucucagcgcaaaauauuuaagccaguaauaccuguccaauagcaaugccuaccacaugaacauugauuugaaacauccauguguuacaaucccuuuucccuuuugaauuuuuguuguauguauguggauauguccaugugguuguaugcugcauaugcccauggagaccagaagagaggauuguauuccucuagagauggaguuauaaguggauacaagcugccuccuguggugcuaagaacugaacucacaucaauuggaaaagcaauacacacucuuaacuguugagcugucucucuugccccagggguuacaaucccauaggguuggaccugagggguguauaaugccugugugaacagaaauguagggacucuggcuuauguaaagucugugggggugagggucaagcgacuaauagacaagaucuuauuaauauuuaugauuccaucuugauugacuuucucccuaggaauaaaaagguguucuuauuuagagaagaguaaauauaacuuaguuuuggaaaacuuuucacguuugacaaaccaucucaugaugaccaggcugcguguuuaaaauacacaguacagguaauuccaccgugaucaauaaaaagcacuccuagaaauacaaaaauaaaaaacaaaaaccaaaaagccuuuguucuagaugccccuaugccauuuucccccaccaucuguaaaagccaguucaucucccaaaguuuauuucaaaggccaccucuucuauggaagccuuuuaaaaaauaaguaaaaacuaaaauaauaauaauaauaaaaauuaagaaaaauugccuaucuacuauccaccccagucccaaguaugggaguagucgguuuuugacucucuggaacagaaaacugccuuuugcauuuauguucuuguccaacucuaaaacuaaggaggaaugcccaacccagcucauccccuacaucagccaccaaauaaacaaaagcaacagugagucugucgggaggggugaccaucacuuuagagacccugauguguguagcagcugagccaaaaugacugaaccucuagagaaagagcaggagggaaccaaagggaggcauugcucccugggauaacugccucugcucagggcucaggccugcagaagcugcagacuccugugcagaaggagccccuucucugcaucucugaccuucagaguagaaaccggaaguagcgcagcuuaaaaauguuucuuacggacauccaucuccguuuuaacagacaguugaaaugaucaguuaucggauagguccugcacgaaagaucaacccugagauacaaauaugggugcuucuguaugggggugauaguauggaaggagacagacacggaagcuccuaucaguugauuguaucacacuggucauacuuuuguuucauauacugucuauaguggugugagacucguccucccgcacguacaagaagcauacuuggguucaaagccagagucaaaacuaauaaagugcaauuuguuugcucgggauuccaugucuaccaauuagaaaaaguuguucuguuaccaaaauaagagucucuggcuauuaaucugcaccuccucucuucaaagaugggugcuuuuuuuccccuaugaugaaacagauguguucaguggucuuuauuuaaaauuuauaucuccuuucaugagauaauuaacaggcaccacuccuaacucauggcauuugguuuucagauuuuuuuuuuaaaucaauaccauuuaagguucugaccuucucuuuuaauauuuugacacaaccuuaacuugcagaugucagggucuugcuugguaauuccugcaaagccgcucuucaucggcuggaagacaucugcggggcucuagaaaaugcauagcccugauaucagaaagcggaccucgaagcuaauucuucauugaggcagagcuguauaaacucagacaagcuaccugaucaccuauccucaauuuuccucucuguaaaaaucagaccaacaacaguacguacaugguaaguuucuuguuggggaauaaaugaccuaggacauauaauggccaugccucugacaaguauguagcaaauauuagacuuaaaauaccugcugucauuuuuggucuuggcacaguuacagauuaaaacucguauuuucuuaucuauaaaaugagaguacugucauuuacuuuugagauguuaucagauucaaacaagaagauaacagauauaggaauaucagacauauagaaaguaaucaaguaugccaggcaugaaggacccaugccugguaucccggaacuuaguagacugaggcaggauaauuaccuugagugugaaacuugcacaccaagacuuucuuucaaaaacaaacaagagcuggagaaagagaggagcgaacgagcgggagggagggggagaaggagagagagacagagagagagagacuacauguuuuugaucaugcaugagcuugaaacugaacuguaaacauaaaagucuuuagcaaauccuaaaauugaguuagaaaugucaugcaaaaauugguccauaacuaagagaaugucugacauauuugaaaugcaaacccaaguuuuuugguuuaucuuuaacuuuaccuaaagauaaccuuuuguaaauguaaauucuauauccacaaaauaagaaacauucucuuaagccaaacuguucuacuauacuguaaucaagaaaucuaacaugcuuucuuaagccaagaaacuauauauugcuuacaaaucugauugagugugcaauggcuuaaaaaaaaaugcuuuccagcugugguggcgcaauguccucaaugcacuagugaaacagguaaaaucuauguggucugaggccagcccagucuacaaagcaaguuucaggccagccuggacuauguugagagauauggucaaauaaauaaauaaauaaauaaauaaauaaauaggauauuaaaaauuuaaagacaauucagcaggcauucuuugacaguauucaagauaauuuacugggaacugaagacacaccuugagcccuugccaaaaaggccuacacauuaccacugauaaucucaaaauacaacuuauaaaaaccauacaggaguucaauuugaaccagaaaguggauaaguagcauaaacaugcguccaaaaaauaaguucuccccuuuaacuacaagccugccuagauuuuaaaaagcaaaagucauuuuuaaaaggcaguuguuaucugggaagcuauugaauuugugccagaaaccaauauuucaaaagguaaaccuguaaaauaauagguaucuguaaaugaaagacuggaauaaccccaggagcagcaacacaguaauuagcaacuuuuauagaguaauaacauguuccauauucucucuacacuagcucuuugaaguugccaguguaauauauacaaguuuuauuacauuggagcccauccuuguguguuuuauaggugcuagcauuaugcagagcaagcuguagucaccgucggaucuucuauaagaaacugcccgauaauucgugagcucugugucuaguuuauuuuguuacaccugucuuuaagaaaauaaagucacuuugagccuaagucacuauggagauucacaugcccacaugccaucgagguaugugucauaaaucauaaagcaguuuagcuuuaaaauugugcaucgcauauucaugugcacaccacuugcaguuuuugacacaugugaacucuuuacugaauuaaaaagggaacugcucagcucuacaaucagcgauuaccagaggcagaacagaaagcaguuaauaugcuuguuccagcagauguucauccccguaaauauuaaacauaacacaaguuccuccaggaauauacaagcaguaauuuuaccaccugaauagggcugguuggaaacauuuaaggggugggggcaaugugagggaugcugaagcagccaaugggauuuuucagacaaccgcaacuagaauuaaauugcaucuaccugugauuuaccuauagcagcucucccuaaugcgagauuagcgagaacuggaaccccaagugcauuccaggcugccagcuuugagcuugacaaaaagagugaggaguucagccaugggcaugugugaagaaagggugcaaaggaaccgagaaccuccgggaaaugagucucccugggccaaggccuccggaauucgggcaccaagacacacuggccuccugccuagggugcucacuuuuccaucuccagugggagugagguaggacagaggaaggaugcaaacgccaagcagggagcaggcagggcgcaaggcuagagagcauccucuccgggcacuucguagagguaccaacucuagggggucacagggguggugagccugaggcucuccgggagcuggaggggagcacaauccgaaggaagggagcugagaggggcugcgagaugaggggugggcucucaggcaucagugacacguucuaaaaaucgguucucuuccccuccaccgcugcgcuccuccaguggcagccagaccccggcccccugagcuagcgcaggcaagcaccgaggggagagaacggaaccggagaccgacgaauucacggggaggcggccgagcauccagcccgccaaggcuggaaggagccggccagcgaggcggguguccccgagccaccccacccccacggcggccgggcacccggagucccggcccaggugagggcaggcggggccagcgcggcuccccagcggccagcaccgggacucaccacagcgacucgaggucccauuccuggagcagggcuaagucgaagcuguccauggugggaggugucagcgccgccgccgccguguccgccgccgccgcuguguccgccgccgccguguccgccgccgccgcugccgagccucgggccgcccgcgcgcugcaacgagaggcgcccgcuaaggugcaucccggccgcgcccgagccgccgccgcccgccugcccgccugcccgccagucacccucccccggcucucagugcccggcacccccgcggccccugcuucccgggcccgcccggcgcacucacccgcucgccggcucgcgcgcagccacacucgccgagagccgcgagcucgcucucucgccgcgccgccgcccccucccggccugcgcccgccccuccgccccucccucgcggcggcccggcccgcugcagccgccggcgcggugcucugcgcccgcccgcucgcccgcccgccucuuucuccuccgggaggcgcgugugcgcgggcgaggccgaggcgcgcgcgcgcguccugagccccgcgccgcgcccgccccgcgcgccccugcgcuccccgcgcuccccgcucuccccgugcggcugcucggggucccgcgcccuuucucgggccggacugccggcucgcccuccucacccgcgccccuccaucucuccagacccucaguggccccgaggguugcgggggacguccucugagccaaagggagcggcgcagcggcgccgagggcagggggaugccgugccgagccgaggccggccugcagcaaagcagaccccugccucucgcccucgccccguguccagcugggacuuucugguccuccgcaaauuaaggggaacccgcagggcgcugcggcuggaggugugcacucuugaagaucuggggugggcgcuaggaaggaaaagcccugggcgccccaggcgcggugagaguuaacagugcagcccacggcagcgcugaaaacaaaucguuucaaauaucuggagccaguaacuuaagugaaauaaagaggaggcgggaaggaagcgucuuccaagaccugcuuucagcugcaguuuagccugggggcugggaggacgagggguaucccacuagcccucagcugcccagucccuggaaaccagucuccuuucuuuuuauuucauacuggaaaggccucucuggguuuccacuacaaacuucccgccgccuccucuccugucuagagaguggcagauugucagcuggaaagaugauagaguaccacuguggcuuguaaaaaaaauaaaacccuugcuauuauuacucccuugguuugagagacugcuccccccucgcucauuauuauauacacucugagaguggggacuggaggcguagagcuggucuauccuuccaucucugggcuucugcccucaaaauugaggaucccaugcuggccccggggguggugcaugggguuccccucucccaugcucuuggccccaguuccuggagcccuguucaggauuccccaggauuccuggagagagcagcaccgagcaaagcucaccacuuacaccaaaccccgcaugcccuaagggaggccuuugcaguguaucggccuuuguuccuuuucuagacaagaagagccaccaugugaggccgccaaaaauuuagccccuuugguagaaauccuaggagcaaccccuuuuuuuauuucacccaccucugaaggagaacuaacgaagucgugggcgcagguagauaaacugccaaaaagccaacuagaguucuaugcucucggaaacagaacugcaaagcucucgggcccccauccuuuucuucccccagcuuuggaauaguucccuauuagcauccauaacuaaugugaaaauaucaaucgcuaagugaaggcagagucugcaucaaauccgcuguagaaacugacugguuauuuuuacaaacuaacaacuucgcugcuugaaacaccaccccggccccuuuaguugaaggcuacaaaagaacaaaggaaauauggacaaaguacaggugugaagggcugggauccaaaaucuuggucuacaguguaucuggagagaaggaggggggaaaugugccuuacagauaccuacuuagcauaaacccucuuggaaauguuugcucuggcaaaagugagcuauagacaucacauggagacagccuucccaggaacaaaggcuggggguggaggguggaggagagagagagaggggaacagccccugccuggaagaacugcaaguuccaaggccugaacaagaaauguguccuguuccuugggcuccuggcugcagcugggagucuucuccagaaaggagaccucccgccccucccagggaucuggcuucccgucccuucccuucccaccacaucuguuuauacaaaagaagcugcugaagaacaaacagaaccguguuuacugcgggucccaugccgagcgagccugaggcucggacacagauucaagccuccuccucuuaguggcugaagauaaaugggucccagaaaaggagaaagagcaaaaggaguuaggcuuggggagggaaagguuauuuguaaaaggucucccuaaaagagcuaugaagggauggacagauguauauuuaagugucggcucuggguccucacguuuacauuuaaguguacuugagccggaagucauuucacuguggguaauuuuuuuuuuaaacguuucuucacaaauaauguauuuucuguuuggggucuuuaacucgaggacggaugcauuaguauuuuauuucugguggauguuucugugaauagagcccacuuggagagugaaggcauuggaagaaacccaaaauguuguuguagauacugucuuugccuaagcugugauugaaauaaacugaaaaugaauagauuucacuggugagauguagaggaguuaaugagacucuucaaucuaagaacuuauuauuuauauuuuauauuuuaacuuguuaacuuauauuuuauauuuuauggcuguucccauuauagagucauugguguaugagccgaauccagcacugagacaagucaaaauuucaacauuaguaaaaaaaagaagaggaagaagaaggggaggaagaagaagagaaggacagagggaaggaaagggggaagggagagagaaugugaggugcugguacucucuagaauuagaaaagggguugguuuguugaguuuuuguuguugugcuuggguuuugguuuuggugacuuuuuguuuuguuuggagaugggggguuguuuguuuuugcuaggguuuuguuuucuguaaaggaacaagagauugcccagauagauagauagauagauagauagauagauagauagauagauagauacauacauacauacauacauacauacauacauacauacacaaauacauaaauagauacauagagauaaauacauagauacauacauacacacaaauacauaaauagauacauagagauaaauacauagauaaauagauacauagagauaaauacauagauaaauagauacauagagauaaauacauagauagauagaugagagagagaugugaaagagagagagagagagagagagagagagagagagagagagagggguuucccagugaagcaguagcuucggaacacacagaagauccgagggccuuuucugcugagggagaagcaacuugugcuacugagagcugaauggaaccgcccaguucaggagagggccacugaggaaggaagguagcgaaagcgggacugccuggccucccugggggccuggcuaguugguuggcugguuugugcuaaauccacaaaaugaaggaaggaagaaguggcuccugcuuaacaggguaugcgcaugugcuucagcaaggaccucguccucaauaugcucuccugggaugagaagccucuugugugcacccagaagcaaauccacagcaucucccaucuccaucaacuaauucccaagacauggcuggaacucagagguaguuuugaggaaccaguagaaucuuucucaaucucucucucccucucccugccccucccacuccuccucuauucucuagauaagagcuagcucuguggaugaccugccuggaagcucucucaaccucuccucccucuucucuaccaucuuuucuuacaacaccuuucuuucuaguuccagggaagccggcagauaacucagucagcuucucuuuccagaggcuuccaggguuuuuugaaacuaucuaggguuugccaauaaacccuccaugcuuuuugcuugcaaaugagauguuaauaugucaacccccaggacagcaaggauuuucaaaucuacccaggagcuccaguguccucuuucccucacucuucacagguagcacacaguggaucuagccugggauccaagguaccuuucucauuuuucccccucauucuccagguccugagcagauggugcgguugugcuggcugucaucacuccuccuauguuuccauggaaacauggggcauagggaccaucucugccuugggcucccugacaguauccucuggcugaaaacuucacuaaggccccuccuccuuacuugccugcuguccggagcuuugcagaacauucugggccacaggcagucagggccauuucagcaauccucuaaggacaugcucccugcaaaggguuguaaauugacugaaagggggaggggaagccaauaucucagucagguggcugaagccucuuugggauggcaacaaauacagauaaucuguccccucagccaccuuccacaauggcugagaauugccccaaaugucaaauucgaugcuucuaagguuuucuguguugucaggcagcagguauuuauugagugugaguauacgguugagguuuuacaccgcacucacaucccaccaccuggaaauguucauuccauuuuuuuuuuuuuuuuuuacaaaaccagguuuuucccuaaggaaugcacuuucuucaaaguuuccaacauccuccuggcuacauaauucauuuauauagccacgaagacauuaauuagauucagaaguccguggaaacagcaaagcuaggcaaggucagagggcaagcagggcaaagaaaagagagggggaaaugaccccuaggagagggugaggaaguggagggagauuuuucaugccuuucaaguaucaaacaagacaaagacaauuucaaaacguggucaacuaccauaacacuuuguagagaaaguauugccaaauguaaaaagucuguuaaaaaaaaaaaaaaaacaaaaaaaacagaaguucauuugcaugauaauuuuaugcauauacacuuuugguguuauuguuucucauacucugcuacaaagauuggggauggggaggaagcgggacucaucauuuuuuuuuuuuuuuaaagaaaaaccaauguggucacuccuacucuggaaacagaaaagacugucuuguugugagcgcgagccagcugaguaucucaccgcgguuccuguaucacaccucacacugacuuguuggcagaugaauccaccauuucuugauaugagaggaacagaaacuaaccacccagacgaaaucacuggcuccugggcaugcuuuuuugagaugcgcacuggccaacuuuucaagauugcaaggauccggaaccuacuuggaguaguggauaaauagcccuacaagagcagguaggccucucuccccgcuggcuccgguuccacauaucagccccaucucaugcucccaaaagcacauaagguauguugccaugguuuuccucugcgagcaaguacacuaaggaacagauaagugucacuaaccaaagcacggcagauuggggaucagaucugguagccacaacaccauaugccacccuguagcuuucgccuuaauuauauagcgucagagcaucccccugcacacaggugcuugaauaaugaauguaauguggacccagucagaagcccucuacccggcuuugcauuucucccuuuugcuagcucugucucagagaucugccacaacagagcauccaugacacccgcaugcucucccugggcuuaggacuuuuccuucgcagcuccagaaugcauuggaugcucuuugucucuugucaguuuuugucucugauaguccuaaaauguuaguguucugguuuggguuguucucccugagugcugccagacaggacucccugacauaugucaggagagccauaaacuucuuccuauuuaaagguaagcccuccuguuggccucuagccacucucaagguguuguuuuguucuaagcaggacugcagugaugcccauugagaguuaacaggcagcgagaacaguguguccaggaggaagugacuuugcucccaucuagggaggcgucaucagagagaagucacaacaugacugaguguacugugucuuuucgcccgggacaagagacaugcuagaaagugugaugguccucgggccgccuuggggcuacacagacagcucccagccugacaccagagauguuucaaauuguaucuuggggguaugaauagagaaaggggcagcaauauaagcaauauaaggcucucauaaacuccuucuccccauagcugagauuccauagcagugaccuucaaguccagaaacagagcaaagccuagccguugaaagacagagacagacagauauggcauacuaugccaauugccugcccaguaucaauccacccuccugcuuaacgaaagaacuuaagccugguuuagagaauuaauaagccuggaucuuuuuauaguuauauccaguuagacaguuaaaucagcuuauuuccagucuuucuuugaaagaacuggacauaugacacaauccuggccaaugagacacggguuuauguuagcuacaauuucuccgaacguucuuguaccuggaauggacacuacccuucccucuaggucacuuccuucuuucuguccaaaauucagauugaggccugagaaggagcagcuguuggggacuguaggagccaaagcagacacuuuuguuggcccaucagaagucaaaaggaucaccaguuccguguuucugucugcuuacaguuguccuugccugcguugggccgccugccucucuguaucuguaucuucagagcacagugagacccuguguggcuagcgcucucuuaccacacuuuacuaucuuagcuaacugguuagagaaaccacgccccuugaaggcacccuacacauggcagcacacagucaggucuaccaagugucucagcuauaugacccaacagaagcagcuguaccaaagaaccauugugacuuacuagagacugcgauggcuuccuuaaauauaaccgugucuucugggcucauucuaguuguaagaauguuaauuaauaagaaacuuaugccccuuugucuggagacugauuaaucuggcuccagcauuuguggaauauuccguauuauuagcuguucuuuauuuccacauuauuuauuaaccagguuaaguuauuguuacauccucacaaggauacuaaaagauggcagucauggaaaacagcaaaggaauaauaauagucgggcuuucuuguguuccagccgcauucacaaaaaugugcgcgcuuccgacguugucauuguuucuaccaauaaacuaauuaccacuguaugaagcucguuuacuucagaaggaguuuagagaaacagcuaauuaaguacaguauuuugaaauuuaaacugcauuacaggguuagaacccuguaaugaaauugcagaagcuuacaagggaaagagaacccauugcagcucucuguagcuccuacgugauuggcaucucuuccuccacaucaauacugccugcagccuuggggcaaaccguuucuaaugauaugggggcugucucucuccgaagcccccucaaaccauuucaaaagcacucuagccugaccaggaccacacuuuuccuuguguuuaugggccauacauugaucucccugugucuuccuagaacaucauuagacuacaguaagcacuccagcuuagcauccagucucccuggaguccuucugccaauccuccacauacugagucgauuggcuccuaugaucuacucaggacucuggcagagcgagguccccuaggaugucauacaaagaaacagaacuggacauaggaaugagagaauccccaacuucuuguuuucuugggagaagagagcuucagacagcagcuggagcuugaccucagggagaaaaugcucaucacaagauagggaggcaggaaacuacuguggagggagauaccugagcccaugauggucccaagggaggagcagcacaauagagaguaagagggagacuguaggaggagacugccccuuguuaaagagcaucugcagaagccacaaaagcaggguuucugaggacagacccagugaccuuucagaacaccaccucuuucucuagaacuuguuacaauucucucugcccagcgcagucacaauuuuaugaaauugguauuguugucugucgcucucuagguaguaaccuaaagggaaucucuucccuuuggcccuggaagaaucccaggugagauccacaagccgccgccccuggaggaaugcagccucuagguaagagcuguauuuacaucaaugcuuucccaagcacagggcauagggucagaucccaagggagugcugaaugaccacgcgagucauuucagagauugauuugccaaacaagcguggagagccuaguguguguuaagugauggguuuagaaaggaaagaaggagauguucaaaguuugaaaaaaauaaaagggggggggggaagcaaacuacuucaguuagaaggauugugcccauacaucuuuauucauuugcccauccuugaacugagcaaauguuuaucaagccagagaagcaacuuaaagcuuaccaccauaagaaggaugguacguucucaccaaggaagcuggauguuguuguguuauauguuauaauguacucagacugugaugaggagguacaucuacucaggggggaaucuauguucaaagaauagcuaauuuguauccaaaucaagaauuaagggagggggaguugaggcgaaccagccagaugcauggcauacugcagcguuuaucugucugcuaggcagugugucuauagugccauaggagaaagaacggguggguggccacuggagaccucuucuggggaguuuuaauuucaaaguuaacauccguguugaucuaauggaacaaaagccaaagcgaacagggccucauaacaauagaagagugucccaagcagaaggaaaagcacaugacagucaucagaggccagaaagaagccugccguguacccccaaacagagaaggcucuauaugaucagaaugucgccuggggugugggaaggggauggaucuuaguauauaucaagugcggcaucacagagaauaagggagaagagacagcuccaagacuagacaagacacaggagccaagugguggaaacuuuucuuuuugguguugcaaaaaauguugcaagugaacaggaaacaaacaucagagauucuacagcacagcgcugccaaagccuuggagacaacagaggguugaaagagggaauggcuucugagaaacccgagaaaguguuugacgagcauuagaaaaguggcgguuguuuuagggcuuuguuuuaaguuguaaaaucaagaaagucugcaaacuccuuccuuuaggcucaaggcuggccaucucauuaacacagccuacagcaaaaauaaaaauguacagagccuggcucauaaauuaggaggaauguuaaaauguuggcaucaagcuuuaaacuacgacaggauccuucuaacugccuaggucacauacccaggcagcugccccacgcugaggcaccccagugacaucuuccugcucuugcaucucuucacugacagaaugggaagacauuggcuccuuggagacugguguccuaaggaccccccaccccccaacagcauacuuagagcucagcaccaugccagcccucuagccuuggguucauuccaugaugacauuacuuuugauuauauugcuaauagacaccuagaaaaguacaagucauaaaaaaaaaacaaaaacaggauauaaugaaagagguagguccgaguuuaagugcucuccauuuccacucucuucucaaugaaaauccucaaaagucacuuuauguuuguuaaacaagaagaugacagcaaugcagguggagaaacugaggaaaggggaaauggcuauguagcaugaaaaucaugaguuggucagacugggaugaggaggggccccggaaacacuguaaagaaugaaugggauuugguagaaagacagaagcauuuacaugggaugucagggagccugugauagaauacuguuacaguuuacaucuuccuaauggcuuauaaggacaggcuggugucagacguggugugagcugcaugugugagguucugaggucaaucuccagcaccaccaaacacaaacauaauaaauaaaaauuaaaaugcuaaaauagcauuacucauaaugauuuaggaagccauguguacggugugagguagguguguguguguguguguguguguguguguguguguguguguguugagaaagguggcuuucaagucuuucugcagauuagaauugucuggaggacaaaucuccaguggccugucccacgccaagacgcuuacuuaaucugugugcgcugaucugaggagucccugucuugggggaaaccaucaugcagaaguggucgggcauuuuuagccagccuucuggccuuccucucaggccucaucuucagugacugcuccauuuuuacuggucuuuggggauugguucuaauguuuugaauuaauugggaaucugcacguccaaacacugaaggucccuguccccaauugguuuuugaucaucaauagccaaccaauagccaauggcuuggggugggggguguggggggagagagagagaacuuuuaaauuugugcaggcugagaacuggaagagaggaaggaggagagauccccaugaugggaagaagaaagaccagacuuaaaggcccaccaauguauuagaaucagggaaaguggccacacgggccacuuccccaauuguguuugggguagcagagaugaaauacagauuuuaaagaggaguguuugcuagcaggaggaagaauaagaacugcccaaccuuugaacuaaccaggcauauuuaaaauuaacugccgugugugugugugugugugugugugugugugugugugugugugucuuucauucacgaauccagauagcucuugggcaagugcaaucaucaggagcacagaucaguuagccaaauuacugcuacacggguguauuugucuauaugcuuuuggucacugucccaucauaucaaaccccacugacuuauagaggcaucgauguucaccuuguuuaccuuuagacuaugucaagccccuacgcuuuguuuaucaccauuguuucagaagcaucaucucaaguuacagacaggcacucagcaaagguccguuugccucuuaacugaauugcuuugaguauauggauugcuuauuaggaaugcugggucuucuaguaucugagcaagguaugccucuguuuauuuggauucucuuucauuuauaucugaaacguuuagugauuuguugcaaagauuauuuaaauaucagauagacuuucuuccuagguguuugauuaaauugaccuauucauucugagagucuaucuauuuucuaucuguacaguaguaggagaaugccaccugugaauguuggcuauuuucuuuggaagauguauaccuccauuauuauuauuauuauuauuauuauuauuuuacuuacuagcugguaacucacauuugacaaaccaugaugguggccauaaaaauuauaaggcuuccagugccauguguggaaaauauucuuuaugaguuaucaaucagagagacccuagggaacucccaaacaaugcaugcuuuugccuacguuccucuugguuacccacaaaacgaguugcuaacaccccauugcugaagacaccacacaacuuggaugagaaaucaagguagcaucgauccggaagcuuccuucuugccagcuagcgcugaacuggaagcuuccagaaggcacuauguaagcagcuagggaaaagcaaggcaucaaaugcucuuacccagcugcgagccccgugguuacaauaacagcaugaggcaaggugugccgacuuaugcaauaguggcaaaaccguuauggggauaaucagccacucucugauuggcuuugggguucacuccacaggagcgcauccauuugugggacuguaaacaugcaggaaaggucauaagccuuguaggggaacuuaauucuucucuuuaacuaaauugacgcagcacugaacugccuccuaauuauauauuuguauccauagacauucugagcuuuaaucagagaagguucucuuuucuaaugaauuuuagugaaugcagagguucaugacucuacagggcucuaagaaugaaugccaggggaauguucagcacucaggaagacaauuauacuacucccucuaaagccaggcaaacauuuggaauaugggguagaaagaauggaggaucuggaggacagggagaagagcccugaagugccaucuccugggcaguguacagucauugcaaucgcagacucuguagugggucuauacaagagcggccccuccagagccggggaggaauggacucaggagaccacacaccucccuacuaaacuacuuccuauagccagacucgggaaaaggcaagagccucuaucuucaguguguacauucaggaacccccauggggcuccaaaggauagguuuagaacaauagucacucggaugguacuagcgaaacuaaaugggucaaaagcaaaauaaaucaaaagaacagaacacagaacccaugggucugaggagacaggaaggaaggaauauugauagagguugggagggaagaagaaagggugaggagguaaggggacagaauauaucacaagcaugagugaaaccagggaacuaaguuaguuaguguuauggaugugugugguucuuuuggggaacucuuaucugauuaagaaaauuuccauuuauugcccguuuguucaauuuauaucuauuuacuugcuuuaucgaaaucaugaacugauggugaauuuuaagggagaaaauuuuuauguggcuaguugaaaagauagacuacaugacuucaguuuucuauuagugguuaauggaguguacgucuuacugaugcauacucuucuuuuccuuuugcuccgccuccuccuucuuuguuauacuuauuuuuucuuugagcacauuuuuaagauuuuuaaauuuauuuauguguaugaauguguaccugcaugaguuuauacguuucauguucaggcacauguaaaggccagaggagagugccagguccccuggaacugaaguuucaggaacagucaugagcugccugugugggucuggaaacugaacccagguccucuacaagagcaguaggcacucuuaacugacaaacugccucuccagccccaaggugcagauuugauguauacauuuuugucaccguuuaguugaaaguaaaaucauuucuaauaucuauugugacuuuuuugacagauggaucauuuauagcauauuuuguaauuuccaaauaaagacuuuccuaauuuuccuuuugaaaauaucuuacaguucaauugcauuuaauuaaggaguaugccucuaccuaucauuuuaauacuuuauaauguguuaaaacguccuacauauauuuaauuuugucaaauagccauguguguuaaaaguaugcacauuuugcucuugcuugccuuucggccaguguuguucauaugagcuucuugguuuuguggggguauuuuguuuguuuguuuacuguuuguuuacuguuugggugcuauaaacacaguaaucauggauuuaacaguuccuuuucuuuuaucuggaaccacagaugucuauuuuucuuauguuguuucuucuaccaauaucuccuuagcuccuaugucuaguuauuuuuaggaugugauuggcagugugucugcaaaaguuuacagaaauaauuuaaagccuacagugauguuuccuuucuccaaagaggauauccaguccugccagguagucaggaucauuagccacuugguauugccuuuucacaauuuuaccagcuuuuuucugugcguugggggugaggcuaaacugcaccacuucucaucaugaguguguguucuuugaaauucacauuuauccuagaguugcacuuucaggagucagaggugaguuggggugggggugggggugggggugggggcgauguuuucuucuuagugagauccucauuuuguccuuagccucagggcuccagaaaucgugaacagcauguaccaaccacuugggcugcuccaaaacugggauuggggauuuuaacuaucaaauaacucuccuugaucucuuuuugagcuugucucugucccccuuuacucgauuuuuagguccuccuggccuuccuaagccaauuauuuagaaaugacucuucagugcacacaauacaugaacauauaccaugaaaagcagcaagguuuuguuuggacuugggcaaugggcucuuccuuaacaggauggcagugcacauccuguguauuggcugagagaaugggagacaaacccagccaggcuguuucaaaccuauaacagcagggugacuuuagguaguagcuucaacuuucucauucucccuucauugauauugaaauugagcuaaugguuauagcuccuuuauuggcaaaugagugcaauaauauugcaaagacauaucuagcauaagugccuacuuaaugacaacuauucuuauuguacucaagcuauuuaaauauuugguaauacuugccaaaauaaacacucauaggcuaugaacuuggguugcuaggaauuccugcgugauaaugcuuccaaguccuagcaaugguuaggagauaccacuggacccaaugggaauaccuccuugucuucuggggucaauuacaagcucuaacuaagggaaagucuggcuuugccugcauguagccuuggagcacagggccuggcagagacucugagacuguuaccuccgugguucaguuucuacaaagacuaauuguuuucagggguuuucauuagccuccuuuuuacacacaguuaaggcuuagaugcagaguaagaaaggccucacguaaccucaagggcucuguuguuaaaauucugcuuuaagccuccuggcccuguuuuacacgcucagagauuauucacccuuuaggagaccauuccugccaaucccugcuguuggcuuuuaaaagcagguccauuuaaaguugguaacuaggcaucaccauugaccucaugcugcuuaauuccuaaccugaucuugaccccagaagucaaagcccuucgaaaagucaauaaaagcagcaaacaaucuuauguuguucuuggcagacuuucccaaacaaugacugaguuuaacaauaguuaauuguggcuuaauaguugcuaacaagcauugagugcuaacaaaguggcagguaauauagcagccaaaugaggugggcacugccauuagcccuguuuuacaggacagccacuguguuuuacagggacaaauuaucuaaccucaggccacaaaccagcaagaggguuacgggcuacucuaugggccccucaguagaauguuagguggagaaacuuagacccagaaaguauuggaggguuuggaaggacucccacaaauuaauagguggauuucuaauagcauaacucuguuagauggagucauuuuacuucugaaggcuauucugauaaggauaggguuggaggacuuaauuaaaacagugguuagcuaugaacccgguccaagggggcagaaugagaggagucuggcuucagaugauuugaaccaguaacguguaugcuaauaaaaaaaaauagucuauauccaacuagagugcauauucccacaauaucgcacacugaguauaaucacuaggaaacuauauaacagacuugacucuugauuccaaccccaacucaagccuugaacucaaccuuugaguccuucauguauucuagauauuaaccuguuggguagacagcaaccauuuucucauuccaggggcugucucuuccccagucaguuauuuccuuuguuguguagcuuuucaguucccaugcaauuacauuuagaggaauagaaccauacacacacacacacacacacacacacacacacacauauacauauauguacauauacauguguguacauacauacauauaaaugacauguaagcaggguauagacugagaaagggaaggaggagagaguaugcaggaugaauauggucaaagcacaucauauauuugaaaaacauugucuuuaugagaccugccacuuugcacaaugacuccacaccauuaacaaaucuuaaugaaaaacuguaagaugggcaggagcugcagagaugguucagugguuaagagcacuuccuguucuugcagcggaucccuguucacuuccuagcaccugcuuggacacucacaauccccuguagcuucauuuccagguguucccauuccugcaagccuccauggggauugcacacaagugauacguguauacacauaaauuaaaaaaauaaguaagucuauuuuaaaacuaacaaagucagaugugauaguacccacuuucaaucccugcacaugggaggcagggcagggccagaggcggggcuggaggcagggguggugggggggggcagauccagaucuacauuuagauuucuuugacuucaaggucaucuaaggguauuuacugaugagaccuugucucaaaagaguagaggcaggaagggagagaggaaggaaagggggaggaagaggaagaggaggaggaagaagaaaagagaaaaggaaaggaaaggaaaggaaaggaaaggaaaggaaaggaaaggaaaggaaaggaaaggaaaggaaagacaaauuuuaggacaguuauuuaaaauggccauagaagaggggcagggaauucagagaacuguuaacaaugaggcugcccaauuaaguaguaaaaacuaaauauaugagccugucuucgaacuacagcgucauaguuccggcccaagugugaguaacuaaguacaagcuuucucugaagaggaaagcagagugguucuucaauggcuugacucaauauuucucaaaaugugauucuuuuuuccucaauugagcauuucccaaauuuuaaauuccuuagagauucucaaucauauuaucaguguaaggcccaagaaggcucagcugaggaaaccacgcaacuucaguuagcucagaguucgucagucucacaugacuuugcaguguuuuacacggacauuuaugacugucucagaagugugggaagugaagaauuaagacacuacuauuaaaucccuuagaugaugacuaaaugcuuuuuuaaaaaauaggggcaauuuuguaauaaaaucaucaucuguuauccgugguucuucaaagguggauccaucuagaguaaacgagcuuucacggcccguguaaggagaaaccucagaauuaagaagagccuggcugucuucacauuuaccagaaguaauucuaaaauaucuaccaaugaccggacuaaucccaggaccagaaacucucccucuacagcacugaauucuuucaagaugccucugacuuugagugaaauuuaguuauugcaucuucccaggaaggacaguaauuccccaagaggggaccacaagacaguaguuguuuauacagauggaaaggcacagaguucaggguaagagauaaagcuagcucauaagccauuauuccuccuuuaccugggacuuauggcuucugcaggacugaggauguguguuuguuguugacgccugcauuaucaauugcuagcuaucuaacuacugagcccauuuuccuacuaaagccacaggauaaaacacacagaauacaagaugauuguuggucaucaugaccccaacuuaaaacaguuuccuagcaagcaugccucuccugucaucccacacaauucuaaaggaaagguccugucaauucauagaccuacuaagggcacaugaaaaucacaugaggaccucucccuuauuaguuaauuuauucauuuucaugcguauagguauuuugcuuacauauaugucuguucacuaaaugcaugccagguacccaaugacuguucugggacuggaauuccaaaugguugugaacuuccaugugguugcugggcauugaaccuggguacccuggaagaacagucagugcucuuaacuguugagccaucucucuagcaaccaacccuuucuccccucaauaguaauucaaagccaacagucaccacacauguaaagaaaauggcagcuugugagcagaaagccaaaagaagcaagaacagcccagaaggaaucaaagagacacagaacuaaagauggcauuaaaagcacugaaaucaaauccagaggaauuuagggaaaauguuguaacccagagguuagaauggucuagaaaauuuuaauugaauggauuaggaaauagcuaauaaccaauagcucuucauauucagagugcaagaaaagaaagacaacauggaaaacuguuggggguuuuuagaaagucagucuagauagaguuagacauucuuaaucaaauauauaauuaaaagaaaaucuuuuuaucaaaaauacugaaggauaaguuacuucauaucuaaagaccugucagcgaccuagaacaauuaguaaaaacggaggcaugaccuagcaaaauguugagucgucaaugugcuaauauuuacagaauaaggacauuacaaaaaacuagacucagccagauauuagccaugcgucaaaguagaaugcuguuuuuaccaaaaacaaaacaaaacaaaaacgaaacacaaaaaaaucccagcaagcuuguuuuccacacauucuuuucuuuuaaggguguuugaagauacacucgagaaaaccaaaaguggaccaaaauggaaauucugaaaccaguccaccaaucuagagccugccacaggcaaacaaauuuacagaacuauuguaucacaggcuaccaguaaaguaggggucuggagguggggcuggggagccaggacccaaagucucuaggggaaagaagagcauaauaaaagagacaccuggguggcauuaaucccauggacaaauaaaggcaagaaaauaguauuguuuucaaacucugaaaaucagacagaaggauauguaauaaacaaaaagguacaauaagggugcaauucacaagagaagcagaccacgauuuaaugaaauaagaauauaaaaacagaagaauuccacggaaccuugcuucugggagccuugauuggcccacaggugauggcucgagacucgguuaaaacgguuugcuccucagggaugacucugauuggucugugaauggacuguggagaccagcugcaaccuccaggcauaguaaaaaguaaacauuagacagcaauaaacauuagaugcugggaacgucuugaaucccaaacggagaaagucagucuucuugagcuaaauucucaaccuuuguuuuggagaagcugucagucagaacugugguugacacguuaguagcaaaguaagaggacuaguaugucauccauaugaauccagcacuagaaggacaagccugcaucugccccaguugguccaugacggguccuuaguucaaggcagaacgccauucccagcaugccugccugauaaucaugaauggaaggccaguucugagaaacgguccugaggagggacguuaauguucacuggagucauugaaaauauaaaugguaauugcgagggcuuguggaagaauggaacaugccauggagaagaggguuuccugggagaaggggagaauuagccauagcaugagagggaaucagccaaggaaggagauugcugucuuccugccugagggaucagaagaaagaucggggagagaagaccagagugagagucugagaggucagcugacugcacacguguguguauugccuaccgggagugcaucaaguugguaguauaugccuguuuccuuugggcugauacgacccacgccagcuugaacuggagcaacugugaugaccuaugugugacccuccugagagcaagccucuugacauuuccuugugggcucaggagcuugaggagacucaugggacuggugaggccucucccuucacuucaacuauuaacaguaaacaauggggaagggacuguacaguaguauaguggcuggugugucacccggggagccccuucagugguucagcauuuugugagucaugcacacuguagcugugacucuucacugagugauauagccggccauaaguuaccuggggaacuuccucgugguguagccucauuugaguuccacgguccuguaagaacuccaaaucaaauucucucaauaagcuagcugguuguggguggggucaucugcuuggucuguugauauucugccuaucuguaaagauguguuucuacaccuccccugaagaagucaugggacaaccaggaacgcuggggacacggcuguauuuccccaucgggagggcgcacugaauagcauauucuguucgagaaggcagagggguguuuacggggcucuuagggcaaggggcugggccagcugccagugauaauggcagaaauacuagcucugcuccugaagacacgucuguucuccuaagacagcaaucaacgugaaggaacacagauccaaauucucacagaucacgggugccaugugggggauugggugcugagcucggggacccugguuaacucuuccaauucacugggguccucguuagagcacuggggcagcaucugcuuagugacaagaguugguggugcuuucaaaggcacuuaacguacccccaggauacugguggcccacagggggaauccaacucauaaucuuuaacacuugucauaauuauuucucuuucaauaauaccaucucccacccccaccccaggaaacuuaacauuaucacaaacgaaauguagagauauaaacacucaaugcuuucuuaauaaaaugcagucagcggccucagggaauuuuuguagcaaaagccuccgaaaucaauuauauuuuucucucguuucuacucccaauaauugaauguuuuauuucuuuauuuacuuaaguucuuuugaaaugaaaagguggagcucuguugacacauggaggaaggggguauuauuaauuaaaguuguuaacgucuaagaugagaacagcguugacgcauacaaaugagcauuauugggcugucaggaagaccacaggcugggccucuguggaaggaccaucccaucacuuccagggugugagucugcagccacgguccauacuccaguguucaguguccgugacugaagugcucagaggaugcaggguuacugacugcauuugcucuguuuuagccagaauguauaguccccgaucuuuccuuuugucccuucuuggucucaugggaugcugacaucacugguuuuguuuguuuguuuguuuguuuguuuaauagauauaggagggagugguuguuccccuuccgcagacucagcucagagaggacacuggcccagaguaagggggcugauugaucccacaggcagaaccacugcuucgaguccgucuuagcauuucuguugcuucaaugaaacaccaugaccgaaagcaaguuugaagaggaaagggucuauuuuguguacacuucuacaucaccgcucaucaucaaaggaacucaggagaggaaccuggaagugggagcugaugcagaguccauggauaggggcugcuuacuggcuuguuccucauggcuugcucagccugcuuccuuauagaacccaggggugacuccguucacaauggguugggcccuuccaggcugaacacucauuaagaaaauaauccauaggguugccugccuauagcccgauguuaugcaauuauuuccucaguugggguucacuucucucaggugacucuaacuugugucaaguugacauuaaacuaugcagcacagagucuuuggaugacuggcagucacuuccugcagacuuccugacccuauacccccugaccucuaaaccucacacacuccuccacaccaacuacacacaugcugggagccugaggauaaacaaagcccacgaagaucagcuggagcagaagcaagggaaagcucuggucuauccucaccucagugaggaguuucggagaaagaguacucauacagcacacaggucucagcucugucuuggugguucccuuccucuguuauuggcuguauguuucuccgugugugcaucucuucccaccccacccccaucccucuccucacucauucccaugggacaaaugcacaagaagcgccugaugucuuuucuggccgguuaaggaacacuggggugcuucgcucagggaaggccacuuucaaguuaaggccaugggguuuccggagccggcccuugaaagcaggcuaccagagaucagucaaugcugaguuuugugauuuggccccaagaacacuuugagcacagagcuacacugugcugugaaaaagucaguugucguagucuuagaugucuccgugaagacaccaauaggcaacacuggacccuaaaguugaaaucuuggauguuuagucugaaaugaggacuuucaaguaauucucauucguuggcaucacaauugugagguuucuguagcuaccauaaugaaacacaaucauugcuuauccaagcaagcugaggagagagagugugguuagcucaaucgaccguuaacgccucggcucugaggugguuaauuuucuucuccuuccuguggguacauuucuagaggacagggagagugaguggggucagaggucaaggccaguggucaagcccaucugucgccuuggcuagagccagcugccucuccaccaauuguugucaagagugugcaagcuguugcacuaaagaugguguguggcacugcccagguccauagcuaacagacccagccaucuuucagaguuccccaaugccauuuucauugucaccacggacacagccccagacuuaaaggagcugucucaaugacaucguuccucaaacuagaauccuaauguguuuucucccuccagaauuccagggaaaugaacagaacagaaucaucaaaacauuuaaauauauaccuucucuaccaguuacaccucaccagguguagacagucagcugaacaaaagcugcaagucacaaaauugacccuucauucuagaaaacccagaaaacccagccacuuuguaguuuuccugguauuguuauaacucuguguguguguguguguguguguguguacaguccacauuaugaucacguaaugggcaggccauuccaaugggcaauuuacucucugggaaaucaaggaggccugaaacacaugccugcuccuucccaggucccucagagcuauuuagaaaauuacuauugugauucagaaaaugcucuaccagccugaggaauuaaccuucuuccuaauacgucuaauuuacugguucuucaaguaauugcuguguuaaaguugcugcaaguccaggaucuaaauaaucacgcaaaggcuacuuuuacgaaagcucggugugaucuggcgcgcugagugcgcuguguguaaccuuguuaaauccucacaacaacccgggugagagaggcauuaccauccccggcuuuaacugaagugcaaauuacgaugcagagcaagaagucauuugcuuguggucucuuggcugcccaagcaugguacacacgcuaugacuaggguucauucacacugggaggcucugcugggauuugaacacugaucuaaaccuucacucacugagccugugaguaguucuaccgaauguaaccugugcuguagugaaaagggagagugugugcauucaggugugagugacaggacaccugcuggcuuuuaguuacuuauuuauuugacacuuucucugcugcauauauguauucauuuguguucagaucuguguuuaugugcaugcuggaggaccaggggucaaccuccagugguguuccuuaggucuuuuuaagacaggaccucccauugggucccaaagcuuucugauuaggccacaauggcagacuaacaagccccagcgaugcucuuguuugucuccucauaacugggauuguaagagcucacuaucauguccagcuucuuaugugggugcuggguauugaacucaggcccucaggguugucgguccccaucugaacugucucccuaaccccuggucagacacauucaauagcgccccaucaucugaaagcauguagcauuacauuagaauaggcuaugcuccgggggauaggaugcacaaaguuucuagaaguuaauuaaucuuuagaauuaguagaaucuauggguagauucuuagcuuacaggaagcauccuucugaaaacuaauguaccgugccugcagcugaggguuucuaucaagccuggccgaguuuauccuccagagaaaagcaggagaugccugguucaaauaguguaaccccagggccccaggacuccaugagacaccgacaccuuuauaagaaauagugggggaaaggcacacugaacuaauggggagcacgcuguagcauaaccuccauuaggucagccagacacccucaaauccucacuaaugcccaguaugccacugacauaaagagcucugggugccaaggggagcaguuucauggacuguuaucuacauggccccagagcacaaaacacaaaacucucucagaauauuuccagaagguucugacauaaauuccugggguaaugagaccauucucugcccucccggcuuccagacgcacaggcagccucacggaaaccccaaggccaucucagcggagaugacaaaggacgucugccagucacaagguuaaucgcucacuccuucguucuaaaacaaagauuagcaagcaaccugcuuuuaauguacaaauauauaacggcaggucagacaacaauaaagagugaauaacagacuuguaaaauuaauggccagaaauuccaccgcagguuguuuuuuuuuuucagcccugcaucucuccagcccacaucauaaauauauccccgaaaaacaggagaauggacaccagaacagggccgccugcugauucccccaaacgccaauccucagagacacacgugacuauguuuaaccagacugaggaaggauuggcucaaggcauccacggugcuuccucaggcaccaagcuauucgaguggguaugcuuuccaggccggaguuacugauaucauguaagugcacuuuuuccaggagaggcugcccucugcaaauagauuucuccugaaucagccagcuccugaguugaccucuauuuguuauacuuaggagucaaaugggauaaugcagagcccggcccuagacguggaauccugccccggaggauggacauaggaguugaugaaagcaugcguacacacuuucaaauuccaaccacaugccaugcguggcauuagaagaugagaguaauaucuaaagcugauguucauugagcaccuacugugugccagguauucaaagaaaggcacaugugucugcucacugaacccuuaggcuguaccuuucuauagaaucaucguggaacagugaaccuccccacucaagcuuagugagcacuuucccugcucccaagcaagaacuaaccugccccacccagacacaugguguggcagaacguucuccguucuaagcauagagaauuggguuccuaacccaagcccaugagauacacugaauuauucugaggggccucaggaagaaggagcccaauacaacuacggcaauuagcaaugcaacgaaaacuugaaaauuucccagagaguggauuucaacuguaucuaccaccaccacuaucaucauccccaccaccaucaucgccaccaccaucaucaccaccacuaucaucauccccaccaccaucauccccaccaccaucaucaccaccacuaucaucauccccaccaccaucaucaccaccaccaccaucaucaccaccaccaucaucaccaccaccaucaucaucaccaccaccaucaucaccaccaccaucaucaucaccaccaccaucaucaccaccacuaucaucaucaccaccaccaucaucaccaccaccaucaucaucaccaccaccaucauccaccaucaucaucaccaccacaaucaucaucaccaccaucaucaccaccaccaucaucaucaucaccaccaucaucaucaccaccaccaucaucaccaccaucaucaucaucaccaccaucaucaucaccaccaucaucauccccaccaccaucaacaccaccaccaucaucaccaccacuaucaucauccccaccaccaucauccccaccaccaccaucaccaccaccaccaccaccaccaccacuaucaucaucaucaccaacaucaccaucuaaacaacaggacaggcagauaauuguuacccuuccccccaaccccaugucuugcgcgcacucaacaggccaggaagaacgacgcugcuacaggauccuucugcacacauuuauucaguccuguuucuucuuucuccauauaucucccuuguuuauaucuccccuguuuauaucuccccuguuuauaucucccuuguuuauaucucucccuuguuuuuauaucucccuuguuuuuauaucucccuuguuuuuauaucuccccuguuuuuauaucuccccacuaauaguaauccucucuugaauaauaauccucccucuagccugggccucucacucuuuuauacuuucaguucccauccacgcacagcaggccacgccaccucaccaggcaugcagcuucagcuaaucagggcagcaggggcaaaucuccaccaaauuggauucaccuguauccugguacaccugcgcagcacucaagauguuugugucuuauaugaggaagucaggugcaagucauaugacuuagcugcagucccuggcgccuuugggacugccgccacacccgcuccccacacccaugccaguuuaucaaagaggaauaccagugaaacacaaugacuuagugguggucgaagagaaauauauccuccccauccuuuaauuuaguuuuaaauuaaacacaguaucaaagcagcauauaccaagugaagaagugccgcucaccaaccugugugguagucauugaccacgcgugaccuuugggaaagggcaguguacuuugaagacacagcacuaaaaaugcaaaacucagaguuugaauacucaugguuugcuaaauaaaacagaauuauugaacgggcuggagagauggcucagcaguuaagagcacuggcugcucuuccagagguccugaguucaauucccagcaaucacaugguggcucacaaccaucuguaaugggaucugaugcccucuucuggugugucugaaggcagcaacaguguacucacauacaugaaauaaaucuuaaaaaaaaaaacagauuauugagauuauaaaaguugaaucauguuaauuuaucuuaucauugaaaagaaagacauuagaugacuggguaggauuugcuccguuuucuauuuucucacuuggugcuuuuuguaaacauuucuccuccacugccaccuacaugcagagagcaaagcaaauggaaacauagcgaggagaauuuuuuuuuuccugaagauugauagcaccauuuguguauguacauaugcaugcaggugcccuaagagaccacaagagggcauagaucccagggagcugaagucacaggcaguugugacccacccucuucuagagcagaaaguacuuuaacuaccucuuggguugggccccaguuugacccugguuugggccuugaggacaaacccaagccugacuugaguuuugagaccugucucagucacuuccauauuggggugacucagcaaaaccuguuuggcccugccucugcccugcuguuguugauguagagcuuugccauuggcucugucagucacuccauacccucugucacccaucccggucucauaugucaucuuaccccacaaacaccccccgccccccauguucugaacuuauauaagcgagaggcugaugccauaaaguugaguuccugcuuccacaagacuccuagcuuaguguguuucuuuugguccgucugcacucaccauuccacucagccccagagagacucuggcgggacugggaccucucuccucucgccuggaccugcaggcaaggagccaggacuugggugcuuucuaaauguucccauuuuauuugaauuuauuuauuuggcugugcuuuuuauauauguuaacgacaacaagcucaugcuuuguauuaaguaauuuugcaaguacuuuuguguucauuugguauaugcugcuuugauacuauguuuaauuuaaaacuaaauuaaaggacgagaaggauaaauuucucugagcuccccucccaaccccaccccuccacaacuaagucauuaugugucacuggucguucucuuugauuaacuagggggagggauuacaauguacuauucauuguuuuaguugaguuuucugauaagcucgaguauauaauuagucuaucaaauuuuuauccugaggucguuuaauguuccacaaauucucuuuaguaauuauuauacuacaagcgugauuauacuacaaugguauucuacuaaaagguauuuugucuaguauuaucuucuuccccucuauauauaguagucagaaaauaucccaauaaucacucuauuaaaaaauuaccccuccaaagacgaauuucccuaggccuguuaugaacauauauugcucuaggccacugagaugcagcgugggacuuagauucuagggagaaggcuaaauacccacggagagaugggggaggcaggaaggaagggaaaggcaacuuauacaugcaagaaacggcuccaagcagagaaaauggccugugauagaccaaaggaggaacaugcaagagauagcaaggaagccuggcauggcagugggggccaggaaucccagcacuugagagguggaggcagguggaggcaggagacugaucacaaggugcuccaaggcugucuaguaagcugaaggccaggugagccacaugagcuccugucucaaaacuaagugaauacacacugaagaagucaugagugggaagugccacaaguggggcagagggaacuagaagaaguuaaccccagcguuugucauguaagggcucuaugcuuuguaccugaagagcacaauacgcaguuucccgaagacagcccugcagugugccaaggaagcuuugauaauguuacaaucaagccaugaucccaugaggacguagacgcucuccauaucuccauaccggacaggucuccugugcacaucaaccaccaccaccagcaccaccaccaccaccaccaacaacaacaacaacaaaagaccaggaaaggguuagcaaguuguuucaugugccuccugcuucuaagaagccaauagaaaaaaugcaacuaccuucgaugauggugaaaugagaagcccaagccacaacaugagcucuggaagauagaugcuagauagaugauugaugauagaugauagaugauagaugauagauagauagauagauagauagauagauagauagauagaugauagacauauagaugauagauaaguagaugauaggugguaagaagauaauagauuauagauauguagauaaauggguagauggaugauggaaaaaugagauagauagauagauagauagauagauagauagaugauggaugauaguuagaugauagauuauagauagauaaauaaaugauggaugauagauaaauagguagauagaugauagagagagccaucaucauggaggaaggggguuccagccagcuccaaaccacugagaguuuuuuuuuuuuuuaagauuuauuuuuuacuuugaauuaucuccgucugugcacacacaugaacgugugucugaacauaugugcagcaugagcagagucuagaagaagguauuggauuccuggagcuggagucacaggugguuuaugagccacucugcaaggauucggggaaccaacuccaucccuuuguaagguaaacaaugcugagccaucucuccagucccugugcugaugaaaguccuaaucuaugaugcuuugagcaaacuaaaacacuguugcugaugaccuguguaaguuaaaccacuacauuucagaaacaaggacaaccgaacccucuguuuucacuguucuggcagcagcugccuccagaucuggaaccugcggugaaagggagucggagcccuggggaccgcccucaaaggguguuuugggcugugguuuuagcugguugcuuacacaguaacagacguugaggcagcgagguuuuccacuggagaguucugagcaaucauauguuaugacuuaguuuuacaagaauuccucuuggucugggcugagaaccgagugggagaggaggaguggguaaagugggagcugaguuugaagaacaggcuggauuuugacuucuggucuugaauacaggaaguagaggcagggagagugaaaaccgauuugaauguggacacagaucaaggcaccuguggaugggaugugcuggccaaucagaucacaugaggacacagaaggaaaguagcgggagaggaggacagcuccgaguugcuggccugauggaugagaauggagcuuuuauggagaugucaugaaacugcaggagaagccgggguguuguuagggaaaugauguuaagaucaugaagcagaaagcacacucaacggugaggcuacgugcagcaggacagcgcauucaugucaggagagagauggaggcugcagggcuuuacaggucauauggagauggggucagcuggggagugaaugcagggucuauggaguagaguggucagaggaucuccaucacugagagauauggaagugcuggagccgaggaacgaaccaagaaaacgacguucuggagagccaagacaaggcgucugagaugcagauuaucugugccaugugggcgaaagaaucaagucucaugaggauccgccaggcuugaucuccugccccugucuugcucuggcugacucaaaaagaguccuuucucauggacuaaacuuucaugugcgugggcgagcaccaauguguuucucucuuccagagauauguuuaucaccugggacuacaugaccacuugaguuuugucuuugacaaggcaaauacugcacccugcuuuucuuccuuuuccaaauacagcuaggcaagucucuaacauucaucaggaguuuucauugcaauccugugaagucccuucccuccuuaaauagauggggauuuaaauuuaauuuaaccuuuuaccacauauguauuuaaauuauuucuuuacaugcauggguguuuugcuugcauguaugucugugcaccacaugugugccugguguguuuguaagcuagaagaggguguuagagucccugugucuagaauuacagaugauugggggcuuccagguagauggugggaauugaacccacauccucugaaagagcagccugugcucuaaucauugagauuagaugacccucacuuuauuuuuauauauaaauuugcuuaguaagugcugagucauucauaugaaaucccuagcugauucugcagaauuuuucccccuucaggccuguuuccugguacuuaguucuucuaaguauuuaaauuuuagugccuuuuauaaauacaguccuccuuuguauguucuuucuguuuuagcuguaagaaguccauuugcauagaaagcauucucucaugauuucuaaagcuuuacacgcagggcaaacaguuuucaguaccuuugcuacuugcacagcacacggucucaacccacagacucgugaagcaagcuaucgaggaggaugggcaguaauagcagcauuucauggggcuucccaaagaggccaugauuuccaggugcucugagagcugcuguagccacacaucugaacaugucccagagacucccaauuucaaauacuuuuuccuuuguuaacccaugagucagaccauaugucccuuugaucuuugcuucagaaaauauugucacgguauucaaaaacaaggacagcccaggcaaaguuguaacaucugggcuguuuuucuucugaaacccccccaccccccaacuuucagcuuucauccugguuauguaugucuggagagcacacaugcacaagcacauacauuaauaaauacucacacauucgcacauaugcacccuugcaauacacacacauacacgcacccucauucgcauauaugcacuuuugcaacacacacacacacauucgcacauaugcaccuuuguaacauacacacacuuacacauucaaacauaugcacccuugcaacacacacacacaauuauacauuugaauacauacauacacuuacacaauauacgugauguacaaauguacacacucauauauacauucacacugccaaggaacagaggaauuuuauuuagaugguccccacacaugugcagacuagagucuagucucucccaagguugguguggaagauuguagaguugagcaagccaggcuugagccucacaucuaucucuauauugggaaggccauuuaacucccuaugacuuucauucuccauaugugaaagaaguguucaucucacccccaacccaggguggcuggggggacuuagaaaauuuccauuaaaaugcccccugcagaguagagggaagggaagcaguucccguuaguauaauuuagagggaauuucaauaugauuggccuuaaagaaacucccaggccuugcucucuacucuagcuguagaaacaaagugcccaggauaaaucucucuuuucucuccccugcaccucaaccaugagccaaaucacccauuuguaacaagucaguguccacucagagguuguugugucaagaguagauacaaaaugcuuaugacuuguacugucagccccagccuucagccuuccuggucccucagucuuccuucugaggaaguuuuaugguauggagcuuagguaagaucugaaauucaacggggucugaucuuaccucccaaaaggcagccaucaagccuaaagaugucuggcuaccuucucccuccucuuuaugaauguuuaaacaaguggcgccccagugggggagcagauaagucauacccguuacaguaguggucacuucacaugacucagacagcugucauguuguccucucuagcuguucucacuaccugaccaugaaaacuccuugagauuccuggucuauuuugucuaaugucuuaaaaaauuuuuauuucuaugugaggcauguguguguaggggcauguauacggaaaugccaugcuuaaaaaugugacaaacccucugaaacuggaguuacagguguuguaagccaccugaugugguagguacugggaaccaaagcugcguccuuugaaaaagccccaaaugguccuaacugcugcuuccucucuccagcucacugcucuguguuaaauuugauugacucccucgguucagcagaguaucuuucugcucagcacugucuguccaauacacacagaguccacggggaauacaaggcaaaguggcccuuccuaccucugaaaaaucucucaguuacuguggccaacauccacccaggggaagggggaauuucuaaaacacacaaaggcagguccacuggagggaggaugggggaggguuuaggggguggcagagagccuuucaguuugcaaauguauccucaaauguugccaguggauguaggaacaauaacgaaguaucaauugugcaccccuaccaacacaaacaaaccuguuugcuuuuuagaaggauucaaacuuguaucaguucucaagguaggaaaacaaauguuuaucucugcccuuucucucuuuguugaccauugcgucugcaucucuccuugucccaggguaggcugccacaaaacauuuaccaguucucugauugucauccaacuuaacaugguccguggucugcuggcugagggaaguuuaagcaggaucuaauugguaacauauuguugauugaauuaaguaccauaugauagagauuuaaaccauaguaauuuuuccauaaagaaaagucugucaacaggcuggagccgaggagcagcaauaaaucaaauugucauguuuauuaguuauugcaagaguuggguugccucguauucauuauaacccccauuuuagcacagauaaaagcucuaaagcggaguauuugugaaagaugcuuuuaauagguuuguauuugugcacaaacaccugcuuauauuuuaauccugagaaaaugguguuguuucauuuuagaaaguucauguauuuugacaguuaucuagggaagagacaaggcuuuggguaaaauguccaaguuauguuuuaaaaccuugaaaaaucaacucauuaacaguuaaauaaauaagaaaguuaaauagacuggggccacagaacguaauauaacauccuucccuuaucagauuuacucaaauucagagaggagguaggacauuuuuaguaagagaucuuuagaacaaugcuauuugacuuauaauaucugaauuucagaaauaaaaguuuauguauggcaaugguuuggcaaaucaugaaccauuauuaccagagccauuugaaagaauaagcaaugccacacuuuauaguaugucauuaagagccaacaucaggggaugggugacugaguaaaguucugccgugcaagggucuugaguucagguccccagcaccuaugcaaaagcugggcuuggugucaagucuaugaaucuggaaagaugcagagaagugaaucucuggagcucucugcccagguggcuuagccaaaucaacacauucagggcacugagagacccugccucagaaauacgggguagggguggguaggguggggaauuacugagaaggacuccugauagugaccuuugaccaccacauacauauacaggcacauggaugugcacucucacgagcagaaacacacacacacacacacacacuaauuaaagcaaaacagaacugaccucacuagccacacuuuucuuucagucugucuuuacucagaguaccauccaaauguauucuugggugaaucugaaauaauagaacacuauuuuaucugccuagccacacugagucccuauaaagccaugugugcucuaugcaaaagguuacugaacacucuugacaaauaaagaaaguguggaaaguaaaagugauucauuguggggaccucugcugucagucuuagcaagcaggaugucagccugggaguccuugaucagaacaaugguguagauugaagaaucuguaagcugaagucuggcaccagcccccuacugucccccuagcucucacuguaacuuugaacugauuugaaguuguuuuggacuuggcuuccucauugcucacuuuuggugaauggucugcauccuagagauaacgugugagggcugaggacauggcucuggacagggucaaauggaauuccccacauacaauuacuggcaagugggagacuccgaguacacucugggcuaucagcuagaugagagaauugcagguaucgauucccuaggcugcugugcacaugggugaagaggagaugugugaauacauauaaccagacauaguauuuccaugaugucccucccaugagugggacucaugaacagggauguccagagcucuuuucucucugccuguuguucuccagcauucugagggucagaacugucagcucuaacugaaaugucuccucuaagccugccccaacugcuauccauucaccuuuccaaccuuuugacauuucucuucaagucugauagcucaauugcaugaaagauagcaguggcaccaaugaugggcagcccguccucaccaagccccucuacuguuccaggcacucucuuaugugcuuuauauguaguaauacauucagcucuuaauucagagauagaggccauuaucacguccaguuuucagaugaaggacccaggauguggagacauagcagcuuauccaaauccauccugcuagagaagggauuugaaccagcagguccagcaaaugagcaaugcucauuuguccuguuuuugaaaugcaaaccaaauaaaacuaugcaugcuacaacugaauacuaagcacagaugaugccccagaccgaggaaauagcaguugacagagacaaaccccaagaacauugaaugcacacguugcuuugcuguuaucucacucagguggggagacagggagauggggacauggggagacccuguggccccauguagaggaagacgauucugugcaguuagcaaaccucuacauuuccaccaggaaacagauacguuugguaaaaacaggagaugcuuucuaacauugauuacuuaguuuguacaaaugacacucggaugaguuuaccaccgcuugcuugaucuguggacauuugcccuucagcugucgcucuuguagugccaggccccacgcuacccacaucacccugucuuguaggaggauuguugugcuuugaauggacaacucugggaaaugcacaucuaaacacgauggcauguuuuguaauuuguaacauuugaguaacaaggaaucacauguagaaaaaaaagcccuucguuauacuaauuguuuucuuuggucucuaaaaaaauauagcugcuguguuauuugauaucgugugauguguguuccuggauaugaauacuagagugugugugugcauuuguguguguguguguguauacauaauguuccuugugugaauacacgagcuacacggauaguguuguuaacuguugcauuaaguuacguuugcaugagggagaguggccuuaggcuucccacagucuccuuuguguagguccugaagucaccggcaaggccacccucagauccucccugggaccuugacuuggguucuuucauugagguauagcuggugaccuacaugagguucagacauauugccuaagaccacugggcccaauuggcaucacagauguaugugagaacauguuuaccucuagauugugucuucuuugcaugccacacaugcauacacacacacacacacacacacacacacacacacacacacacacacacacguuaugaccuucccugguuauguuccacaucugccugucccauuaucuagccaugcaccaggucacgauucucucuauggagcaggcuaggaaugcucucaacugucgggcccugaggcgcccgagugcacaguccuaggcuucacccacaacucccgaaaguaccgagacacagacccacuuaccucucaacacacucuugguuuuauuuuuuuccuguuccaaauaaauuguucggcuucucucuucuguguacggaucccuccucgcuggcaagcguucu

SEQ ID NO: 12055 - RNA, 15908 nt, Mus musculus
ugccaaacauaaaacuuuauuacauuucuaguugugucccucugugauauauucagaaucaaguacuggacagaauagcucuaacuauguccuugggcuaguaagguuucuaccccaccugauaaaccggcuucuguucccauccugguaccagccggaggaggcacuuggauuacauagaaagcagcagcuggcuugaagaggggguuuuagucugaaaucucccaaugggaauacagaacagauugaacuuguguaccagaguagacuucaguguuucucagaccagagagggcacccaaggcgcuuucccuguccccacuuaucucucacccagacugcuucccagccacacccagaaucccacaauccaccucugugugucagagcaaaauaggaggucccucuagguccgauuuuaaaagccucagaaggccccaaggcacuuugggucuggaugguagccaggcugggcgccaggcaggguggaugccauucugguuuagcccccauacugaugaaacucugcucacugucuuuuuuccccuagccagauaaauaacugauacauguuacuggaagaugggguuggaacagagagaccccagggcacagaucucuucuagcuucuaaagcuaagagaugccaagccuaaagaguucagacagcauaaguggccuaugagcacuggagcuggaggcaaagcaucuggcuuuauuggauccaggagggagacagcuccagcuccuagccuagaacccuguggccgaggugggaggggagccucuuccccucagagcuccuguguucacaggcucccuacuccccuacacacacccacacacacccacccacacacacacacagaguuuggugcauacucgucauggguaaagggaaggagauacaccuucagacuaguucuuaccaagcccaccaagggcuaagaggugccagugaucccagcaucauggcucucacugaacacagccagagguccucccauccccaggacggagaggaaacugagcagauuacuugaggggagacgggaccuagggcccagcccaauaggaaagggugagucccaggccagugaaagggacaucucucuuucucucagucucuacuuccuacgagcuggagcacgaacgugaagauauagacuauaucuguguagaucuguagggcgccugugauguaguccuccgggcugauggugugcuuccgguuccccaggaccagcugugugucauaagccaggaacugcagggaaaccagacaugagugccaaggagcucaguguccaggguucacuuccugucagcacgauguccugagagcccugggccagccauauagcucacuaauggagucagucacuagggaggagugugcuuuuuacaugguuucugccauugagcaguucacuugucuaccagagacuggcacacaucuguuacccagccagcaaugugaacagagcaaaacagggaugucagaaacuuguaaaacaccuacauaagaagagaacaauuguccauggcuccuccccaccucccaagcugccuaaaagccaccaucucagcuccccucccagaagagggaacuaacuuaccagggugaaacagauggcccccagagcugcauagaccauguggagccaguaaaucuguaaaauagcacaguauggcauuagggagccacgcagagcauagccaaagcaggccuuggagacccagcugacccugggacuccagcuagagaggcagguagggaagcuaccucuccaggauccccaucuugccucuagauccugggagaaacugagauuguaauuuaucugccaaaggcugucccacaauguccacguuagcccaucagcccaacugaaagcuagugaaguccaggaaugucuacuggaggucauggaaacaagacaagcccagugcaugcuguuugaagagccugugacagugagcucccaggagccagcccauggaugcagcucacuggcuccuacagcccaccuuagauacaguuuagagaagccuguuggcaaccugccaccccacucaacacuccugccaagugccuguacacagaccaggaccagccauggugaggggggggcagcaccucuuguuuugauccuuccccuccaacccuguguucccgccuuagcugacuggaagcaaagaacgcagcagaaccagcaaucucggggccacuuccauccaggcccaacuuaguccuucacgaaaccuggucucggcuaaccuaucaguuccuguaggaaccaaguggugcuauccagggcuuaagggggcugugguuuaucaccugccugagagaaaucuguuauacccuaacccaaaaggaugguauuguguuggugccugcacuggccaguggagaggugugugagccagagcccgccccugcuccacaggaagucugcugccuggguucugccuacccuucuggcaggacacucacauauuuaaagaucagcacuaugcuugugacaauuccggucaccaucagcacuauucccagcacacagaagaggccuguacacgaggugaaguccaccuagcagaaagggagaaagaggcacgucgauaacugccauccuuagcaucccagaggacugacccugagccccaguuggggagucccagugcugcucuuggggacauggcagugacagugauaugcuaaggacauauaucauacaggaagcaauuugucaaguacagacaugggagcaggagauuaggcuagggaagucccuagucugcaagggucugaacccuuccaugccugcccaagugcugaacccaaagguguguguguguguguguguguguguguguguguguguguguguguguguguguguaagagggcaggauggucagagaaaggccuuccccauccucaccuuagucugaaagcagaagauggugacagagauggauaccacagcggugaugaucauugcuaugaugacagcuuugguuucauacauacuggggaaaaggaagcagcguugagaugggccagaggcagaagccauaaauagacucccuauguucaggauugugcccauaguccauccagccuuccaugacauucccuccccaagagcauggaggauugucccugaacauaccuggaaauagugccugucacaaagcccaaagccaaagucugcgggcaggagagaaugaggccaaugguuaagaacagcaugggcuauugaguauggcucaacacagaacagccucaacacuggucgccaugacccugcaggagcuggggguaacuguauugggaagaacagccacagaggaaagcaagagcagggccagccaaggacaaggguguccccaacccuuccccgaguguaggucuuccauuucccuucuagacuuacaaagauggugagcaagaugauguuccaugggaaucggcgccuggagacagagggagagggaggaagacccugguuaccugccugggccaucaagucucagcagcuccuuuagcagaaguccugagaaauaagccuucuccuuagggaggguacucagauauuuacacaaggauaacccgagacaguccuuuccuguggagccagcauggcugggacuuguuuagaaccugcaugucuccugugugacugugacaaaaucccuuggcgccucugaacccugaguucuuccugauagagaugcaguaacuuucccuuuuauguuuguaauuuuuuauuacguuggugugugugugugugugugugcaugcaccacagcacacauguggagaucagaggacagcuuguaggaaucauuuucuuuccaacaugugggucucgggccucaaacucagaucauuaggcgugguggaaaguaccuuuaccuguugagacaucuugcuacuuccucccuuuuugauuuucuuuacuguuuauuaaaugcucgacaugguacauaucuuguauauaugauucuuccauaucuuguaagauagauauagcauauaggugggcauugcacacuacucuguaacacagcuggccucuuguuccucaucaauacuccuuguaggcucucuucacugugcaaacccuuuuccucuuacaaugcucugccccugucccacuuucugcccuccucuugucagggucuccaacacucaccugggucccuggcagcaggcaagggucagguaggugacaaggaagacagcacugagggaagagaugggacauagcuauaggacacgacaccccccggccugcuccuagcccaguaugaccugaaggcaaugcaaggugaucauagagagccugggcagcaccaugaaaccuucauuccaucaccacgugucugccugcuccuguccugucccagcacuccgugauguuacuccuccucagguugcucuucugccccugccuggagacuggcacaguuucugggaagcccucucucuuagggcauaguucugcccugaacaacgccggucagcugccuccugucccccucccaucccagcagcaacagccugcacucacuaggacacguaguacacagccacauuguuccucacguauuugccgacugguucccuguaaaacagaggacaccaagaaaagaaucauccuguggcuguccgccuccagcggagagccaccccugcauaggcagcccagcaguaacccaggcugagagaggagagacucacacaaaggugaagauugcaaugauggccacagugaugagcagcuggacagaaaugaugcaauacaccuagaacaaagagccagggguauagcucccgccucauacaagccucucccugaaaaacagucagugccaaggccucugcccaccuaccucacccccaacaugcuagugguacaaggggccuccuuuuaguuugaaaggcucagugguuaagaacauauauugcucauggaccugaguucagaucccagaaacagcaucaggcaacucauaauuacuuguauccaacucuagcuucagggggucugaugcuuucuucuggauuccuuggauacuacacucacaugugugcauacacauauacaugcauacacacacacacacacucacucacacacucaauuaaaaauaaaucugucuugaaaagauaaacaaugacuguaauuuggaaggcuccacuuuuccaguccucagagagucuucccugacugcagucuggccugaaagggaccccucugccacuccagccguuucuuggccccuuuccaccuacccagcauccagcuuauaguauagcgcuuacugcucacuugcucugccugcuccuguccuaacagcaguuuucugugacaaggguugaaagaaaggauguguggugguuuagagacaacauguuuacuucagcucccaguugcuugcugucuaacaggacagaacaggaaggggaagugcagaauccaagcccagagugacucugucaucccaaaacaaagucagggcaaugggaaucacagagaggggagucuccucugaggacggugcacagguaggcagcuaagacacguacgugggaaugucuaucuaaaccuagaccuccccuaagccccaacccaguucuuaccuuuuggaugaaggaaugucgaacuuuccggucaucccauucuccaggacgaaagcugucacuuccugcucucuccucuucauuauagucauggccuaggaccagaggcagaucacaucaaccaacuggggaccuaggacacauagccuccaucucaaagcaccccugaccucccugacucaaaccaaggcucaggugccucuguccaaaagacacccuuguaacucagacucuuauuaagcuuggguucucuaggcuuccucaguguaaccccagcuuggcucaggugagaaagagcugugcugucagcaggcagcugcugcgggcuguguguccagcccaccuauuuggagacaggcuaguggcaucgccaucuaggaagcagcuggcauuuagggaguggaacuggcuggcagagcaguggccuugggaguggagugccagagaguaagagggaagacuacacaggaaguagguacaggagggcaugggcugugucuacagcaggcuucacaaugcacaguggucaccucagaaugcauguccaaauaagagcuggccauauacucacuggcucuaggacacugaggcuacugcagccaccaacauuccauggaugccucuuggggaacuacuuccaaaaucuacccagaaggagcugcgguacagcucauaggcauaggcagagcaaauguuuaaugaccuugaguucagucucucauaccaaaaacaaacaaacaaacaaacaauauguguguguguguguguguguguguguguguguguguguguguguguguguauguggguggguggguggguguauauaugugugcauauauauaugcaaaauccacccccaggagaagaggcuuacucuagucuaacaucaccuucacuggacaaccaugacauuuuggcuguuggcaggagaugugucagcccuaggauauuaaaaagugcuuaggguuccuaaggaaggaauggugcccacacacaguggcaacagacuuguugagaaacagaaaugguuccuuagggcaaccacuuagaagccauuacuucacccagcugccaucucuggguguaaguucagucuuaaggccucagucuucuuacugaauauauaggccagcaaguggcuggagggaagaccaggagguuaaggggaaggugagacaggaagagaaaaugguaucaaaggggaugguaggaggaagggaauguaaggguuccucagugccaagcucuaccuugucccaccaaccccagccacccuccaugacucaccguaguucaugggcauuggauggacgggaggaaccggcuguggguagccagcaggaugaccguaaccagguugaggguaggcaggguaggcgggauaaccaccuggcaggacagauggcugcccguagccaccaggagguggagagccaggguacaggggguugugguccucauagggagguggggcacugggauuggacauggccacucaagggcugaggggaaaccccagcuucuggguccugcaauaggaaacaagcaaucagucaugaguuccuggcugcccacuccacccuugcuccuuucuaggcuaugucuguagcuuacacaugccauucaccgcccacaggacaccagcccuuggguuuuauaaucucucacagcagccuuuaucuggggccuccccugcccuggccacaggagaguagggguggggauuagucagacgaccagcgucacagcugaggaucagaacaacacaagagacuggcagccugggaacucccuguucgccuuuaagggaaccuugcagugcuguccugacagcagaaccagggaagaagcuggauggcccuagaagcgcuuccuggugagucacagggcuggccagcugggacccuuuagagggcucaacccagcccccacagcagcuggcuggagcagcaggcuugagggccagauacaggguggagccaagcuagaagcugagcaggaaagaggaggaagaaaacaauccugccacugugccagaauggccaggccccagagggaggggcagggcuggcagcagacaggacucuccaguucccaucccgucacggggcauguggcagccugugccuguugcucccuucgcuggucuugccagggaguaaacagugcuccagagcucccuggaagggggucucuggagucuucccagcagcaguggcggggaaggucaaggaaagcaagcagagaagugagggcacaggauggaaugccucugacaggagagcccugcagcuugccgaagcuccaggugccacacugaugcucaggggagcagugaggcccauuuuaguaaaguagcucccacaguccuggagccagcuguuaggagcacacccugagugggucugguguuaugaguccuucaugcuuugcuguacuuucuaggccuccucugccaagcucaucacagccuguggacccauaaugaaauggcaggcacauccagauauggcagagaugaggacagagacaaaccaaggaaauggugucuuuauuucuuucacagaaccaccccuucccaugcacacccugugacagaguuacccccugcccuacaggaaagacuggcagauccaggucagccacaccuucagggccgcugcuggaagcaggagagucccagcuucucuuucagggcaccagugcagcucagagaucagauagaggacaugcacggcuccucucaggacaacgggagugauucacaaggaaaaccagugaggaucgaguaacaggccaggucucugagcaggucacacugaggaaagcuguucuccaucuccccagagcaagaaugugucaagccagagagaagaaagccuuucuagagaggagggguaugagaagugagccgggcagggaagcuugggagucaggcacugcgcagggcagagcuacuggagaagugggacucccagaguggagagugagucuaagaucagccacuggaacugguuuggagagucucgagucuaugaaaggacagaguaaucacaagcaagauaaaagaagcaaguuuuuccugccccagccuuuggagcaaaagccuuguuccccuaaacccuacucuuucccucuccaagccgccuucugaguccacagaaagaacgacauccugguggaugggaagagggcaaagcagguuaccuuugguauagaggugccugacauuccauuauggcuuuuaucucaguaaucuaggucuauaugaaauccuccauggggggagagggggugcuggcugauggcuaaacaguccuaaaaggcacugccaggaaaggcccuguuguuagagucccaacagugcuaccaagccaugaugucccaaugaccuggcccuucacuuucacaggguaugugggaaauggggugguugagugaucucagggcucaaugacagcucuaagagcugacugugacccaggaaacugaccaugcagggcccccucccucuucccaagagaggggcugcagugacucacugucugggguguggcuccagggucuaggguggcucagcugcugacucacaggccuccccccuguccucccugcccggucgugcugggaggaauuugccaguggaccugccugaucccagcauaguucucugaguccuccaccaccugcccuuuugaaccagagaugaugucaugcgucaguguccccaccuggaagauggguucaacaccacuuaacaguaccucccaaggaaccgucaaaauuaagacagaauauacacacugaguggguggagagaugguucagcaguuaagaacacuggcugcucucccauaggaccuggguucaaguccuggcauccacauggcagcucacaacugucuguaacucuaguuccaggggaucugacacccucacacagacauacaggcgggcagaacaccagugcacauaaaauaaaaauaaguuaauuuaaaaagaaaaggaaagagaggaaggaaggucggagcucuuagaacaaugcccagccuaaccagggauacacucuggcuguuuucagcugugaacugacuaacuccuaacuccguaaaguaugacagcaggugaacagugcuauuacagagacaccgaggcuuagcagaaugaagaaagguggccagggacaccucaccaggcuauaacaaagucaaggcuuacccccaaggcuggcugacucuggugucccuuuugagucccuuauuuggauagucuaucuaucccaauuucucagccaucucccauggcuuuggccucaaauccuccaguaauaauagcaggcucacacagaaguggaugccugacgauucagccccuccacagugcaccccagucccauccaccagcacaaggagacucaacaugucagaaucuagacacccacccacuuaagacaagcugauccuaggcuacaauacaauccuggcugucugacccuggugcaggagaguaaaacccuuguuuuguaccagccagccucugccacacucuccacugagccauggcaugggcgauauuugucagaccagagagaacuucaggaacccagaauacccaacauggcuucuaagcaggccucagcuccugccuggccuccaccaaggcuuccaccagggcugaggucugggcuagcacugcccuaggggcaguggucauucauucuccuagccaggcugaggcauggggacaagagaaggaaacgaguaggaagaaggacaaggacagagaagagaccuggagacaccgagguucuuccggguucacccagggcugugagggcuucacagacugcagggguuacagagaacugggaucauuuuccuaagcugagaaggccuuugccccgucccggcacuuccauguuucagccuguaccuuucucagguaaugcauccaugucagaaaaaacccagaaccucucccugacucagucacagcaggacuggguacugggcccacacagcgggauuuguugguggccaagcuuuucaguguagaaucuggggagacugccccacaaaacccuggguugucucaggaggucaacucugucccuggucugccgaggucgaacucuggcucuaacucuccuguggcauaagaaguguuaagauuauggaaucuguagccagaaggcugagcuacugggguuacaagcaagagggugugucuggagggaaggacagaaaagagcagcccgggcagcuugcccuccugaaugccaggagccaaugcccagaccagaauggaaagaagugcucagcaugcgucucaggaagccccaccccacaccaaggucuccaugccuagcuucuucccuccauucuccccaagaaaacaccucccuccccagcacauagccacugggacagagaagugacagaagcagccaggagcccagaaugaacauaguacucuccgguggccuggccucaggauucggaggugaaauagaggggauccaaauacugaggugucaguagaaccaggaagcccuaaagcaccagcccaggacaggcccuccuggccaagaauuuggaacuucugggccagguauuguaccucaugccucuaauucuagcaguggcaggggaaauaaaucucugugaguucaaggccagccuauucuacuacauagcaaguuccaggccagccaggaaaugauaaugagaugcuaucuugggggaggggguguguguuaaggacuuuagaacuuuccuucccagccucgcccaguaucaaaagcucagcaaaagagccacagaugccaggcaaagaacccucuccaguccccucauuauuucuugcucauccugccaaccuguuacuuuccuccuaggcuccaggccacuccccagcuccuaccucuagagugucucucucuguauccacagaaacagagggccaaguccuagagaauauggaggggccccauccagcagcuucuccaucacccuaaucucagagggcagauuugcaucgugagguuguaauaucagagagcccagccgcaugaccagucaggguggccuuggugugcuuauaaagaaagaggggcugggcagugguggcgcaugccuuuaaucccagcacuggggaggcagaggcaggcggauuucugaguucgaggcuagccuggucuacagagugaguuccaggacagccagggcuacacagagaaacccuaucuugaaaaagccauuaaacaaaagaagaagaagaaaagaagagggagggagggagagaaagagaaagagagagagagagagagagagagagagagagagagagagagagaggaagagaggaagagaggaagagaacaugccagguguaguggcucaggccuuuaaucccagugccugggaggcaaaggcaggcagaucucuuagauggaguccagccuagucuacaaagugaguuucuagacagucagagcuacauaagugagacugucucaaaauuaaaagaaagaaaaaaaggaagccauuaucagggcugcugcuauuuuugacacaaaggccugcccugccccguuuguauugucucuggguuaggaggggagacaaguaggagaacaggaguauuaaucagaccaaaguggaaaaucacagggguggggaaggaagagcgccacggaagagugguaagaucaguacuuaguaagcaaccaagguauuucuuaugcucacaaaagaucacaccuucaauaaaaaugcuacauuugagagccaggaauagugggacacaccuauaaugugagcacucaggaggcuaaagcaggauugcuucacguucaaagucagcuugagcuacacagugagcacaaggccagccaaggcuaaggcaacggccuaucuuacaacagucaguugaaauuaucaggaggaugcauggaggcuuuaggauuuaagcauccauggaaggcaguuugcaagcagcagggacagauuugaacuugaugacugauuuugggugcuugucugccagggaggacaccugaagcacccucaccugguuaggggagcacagggcugagggugagaugguaaagaccagcggaguuaagugcacaguggauauggauuccuuuugccaucuuugcccaggacuccaguguaggagcagggaccuaauucuuguccugguguugguacugaccccaguacaugaauugggguaggucacuucccacuuccaggcuccauuuuuacaucuguaagauggguauauucuaggcugaaagaucaaaauccacugcagcccugccaguuugauucuguauaaacaggcuaacaggacaggaagcuucagagcagaaugacauagccaccucauccccaucucacccccacauaccugggaaucuacacacugacuggaugccucuagucgguaggcauacaguaauguguaggacauauacagaggcacauggcauguucuaggcaagaguggccauuaacacucucuccuccuaagauguuuccacucuucacagccugugugaugcugaccugggcaaccuguuuauuacacaaggaccuaacccuaaggaaaaaaacaugcuucuacccagcucuuaaaacccuacacuuccaccagccuguccccucaaaacaggugcaguaaaaccaagcaaaaaaaucucaguggaccagcagauuaaggcacuugcugccaagccugacaaccuaaguuggcucccuagagcccacaugguguaaggagaggaccgacucccuggagcuguccucuggacuuccacaugcaugcagucaccaucacacacaaauaagcaaauauaauuuuuaaaaagaaccacaccugaauggggcauggugauauacaccuguaacccuagcacuagguuagcucaagcaggaagaucacaaguucagggccauaagaaccuguggguguggguaggaggaccagacaugcccucauucucaugccagcugagcaccaggauccccugcagggucugcucccacccuuagguccagcagcuacuggaacuuccaugguaagauuuauagcauagcauggaggaaaucuaggcagcacagaaccaggaaaguagcaucccuaaacaucacccccggggucauagacauguacugaccagucuauguaaggaagucuuaccuuccucccugaccaaugcauuauguccacgacgaguagaggucuguggacccgugcaucuuguuccuaguucuacuucaaaacaaguccuguuuuggccuagacucccaaaaucuuaguuagguuaaggcuagaagauucuaucaaggucagcucuuguucagcauugccaagagaacugaaggcccucugaagauuuguaccucgcuucgacgcuggcuuguugagauacggucucacucugcagcccagguuggcuccaggucugcagccuggccugcaauccuccuuuugccuuucuucugagaaggaugaggugccgugccccaguguuguuacuguuuugugaggcaggcacuugcccuauaacucaggccacuccaccacacacucagucccucagucccggugcuuuuacucugucuuaagggcccauggugagaggucuuggguugggaggugcucugcuauagauggcuucuaucugaggaucccccauucuuaccgaggaagcugagccuaagugccuauuacccuagcccaugagcuucuccaacuacuugccaacuaauauuuuauuaccucuuugaucugcccaguuuuacaugagcagcccugaagucagacaggaaaucaggacccuugaagcaauggucucaccucccuugaaacuauaaagcaagaccagggccccaugacuggagagguaagaacaggcaagugaagaggagagggaguaugguggccuguuuaaggcagacaaagcagcacaaagaagcaccuggcuugcccagccaccacuggccaggccaaagacaccagcuuugaaaccaaagcucaccacugagauaaauauuucagagucucagagaaccagacaccugccagaccuuccaugacagcucuccccacuuauccgguguuuagguugacccucagccccauggguaccaccacccauaggccacaguggagugagugacuggggaaggaugccccggggaacaagaccuggugaagacaguccaggcucugccuuggcagagagccuuccauuccuuccuccuuuucugguucccuccuggcccucccaaaccugcuuucccuuuucccauuucccuguuucuuuuuuuuuuuuuuuuuuuuuuuuauuuuuuauucugaccuaaagaggucaccagggccaggcaagacagcuuucaccuguaauacucccagcacuuaaggaucugaggcaacaaguucaaggcuugacugggcuacugagugaaacugucucaaauaaauaaauaaauaaauaaauaaauaaauaaauaaaccaaccaaccaaccaaccaaccaaccaaccaaccacaguucaucagcuugacuguacuuucugguaggcuucugaauuacagagcaaaggaacaggagcaggccagguuaggaguaggaauggcuucuucuuuagaccuuagguuggcccgcuggcuucucugagcuagggcucccuccucccaccccccaccuuagacagauucucaucaccaguuuuuacgcagccuggugacgccagggcaagcucgaacagccccggguggguuccaagccucuggcuggcucccucccucccucuccccaccagcugaggaccaugaccgccuccauucucacuugcugcacggccacucuggggccccggagugggggacacguccucagacaaacaagccacucagccacugagaggagcacccuacaagaagcgggucagcucgcgggugcgcaccgaaugcgguugcgccacaagcccgggccauauguccugcccgggcgcacauggaaagugaagaccggaacaggcagaacgaaaggacccuagccuggcuccggagcacgaccggagucggcccgcgcgugccagaaaaguucgggcgccugggcgcagcgccgccccaggccacuuccauuccccgccggucucggguccccaccuccaacggccgcagcccccucacuugccugcgcuguuccggaccgugagauccgccugggccucc

SEQ ID NO: 12056 - RNA, 15908 nt, Mus musculus
ggaggcccaggcggaucucacgguccggaacagcgcaggcaagugagggggcugcggccguuggagguggggacccgagaccggcggggaauggaaguggccuggggcggcgcugcgcccaggcgcccgaacuuuucuggcacgcgcgggccgacuccggucgugcuccggagccaggcuaggguccuuucguucugccuguuccggucuucacuuuccaugugcgcccgggcaggacauauggcccgggcuuguggcgcaaccgcauucggugcgcacccgcgagcugacccgcuucuuguagggugcuccucucaguggcugaguggcuuguuugucugaggacgugucccccacuccggggccccagaguggccgugcagcaagugagaauggaggcggucaugguccucagcugguggggagagggagggagggagccagccagaggcuuggaacccacccggggcuguucgagcuugcccuggcgucaccaggcugcguaaaaacuggugaugagaaucugucuaagguggggggugggaggagggagcccuagcucagagaagccagcgggccaaccuaaggucuaaagaagaagccauuccuacuccuaaccuggccugcuccuguuccuuugcucuguaauucagaagccuaccagaaaguacagucaagcugaugaacugugguugguugguugguugguugguugguugguugguuuauuuauuuauuuauuuauuuauuuauuuauuuauuugagacaguuucacucaguagcccagucaagccuugaacuuguugccucagauccuuaagugcugggaguauuacaggugaaagcugucuugccuggcccuggugaccucuuuaggucagaauaaaaaauaaaaaaaaaaaaaaaaaaaaaaaagaaacagggaaaugggaaaagggaaagcagguuugggagggccaggagggaaccagaaaaggaggaaggaauggaaggcucucugccaaggcagagccuggacugucuucaccaggucuuguuccccggggcauccuuccccagucacucacuccacuguggccuauggguggugguacccauggggcugagggucaaccuaaacaccggauaaguggggagagcugucauggaaggucuggcaggugucugguucucugagacucugaaauauuuaucucaguggugagcuuugguuucaaagcuggugucuuuggccuggccagugguggcugggcaagccaggugcuucuuugugcugcuuugucugccuuaaacaggccaccauacucccucuccucuucacuugccuguucuuaccucuccagucauggggcccuggucuugcuuuauaguuucaagggaggugagaccauugcuucaaggguccugauuuccugucugacuucagggcugcucauguaaaacugggcagaucaaagagguaauaaaauauuaguuggcaaguaguuggagaagcucaugggcuaggguaauaggcacuuaggcucagcuuccucgguaagaaugggggauccucagauagaagccaucuauagcagagcaccucccaacccaagaccucucaccaugggcccuuaagacagaguaaaagcaccgggacugagggacugagugugugguggaguggccugaguuauagggcaagugccugccucacaaaacaguaacaacacuggggcacggcaccucauccuucucagaagaaaggcaaaaggaggauugcaggccaggcugcagaccuggagccaaccugggcugcagagugagaccguaucucaacaagccagcgucgaagcgagguacaaaucuucagagggccuucaguucucuuggcaaugcugaacaagagcugaccuugauagaaucuucuagccuuaaccuaacuaagauuuugggagucuaggccaaaacaggacuuguuuugaaguagaacuaggaacaagaugcacggguccacagaccucuacucgucguggacauaaugcauuggucagggaggaagguaagacuuccuuacauagacuggucaguacaugucuaugaccccgggggugauguuuagggaugcuacuuuccugguucugugcugccuagauuuccuccaugcuaugcuauaaaucuuaccauggaaguuccaguagcugcuggaccuaagggugggagcagacccugcaggggauccuggugcucagcuggcaugagaaugagggcaugucugguccuccuacccacacccacagguucuuauggcccugaacuugugaucuuccugcuugagcuaaccuagugcuaggguuacagguguauaucaccaugccccauucaggugugguucuuuuuaaaaauuauauuugcuuauuugugugugauggugacugcaugcauguggaaguccagaggacagcuccagggagucgguccucuccuuacaccaugugggcucuagggagccaacuuagguugucaggcuuggcagcaagugccuuaaucugcugguccacugagauuuuuuugcuugguuuuacugcaccuguuuugaggggacaggcugguggaaguguaggguuuuaagagcuggguagaagcauguuuuuuuccuuaggguuagguccuuguguaauaaacagguugcccaggucagcaucacacaggcugugaagaguggaaacaucuuaggaggagagaguguuaauggccacucuugccuagaacaugccaugugccucuguauauguccuacacauuacuguaugccuaccgacuagaggcauccagucaguguguagauucccagguaugugggggugagauggggaugagguggcuaugucauucugcucugaagcuuccuguccuguuagccuguuuauacagaaucaaacuggcagggcugcaguggauuuugaucuuucagccuagaauauacccaucuuacagauguaaaaauggagccuggaagugggaagugaccuaccccaauucauguacuggggucaguaccaacaccaggacaagaauuaggucccugcuccuacacuggaguccugggcaaagauggcaaaaggaauccauauccacugugcacuuaacuccgcuggucuuuaccaucucacccucagcccugugcuccccuaaccaggugagggugcuucagguguccucccuggcagacaagcacccaaaaucagucaucaaguucaaaucugucccugcugcuugcaaacugccuuccauggaugcuuaaauccuaaagccuccaugcauccuccugauaauuucaacugacuguuguaagauaggccguugccuuagccuuggcuggccuugugcucacuguguagcucaagcugacuuugaacgugaagcaauccugcuuuagccuccugagugcucacauuauaggugugucccacuauuccuggcucucaaauguagcauuuuuauugaaggugugaucuuuugugagcauaagaaauaccuugguugcuuacuaaguacugaucuuaccacucuuccguggcgcucuuccuuccccaccccugugauuuuccacuuuggucugauuaauacuccuguucuccuacuugucuccccuccuaacccagagacaauacaaacggggcagggcaggccuuugugucaaaaauagcagcagcccugauaauggcuuccuuuuuuucuuucuuuuaauuuugagacagucucacuuauguagcucugacugucuagaaacucacuuuguagacuaggcuggacuccaucuaagagaucugccugccuuugccucccaggcacugggauuaaaggccugagccacuacaccuggcauguucucuuccucucuuccucucuuccucucucucucucucucucucucucucucucucucucucucucucuuucucuuucucucccucccucccucuucuuuucuucuucuucuuuuguuuaauggcuuuuucaagauaggguuucucuguguagcccuggcuguccuggaacucacucuguagaccaggcuagccucgaacucagaaauccgccugccucugccuccccagugcugggauuaaaggcaugcgccaccacugcccagccccucuuucuuuauaagcacaccaaggccacccugacuggucaugcggcugggcucucugauauuacaaccucacgaugcaaaucugcccucugagauuagggugauggagaagcugcuggauggggccccuccauauucucuaggacuuggcccucuguuucuguggauacagagagagacacucuagagguaggagcuggggaguggccuggagccuaggaggaaaguaacagguuggcaggaugagcaagaaauaaugaggggacuggagaggguucuuugccuggcaucuguggcucuuuugcugagcuuuugauacugggcgaggcugggaaggaaaguucuaaaguccuuaacacacacccccucccccaagauagcaucucauuaucauuuccuggcuggccuggaacuugcuauguaguagaauaggcuggccuugaacucacagagauuuauuuccccugccacugcuagaauuagaggcaugagguacaauaccuggcccagaaguuccaaauucuuggccaggagggccuguccugggcuggugcuuuagggcuuccugguucuacugacaccucaguauuuggauccccucuauuucaccuccgaauccugaggccaggccaccggagaguacuauguucauucugggcuccuggcugcuucugucacuucucugucccaguggcuaugugcuggggagggagguguuuucuuggggagaauggagggaagaagcuaggcauggagaccuuggugugggguggggcuuccugagacgcaugcugagcacuucuuuccauucuggucugggcauuggcuccuggcauucaggagggcaagcugcccgggcugcucuuuucuguccuucccuccagacacacccucuugcuuguaaccccaguagcucagccuucuggcuacagauuccauaaucuuaacacuucuuaugccacaggagaguuagagccagaguucgaccucggcagaccagggacagaguugaccuccugagacaacccaggguuuuguggggcagucuccccagauucuacacugaaaagcuuggccaccaacaaaucccgcugugugggcccaguacccaguccugcugugacugagucagggagagguucuggguuuuuucugacauggaugcauuaccugagaaagguacaggcugaaacauggaagugccgggacggggcaaaggccuucucagcuuaggaaaaugaucccaguucucuguaaccccugcagucugugaagcccucacagcccugggugaacccggaagaaccucggugucuccaggucucuucucuguccuuguccuucuuccuacucguuuccuucucuuguccccaugccucagccuggcuaggagaaugaaugaccacugccccuagggcagugcuagcccagaccucagcccugguggaagccuugguggaggccaggcaggagcugaggccugcuuagaagccauguuggguauucuggguuccugaaguucucucuggucugacaaauaucgcccaugccauggcucaguggagaguguggcagaggcuggcugguacaaaacaaggguuuuacucuccugcaccagggucagacagccaggauuguauuguagccuaggaucagcuugucuuaagugggugggugucuagauucugacauguugagucuccuugugcugguggaugggacuggggugcacuguggaggggcugaaucgucaggcauccacuucugugugagccugcuauuauuacuggaggauuugaggccaaagccaugggagauggcugagaaauugggauagauagacuauccaaauaagggacucaaaagggacaccagagucagccagccuuggggguaagccuugacuuuguuauagccuggugaggugucccuggccaccuuucuucauucugcuaagccucggugucucuguaauagcacuguucaccugcugucauacuuuacggaguuaggaguuagucaguucacagcugaaaacagccagaguguaucccugguuaggcugggcauuguucuaagagcuccgaccuuccuuccucucuuuccuuuucuuuuuaaauuaacuuauuuuuauuuuaugugcacugguguucugcccgccuguaugucugugugagggugucagauccccuggaacuagaguuacagacaguugugagcugccauguggaugccaggacuugaacccagguccuaugggagagcagccaguguucuuaacugcugaaccaucucuccacccacucaguguguauauucugucuuaauuuugacgguuccuugggagguacuguuaagugguguugaacccaucuuccagguggggacacugacgcaugacaucaucucugguucaaaagggcaggugguggaggacucagagaacuaugcugggaucaggcagguccacuggcaaauuccucccagcacgaccgggcagggaggacaggggggaggccugugagucagcagcugagccacccuagacccuggagccacaccccagacagugagucacugcagccccucucuugggaagagggagggggcccugcauggucaguuuccugggucacagucagcucuuagagcugucauugagcccugagaucacucaaccaccccauuucccacauacccugugaaagugaagggccaggucauugggacaucauggcuugguagcacuguugggacucuaacaacagggccuuuccuggcagugccuuuuaggacuguuuagccaucagccagcacccccucuccccccauggaggauuucauauagaccuagauuacugagauaaaagccauaauggaaugucaggcaccucuauaccaaagguaaccugcuuugcccucuucccauccaccaggaugucguucuuucuguggacucagaaggcggcuuggagagggaaagaguaggguuuaggggaacaaggcuuuugcuccaaaggcuggggcaggaaaaacuugcuucuuuuaucuugcuugugauuacucuguccuuucauagacucgagacucuccaaaccaguuccaguggcugaucuuagacucacucuccacucugggagucccacuucuccaguagcucugcccugcgcagugccugacucccaagcuucccugcccggcucacuucucauaccccuccucucuagaaaggcuuucuucucucuggcuugacacauucuugcucuggggagauggagaacagcuuuccucagugugaccugcucagagaccuggccuguuacucgauccucacugguuuuccuugugaaucacucccguuguccugagaggagccgugcauguccucuaucugaucucugagcugcacuggugcccugaaagagaagcugggacucuccugcuuccagcagcggcccugaagguguggcugaccuggaucugccagucuuuccuguagggcaggggguaacucugucacagggugugcaugggaaggggugguucugugaaagaaauaaagacaccauuuccuugguuugucucuguccucaucucugccauaucuggaugugccugccauuucauuauggguccacaggcugugaugagcuuggcagaggaggccuagaaaguacagcaaagcaugaaggacucauaacaccagacccacucagggugugcuccuaacagcuggcuccaggacugugggagcuacuuuacuaaaaugggccucacugcuccccugagcaucaguguggcaccuggagcuucggcaagcugcagggcucuccugucagaggcauuccauccugugcccucacuucucugcuugcuuuccuugaccuuccccgccacugcugcugggaagacuccagagacccccuuccagggagcucuggagcacuguuuacucccuggcaagaccagcgaagggagcaacaggcacaggcugccacaugccccgugacgggaugggaacuggagaguccugucugcugccagcccugccccucccucuggggccuggccauucuggcacaguggcaggauuguuuucuuccuccucuuuccugcucagcuucuagcuuggcuccacccuguaucuggcccucaagccugcugcuccagccagcugcugugggggcuggguugagcccucuaaagggucccagcuggccagcccugugacucaccaggaagcgcuucuagggccauccagcuucuucccugguucugcugucaggacagcacugcaagguucccuuaaaggcgaacagggaguucccaggcugccagucucuuguguuguucugauccucagcugugacgcuggucgucugacuaauccccaccccuacucuccuguggccagggcaggggaggccccagauaaaggcugcugugagagauuauaaaacccaagggcugguguccugugggcggugaauggcauguguaagcuacagacauagccuagaaaggagcaaggguggagugggcagccaggaacucaugacugauugcuuguuuccuauugcaggacccagaagcugggguuuccccucagcccuugaguggccauguccaaucccagugccccaccucccuaugaggaccacaacccccuguacccuggcucuccaccuccugguggcuacgggcagccaucuguccugccaggugguuaucccgccuacccugccuacccucaaccugguuacggucauccugcuggcuacccacagccgguuccucccguccauccaaugcccaugaacuacggugagucauggaggguggcugggguuggugggacaagguagagcuuggcacugaggaacccuuacauucccuuccuccuaccauccccuuugauaccauuuucucuuccugucucaccuuccccuuaaccuccuggucuucccuccagccacuugcuggccuauauauucaguaagaagacugaggccuuaagacugaacuuacacccagagauggcagcugggugaaguaauggcuucuaagugguugcccuaaggaaccauuucuguuucucaacaagucuguugccacugugugugggcaccauuccuuccuuaggaacccuaagcacuuuuuaauauccuagggcugacacaucuccugccaacagccaaaaugucaugguuguccagugaaggugauguuagacuagaguaagccucuucuccuggggguggauuuugcauauauauaugcacacauauauacacccacccacccacccacauacacacacacacacacacacacacacacacacacacacacacacacacacauauuguuuguuuguuuguuuguuuuugguaugagagacugaacucaaggucauuaaacauuugcucugccuaugccuaugagcuguaccgcagcuccuucuggguagauuuuggaaguaguuccccaagaggcauccauggaauguugguggcugcaguagccucaguguccuagagccagugaguauauggccagcucuuauuuggacaugcauucugaggugaccacugugcauugugaagccugcuguagacacagcccaugcccuccuguaccuacuuccuguguagucuucccucuuacucucuggcacuccacucccaaggccacugcucugccagccaguuccacucccuaaaugccagcugcuuccuagauggcgaugccacuagccugucuccaaauaggugggcuggacacacagcccgcagcagcugccugcugacagcacagcucuuucucaccugagccaagcugggguuacacugaggaagccuagagaacccaagcuuaauaagagucugaguuacaagggugucuuuuggacagaggcaccugagccuugguuugagucagggaggucaggggugcuuugagauggaggcuauguguccuagguccccaguugguugaugugaucugccucugguccuaggccaugacuauaaugaagaggagagagcaggaagugacagcuuucguccuggagaaugggaugaccggaaaguucgacauuccuucauccaaaagguaagaacuggguuggggcuuaggggaggucuagguuuagauagacauucccacguacgugucuuagcugccuaccugugcaccguccucagaggagacuccccucucugugauucccauugcccugacuuuguuuugggaugacagagucacucugggcuuggauucugcacuuccccuuccuguucuguccuguuagacagcaagcaacugggagcugaaguaaacauguugucucuaaaccaccacacauccuuucuuucaacccuugucacagaaaacugcuguuaggacaggagcaggcagagcaagugagcaguaagcgcuauacuauaagcuggaugcuggguagguggaaaggggccaagaaacggcuggaguggcagaggggucccuuucaggccagacugcagucagggaagacucucugaggacuggaaaaguggagccuuccaaauuacagucauuguuuaucuuuucaagacagauuuauuuuuaauugagugugugagugaguguguguguguguguaugcauguauauguguaugcacacaugugaguguaguauccaaggaauccagaagaaagcaucagacccccugaagcuagaguuggauacaaguaauuaugaguugccugaugcuguuucugggaucugaacucagguccaugagcaauauauguucuuaaccacugagccuuucaaacuaaaaggaggccccuuguaccacuagcauguugggggugagguaggugggcagaggccuuggcacugacuguuuuucagggagaggcuuguaugaggcgggagcuauaccccuggcucuuuguucuagguguauugcaucauuucuguccagcugcucaucacuguggccaucauugcaaucuucaccuuugugugagucucuccucucucagccuggguuacugcugggcugccuaugcagggguggcucuccgcuggaggcggacagccacaggaugauucuuuucuugguguccucuguuuuacagggaaccagucggcaaauacgugaggaacaauguggcuguguacuacguguccuagugagugcaggcuguugcugcugggaugggagggggacaggaggcagcugaccggcguuguucagggcagaacuaugcccuaagagagagggcuucccagaaacugugccagucuccaggcaggggcagaagagcaaccugaggaggaguaacaucacggagugcugggacaggacaggagcaggcagacacguggugauggaaugaagguuucauggugcugcccaggcucucuaugaucaccuugcauugccuucaggucauacugggcuaggagcaggccggggggugucguguccuauagcuaugucccaucucuucccucagugcugucuuccuugucaccuaccugacccuugccugcugccagggacccaggugaguguuggagacccugacaagaggagggcagaaagugggacaggggcagagcauuguaagaggaaaaggguuugcacagugaagagagccuacaaggaguauugaugaggaacaagaggccagcuguguuacagaguagugugcaaugcccaccuauaugcuauaucuaucuuacaagauauggaagaaucauauauacaagauauguaccaugucgagcauuuaauaaacaguaaagaaaaucaaaaagggaggaaguagcaagaugucucaacagguaaagguacuuuccaccacgccuaaugaucugaguuugaggcccgagacccacauguuggaaagaaaaugauuccuacaagcuguccucugaucuccacaugugugcuguggugcaugcacacacacacacacacacaccaacguaauaaaaaauuacaaacauaaaagggaaaguuacugcaucucuaucaggaagaacucaggguucagaggcgccaagggauuuugucacagucacacaggagacaugcagguucuaaacaagucccagccaugcuggcuccacaggaaaggacugucucggguuauccuuguguaaauaucugaguacccucccuaaggagaaggcuuauuucucaggacuucugcuaaaggagcugcugagacuugauggcccaggcagguaaccagggucuuccucccucucccucugucuccaggcgccgauucccauggaacaucaucuugcucaccaucuuuguaagucuagaagggaaauggaagaccuacacucggggaaggguuggggacacccuuguccuuggcuggcccugcucuugcuuuccucuguggcuguucuucccaauacaguuacccccagcuccugcagggucauggcgaccaguguugaggcuguucuguguugagccauacucaauagcccaugcuguucuuaaccauuggccucauucucuccugcccgcagacuuuggcuuugggcuuugugacaggcacuauuuccagguauguucagggacaauccuccaugcucuuggggagggaaugucauggaaggcuggauggacuaugggcacaauccugaacauagggagucuauuuauggcuucugccucuggcccaucucaacgcugcuuccuuuuccccaguauguaugaaaccaaagcugucaucauagcaaugaucaucaccgcugugguauccaucucugucaccaucuucugcuuucagacuaaggugaggauggggaaggccuuucucugaccauccugcccucuuacacacacacacacacacacacacacacacacacacacacacacacacacacacaccuuuggguucagcacuugggcaggcauggaaggguucagacccuugcagacuagggacuucccuagccuaaucuccugcucccaugucuguacuugacaaauugcuuccuguaugauauauguccuuagcauaucacugucacugccauguccccaagagcagcacugggacuccccaacuggggcucagggucaguccucugggaugcuaaggauggcaguuaucgacgugccucuuucucccuuucugcuagguggacuucaccucguguacaggccucuucugugugcugggaauagugcugauggugaccggaauugucacaagcauagugcugaucuuuaaauaugugaguguccugccagaaggguaggcagaacccaggcagcagacuuccuguggagcaggggcgggcucuggcucacacaccucuccacuggccagugcaggcaccaacacaauaccauccuuuuggguuaggguauaacagauuucucucaggcaggugauaaaccacagcccccuuaagcccuggauagcaccacuugguuccuacaggaacugauagguuagccgagaccagguuucgugaaggacuaaguugggccuggauggaaguggccccgagauugcugguucugcugcguucuuugcuuccagucagcuaaggcgggaacacaggguuggaggggaaggaucaaaacaagaggugcugccccccccucaccauggcugguccuggucuguguacaggcacuuggcaggaguguugagugggguggcagguugccaacaggcuucucuaaacuguaucuaaggugggcuguaggagccagugagcugcauccaugggcuggcuccugggagcucacugucacaggcucuucaaacagcaugcacugggcuugucuuguuuccaugaccuccaguagacauuccuggacuucacuagcuuucaguugggcugaugggcuaacguggacauugugggacagccuuuggcagauaaauuacaaucucaguuucucccaggaucuagaggcaagauggggauccuggagagguagcuucccuaccugccucucuagcuggagucccagggucagcugggucuccaaggccugcuuuggcuaugcucugcguggcucccuaaugccauacugugcuauuuuacagauuuacuggcuccacauggucuaugcagcucugggggccaucuguuucacccugguaaguuaguucccucuucugggaggggagcugagaugguggcuuuuaggcagcuugggagguggggaggagccauggacaauuguucucuucuuauguagguguuuuacaaguuucugacaucccuguuuugcucuguucacauugcuggcuggguaacagaugugugccagucucugguagacaagugaacugcucaauggcagaaaccauguaaaaagcacacuccucccuagugacugacuccauuagugagcuauauggcuggcccagggcucucaggacaucgugcugacaggaagugaacccuggacacugagcuccuuggcacucaugucugguuucccugcaguuccuggcuuaugacacacagcugguccuggggaaccggaagcacaccaucagcccggaggacuacaucacaggcgcccuacagaucuacacagauauagucuauaucuucacguucgugcuccagcucguaggaaguagagacugagagaaagagagaugucccuuucacuggccugggacucacccuuuccuauugggcugggcccuaggucccgucuccccucaaguaaucugcucaguuuccucuccguccuggggaugggaggaccucuggcuguguucagugagagccaugaugcugggaucacuggcaccucuuagcccuuggugggcuugguaagaacuagucugaagguguaucuccuucccuuuacccaugacgaguaugcaccaaacucuguguguguguguggguggguguguguggguguguguaggggaguagggagccugugaacacaggagcucugaggggaagaggcuccccucccaccucggccacaggguucuaggcuaggagcuggagcugucucccuccuggauccaauaaagccagaugcuuugccuccagcuccagugcucauaggccacuuaugcugucugaacucuuuaggcuuggcaucucuuagcuuuagaagcuagaagagaucugugcccuggggucucucuguuccaaccccaucuuccaguaacauguaucaguuauuuaucuggcuaggggaaaaaagacagugagcagaguuucaucaguaugggggcuaaaccagaauggcauccacccugccuggcgcccagccuggcuaccauccagacccaaagugccuuggggccuucugaggcuuuuaaaaucggaccuagagggaccuccuauuuugcucugacacacagagguggauugugggauucuggguguggcugggaagcagucugggugagagauaaguggggacagggaaagcgccuugggugcccucucuggucugagaaacacugaagucuacucugguacacaaguucaaucuguucuguauucccauugggagauuucagacuaaaacccccucuucaagccagcugcugcuuucuauguaauccaagugccuccuccggcugguaccaggaugggaacagaagccgguuuaucaggugggguagaaaccuuacuagcccaaggacauaguuagagcuauucuguccaguacuugauucugaauauaucacagagggacacaacuagaaauguaauaaaguuuuauguuuggca
